US007469185B2

(12) United States Patent
Mendrick et al.

(10) Patent No.: US 7,469,185 B2
(45) Date of Patent: Dec. 23, 2008

(54) PRIMARY RAT HEPATOCYTE TOXICITY MODELING

(75) Inventors: Donna L. Mendrick, Gaithersburg, MD (US); Mark W. Porter, Gaithersburg, MD (US); Kory R. Johnson, Gaithersburg, MD (US); Brandon Higgs, Gaithersburg, MD (US); Arthur L. Castle, Gaithersburg, MD (US); Michael Orr, Gaithersburg, MD (US); Michael R. Elashoff, Gaithersburg, MD (US)

(73) Assignee: Ocimum Biosolutions, Inc., Indianapolis, IN (US)

( * ) Notice: Subject to any disclaimer, the term of this patent is extended or adjusted under 35 U.S.C. 154(b) by 427 days.

(21) Appl. No.: 10/357,507

(22) Filed: Feb. 4, 2003

(65) Prior Publication Data

US 2007/0015147 A1 Jan. 18, 2007

Related U.S. Application Data

(60) Provisional application No. 60/407,688, filed on Sep. 4, 2002, provisional application No. 60/394,230, filed on Jul. 9, 2002, provisional application No. 60/394,253, filed on Jul. 9, 2002, provisional application No. 60/378,653, filed on May 9, 2002, provisional application No. 60/378,665, filed on May 9, 2002, provisional application No. 60/378,652, filed on May 9, 2002, provisional application No. 60/378,370, filed on May 8, 2002, provisional application No. 60/374,139, filed on Apr. 22, 2002, provisional application No. 60/373,602, filed on Apr. 19, 2002, provisional application No. 60/373,601, filed on Apr. 19, 2002, provisional application No. 60/371,413, filed on Apr. 11, 2002, provisional application No. 60/371,150, filed on Apr. 10, 2002, provisional application No. 60/371,135, filed on Apr. 10, 2002, provisional application No. 60/371,134, filed on Apr. 10, 2002, provisional application No. 60/370,248, filed on Apr. 8, 2002, provisional application No. 60/363,534, filed on Mar. 13, 2002, provisional application No. 60/353,171, filed on Feb. 4, 2002.

(51) Int. Cl.
G06F 19/00 (2006.01)

(52) U.S. Cl. .............................. 702/19; 435/6; 700/30; 702/22; 707/104.1

(58) Field of Classification Search .................. None
See application file for complete search history.

(56) References Cited

U.S. PATENT DOCUMENTS

| 5,811,231 | A | 9/1998 | Farr et al. |
| 6,160,105 | A | 12/2000 | Cunningham et al. |
| 6,203,987 | B1 * | 3/2001 | Friend et al. ............... 435/6 |
| 6,218,122 | B1 | 4/2001 | Friend et al. |
| 6,228,589 | B1 | 5/2001 | Brenner ........................ 435/6 |
| 6,365,352 | B1 | 4/2002 | Yerramilli et al. ............ 435/6 |
| 6,372,431 | B1 | 4/2002 | Cunningham et al. |
| 6,403,778 | B1 | 6/2002 | Cunningham et al. |

FOREIGN PATENT DOCUMENTS

| WO | WO 94/17208 | 8/1994 |
| WO | WO 97/13877 | 4/1997 |
| WO | WO 97/16732 | 5/1997 |
| WO | WO 99/12118 | 3/1999 |
| WO | WO 99/27090 | 6/1999 |
| WO | WO 00/12760 | 3/2000 |
| WO | WO 00/28092 | 5/2000 |
| WO | WO 00/39336 | 7/2000 |
| WO | WO 00/47761 | 8/2000 |
| WO | WO 00/63435 | 10/2000 |
| WO | WO 01/02609 | 1/2001 |
| WO | WO 01/11076 | 2/2001 |
| WO | WO 01/14425 | 3/2001 |
| WO | WO 01/20043 | 3/2001 |
| WO | WO 01/23886 | 4/2001 |
| WO | WO 01/25473 | 4/2001 |
| WO | WO 01/32928 | 5/2001 |
| WO | WO 01/36684 | 5/2001 |
| WO | WO 01/38579 | 5/2001 |
| WO | WO 01/44512 | 6/2001 |
| WO | WO 01/63279 | 8/2001 |
| WO | WO 02/31704 | 4/2002 |
| WO | WO 03/085083 | 10/2003 |
| WO | WO 03/095624 | 11/2003 |
| WO | WO 03/100030 | 12/2003 |

OTHER PUBLICATIONS

Peng, JBC, 271(6):3324-3327 (1996).*
GenBank Acc. No. AA799479 (Apr. 30, 1998).*
GenBank Acc. No. AI177366 (Jan. 20, 1999).*
GenBank Acc. No. M25823 (Apr. 27, 2993).*
GenBank Acc. No. AA891812 (Jan. 25, 1999).*
Adamson & Harman et al., Biochem. Pharmacol., 45: 2289-2294 (1993).
Butterworth et al., Cancer Res., 49: 1075-1084 (1989).
Cai et al., J. Med. Chem., 41: 1970-1979 (1998).
Calabrese et al., J. Amer. College Toxicol., 15: 62-69 (1996).
Castell et al., Cell Biol. Toxicol., 13: 331-338 (1997).
Chan et al., Proc. Natl. Acad. Sci. U.S.A.., 98: 4611-4616 (2001).
Chanda et al., Hepatology, 21: 477-486 (1995).

(Continued)

Primary Examiner—Carolyn L. Smith
(74) Attorney, Agent, or Firm—Cooley Godward Kronish LLP

(57) ABSTRACT

The present invention is based on the elucidation of the global changes in gene expression and the identification of toxicity markers in tissues or cells exposed to a known toxin. The genes may be used as toxicity markers in drug screening and toxicity assays. The invention includes a database of genes characterized by toxin-induced differential expression that is designed for use with microarrays and other solid-phase probes.

10 Claims, No Drawings

OTHER PUBLICATIONS

Chen et al., *J. Biol. Chem..*, 275: 22619-22622 (2000).
Chisholm et al., *Am. J. Physiol.*, 276: G1165-G1173 (1999).
Chou et al, *Proc. Natl. Acad. Sci. U.S.A.*, 98: 8113-8118 (2001).
Christian et al., *Toxicol. Appl. Pharmacol.*, 82: 239-255 (1986).
Clive et al., *Fundam. Appl. Toxicol.*, 3: 587-602 (1983).
Coles et al., *Arch. Biochem. Biophys.*, 264: 253-260 (1988).
Conforti et al., *Agents Actions*, 40: 176-180 (1993).
Coni et al., *Hepatology*, 17: 1109-1116 (1993).
Corell et al., *Acta Pharmacol. Toxicol. (Copenh)*, 45:232-239 (1979).
Corton & Stauber, *Toxicol. Sci.*, 58: 217-219 (2000).
Corton et al., *Cancer Lett.*, 134: 61-71 (1998).
Corton et al., *Cancer Lett.*, 137: 9-15 (1999).
Corton et al., *Mol. Pharmacol.*, 54: 463-473 (1998).
Crosby et al., *Toxicol. Appl. Pharmacol.*, 169: 205-221 (2000).
Cunningham et al., *Ann. N.Y. Acad. Sci.*, 919: 52-67 (2000).
D'Mello et al., *Exp. Toxicol. Pathol.*, 51: 549-553 (1999).
Davis et al., *Cancer Res.*, 60: 2887-2891 (2000).
De Fabiani et al., *J. Biol. Chem.*, 276: 30708-30716 (2001).
Del Giudice et al., *IL Farmaco.*, 51: 693-698 (1996).
Delaney & Timbrell, *Xenobiotica*, 25: 1399-1410 (1995).
Diel et al., *J. Steroid Biochem. Mol. Biol.*, 73: 1-10 (2000).
Dodds & Rivory, *Mol. Pharmacol.*, 56: 1346-1353 (1999).
Dos Santos et al., *J. Am. Soc. Nephrol.*, 8: 361-367 (1997).
Duivenvoorden et al., *Biochem. Biophys. Res. Commun.*, 215: 598-605 (1995).
Dutar et al., *Brain Res.*, 527: 32-40 (1990).
Eadie et al., *Med. Toxicol. Adverse Drug Exp.*, 3: 85-106 (1988).
Eldridge et al., *Carcinogenesis*, 11: 2245-2251 (1990).
Ellis & Isaacs, *Cancer Res.*, 45: 6041-6050 (1985).
Emmison et al., *Biochim. Biophys. Acta*, 1083: 147-152 (1991).
Enomoto et al., *Toxicol. Sci.*, 59: 169-177 (2001).
Falzon et al., *Br. J. Exp. Pathol.*, 66: 527-534 (1985).
Fan & Rozman, *Toxicol. Lett.*, 75: 209-216 (1995).
Fan et al., *J. Biol. Chem..*, 271: 24698-24710 (1996).
Farag & Hassib, *Clin. Sci. (Lond)*, 84: 387-390 (1993).
Farr & Dunn, *Toxicol. Sci.*, 50: 1-9 (1999).
Fernandez-Tome & Sterin-Speziale, *Pharmacology*, 48: 341-348 (1994).
Ficazzola et al., *Carcinogenesis*, 22: 1271-1279 (2001).
Fielden & Zacharewski, *Toxicol. Sci.*, 60: 6-10 (2001).
Fitten et al., *J. Gerontol.*, 42: 681-685 (1987).
Fracasso et al., *Agents Actions*, 22: 3-4 (1987).
Fracasso et al., *Agents Actions*, 31: 313-316 (1990).
Froesch et al., *J. Biol. Chem.*, 274: 6469-6475 (1999).
Frueh et al., *Mol. Pharmacol.*, 51: 363-399 (1997).
Fulgencio et al., *Biochem. Pharmacol.*, 62: 439-446 (2001).
Furr, *Ann. N.Y. Acad. Sci.*, 761: 79-96 (1995).
Furr, *Eur. Urol.*, 29: 83-95 (1996).
Ganem & Jefcoate, *Toxicol. Appl. Pharmacol.*, 150: 68-75 (1998).
Garcia-Allan et al., *J. Biochem. Mol. Toxicol..*, 14: 65-72 (2000).
Gerhold et al., *Physiol. Genomics.*, 5: 161-170 (2001).
Ghatineh et al., *Arch. Toxicol.*, 66: 660-668 (1992).
Goll et al., *Toxicol. Appl. Pharmacol.*, 160: 21-32 (1999).
Gram & Bentsen, *Acta Neurol. Scand. Suppl.*, 97: 81-90 (1983).
Greaves et al., *Cancer Res.*, 53: 3919-3924 (1993).
Green et al., *Toxicol. Appl. Pharmacol.*, 76: 139-149 (1984).
Guardavaccaro et al., *Mol. Cell. Biol.*, 20: 1797-17815 (2000).
Hamada et al., *Hepatology*, 21: 1455-1464 (1995).
Hamada et al., *J. Hepatol.*, 30: 807-818 (1999).
Hargus et al., *Chem. Res. Toxicol.*, 7: 575-582 (1994).
Koga et al., *Fukuoka Igaku Zasshi*, 82: 197-206 (1991).
Kondo et al., *Cancer Res.*, 50: 6222-6228 (1990).
Kongo et al., *Toxicol. Lett.*, 105: 103-110 (1999).
Koopen et al., *Hepatology* 27: 537-545 (1998).
Koopen et al., *J. Lipid. Res.*, 40: 100-108 (1999).
Kossor et al., *Biochem. Pharmacol.*, 46: 2061-2066 (1993).
Kossor et al., *Fundam. Appl. Toxicol.*, 26: 51-62 (1995).
Kossor et al., *Toxicol. Appl. Pharmacol.*, 119: 108-114 (1993).
Kretz-Rommel & Boelsterli, *Toxicol. Appl. Pharmacol.*, 120: 155-161 (1993).
Kwak et al., *Mol. Med.*, 7: 135-145 (2001).
Lake et al., *Toxicology.*, 131: 9-20 (1998).
Lake, *Annu. Rev. Pharmacol. Toxicol.*, 35: 483-507 (1995).
Larsen & Jafcoate, *Arch. Biochem. Biophys.*, 321: 467-476 (1995).
Laskin et al., *Hepatology*, 21: 1045-1050 (1995).
Lauredo et al., *J. Appl. Physiol.*, 85: 2298-2304 (1998).
Lazartigues et al. *Eur. J. Pharmacol.*, 361: 61-71 (1998).
Lee et al., *J. Pharm. Pharmacol.*, 52: 341-355 (2000).
Lewis et al., *Hepatology*, 2: 870-873 (1982).
Liang et al., *Zhonghua Gan Zang Bing Za Zhi*, 7: 72-73 (1999).
Liu et al., *Infect. Immun.*, 66: 5089-5098 (1998).
Liu et al., *Mol. Cell. Biol.*, 20: 6105-6113 (2000).
Liu et al., *Proc. Natl. Acad. Sci. U.S.A..*, 98: 6192-6197 (2001).
Liu et al., *SHOCK*, 14: 361-365 (2000).
Lock et al., *Toxicol. Lett.*, 10: 427-435 (1982).
Lorenzini et al., *Carcinogenesis*, 17: 1323-1329 (1996).
Lovett, *Science*, 289: 536-537 (2000).
Lugovskoy et al., *Cell*, 99: 747-755 (1999).
Lullmann & Lullmann-Rauch, *Toxicol. Appl. Pharmacol.*, 61: 138-146 (1981).
Mann, *Toxicol. Pathol.*, 25: 72-79 (1997).
Manoukian & Carson, *Drug Saf.*, 15: 64-71 (1996).
Martelli et al., *Carcinogenesis*, 16: 1265-1269 (1995).
Masubuchi et al., *J. Pharmacol. Exp. Ther.*, 287: 208-213 (1998).
Masubuchi et al., *J. Pharmacol. Exp. Ther.*, 292: 982-987 (2000).
Mayeux & Sano, *N. Engl. J. Med.*, 341: 1670-1679 (1999).
Mayol et al., *Carcinogenesis.*, 13: 2381-2388 (1992).
Maziasz et al., *Toxicol. Appl. Pharmacol.*, 110: 365-373 (1991).
McKillop et al., *Xenobiotica.*, 28: 465-478 (1998).
Menegazzi et al., *Hepatology*, 25: 585-592 (1997).
Metz & Ritter, *J. Biol. Chem.*, 237: 5607-5614 (1998).
Metz et al., *Mol. Pharmacol.*, 58: 319-327 (2000).
Milam and Byard, *Toxicol. Appl. Pharmacol.*, 79: 342-347 (1985).
Minamide et al., *J. Pharm. Sci.*, 87: 640-646 (1998).
Mitchell & Acosta, *J. Toxicol. Environ. Health*, 7: 83-92 (1981).
Mitchell et al., *Ann. Intern. Med.*, 84: 181-192 (1976).
Monteith et al., *Drug Chem. Toxicol.*, 19: 71-84 (1996).
Moore et al., *Fundam. Appl. Toxicol.*, 3: 560-568 (1983).
Moran et al., *Immunopharmacology*, 12: 245-250 (1986).
Morigasaki et al., *Biochem. Biophys. Res. Commun.*, 273: 261-266 (2000).
Morooka et al., *J. Biol. Chem..*, 270: 30084-30092 (1995).
Motoki et al., *Cancer Lett.*, 135: 145-150 (1999).
Nicholls-Grzemski et al., *Toxicol. Sci.*, 56: 220-228 (2000).
Nims et al., *Carcinogenesis.*, 8: 67-71 (1987).
Nordberg & Svensson, *Drug Saf.*, 19: 465-480 (1998).
Nuwaisyr et al., *Mol. Carcinog.*, 24: 153-159 (1999).
Oberhammer et al., *Hepatology*, 23: 329-337 (1996).
Ohta et al., *Biochem. J.*, 324: 777-782 (1997).
Omiecinski et al., *Mol. Pharmacol.*, 38: 462-470 (1990).
Omogbai et al., *Drug Chem. Toxicol.*, 22: 629-242 (1999).
Ono et al., *Chem. Pharm. Bull.* (Tokyo), 43: 1483-1487 (1995).
Ono et al., *Chem. Pharm. Bull.* (Tokyo), 43: 1492-1496 (1995).
Orsler et al., *Toxicol. Sci.*, 47: 203-210 (1999).
Outinen et al., *Blood*, 94: 959-967 (1999).
Owen et al., *Biochem. J.*, 348 Pt 3: 607-614 (2000).
Park & Pirmohamed, *Toxicol. Lett.*, 120: 281-291 (2001).
Park et al., *Pharmacol. Ther.*, 68: 385-424 (1995).
Passreiter et al., *J. Cell Biol.*, 141:373-383 (1998).
Pennie et al., *Toxicol. Lett.*, 120: 353-358 (2001).
Pennie et al., *Toxicol. Sci.* 54: 277-283 (2000).
Pennie, *Toxicol. Lett.*, 112-113: 473-477 (2000).
Perrone et al., *Toxicol. Appl. Pharmacol.*, 150: 277-286 (1998).
Pischedda et al., *Proc. Natl. Acad. Sci. U.S.A.*, 92: 3511-3515 (1995).
Pohl et al., *Arthritis Rheum.*, 37: 1557 (1994).
Pollenz et al., *Toxicol. Sci.*, 42: 117-128 (1998).
Poyet & Labrie, *Mol. Cell. Endocrinol.*, 42: 283-288 (1985).
Prevot et al. *J. Biol. Chem..*, 276: 9640-9648 (2001).
Pumford et al., *Drug Metab. Rev.*, 29: 39-57 (1997).
Ratanasavanh et al., *Xenobiotica.*, 18: 765-771 (1988).
Ray & Jena, *Arch. Toxicol.*, 73: 594-606 (2000).
Raymond et al., *J. Toxicol. Environ. Health*, 51: 463-476 (1997).
Reilly et al., *Biochem. Biophys. Res. Commun.*, 282: 321-328 (2001).
Reuter et al., *Life Sci.*, 55: 1-8 (1994).

Rice et al., *Carcinogenesis.*, 15: 395-402 (1994).
Rich et al., *Nature*, 407: 777-783 (2000).
Riekkinen et al., *Eur. J. Pharmacol.*, 322: 1-9 (1997).
Riekkinen et al., *Eur. J. Pharmacol.*, 323: 11-19 (1997).
Riendeau et al., *Br. J. Pharmacol.*, 121: 105-117 (1997).
Rininger et al., *Biochem. Pharmacol.*, 52: 1749-1755 (1996).
Rininger et al., *Drug Discov. Today*, 5: 560-568 (2000).
Roberts et al., *Toxicol. Appl. Pharmacol.*, 135: 192-199 (1995).
Rockett & Dix, *Environ. Health Perspect.*, 107: 681-685 (1999).
Rodrigues & Machinist, *Toxicol. Appl. Pharmacol.*, 137: 193-201 (1996).
Ruepp et al., *Toxicol. Sci.*, 65: 135-150 (2002).
Runge-Morris et al., *Drug Metab. Dispos.*, 26: 795-801 (1998).
Sachidanandam et al., *Nature*, 409:928-933 (2001).
Safe, *Annu. Rev. Pharmacol. Toxicol.*, 38: 121-158 (1998).
Scales & Timbrell, *J. Toxicol. Environ. Health*, 10: 941-953 (1982).
Scali et al. *Pharmacol. Res.*, 36: 463-469 (1997).
Schiller et al., *Toxicol. Appl. Pharmacol.*, 81: 356-361 (1985).
Schiodt et al., *N. Engl. J. Med.*, 337: 1112-1117 (1997).
Scholer et al., *Am. J. Med.*, 80: 34-38 (1986).
Schulte-Hermann et al., *Cancer Res.*, 48: 2462-2468 (1988).
Seefeld et al., *Arch. Environ. Contam. Toxicol.*, 9: 317-327 (1980).
Servais & Galand, *Cell Biol. Int Rep.*, 16: 319-328 (1992).
Shannon et al., *J. Pharmacol. Exp. Ther.*, 255: 1071-1077 (1990).
Sidhu et al., *Arch. Biochem. Biophys.*, 301: 103-113 (1993).
Sinz & Woolf, *Biochem. Pharmacol.*, 54: 425-427 (1997).
Skouteris and McMenamin, *Biochem. J.*, 281: 729-733 (1992).
Skrtic et al., *J. Hepatol.*, 27: 903-911 (1997).
Smith, *Trends Pharmacol. Sci.*, 22: 281-285 (2001).
Snape et al., *Neuropharmacology*, 38: 181-193 (1999).
Somani & Dube, *Int. J. Clin. Pharmacol. Ther. Toxicol.*, 27: 367-387 (1989).
Somani, *Biopharm. Drug Dispos.*, 10: 187-203 (1989).
Soni et al., *Regul. Toxicol. Pharmacol.*, 29: 165-174 (1999).
Stachlewitz et al., *J. Pharmacol. Exp. Ther.*, 282: 1591-1599 (1997).
Stohs et al., *Biochem. Biophys. Res. Commun.*, 111:854-859 (1983).
Tanaka et al., *Clin. Exp. Pharmacol. Physiol.*, 20: 543-547 (1993).
Tarloff et al., *Fundam. Appl. Toxicol.*, 30: 13-22 (1996).
Tenniswood et al., *Mol. Cell. Endocrinol.*, 37: 153-158 (1984).
Timbrell et al., *J. Pharmacol. Exp. Ther.*, 213: 364-369 (1980).
Timbrell et al., *J. Toxicol. Environ. Health*, 10: 955-968 (1982).
Timbrell, *Arch. Toxicol. Suppl.*, 2: 1-8 (1979).
Tournier et al., *Lab. Invest.*, 59: 657-665 (1988).
Trauner et al., *N. Engl. J. Med.*, 339: 1217-1227 (1998).
Tucker et al., *Fundam. Appl. Toxicol.*, 3: 579-586 (1983).
Tucker, *Am. J. Med.*, 73: 27-30 (1982).
Tygstrup et al., *J. Hepatol.*, 25: 183-190 (1996).
Tygstrup et al., *J. Hepatol.*, 27: 156-162 (1997).
van Gijssel et al., *Carcinogenesis*, 18: 1027-1033 (1997).
Vance et al., *Epilepsia*, 35: 1016-1022 (1994).
Visen et al., *J. Pharmacol. Toxicol. Methods*, 40: 173-179 (1998).
Wan et al., *Infect. Immun.*, 63: 2435-2442 (1995).
Wang & Dickinson, *Drug Metab. Dispos.*, 26: 98-104 (1998).
Wang et al., *Neuroreport*, 10: 789-793 (1999).
Waring & Ulrich, *Annu. Rev. Pharmacol. Toxicol.*, 40: 335-352 (2000).
Waring et al., *Toxicol. Appl. Pharmacol.*, 175: 28-42 (2001).
Waring et al., *Toxicol. Lett.*, 120: 359-368 (2001).
Waterfield et al., *Biochem. Pharmacol.*, 46: 589-595 (1993).
Weber et al., *Fundam. Appl. Toxicol.*, 21: 523-534 (1993).
Weber et al., *Toxicology*, 66: 133-144 (1991).
Werner et al., *Mutat. Res.*, 395: 179-187 (1997).
White et al., *Biochem. Pharmacol.*, 45: 21-30 (1993).
White et al., *Carcinogenesis*, 13: 2197-2203 (1992).
Wiesenberg-Boettcher et al., *Drugs Exp. Clin. Res.*, 15: 501-509 (1989).
Woodward & Timbrell, *Toxicology.*, 30: 65-74 (1984).
Woolf et al., *Drug Metab. Dispos.*, 21: 874-882 (1993).
Yata et al., *J. Hepatol.*, 30: 419-424 (1999).
Zarif et al., *Inflammation*, 20: 217-227 (1996).
Zhao et al., *J. Biol. Chem..*, 276: 27432-27440 (2001).
Zhou et al., *J. Clin. Invest.*, 108: 1167-1174 (2001).
Abernathy et al., *Proc. Soc. Exp. Biol. Med.*, 199: 54-58 (1992).

Accatino et al., *Hepatology*, 28: 129-140 (1998).
Agha & Gad, *Pharmacol. Res.*, 32: 279-285 (1995).
Akesson & Akesson, *Scand. J. Rheumatol.*, 13: 198-202 (1984).
al Casey et al., *Toxicol. Lett.*, 76: 257-265 (1995).
Ammann et al., *Toxicol. Appl. Pharmacol.*, 149: 217-225 (1998).
Andersson et al., *Toxicology*, 135: 11-20 (1999).
Anton et al., *Cell Biochem. Biophys.*, 32: 27-36 (2000).
Ashby & Lefevre, *J. Appl. Toxicol.*, 20: 35-47 (2000).
Aura et al., *Eur. J. Pharmacol.*, 342: 15-20 (1998).
Ax et al., *Biochem. Pharmacol.*, 59: 293-300 (2000).
Azri-Meehan et al., *Fundam. Appl. Toxicol.*, 22: 172-177 (1994).
Bagetta et al., *Eur. J. Pharmacol.*, 213: 301-304 (1992).
Basnet et al., *Biol. Pharm. Bull.*, 19: 1479-1484 (1996).
Becker et al., *Am. J. Kidney Dis.*, 22: 611-615 (1993).
Becquemont et al., *Fundam. Clin. Pharmacol.*, 10: 156-157 (1996).
Becquemont et al., *Pharmacogenetics.*, 7: 251-253 (1997).
Belles et al., *Vet. Hum. Toxicol.*, 40: 269-272 (1998).
Benoit et al., *Biochem. Pharmacol.*, 53: 423-427 (1997).
Bentley et al., *Food Chem. Toxicol.*, 31: 857-907 (1993).
Bergeron et al., *Xenobiotica*, 28: 303-312 (1998).
Bergstrom et al., *Annu. Rev. Microbiol.*, 49: 607-639 (1995).
Berson et al., *Gastroenterology*, 110: 1878-1890 (1996).
Berthou et al., *Eur. J. Biochem.*, 232: 179-187 (1995).
Bezek et al., *Xenobiotica*, 26: 935-946 (1996).
Bhagwat et al., *Int. J. Oncol.*, 13: 281-288 (1998).
Blackard et al., *J. Clin. Gastroenterol.*, 26: 57-59 (1998).
Blazka et al., *J. Inflamm.*, 47: 138-150 (1995-96).
Blazka et al., *Res. Commun. Mol. Pathol. Pharmacol.*, 92: 259-273 (1996).
Blazka et al., *Toxicol. Appl. Pharmacol.*, 133: 43-52 (1995).
Bombick & Matsumura, *J. Biochem. Toxicol.*, 2: 141-154 (1987).
Booth et al., *Hepatology*, 23: 771-780 (1996).
Bort et al., *Drug Metab. Dispos.*, 24: 969-975 (1996).
Brown et al., *Arch. Biochem. Biophys.*, 342: 134-142 (1997).
Brown et al., *Environ. Health Perspect.*, 104: 634-6440 (1996).
Bruckner et al., *J. Pharmacol. Exp. Ther.*, 300: 273-281 (2002).
Bulera et al., *Toxicol. Appl. Pharmacol.*, 134: 313-320 (1995).
Burcham & Harman, *J. Biol. Chem.*, 266: 5049-5054 (1991).
Burczynski & Penning, *Cancer Res.*, 60: 908-915 (2000).
Bursch et al., *Arch. Toxicol.*, 59: 221-227 (1986).
Buttery et al., *Lab. Invest.*, 71: 755-764 (1994).
Byard & Dougherty, *In Vitro Cell Dev. Biol.*, 21: 489-494 (1985).
Cabre et al., *Clin. Exp. Pharmacol. Physiol.*, 27: 694-699 (2000).
Calabrese et al., *Food Chem. Toxicol.*, 34: 301-311 (1996).
Carfagna et al., *Toxicol. Appl. Pharmacol.*, 137: 173-181 (1996).
Carpenter-Deyo & Reed, *J. Pharmacol. Exp. Ther.*, 258: 747-752 (1991).
Carriero et al., *Pharmacol. Biochem. Behav.*, 58: 851-858 (1997).
Casley et al., *Pharmacogenetics*, 7: 283-293 (1997).
Cattley et al., *Cancer Lett.*, 33: 269-277 (1986).
Cattley et al., *Carcinogenesis*, 9: 1179-1183 (1988).
Chen et al., *Amino Acids*, 18: 319-327 (2000).
Chen et al., *Carcinogenesis*, 21: 1205-1211 (2000).
Chen et al., *J. Environ. Pathol. Toxicol. Oncol.*, 14: 83-99 (1995).
Cheng et al., *Neuroreport.*, 8: 97-101 (1996).
Chico et al., *Exp. Clin. Endocrinol. Diabets.*, 104: 137-144 (1996).
Corton et al., *Biochimie.*, 79: 151-162 (1997).
Cousins et al., *Eur. J. Pharmacol.*, 322: 137-145 (1997).
Cousins et al., *Physiol. Behav.*, 64: 153-158 (1998).
Coyne et al., *Gastroentology*, 75: 76-90 (1978).
Gong et al., *Pharmacogenetics*, 11: 357-368 (2001).
Gracon et al., *Alzheimer Dis. Assoc. Disord.*, 12: 93-101 (1998).
Guarner et al., *Liver*, 5: 35-39 (1985).
Gupta et al., *Carcinogenesis*, 6: 933-936 (1985).
Gupta et al., *Toxicol. Appl. Pharmacol.*, 146: 317-327 (1997).
Ha et al., *Biochem. Mol. Biol. Int.*, 29: 387-393 (1993).
Hakansson, *Acta Neurol. Scand. Suppl.*, 149: 7-9 (1993).
Hallak & Giacobini, *Neuropharmacology*, 26: 521-530 (1987).
Hanson et al., *Lab. Invest.*, 41: 500-503 (1979).
Hartung et al., *Dev. Biol. Stand.*, 86: 85-96 (1996).
Hase et al., *Planta Med.*, 63: 22-26 (1997).
Hassett et al., *Biochem. Pharmacol.*, 55: 1059-1069 (1998).
Hayashi et al., *Biochim. Biophys. Acta.*, 879: 140-148 (1986).

Henderson et al., *Proc. Natl. Acad. Sci. U.S.A.*, 97: 12741-12745 (2000).
Herbst et al., *Am. J. Pathol.*, 150: 1647-1659 (1997).
Hildebrand et al., *Arch. Toxicol.*, 73: 233-245 (1999).
Hill & Roth, *Toxicol. Appl. Pharmacol.*, 148: 169-175 (1998).
Hill et al. *Toxicol. Sci.*, 47: 118-125 (1999).
Hinz et al., *Neurochem. Res.*, 21: 331-337 (1996).
Hoebe et al., *Vet. Q.*, 22: 21-25 (2000).
Hoshi & Fujino, *Chem. Pharm. Bull.*, 38: 3446-3448 (1990).
Hoshi et al., *Jpn. J. Pharmacol.*, 50: 289-293 (1989).
Hussain et al., *Sci. Total. Environ.*, 274: 151-160 (2001).
Ibebunjo et al., *Can. J. Anaesth.*, 44: 1021-1026 (1997).
Iimuro et al., *J. Leukoc. Biol.*, 55: 723-728 (1994).
James & Roberts, *Carcinogenesis*, 17:1623-32 (1996).
Jeon et al., *Toxicol. Appl. Pharmacol.*, 144: 27-35 (1997).
Jinno, et al., *Arch. Toxicol.*, 71: 550-555 (1997).
Jover et al., *Biochem. Pharmacol.*, 46: 1967-1974 (1993).
Jurima-Romet & Huang, *Biochem. Pharmacol.*, 46: 2163-2170 (1993).
Kaminski & Stevens, *Toxicology*, 75: 175-188 (1992).
Karchner et al., *Mar. Environ. Res.*, 50: 51-56 (2000).
Kasper & Mueller, *Carcinogenesis*, 20: 2185-2188 (1999).
Kato & Yamazoe et al., *Toxicol. Lett.*, 64-65: 661-667 (1992).
Kaufmann et al., *Carcinogenesis*9: 779-782 (1988).
Kawai et al., *Infect. Immun.*, 59: 2560-2566 (1991).
Keller et al., *Toxicol. Appl. Pharmacol.*, 104: 259-266 (1990).
Kemper, *Prog. Nucleic Acid Res. Mol. Biol.*, 61: 23-64 (1998).
King & Somani, *Life Sci.*, 41: 2007-2015 (1987).
Kishi et al., *Mol. Aspects Med.*, 18: S71-S77 (1997).
Kitteringham et al., *Hepatology*, 32: 321-333 (2000).
Knight et al., *Toxicol. Sci.*, 62: 212-220 (2001).
Kobayashi et al., *Drug Metab. Dispos.*, 26: 1026-1030 (1998).
Kocaoglu et al., *Arch. Immunol. Ther. Exp. (Warsz)*, 45: 73-77 (1997).
Kocarek et al., *Mol. Pharmacol.*, 54; 474-84 (1998).
Krall et al., *Ann. Pharmacother.*, 33: 441-450 (1999).
Kryger et al., *Structure Fold. Des.*, 7: 297-307 (1999).
Kullak-Ublick & Meier, *Clin. Liver Dis.*, 4: 357-385 (2000).
Kunstle et al., *Immunol. Lett.*, 55: 5-10 (1997).
Kuo et al., *J. Pharmacol. Exp. Ther.*, 282: 1072-1083 (1997).
Lacroix et al., *Gene*, 86: 201-207 (1990).
Lagadic-Gossmann et al., *Cell Biol. Toxicol.*, 14: 361-373 (1998).
Lahiri & Farlow, *J. Mol. Neurosci.*, 7: 41-49 (1996).
Lake et al., *Environ. Health Perspect.*, 67: 283-290 (1986).
Lamb et al., *Toxicol. Appl. Pharmacol.*, 101: 106-113 (1989).
Lang et al., *Alcohol Clin. Exp. Res.*, 22: 823-829 (1998).
Larrauri et al., *Mol. Toxicol.*, 1: 301-311 (1987-1988).
Laurent & Fraser, *FASEB J.*, 6: 2397-2404 (1992).
Lees et al., *Lipids*, 30: 221-226 (1995).
Lemberger et al., *J. Biol. Chem.*, 271: 1764-1769 (1996).
Lèullmann-Rauch & Scheid, *Virchows Arch. B Cell Pathol.*, 19: 255-268 (1975).
Li et al., *Biochem. Biophys. Res. Commun.*, 229: 982-999 (1996).
Li et al., *Zhonghua Gan Zang Bing Za Zhi*, 9: 103-104 (2001).
Lin et al., *Chem. Res. Toxicol.*, 9: 1183-1193 (1996).
Liu et al., *Biol. Pharm. Bull.*, 21: 44-49 (1998).
Liu et al., *Cancer Res.*, 52: 4139-4143 (1992).
Lomri et al., *Chem. Res. Toxicol.*, 6: 800-807 (1993).
Lupo et al., *Toxicology*., 44: 229-239 (1987).
M'Harzi et al., *Pharmacol. Biochem. Behav.*, 56: 663-668 (1997).
Mahnke et al., *Arch. Biochem. Biophys.*, 337: 62-68 (1997).
Mancy et al., *Biochemistry*, 38: 14264-14270 (1999).
Marsman et al., *Toxicol. Appl. Pharmacol.*, 122: 1-6 (1993).
Martelli et al., *J. Pharmacol. Exp. Ther.*, 273: 113-120 (1995).
Martelli et al., *Mutagenesis*, 14: 463-472 (1999).
Matsuda et al., *Bioorg. Med. Chem. Lett.*, 8: 2191-2196 (1998).
Matsuo et al., *Acta Med. Okayama*, 46: 345-354 (1992).
Mayorga et al., *Pharmacol. Biochem. Behav.*, 56: 273-279 (1997).
McGirr et al., *Xenobiotica*, 20: 933-943 (1990).
McMartin et al., *Res. Commun. Chem. Pathol. Pharmacol.*, 31: 99-110 (1981).
Mejdoubi et al., *Biochem. Biophys. Res. Commun.*, 254: 93-99 (1999).
Meyers et al., *J. Pharmacol. Exp. Ther.*, 214: 87-93 (1980).

Migliari et al., *Arch. Ital. Urol. Androl.*, 71: 293-302 (1999).
Miller et al., *Toxicol. Sci.*, 48: 30-37 (1999).
Mino et al., *J. Histochem. Cytochem.*, 46: 1151-1160 (1998).
Mizutani & Miyamoto, *Toxicol. Lett.*, 105: 25-30 (1999).
Mohammed et al., *J. Neural. Transm. Park. Dis. Dement. Sect.*, 2: 285-294 (1990).
Monteith et al., *Arch. Toxicol.*, 72: 147-156 (1998).
Mus'ilkov'a & Tucek, *Neurosci. Lett.*, 125: 113-136 (1991).
Nabeshima et al., *Jpn. J. Pharmacol.*, 57: 311-319 (1991).
Nakamura & Lou, *J. Biol. Chem.*, 270: 7347-7353 (1995).
Neghab & Stacey, *Chem. Biol. Interact.*, 99: 179-192 (1996).
Nochi et al., *Biol. Pharm. Bull.*, 18: 1145-1147 (1995).
Nussler et al., *ALTEX*, 18: 91-101 (2001).
O'Hara et al., *Fundam. Appl. Toxicol.*, 13: 605-615 (1989).
O'Hara et al., *J. Appl. Toxicol.*, 11: 147-154 (1991).
Ohuchi et al., *Am. J. Physiol.*, 268 (6 Pt 1) G997-G1003 (1995).
Olivier & Krisans, *Biochim. Biophys. Acta*, 1529: 89-102 (2000).
Olsen et al., *Chem. Biol. Interact.*, 107: 93-108 (1997).
Olson et al., *Fundam. Appl. Toxicol.*, 22: 631-640 (1994).
Ono et al., *Biol. Pharm. Bull.*, 18: 1779-1783 (1995).
Padgham et al., *Biochem. Biophys. Res. Commun.*, 15: 599-605 (1993).
Panduro et al., *Nephron*, 65: 100-107 (1993).
Paoletti et al., *Exp. Neurol.*, 149: 349-355 (1998).
Paolini et al., *Chem. Biol. Interact.*, 95: 127-139 (1995).
Parte et al., *J. Androl.*, 21: 525-533 (2000).
Parzefall et al., *Carcinogenesis*, 22: 519-523 (2001).
Penzes et al., *Gene*, 191: 167-172 (1997).
Peruzzi et al., *Neuroreport.*, 8: 103-108 (1996).
Petrulis & Bunce, *J. Biochem. Mol. Toxicol.*, 14: 73-81 (2000).
Phillips et al., *Carcinogenesis*, 17: 89-94 (1996).
Plant et al., *Carcinogenesis*, 19: 925-931 (1998).
Plymale & de la Iglesia, *J. Appl. Toxicol.*, 19: 31-38 (1999).
Porubek et al., *Drug Metab. Dispos.*, 17: 123-130 (1993).
Porubek et al., *Mol. Pharmacol.*, 31: 647-653 (1987).
Preece et al., *Arch. Toxicol.*, 64: 49-53 (1990).
Puri et al., *Mutagenesis*, 6: 471-478 (1991).
Qi et al., *Cell. Biochem. Biophys.*, 32: 187-204 (2000).
Rabe et al., *Drug Saf.*, 14: 25-38 (1996).
Riekkinen et al., *Eur. J. Pharmacol.*, 366: 13-18 (1999).
Roberts et al., *Toxicol. Lett.*, 112-113: 49-57 (2000).
Roberts et al., *Toxicol. Lett.*, 50: 283-288 (1990).
Robertson et al., *Arch. Toxicol.*, 72: 362-371 (1998).
Rodi et al., *Toxicol. Pathol.*, 27: 107-110 (1999).
Roskams et al., *Hepatology*, 24: 524-532 (1996).
Roskams et al., *J. Pathol.*, 185: 290-297 (1998).
Roy, *J. Endocrinol.*, 70: 189-195 (1976).
Runge-Morris et al., *Drug Metab. Dispos.*, 24: 734-737 (1996).
Runge-Morris, *Chem. Biol. Interact.*, 3: 15-27 (1998).
Rusyn et al., *Carcinogenesis*, 20: 2095-2100 (1999).
Sallustio & Holbrook, *Drug Metab. Dispos.*, 29: 1535-1538 (2001).
Scassa et al., *Exp. Cell. Res.*, 244: 460-469 (1998).
Schiaffonati & Tiberio, *Lever*, 17: 183-191 (1997).
Schrenk et al., *Arch. Toxicol.*, 65: 114-118 (1991).
Seitz et al., *Chem. Res. Toxicol.*, 11: 513-519 (1998).
Seitz et al., *Hepatology*, 20: 487-493 (1994).
Sendo et al., *Chem. Pharm. Bull.* (Tokyo), 32: 795-796 (1984).
Sèurmen & Eryèurek, *Toxicology*, 75: 63-69 (1992).
Severson et al., *Can. J. Physiol. Pharmacol.*, 62: 244-247 (1984).
Shackleton et al., *Toxicol. Appl. Pharmacol.*, 130: 294-303 (1995).
Shear et al., *Skin Pharmacol.*, 8: 279-291 (1995).
Shervington, *Biochem. Mol. Biol. Int.*, 45: 303-313 (1998).
Sheweita et al., *Toxicology*, 28: 217-224 (2001).
Shiota et al., *Res. Commun. Mol. Pathol. Pharmacol.*, 94: 141-146 (1996).
Shirley et al., *Drug Metab. Dispos.*, 21: 580-586 (1993).
Shultz et al., *Toxicol. Appl. Pharmacol.*, 154: 84-96 (1999).
Sidhu & Omiecinski, *J. Biochem. Mol. Toxicol.*, 13: 1-9 (1999).
Sidhu & Omiecinski, *J. Biol. Chem.*, 273: 4769-4775 (1998).
Smith et al., *J. Neurosci. Res.*, 66: 236-241 (2001).
Smith et al., *J. Pharmacol. Exp. Ther.*, 280: 710-720 (1997).
Styles et al., *Carcinogenesis*, 18: 303-313 (1997).
Sundstrom et al., *Biochem. Pharmacol.*, 37: 1003-1008 (1988).

Takeuchi et al., *Neuropediatrics*, 19: 158-161 (1988).
Tamura et al., *Toxicology*, 63: 199-213 (1996).
Tanaka et al., *J. Physiol. Pharmacol.*, 50: 405-417 (1999).
Tang et al., *Drug Metab. Dispos.*, 27: 365-372 (1999).
Tansey & Shechter, *Prog. Nucleic Acid Res. Mol. Biol.*, 75: 157-195 (2001).
Tarbet et al., *J. Biol. Chem.*, 266: 16667-16673 (1991).
Tee et al., *Toxicol. Appl. Pharmacol.*, 83: 294-314 (1986).
Theilig et al., *J. Am. Soc. Nephrol.*, 12: 2209-2220 (2001).
Thomas et al., *Oncogene*, 19: 5259-5269 (2000).
Timbrell & Waterfield, *Adv. Exp. Med. Biol.*, 403: 125-134 (1996).
Tithof et al., *Environ. Health Perspect.*, 104:52-58 (1996).
Titorenko & Rachubinski, *Nat. Rev. Mol. Cell. Biol.*, 2: 357-68 (2001).
Tobin et al., *Mol. Endocrinol.*, 14: 741-752 (2000).
Tsokos-Kuhn, *Arch. Biochem. Biophys.*, 265: 415-424 (1988).
Turnbull et al., *Biochem. Pharmacol.*, 32: 1887-1892 (1983).
Uhl et al., *Mutat. Res.*, 468: 213-225 (2000).
Vaananen et al., *Inflammation*, 16: 227-240 (1992).
Varone & Canepa, *Arch. Biochem. Biophys.*, 341: 259-266 (1997).
Villalobos et al., *J. Med. Chem.*, 38: 2802-2808 (1995).
Vinggaard et al., *Toxicol. Appl. Pharmacol.*, 55: 150-160 (1999).
Vonen and Morland, *Arch. Toxicol.*, 56: 33-37 (1984).
Wagstaff & McTavish, *Drugs Aging*, 4: 51-540 (1994).
Wang & Tang, *Eur. J. Pharmacol.*, 349: 137-142 (1998).
Wang et al., *Arch. Toxicol.*, 71: 638-645 (1997).
Watanabe et al., *Biochem. Pharmacol.*, 60: 285-291 (2000).
Watanabe et al., *Free Radic. Biol. Med.*, 30: 1019-1028 (2001).
Weber et al., *Chemoshpere*, 30: 2635-2641 (1998).
Weber et al., *Chemoshpere*, 30: 629-639 (1995).
Williams et al., *Biochem. Pharmacol.*, 49: 209-17 (1995).
Williams et al., *Drug Chem. Toxicol.*, 21: 449-476 (1998).
Wong et al., *Toxicol. Appl. Pharmacol.*, 153: 109-118 (1998).
Woodcroft & Novak, *Drug Metab. Dispos.*, 26: 372-378 (1998).
Wormser & Calp, *Toxicology.*, 53: 323-329 (1988).
Wroblewski & Olson, *Drug Metab. Dispos.*, 16: 43-51 (1988).
Xiong et al., *Life Sci.*, 65: 421-430 (1999).
Yamada et al., *Life Sci.*, 61: 171-179 (1997).
Yamamura et al., *Drug Metab. Dispos.*, 27: 724-730 (1999).
Yasuhara et al, *Toxicol. Appl. Pharmacol.*, 79: 453-460 (1985).
Yoshida & Suzuki, *Eur. J. Pharmacol.*, 250: 117-124 (1993).
Yoshida et al., *Eur. J. Pharmacol.*, 214: 247-252 (1992).
Zeiger et al., *Mutat. Res.*, 393: 189-197 (1997).
Zhu et al., *Neurosci. Lett.*, 95: 252-256 (1988).
Schilter, et al, *J Pharmacol Exp Ther* 294(3):916-22 (Sep. 2000). Abstract only.
Bissig et al., *J Biol Chem* 269(4):3017-3021, 1994.
GenBank Accession No. L23413, Bissig et al., "*Rattus norvegicus* sulfate anion transporter (sat-1) mRNA," Apr. 12, 1994.
Raburn et al., *Endocrinology* 136(12):5769-5777, 1995.
GenBank Accession No. L26268, Raburn et al., "*Rattus norvegicus* anti-proliferative factor (BTG1) mRNA," Jan. 26. 1996.
Irizarry et al. (2003), "Summaries of Affymetrix GeneChip probe level data," *Nucl Acids Res* 31(4):e15, 8 pp.
Nguyen et al. (2002), "Tumor classification by partial least squares using microarray gene expression data," *Bioinformatics* 18(1):39-50.
Hamadeh et al. (2002) "Prediction of Compound Signature Using High Density Gene Expression Profiling" *Toxicol. Sci.* 67:232-240.
MacGregor et al. (2001) "In Vitro Human Models in Risk Assessment: Report of a Consensus-Building Workshop" *Toxicol. Sci.* 59: 17-36.
Salter & Nilsson (2003) "Informatics and multivariate analysis of toxicogenomics data" *Drug. Discov. & Dev.* 6(1): 117-122.
Steiner et al. (2004) "Discriminating Different Classes of Toxicants by Transcript Profiling" *Environ. Health Perspect*. 112: 1236-1248.
Sutter et al. (2002) "Multiple Comparisons Model-based Clustering and Ternary Pattern Tree Numerical Display of Gene Responses to Treatment: Procedure and application to the preclinical evaluation of chemopreventative agents" *Mol. Cancer Ther*. 1:1283-1292.
Cadet et al. (2002) "Distinct Gene Expression Signatures in the Striata of Wild-Type and Heterozygous c-fos Knockout Mice Following Methamphetamine Administration: Evidence From cDNA Array Analyses" *Synapset*. 44: 211-2268.

He et al. (2001) "Histone deacetylase inhibitors induce remission in transgenic models of therapy-resistant acute promyelocytic leukemia" *J. Clin. Inves.t.* 108: 1321-1330.
Tao et al. (2003) "Profiling of differentially expressed apoptosis-related genes by cDNA arrays in human cord blood $CD34^+$ cells treated with etoposide" *Experimental Hermatology* 31: 251-2606.
Wilson et al. (1999) "Exploring drug-induced alterations in gene expression in *Mycobacterium tuberculosis* by microarray hybridization" *PNAS*. 96: 12833-12838.
PCT International Search Report, 2005.
Afshari et al., *Cancer Res.*, 59: 4759-4760 (1999).
Ahotupa et al., *Carcinogenesis.*, 15: 863-868 (1994).
Al-Bayati & Stohs, *Arch. Environ. Contam. Toxicol.*, 20: 361-365 (1991).
Allan et al., *J. Biol. Chem..*, 276: 27272-27280 (2001).
Ameisen, *Nature*, 395: 117-119 (1998).
Andersen & Barton, *Environ. Health Perspect.*, 106: 349-355 (1998).
Anderson et al., *Mol. Carcinog.*, 26: 226-238 (1999).
Anderson et al., *Toxicol. Appl. Pharmacol.*, 137: 75-89 (1996).
Arano et al., *Arzneimittelforschung*, 46: 398-400 (1996).
Atchison et al., *Digestive Dis. Sci.*, 45: 614-620 (2000).
Bagetta et al., *Biochem. Biophys. Res. Commun.*, 197: 1132-1139 (1993).
Bajgar et al., *Neurochem. Int.*, 24: 555-558 (1994).
Baker et al., *Chem. Res. Toxicol.*, 14: 1218-1231 (2001).
Barner & Gray, *Ann. Pharmacother.*, 32: 70-77 (1998).
Bartosiewicz et al., *J. Pharmacol. Exp. Ther.*, 297: 895-905 (2001).
Beck et al, *Arch. Toxicol.*, 64: 210-217 (1990).
Becker et al., *Alzheimer Dis. Assoc. Disord.*, 10: 124-131 (1996).
Bedard et al., *Antimicrob. Agents Chemother.*, 43: 557-567 (1999).
Bedossa et al., *Hepatology*, 19: 1262-1271 (1994).
Beierschmitt et al., *Toxicol. Sci.*, 63: 15-21 (2001).
Belury et al., *Toxicol. Appl. Pharmacol.*, 151: 254-261 (1998).
Berndt et al., *Proc. Natl. Acad. Sci. U.S.A..*, 95: 12556-12561 (1998).
Birge et al., *Toxicol. Appl. Pharmacol.*, 105: 472-482 (1990).
Boelsterli et al., *Cell Biol. Toxicol.*, 3: 231-250 (1987).
Bort et al., *J. Pharmacol. Exp. Ther.*, 288: 65-72 (1999).
Bosio and Borlak, *Innovations in Pharmaceutical Technology*, 65-75, (2001).
Bouchard et al., *Liver*, 13: 193-202 (1993).
Bruck et al., *Dig. Dis. Sci.*, 44: 1228-1235 (1999).
Burchiel et al., *Toxicol. Sci.*, 59: 193-195 (2001).
Burczynski et al., *Toxicol. Sci.*, 58: 399-415 (2000).
Bursch et al., *Arch. Toxicol.*, 69: 253-258 (1995).
Buttar et al., *Toxicology.*, 6: 9-20 (1976).
Hargus et al., *Chem. Res. Toxicol.*, 8: 993-996 (1995).
Harries et al., *Toxicol. In Vitro*, 15: 399-405 (2001).
Hartung & Wendel, *Biochem. Pharmacol.*, 42: 1129-1135 (1991).
He et al., *J. Biol. Chem..*, 276: 20858-20865 (2001).
Hellriegel et al., *Biochem. Pharmacol.*, 52: 1561-1568 (1996).
Hessel et al., *Braz. J. Med. Biol. Res.*, 29: 793-796 (1996).
Hillstrom et al., *Proc. Soc. Exp. Biol. Med.*, 200: 122-126, (1992).
Hissink et al., *Chem. Res. Toxicol.*, 9: 1249-1256 (1996).
Hogue, *Chemical and Engineering News*, 79: 33-34 (2001).
Hunter et al., *Br. J. Pharmacol.*, 98: 79-86 (1989).
Inohara et al., *EMBO J.*, 17: 2526-2533 (1998).
Iredale et al., *J. Clin. Invest.*, 102: 538-549 (1998).
Iswaran et al., *J. Toxicol. Sci.*, 25: 75-88 (1997).
Itoh et al., *Behav. Brain Res.*, 83: 165-167 (1997).
Itoh et al., *Eur. J. Pharmacol.*, 322: 11-19 (1997).
Izumi et al., *J. Biol. Chem.*, 272: 7381-7389 (1997).
Jean et al., *Toxicol. Lett.*, 95: 155-163 (1998).
Jenner & Timbrell, *Arch. Toxicol.*, 68: 349-357 (1994).
Johnston & Kroening, *Pharmacol. Toxicol.*, 83: 231-239 (1998).
Jover et al., *Toxic. in Vitro.*, 6: 47-52 (1992).
Kanaji et al., *J. Cell Biol.*, 151: 277-288 (2000).
Kannan et al., *Oncogene.*, 20: 2225-2234 (2001).
Karam & Ghanayem, *Carcinogenesis*, 18: 2077-2083 (1997).
Kasper & Mueller, *Carcinogenesis*, 17: 2271-2274 (1996).
Kesterson et al., *Hepatology*, 4: 1143-1152 (1984).
Kim & Ziegler, *Drug Metab. Dispos.*, 28: 1003-1006 (2000).
Kim et al., *Drug Metab. Dispos.*, 26: 66-72 (1998).
Kim et al., *Toxicol. Appl. Pharmacol.*, 102: 34-39 (1990).

Kinbara et al., *Scand. J. Gastroenterol.*, 32: 947-952 (1997).
Kingsley et al., *Epilepsia*, 21: 699-704 (1980).
Kingsley et al., *J. Clin. Pharmacol.*, 23: 178-185 (1983).
Knapp et al., *Am. J. Vet. Res.*, 56: 801-805 (1995).
Crismon, *Ann. Pharmacother.*, 28: 744-751 (1994).
Cuevas et al., *Clin. Exp. Pharmacol. Physiol.*, 28: 637-642 (2001).
Darbre & King, *J. Steriod Biochem.*, 36: 385-390 (1990).
Davila et al., *Toxicology.*, 57: 267-286 (1989).
Davis et al., *Biochemistry*, 25: 1632-1636 (1986).
Davydov, *Trends Biochem. Sci.*, 26: 155-1560 (2001).
De Ferrari et al., *J. Neurosci. Res.*, 52: 435-444 (1998).
Delaney & Segel, *South. Med. J.*, 78: 1390-1392 (1985).
DeLeve et al., *Biochem. Pharmacol.*, 53: 1339-1345 (1997).
DeNoble et al., *Pharmacol. Biochem. Behav.*, 36: 957-961 (1990).
Dilworth et al., *Toxicol.* In Vitro, 4: 169-176 (2000).
Dirven et al., *Biochem. Pharmacol.*, 43: 261-299 (1992).
Eri & Tveter, *Eur. Urol.*, 26: 219-226 (1994).
Farghali et al., *Int. J. Immunopharmacol.*, 19: 599-604 (1997).
Farghali et al., *Methods Find. Exp. Clin. Pharmacol.*, 6: 449-454 (1984).
Fariss et al., *Hepatology*, 20: 240-246 (1994).
Fernandez-Salguero & Gonzalez, *Pharmacogenetics*, 5: S123-128, (1995).
Forestier et al., *Biochem. Biophys. Res. Commun.*, 225: 377-383 (1996).
Friedman et al., *Dig. Dis. Sci.*, 44: 1362-1363 (1999).
Fritz & Kaina, *Biochem. Biophys. Res. Commun.*, 268: 784-789 (2000).
Fujiki, *FEBS Lett.*, 476: 42-46 (2000).
Galisteo et al., *J. Pharmacol. Exp. Ther.*, 294: 160-167 (2000).
Gall et al., *J. Steroid Biochem. Mol. Biol.*, 70: 101-108 (1999).
Galli & Mori, *Arch. Toxicol.*, 65: 330-334 (1991).
Garcia-Allan et al., *Arch. Toxicol.*, 71: 409-415 (1997).
Gebhardt et al., *Cell. Biol. Toxicol.*, 12: 57-68 (1996).
Geiger et al., *Agents Actions*, 38: Spec No. C69-72 (1993).
Ghatineh & Timbrell, *Biochem. Soc. Trans.*, 18: 1217-1218 (1990).
Giacobini et al., *Neuropharmacology*, 35: 205-211 (1996).
Giacobini, *Neurochem. Int.*, 32: 413-419 (1998).
Gil et al., *Biochim. Biophys. Acta.*, 1272: 140-146 (1995).
Gomez-Lechon et al., *Altern. Lab. Anim.*, 29: 225-231 (2001).
Cadet et al. (2002) "Distinct Gene Expression Signatures in the Striata of Wild-Type and Heterozygous c-fos Knockout Mice Following Methamphetamine Administration: Evidence From cDNA Array Analyses" *Synapset.* 44: 211-2268.
He et al. (2001) "Histone deacetylase inhibitors induce remission in transgenic models of therapy-resistant acute promyelocytic leukemia" *J Clin. Inves.t.*108: 1321-1330.
Tao et al. (2003) "Profiling of differentially expressed apoptosis-related genes by cDNA arrays in human cord blood $CD34^+$ cells treated with etoposide" *Experimental Hermatology* 31: 251-2606.
Wilson et al. (1999) "Exploring drug-induced alterations in gene expression in *Mycobacterium tuberculosis* by microarray hybridization" *PNAS.* 96: 12833-12838.
PCT International Search Report.
Bosio and Borlak, *Innovations in Pharmaceutical Technology*, 65-75.
Hillstrom et al., *Proc. Soc. Exp. Biol. Med.*, 200: 122-126.
Fernandez-Salguero & Gonzalez, *Pharmacogenetics*, 5: S123-128.

* cited by examiner

PRIMARY RAT HEPATOCYTE TOXICITY MODELING

RELATED APPLICATIONS

This application claims priority under 35 U.S.C. §119(e) to U.S. Provisional Application 60/353,171, filed Feb. 4, 2002; 60/363,534, filed Mar. 13, 2002; 60/371,135, filed Apr. 10, 2002; 60/371,134, filed Apr. 10, 2002; 60/370,248, filed Apr. 8, 2002; 60/371,150, filed Apr. 10, 2002; 60/371,413, filed Apr. 11, 2002; 60/373,601, filed Apr. 19, 2002; 60/374,139, filed Apr. 22, 2002; 60/394,253, filed Jul. 9, 2002; 60/378,652, filed May 9, 2002; 60/373,602, filed Apr. 19, 2002; 60/378,653, filed May 9, 2002; 60/378,665, filed May 9, 2002; 60/378,370, filed May 8, 2002; 60/394,230, filed Jul. 9, 2002; and 60/407,688, filed Sep. 4, 2002, all of which are herein incorporated by reference in their entirety.

This application is also related to pending U.S. applications Ser. No. 09/917,800, filed Jul. 31, 2001, Ser. No. 10/060,087, filed Jan. 31, 2002, and PCT/US03/03194, entitled "Molecular Hepatotoxicology Modeling," filed Jan. 31, 2003, as well as to PCT Application PCT/US01/23872, filed Jul. 31, 2001, all of which are herein incorporated by reference in their entirety.

SEQUENCE LISTING SUBMISSION ON COMPACT DISC

The Sequence Listing submitted concurrently herewith on compact disc under 37 C.F.R. §§1.821(c) and 1.821(e) is herein incorporated by reference in its entirety. Three copies of the Sequence Listing, one on each of three compact discs are provided. Copy 1 and Copy 2 are identical. Copies 1 and 2 are also identical to the CRF. Each electronic copy of the Sequence Listing was created on Feb. 3, 2003 with a file size of 6321 KB. The file names are as follows: Copy 1—g15113wo.txt; Copy 2—g15113wo.txt; CRF—g15113wo.txt.

BACKGROUND OF THE INVENTION

The need for methods of assessing the toxic impact of a compound, pharmaceutical agent or environmental pollutant on a cell or living organism has led to the development of procedures which utilize living organisms as biological monitors. The simplest and most convenient of these systems utilize unicellular microorganisms such as yeast and bacteria, since they are most easily maintained and manipulated. Unicellular screening systems also often use easily detectable changes in phenotype to monitor the effect of test compounds on the cell. Unicellular organisms, however, are inadequate models for estimating the potential effects of many compounds on complex multicellular animals, as they do not have the ability to carry out biotransformations to the extent or at levels found in higher organisms.

The biotransformation of chemical compounds by multicellular organisms is a significant factor in determining the overall toxicity of agents to which they are exposed. Accordingly, multicellular screening systems or screening systems using isolated eukaryotic cells may be preferred or required to detect the toxic effects of compounds. The use of multicellular organisms as toxicology screening tools has been significantly hampered, however, by the lack of convenient screening mechanisms or endpoints, such as those available in yeast or bacterial systems. In addition, previous attempts to produce toxicology prediction systems have failed to provide the necessary modeling data and statistical information to accurately predict toxic responses (e.g., WO 00/12760, WO 00/47761, WO 00/63435, WO 01/32928, WO 01/38579).

SUMMARY OF THE INVENTION

The present invention is based on the elucidation of the global changes in gene expression in primary hepatocytes exposed to known toxins, in particular hepatotoxins, as compared to unexposed cells as well as the identification of individual genes that are differentially expressed upon toxin exposure.

In various aspects, the invention includes methods of predicting at least one toxic effect of a compound, predicting the progression of a toxic effect of a compound, and predicting the hepatoxicity of a compound. The invention also includes methods of identifying agents that modulate the onset or progression of a toxic response. Also provided are methods of predicting the general pathology classes and cellular pathways that a compound modulates in a cell. The invention includes methods of identifying agents that modulate protein activities.

In a further aspect, the invention provides probes comprising sequences that specifically hybridize to genes in Tables 1-5XX. Also provided are solid supports comprising at least two of the previously mentioned probes. The invention also includes a computer system that has a database containing information identifying the expression level in a tissue or cell sample exposed to a hepatotoxin of a set of genes comprising at least two genes in Tables 1-5XX.

DETAILED DESCRIPTION

Many biological functions are accomplished by altering the expression of various genes through transcriptional (e.g. through control of initiation, provision of RNA precursors, RNA processing, etc.) and/or translational control. For example, fundamental biological processes such as cell cycle, cell differentiation and cell death are often characterized by the variations in the expression levels of groups of genes.

Changes in gene expression are also associated with the effects of various chemicals, drugs, toxins, pharmaceutical agents and pollutants on an organism or cells. For example, the lack of sufficient expression of functional tumor suppressor genes and/or the over expression of oncogene/protooncogenes after exposure to an agent could lead to tumorgenesis or hyperplastic growth of cells (Marshall, *Cell*, 64: 313-326 (1991); Weinberg, *Science*, 254:1138-1146 (1991)). Thus, changes in the expression levels of particular genes (e.g. oncogenes or tumor suppressors) may serve as signposts for the presence and progression of toxicity or other cellular responses to exposure to a particular compound.

Monitoring changes in gene expression may also provide certain advantages during drug screening and development. Often drugs are screened for the ability to interact with a major target without regard to other effects the drugs have on cells. These cellular effects may cause toxicity in the whole animal, which prevents the development and clinical use of the potential drug.

The present inventors have examined primary rat hepatocytes exposed to the known hepatotoxins which induce detrimental liver effects, to identify global and individual changes in gene expression induced by these compounds. These global changes in gene expression, which can be detected by the production of expression profiles, as well as the individual genes, provide useful toxicity markers that can be used to monitor toxicity and/or toxicity progression by a test compound. Expression profiles, as well as the individual markers, may also be used to monitor or detect various disease or physiological states, disease progression, drug efficacy and drug metabolism.

Identification of Toxicity Markers

To evaluate and identify gene expression changes that are predictive of toxicity, studies using selected compounds with well characterized toxicity have been conducted by the present inventors to catalogue altered gene expression during exposure in vivo and in vitro. In the present study, amiodarone, alpha-naphthylisothiocyante (ANIT), acetaminophen (APAP), AY-25329, carbamazepine, carbon tetrachloride, chlorpromazine, CI-1000, clofibrate, CPA, diclofenac, diflunisal, dimethylnitrosamine (DMN), 17α-ethinylestradiol, gemfibrozil (Lopid®), hydrazine, imipramine (Janimine), indomethacin, lipopolysaccharide, lovastatin (Mevacor®), methotrexate, phenobarbital, tacrine, tamoxifen, tetracycline, valproate and Wy-14643 were selected as a known hepatotoxins.

Amiodarone (Cordarone®) is an anti-arrhythmic agent whose chemical structure contains a benzofuran ring (ring A) coupled to a p-OH-benzene structure substituted with 2 iodines and a diethyl-ethanolamine side chain (ring B). This drug is known to cause damage to the liver and has been shown to adversely effect the mitochondria by uncoupling oxidative phosphorylation and inhibiting beta-oxidation and respiration. Inhibition of respiration decreases ATP and increases production of reactive oxygen species, which in turn cause lipid peroxidation. The steatosis and hepatitis observed following treatment with amiodarone are believed to be due, at least in part, to lipid peroxidation products (Spaniol et al., *J Hepatol* 35(5):628-636 (2001); Berson et al., *Gastroenterology* 114:764-774, (1998)).

Aromatic and aliphatic isothiocyanates are commonly used soil fumigants and pesticides (Shaaya et al., *Pesticide Science* 44(3):249-253 (1995); Cairns et al., *J Assoc Official Analytical Chemists* 71(3):547-550 (1988)). These compounds are also environmental hazards, because they remain as toxic residues in plants (Cerny et al., *J Agricultural and Food Chemistry* 44(12):3835-3839 (1996)) and because they are released from the soil into the surrounding air (Gan et al., *J Agricutural and Food Chemistry* 46(3):986-990 (1998)).

Exposure to α-naphthylisothiocyanate (ANIT) has been shown to increase serum levels of total bilirubin, alkaline phosphatase, serum glutamic oxaloacetic transaminase and serum glutamic pyruvic transaminase, while total bile flow was reduced, all of which are indications of severe biliary dysfunction. ANIT also induces jaundice and cholestatis (the condition caused by failure to secrete bile, resulting in plasma accumulation of bile substances, liver cell necrosis and bile duct obstruction) (Tanaka et al., *Clinical and Experimental Pharmacology and Physiology* 20:543-547 (1993)). ANIT fails to produce extensive necrosis, but was found to produce inflammation and edema in the portal tract of the liver (Maziasa et al., *Toxicol Appl Pharmacol* 110:365-373 (1991)). ANIT-induced hepatotoxicity may also characterized by cholangiolitic hepatitis and bile duct damage. Acute hepatotoxicity caused by ANIT in rats is manifested as neutrophil-dependent necrosis of bile duct epithelial cells (BDECs) and hepatic parenchymal cells. These changes mirror the cholangiolitic hepatitis found in humans (Hill, *Toxicol Sci* 47:118-125 (1999)).

Histological changes include an infiltration of polymorphonuclear neutrophils and elevated number of apoptotic hepatocytes (Calvo et al, *J Cell Biochem* 80(4):461-470 (2001)). Other known hepatotoxic effects of exposure to ANIT include a damaged antioxidant defense system, decreased activities of superoxide dismutase and catalase (Ohta et al., *Toxicology* 139(3):265-275 (1999)), and the release of proteases from the infiltrated neutrophils, alanine aminotransferase, cathepsin G, elastase, which mediate hepatocyte killing (Hill et al., *Toxicol Appl Pharmacol* 148(1): 169-175 (1998)).

Acetaminophen (APAP) is a widely used analgesic and antipyretic agent that is an effective substitute for aspirin. Although acetaminophen does not have anti-inflammatory properties, it is preferably given to patients with ulcers or patients in whom prolonged clotting times would not be desirable. It also preferably taken by people who do not tolerate aspirin well.

Acetaminophen is metabolized to N-acetyl-p-benzoquinoneimine (NAPQI) by N-hydroxylation in a cytochrome P450-mediated process. This highly reactive intermediate, which reacts with sulfhydryl groups in glutathione, and in other liver proteins following the depletion of glutathione, can cause centrilobular hepatic necrosis (particularly in zone 3), renal tubular necrosis, and hepatic and renal failure (*Goodman and Gilman's The Pharmacological Basis of Therapeutics, Ninth Ed.*, Hardman et al., eds., pp. 631-633, McGraw-Hill, New York, 1996; Chanda et al, *Hepatology* 21(2):477-486 (1995)). Less serious side effects include skin rashes (erythemas and urticarias) and allergic reactions.

Upon treatment of rats with acetaminophen, hepatotoxicity can be observed 24 hours after dosing, as determined by statistically significant elevations of ALT and AST in the serum and by hepatocellular necrosis visualized at the light microscopic level (Hessel et al, *Braz J Med Biol Res* 29(6): 793-796 (1996); Bruck et al., *Dig Dis Sci* 44(6):1228-1235 (1999)). High, but non-lethal, doses of acetaminophen given to rats also produced elevated levels of genes involved in hepatic acute phase response and liver cell maintenance and repair: arginase, beta-fibrinogen, alpha 1-acid glycoprotein, alpha-tubulin, histone 3, TGF beta and cyclin d. Expression levels of genes regulated by the cell cycle were decreased (Tygstrup et al., *J Hepatol* 25(2):183-190 (1996); Tygstrup et al., *J Hepatol* 27(1):156-162 (1997)). In mice, expression levels of genes that encode growth arrest and cell cycle regulatory proteins were increased, along with expression levels of stress-induced genes, transcription factor LRG-21, SOCS-2 (cytokine signaling repressor) and PAI-1 (plasminogen activator inhibitor-1) (Reilly et al., *Biochem Biophys Res Comm* 282(1):321-328 (2001)).

AY-25329 is a phenothiazine that has been shown to be toxic in liver and in kidney tissue, where it can cause nephrosis. Phenothiazines are a class of psychoactive drugs that are used to treat schizophrenia, paranoia, mania, hyperactivity in children, some forms of senility, and anxiety. Side effects associated with prolonged use of these drugs are reduced blood pressure, Parkinsonism, reduction of motor activity, and visual impairment.

The present inventors have noted indications of liver and renal effects of AY-25329 by changes in serum chemistry. As early as 6 hours after the first dose, statistically significant increases in serum levels of creatinine, BUN, ALT, triglycerides and cholesterol were observed. Most of these markers of renal and liver dysfunction remained altered throughout the 14 day study period. Light microscopic analysis revealed effects in the liver as early as 6 and 24 hours, as evidenced by an increased number of hepatocytic mitotic figures and decreased glycogen content. Following 14 days of repeated dosing, nephrosis and alterations in the peripheral lobes of the liver and in the cytoplasm of hepatocytes were evident in rats dosed with 250 mg/kg/day of AY-25329.

Carbamazepine (Tegretol®) is an anti-epileptic agent. In rats, it has been shown to induce a number of cytochrome P450 enzymes, in particular CYP2B, and the drug may also cause steatohepatitis in humans (Tateishi et al., Chem Biol Interact 117:257-268 (1999); Grieco et al., Eur J Gastroenterol 13(8):973-975 (2001)).

The pathogenesis of acute carbon tetrachloride ($CCl_4$)-induced hepatotoxicity follows a well-characterized course in humans and experimental animals resulting in centrilobular necrosis and steatosis, followed by hepatic regeneration and tissue repair. Severity of the hepatocellular injury is also dose-dependent and may be affected by species, age, gender and diet.

Differences in susceptibility to $CCl_4$ hepatotoxicity are primarily related to the ability of the animal model to metabolize $CCl_4$ to reactive intermediates. $CCl_4$-induced hepatotoxicity is dependent on $CCl_4$ bioactivation to trichloromethyl free radicals by cytochrome P450 enzymes (CYP2E1), localized primarily in centrizonal hepatocytes. Formation of the free radicals leads to membrane lipid peroxidation and protein denaturation resulting in hepatocellular damage or death.

The onset of hepatic injury is rapid following acute administration of $CCl_4$ to male rats. Morphologic studies have shown cytoplasmic accumulation of lipids in hepatocytes within 1 to 3 hours of dosing, and by 5 to 6 hours, focal necrosis and hydropic swelling of hepatocytes are evident. Centrilobular necrosis and inflammatory infiltration peak by 24 to 48 hours post dose. The onset of recovery is also evident within this time frame by increased DNA synthesis and the appearance of mitotic figures. Removal of necrotic debris begins by 48 hours and is usually completed by one week, with full restoration of the liver by 14 days.

Increases in serum transaminase levels also parallel $CCl_4$-induced hepatic histopathology. In male Sprague Dawley (SD) rats, alanine aminotrasferase (ALT) and aspartate aminotransferase (AST) levels increase within 3 hours of $CCl_4$ administration (0.1, 1, 2, 3, 4 mL/kg, ip; 2.5 mL/kg, po) and reach peak levels (approximately 5-10 fold increases) within 48 hours post dose. Significant increases in serum-glutathione s-transferase (-GST) levels have also been detected as early as 2 hours after $CCl_4$ administration (25 L/kg, po) to male SD rats.

At the molecular level, induction of the growth-related proto-oncogenes, c-fos and c-jun, is reportedly the earliest event detected in an acute model of $CCl_4$-induced hepatotoxicity (Schiaffonato et al., *Liver* 17:183-191 (1997)). Expression of these early-immediate response genes has been detected within 30 minutes of a single dose of $CCl_4$ to mice (0.05-1.5 mL/kg, ip) and by 1 to 2 hours post dose in rats (2 mL/kg, po; 5 mL/kg, po) (Schiaffonato et al., supra, and Hong et al., *Yonsei Medical J* 38:167-177 (1997)). Similarly, hepatic c-myc gene expression is increased by 1 hour following an acute dose of $CCl_4$ to male SD rats (5 mL/kg, po) (Hong et al., supra). Expression of these genes following exposure to $CCl_4$ is rapid and transient. Peak hepatic mRNA levels for c-fos, c-jun, and c-myc, after acute administration of $CCl_4$ have been reported at 1 to 2 hours, 3 hours, and 1 hour post dose, respectively.

The expression of tumor necrosis factor-α (TNF-α) is also increased in the livers of rodents exposed to $CCl_4$, and TNF-α has been implicated in initiation of the hepatic repair process. Pre-treatment with anti-TNF-α antibodies has been shown to prevent $CCl_4$-mediated increases in c-jun and c-fos gene expression, whereas administration of TNF-α induced rapid expression of these genes (Bruccoleri et al., *Hepatol* 25:133-141 (1997)). Up-regulation of transforming growth factor-β (TGF-β) and transforming growth factor receptors (TBRI-III) later in the repair process (24 and 48 hours after $CCl_4$ administration) suggests that TGF-β may play a role in limiting the regenerative response by induction of apoptosis (Grasl-Kraupp et al., *Hepatol* 28:717-7126 (1998)).

Chlorpromazine (Thorazine®) is a central nervous system depressant that is used as a sedative and also as an anti-nausea or anti-itching medication. The mechanism of action is not known. The drug induces canalicular cholestasis, a condition characterized by a decrease in the volume of bile formed and impaired secretion of solutes into bile, resulting in elevated serum levels of bile salts and bilirubin. Chlorpromazine has also been shown to inhibit bile acid uptake and canalicular contractility. Bile plugs can form in the bile ducts and canaliculi. Drug-induced cholestasis is also associated with cell swelling, inflammation and cell death (*Casarett and Doull's Toxicology: The Basic Science of Poisons, 6th Ed.*, Klaassen et al. eds., pp. 476-486, McGraw-Hill Medical Pub. Div., New York, 2001).

CI-1000 (4H-pyrrolo:3,2-d:pyrimidin-4-one, 2-amino-3, 5-dihydro-7-(3-thienylmethyl)-monohydrochloride monohydrate) is a compound with anti-inflammatory properties. After treatment with CI-1000, increased serum ALT levels, a standard marker of liver toxicity, were observed in dogs.

Clofibrate, a halogenated phenoxypropanoic acid derivative (ethyl ester of clofibric acid), is an antilipemic agent. The exact mechanism by which clofibrate lowers serum concentrations of triglycerides and low-density lipoprotein (LDL) cholesterol, as well as raising high-density lipoprotein (HDL) cholesterol is uncertain. The drug has several antilipidemic actions, including activating lipoprotein lipase, which enhances the clearance of triglycerides and very-low-density lipoprotein (VLDL) cholesterol, inhibition of cholesterol and triglyceride biosynthesis, mobilization of cholesterol from tissues, increasing fecal excretion of neutral steroids, decreasing hepatic lipoprotein synthesis and secretion, and decreasing free fatty acid release.

Clofibrate has a number of effects on the rat liver, including hepatocellular hypertrophy, cellular proliferation, hepatomegaly, induction of CYP450 isozymes, and induction of palmitoyl CoA oxidation. Long term administration of clofibrate causes increased incidence of hepatocellular carcinoma, benign testicular Leydig cell tumors, and pancreatic acinar adenomas in rats. Clofibrate induces proliferation of peroxisomes in rodents and this effect, rather than genotoxic damage, is believed to be the causative event in rodent carcinogenesis (*AHFS Drug Information Handbook* 2001, McEvoy, ed., pp. 1735-1738; Electronic Physicians' Desk Reference-Atromid-S (clofibrate) at www.pdr.net; Brown and Goldstein, "Drugs used in the treatment of hyperliproteinemias," in *Goodman and Gilman's The Pharmacological Basis of Therapeutics, Eighth ed.*, Goodman et al., eds., pp. 874-896, Pergamon Press, New York, 1990).

Clofibrate also increases hepatic lipid content and alters its normal composition by significantly increasing levels of phosphatidylcholine and phosphatidyl-ethanolamine (Adinehzadeh et al., *Chem Res Toxicol* 11(5):428-440 (1998)). A rat study of liver hyperplasia and liver tumors induced by peroxisome proliferators revealed that administration of clofibrate increased levels of copper and altered copper-related gene expression in the neoplastic liver tissues. Down-regulation of the ceruloplasmin gene and of the Wilson's Disease gene (which encodes P-type ATPase), along with up-regulation of the metallothionein gene, were noted in these tissues (Eagon et al., *Carcinogenesis* 20(6):1091-1096 (1999)). Clofibrate-induced peroxisome proliferation and carcinogenicity are believed to be rodent-specific, and have not been demonstrated in humans.

Cyproterone acetate (CPA) is a potent androgen antagonist and has been used to treat acne, male pattern baldness, precocious puberty, and prostatic hyperplasia and carcinoma (Goodman & Gilman's The Pharmacological Basis of Therapeutics 9th ed., p. 1453, J. G. Hardman et al., Eds., McGraw Hill, New York, 1996). Additionally, CPA has been used clinically in hormone replacement therapy to protect the endometrium and decrease menopausal symptoms and the risk of osteoporotic fracture (Schneider, "The role of antiandrogens in hormone replacement therapy," *Climacteric* 3 (Suppl. 2): 21-27 (2000)).

In experiments with rats, CPA was shown to induce unscheduled DNA synthesis in vitro. After a single oral dose, continuous DNA repair activity was observed after 16 hours. CPA also increased the occurrence of S phase cells, which corroborated the mitogenic potential of CPA in rat liver (Kasper et al., *Carcinogenesis* 17(10): 2271-2274 (1996)). CPA has also been shown to produce cirrhosis in humans (Garty et al., *Eur J Pediatr* 158(5): 367-370 (1999)).

Diclofenac, a non-steroidal anti-inflammatory drug, has been frequently administered to patients suffering from rheumatoid arthritis, osteoarthritis, and ankylosing spondylitis. Following oral administration, diclofenac is rapidly absorbed and then metabolized in the liver by cytochrome P450 isozyme of the CYC2C subfamily (Goodman & Gilman's The Pharmacological Basis of Therapeutics 9th ed., p. 637, J. G. Hardman et al., eds., McGraw Hill, New York, 1996). In addition, diclofenac has been applied topically to treat pain due to corneal damage (Jayamanne et al., *Eye* 11(Pt. 1): 79-83 (1997); Dornic et al., *Am J Ophthalmol* 125(5): 719-721 (1998)).

Although diclofenac has numerous clinical applications, adverse side-effects have been associated with the drug, such as corneal complications, including corneal melts, ulceration, and severe keratopathy (Guidera et al., *Ophthalmology* 108 (5): 936-944 (2001)). Another study investigated 180 cases of patients who had reported adverse reactions to diclofenac to the Food and Drug Administration (Banks et al., *Hepatology* 22(3): 820-827 (1995)). Of the 180 reported cases, the most common symptom was jaundice (75% of the symptomatic patients). Liver sections were taken and analyzed, and hepatic injury was apparent one month after drug treatment. An additional report showed that a patient developed severe hepatitis five weeks after beginning diclofenac treatment for osteoarthritis (Bhogaraju et al., *South Med J* 92(7): 711-713 (1999)).

In one study on diclofenac-treated Wistar rats (Ebong et al., *Afr J Med Sci* 27(3-4): 243-246 (1998)), diclofenac treatment induced an increase in serum chemistry levels of alanine aminotransferase, aspartate aminotransferase, methaemoglobin, and total and conjugated bilirubin. Additionally, diclofenac enhanced the activity of alkaline phosphatase and 5'nucleotidase. A study on humans revealed elevated levels of hepatic transaminases and serum creatine when compared to the control group (McKenna et al., *Scand J Rheumatol* 30(1): 11-18 (2001)).

Diflunisal, a non-steroidal anti-inflammatory drug (NSAID), is a difluorophenyl derivative of salicylic acid (Goodman & Gilman's The Pharmacological Basis of Therapeutics 9th ed., p. 631, J. G. Hardman et al., Eds., McGraw Hill, New York, 1996). It is most frequently used in the treatment of osteoarthritis and musculoskeletal strains. NSAIDs have analgesic, antipyretic and anti-inflammatory actions, however, hepatotoxicity is known to be an adverse side effect of NSAID treatment (Masubuchi et al., *J Pharmacol Exp Ther* 287:208-213 (1998)). Diflunisal has been shown to be less toxic than other NSAIDs, but it can eventually have deleterious effects on platelet or kidney function (Bergamo et al., *Am J Nephrol* 9:460-463 (1989)). Other side effects that have been associated with diflunisal treatment are diarrhea, dizziness, drowsiness, gas or heartburn, headache, nausea, vomiting, and insomnia.

In a comparative hepatotoxicity study of 18 acidic NSAIDs, diflunisal was shown to increase LDH leakage in rat hepatocytes, a marker for cell injury, when compared to control samples. Additionally, treatment with diflunisal led to decreased intracellular ATP concentrations. In a study comparing the effects of diflunisal and ibuprofen, both drugs appeared to cause abdominal cramping, even during short-term usage. Because the toxic dosages were selected to be below the level at which gastric ulceration occurs, more severe gastrointestinal effects were not detected. But, increased serum levels of creatinine, a sign of renal injury, were also observed (Muncie et al., *Clin Ther* 11:539-544 (1989)).

Another model compound, dimethylnitrosamine (DMN), is a known carcinogen and inducer of liver fibrosis and lipid peroxidation. DMN causes oxidative stress in liver cells, which may be the link between chronic liver damage and liver fibrosis. Rats treated with DMN showed diffuse fibronectin deposition, elevated hydroxyproline levels (an indicator of fibrosis), increased levels of collagens, fibrous septa, and impaired oxidative balance. Serum levels of ALT and malondialdehyde (MDA) were increased, while serum levels of SOD were decreased (Vendemiale et al., *Toxicol Appl Pharmacol* 175(2):130-139 (2001); Liu et al., *Zhonghua Gan Zang Bing Za Zhi* 9 Suppl:18-20 (2001)). Other studies in rats have noted severe centrilobular congestion and haemorrhagic necrosis several days after a three-day period of DMN administration. Following additional periods of DMN treatment, the rats developed centrilobular necrosis and intense neutrophilic infiltration, which progressed to severe centrilobular necrosis, fiber deposition, focal fatty deposits, bile duct proliferation, bridging necrosis and fibrosis around the central veins (cirrhosis-like symptoms). A decrease in total protein and increase in DNA were also observed (George et al. (2001) *Toxicology* 156(2-3):129-138).

17α-ethinylestradiol, a synthetic estrogen, is a component of oral contraceptives, often combined with the progestational compound norethindrone. It is also used in post-menopausal estrogen replacement therapy (*PDR* 47th *Ed.*, pp. 2415-2420, Medical Economics Co., Inc., Montvale, N.J., 1993; *Goodman & Gilman's The Pharmalogical Basis of Therapeutics* 9th *Ed.*, pp. 1419-1422, J. G. Hardman et al. Eds., McGraw Hill, New York, 1996).

The most frequent adverse effects of 17α-ethinylestradiol usage are increased risks of cardiovascular disease: myocardial infarction, thromboembolism, vascular disease and high blood pressure, and of changes in carbohydrate metabolism, in particular, glucose intolerance and impaired insulin secretion. There is also an increased risk of developing benign hepatic neoplasia. Because this drug decreases the rate of liver metabolism, it is cleared slowly from the liver, and carcinogenic effects, such as tumor growth, may result.

17α-ethinylestradiol has been shown to cause a reversible intrahepatic cholestasis in male rats, mainly by reducing the bile-salt-independent fraction of bile flow (BSIF) (Koopen et al., *Hepatology* 27:537-545 (1998)). Plasma levels of bilirubin, bile salts, aspartate aminotransferase (AST) and alanine aminotransferase (ALT) in this study were not changed. This study also showed that 17α-ethinylestradiol produced a decrease in plasma cholesterol and plasma triglyceride levels, but an increase in the weight of the liver after 3 days of drug administration, along with a decrease in bile flow. Further results from this study are as follows. The activities of the liver enzymes leucine aminopeptidase and alkaline phosphatase initially showed significant increases, but enzyme levels decreased after 3 days. Bilirubin output increased, although glutathione (GSH) output decreased. The increased secretion of bilirubin into the bile without affecting the plasma level suggests that the increased bilirubin production must be related to an increased degradation of heme from heme-containing proteins. Similar results were obtained in another experiment (Bouchard et al., *Liver* 13:193-202 (1993)) in which the livers were also examined by light and electron microscopy. Daily doses of 17α-ethinylestradiol have been shown to cause cholestasis as well, although, following drug treatment, bile flow rates gradually returned to normal (Hamada et al., *Hepatology* 21:1455-1464 (1995)). Liver hyperplasia, possibly in response to the effects of tumor promoters, has also been observed (Mayol, *Carcinogenesis* 13:2381-2388 (1992)).

The lipid-lowering drug gemfibrozil (Lopid®) is a know peroxisome proliferator in liver tissue, causing both hyperplasia and enlargement of liver cells. Upon exposure to gemfibrozil, hepatocarcinogenesis has been observed in rats and mice, and a decrease in alpha-tocopherol and an increase in DT-diaphorase activity have been observed in rats and hamsters (impaired antioxidant capability). Peroxisome proliferators increase the activities of enzymes involved in peroxisomal beta-oxidation and omega-hydroxylation of fatty acids, which results in oxidative stress (O'Brien et al., *Toxicol Sci* 60(2):271-278 (2001); Carthew et al., *J Appl Toxicol* 17(1): 47-51 (1997)).

Hydrazine ($NH_2=NH_2$), is a component of many industrial chemicals, such as aerospace and airplane fuels, corrosion inhibitors, dyes and photographic chemicals. Its derivatives are used in pharmaceuticals such as hydrazine sulphate, used to treat cachexia in cancer patients, isoniazid, an anti-tuberculosis drug, and hydralazine, an anti-hypertensive. These drugs are metabolized in vivo to produce hydrazine, among other by-products. Consequently, exposure to hydrazine is by direct contact, e.g., among military and airline personnel, or the result of its production in the body, e.g., in patients with cancer or high blood pressure.

Studies on rat hepatocytes have shown that hydrazine causes a dose-dependent loss of viability, leakage of LDH, depletion of GSH and ATP and a decreased rate of protein synthesis (Delaney et al., *Xenobiotica* 25(12):1399-1410 (1995)). When administered to rats, hepatotoxic changes, characterized by GSH and ATP depletion and induction of fatty liver (increases in liver weight and triglycerides, with the appearance of fatty droplets, swelling of mitochondria and appearance of microbodies) were also found to be dose-dependent (Jenner et al., *Arch Toxicol* 68(6):349-357 (1994); Scales et al, *J Toxicol Environ Health* 10(6):941-953 (1982)). The hepatoxicity, as well as renal toxicity, associated with hydrazine exposure has been linked to free radical damage resulting from oxidative metabolism by cytochrome P4502E1 (CYP2E1), which catalyzes the conjugation of free radicals with reduced glutathione. Although exposure to hydrazine and several hydrazine derivatives increased enzyme levels in kidney tissue, increased enzyme levels were not detected in liver tissue (Runge-Morris et al., *Drug Metab Dispos* 24(7):734-737 (1996)).

The mutagenic and hepatocarcinogenic effects of hydrazine were examined in hamster livers. In vivo, hydrazine reacts with formaldehyde to form formaldehyde hydrazone ($CH_2=N-NH_2$), an alkylating intermediate that methylates guanine in DNA. Upon treatment with hydrazine, liver DNA showed the presence of methylated guanine, DNA adducts and the impairment of maintenance methylation (impaired methylation of deoxycytosine). Hepatic adenomas and carcinomas also developed in a dose-dependent manner and could be correlated with decreased maintenance methylation (FitzGerald et al., *Carcinogenesis* 17(12):2703-2709 (1996)).

Imipramine, a dibenzazepine derivative, is a tricyclic antidepressant agent commonly used for the treatment of major depression. Experiments in rats have shown that the drug induces cytochrome P450-mediated formation of reactive metabolites, which cause acute cell injury. Decreased levels of glutathione and protein thiols, as well as lactate dehydrogenase leakage, all standard measures of liver toxicity, were also noted (Masubuchi et al., Arch Toxicol 73(3):147-151 (1999). On rare occasions, imipramine has induced cholestasis and hepatitis in humans (Moskovitz et al., J Clin Psychiatry 43(4):165-066 (1982); Horst et al., Gastroenterology 79(3):550-544 (1980)).

Indomethacin is a non-steroidal antiinflammatory, antipyretic and analgesic drug commonly used to treat rheumatoid arthritis, osteoarthritis, ankylosing spondylitis, gout and a type of severe, chronic cluster headache characterized by many daily occurrences and jabbing pain. This drug acts as a potent inhibitor of prostaglandin synthesis; it inhibits the cyclooxygenase enzyme necessary for the conversion of arachidonic acid to prostaglandins (*PDR* 47$^{th}$ *Ed*., Medical Economics Co., Inc., Montvale, N.J., 1993; *Goodman & Gilman's The Pharmalogical Basis of Therapeutics* 9$^{th}$ *Ed*., J. G. Hardman et al. eds., pp. 1074-1075, 1089-1095, McGraw Hill, New York, 1996; *Cecil Textbook of Medicine,* 20$^{th}$ *Ed*., part XII, pp. 772-773, 805-808, J. C. Bennett and F. Plum Eds., W.B. Saunders Co., Philadelphia, 1996).

The most frequent adverse effects of indomethacin treatment are gastrointestinal disturbances, usually mild dyspepsia, although more severe conditions, such as bleeding, ulcers and perforations can occur. Hepatic involvement is uncommon, although some fatal cases of hepatitis and jaundice have been reported. Renal toxicity can also result, particularly after long-term administration. Renal papillary necrosis has been observed in rats, and interstitial nephritis with hematuria, proteinuria and nephrotic syndrome have been reported in humans. Patients suffering from renal dysfunction risk developing a reduction in renal blood flow, because renal prostaglandins play an important role in renal perfusion.

In rats, although indomethacin produces more adverse effects in the gastrointestinal tract than in the liver, it has been shown to induce changes in hepatocytic cytochrome P450. In one study, no widespread changes in the liver were observed, but a mild, focal, centrilobular response was noted. Serum levels of albumin and total protein were significantly reduced, while the serum level of urea was increased. No changes in creatinine or aspartate aminotransferase (AST) levels were observed (Falzon et al., *Br J exp Path* 66:527-534 (1985)). In another rat study, a single dose of indomethacin was shown to reduce liver and renal microsomal enzymes, including CYP450, and cause lesions in the GI tract (Fracasso et al., *Agents Actions* 31:313-316 (1990)).

LPS (lipopolysaccharide) is an endotoxin released by gram-negative bacteria upon breakage or rupture of the cells that induces an acute inflammatory response in mammals and that can cause septic shock. LPS is also a research tool used to initiate liver injury in rats through an inflammatory mechanism. Typically, the membrane components of LPS are lipid-A, KDO (2-keto-3-deoxy-octulosonic acid), core polysaccharides and O-antigen polysaccharides, the polysaccharide units differing from one bacterium to another (*Zinsser Microbiology* 20*th Ed*., Joklik et al., eds., pp. 82-87, Appleton & Lange, Norwalk, Conn., 1992).

Primary rat hepatocytes derived from liver parenchymal cells and sinusoidal cells of rats that have been exposed to LPS in vivo can directly respond to LPS in cell culture. Numerous effects of LPS-induced endotoxemia can be detected, including elevated levels of nitric oxide synthetase (NOS) with increased nitric oxide and nitrite production, cellular hypertrophy, vacuolization, chromosomal emargination, cytoplasmic DNA fragmentation and necrosis (Pittner et al., *Biochem Biophys Res Commun* 185(1):430-435 (1992); Laskin et al., *Hepatology* 22(1):223-234 (1995); Wang et al., *Am J Physiol* 269(2 Pt 1):G297-304 (1995)). Other studies have indicated that the presence of Kupffer cells with primary rat hepatocytes is essential for the induction of hepatocyte apoptosis by LPS (Hamada et al., *J Hepatol* 30(5):807-818 (1999)).

Exposure of rats or primary hepatocytes to LPS induces the expression of a number of acute-phase proteins in the liver. Recent evidence has indicated that rat hepatocytes express soluble CD14 protein, and LPS is capable of markedly increasing levels of CD14 at both the gene expression and protein expression levels (Liu et al., *Infect Immun* 66(11): 5089-5098 (1998)). Soluble CD14 is believed to be a critical LPS recognition protein required for the activation of a variety of cells to toxic levels of LPS, even in endothelial and epithelial cells (Pugin et al., *Proc Natl Acad Sci USA* 90(7): 2744-2748 (1993)). Another key component of the LPS recognition system is lipopolysaccharide-binding protein (LBP), which binds to LPS. The LPS-LBP complex interacts with the CD14 receptor, inducing LPS sensitive genes. LBP can be induced in hepatocytes isolated from rats that have not been primed with LPS, indicating that this key regulatory pathway is intact in primary rat hepatocytes (Wan et al., *Infect Immun* 63(7):2435-2442 (1995)).

Lovastatin (Mevacor®) is a cholesterol-lowering agent belonging to a class of compounds, the statins, that are potent inhibitors of HMG-CoA reductase. This enzyme catalyzes the conversion of HMG-CoA to mevalonate, the rate-controlling enzyme in cholesterol biosynthesis. HMG-CoA reductase inhibitors block the production of cholesterol in the liver leading to a reduction of LDL particles in the plasma. Lovastatin has additional effects on lipid metabolism, including depletion of intracellular pools of sterols and increased synthesis of LDL receptors, leading to enhanced removal of LDL and LDL precursors from plasma. Upon treatment with lovastatin, plasma levels of VLDL, IDL and triglycerides also decrease. Oral doses of lovastatin are extensively absorbed by the liver, and the drug is excreted primarily via the liver; less than 13% of its metabolites are excreted in the urine (*Goodman and Gilman's The Pharmacological Basis of Therapeutics. Ninth Ed.*, Hardman et al., eds., pp. 884-888, McGraw-Hill, New York, 1996).

The most frequent side effects are liver damage, characterized by elevated levels of hepatic transaminases (e.g., AST and ALT), creatinine phosphokinase and alkaline phosphatase, and myopathy, characterized by muscle pain and destruction of skeletal muscle cells. Cases of drug-induced hepatitis, accompanied by jaundice and elevated levels of liver enzymes, have also been reported, although the symptoms were reversible following withdrawal of the drug (Huchzermeyer et al., *Deutsch Med Wochenschr* 120(8):252-256 (1995); Heuer et al., *Med Klin* 95(11):642-644 (2000)). Histologic examination of affected liver tissue showed centrilobular necrosis, centrilobular cholestasis, and infiltrates with mononuclear and polymorphonuclear cells, including eosinophils (Grimbert et al., *Dig Dis Sci* 39(9):2032-2033 (1994)).

Experiments by the present inventors have found that when rats were dosed with lovastatin, at 9 or 90 mg/kg twice a day, no effects were noted in liver tissue after 6 or after 24 hours. After 14 days of treatment at the higher dosage, however, liver cells showed abnormal vacuolization of the cytoplasm. Hepatoxicity data from other studies of laboratory animals treated with lovastatin have not been widely reported. Therefore, in order to establish a more sensitive model for examining the changes in liver tissue caused by lovastatin, as well as to have a means of examining changes in expression level of individual genes as a result of exposure to lovastatin, experiments in cultured hepatocytes were undertaken.

Methotrexate is a widely used antineoplastic drug that is also frequently prescribed for the treatment of psoriasis (a disease characterized by abnormal proliferation of epidermal cells), juvenile lymphoblastic leukemia, rheumatoid arthritis, and a number of other cancerous diseases, such as leukemic meningitis and choriocarcinoma. Although generally not metabolized, at high dosages, metabolites such as 7-hydroxymethotrexate, a nephrotoxin, do accumulate. Methotrexate polyglutamates are retained in the kidneys for weeks and in the liver for months ((*Goodman and Gilman's The Pharmacological Basis of Therapeutics, Ninth Ed.*, Hardman et al., eds., pp. 1243-1247, McGraw-Hill, New York, 1996).

Methotrexate acts to prevent DNA synthesis and cell replication by inhibiting the rate-limiting enzyme in purine and thymidine synthesis, dihydrofolate reductase (DHFR) (Goodman and Gilman's, supra; Schwartz et al., *Proc Nat Acad Sci USA* 89(2):594-598 (1992)). It also acts as an suppressant of cell-mediated immune responses. The biochemical toxicology of methotrexate has been well characterized in man, where long-term administration produces hepatic fibrosis or cirrhosis, especially in heavy drinkers, which is linked to persistent, mild-to-moderate, increases in serum transaminases, alkaline phosphatases and bilirubin (Reynolds et al., *South Med J* 79(5):536-539 (1986); Tolman et al., *J Rheumatol* 12 (Suppl 12):29-34 (1985)). Methotrexate is a rather long-acting, rapidly reversible DHFR inhibitor, despite its high affinity for the target enzymes in many cell types, which may be due to the formation of methotrexate polyglutamates that reduce the ability of DHFR to pass through cell membranes. The toxic effects of methotrexate may be due to the depletion of tetrahydrofolate cofactors that are required for purine and thymidylate synthesis (methylation reactions in hepatic 1-carbon metabolism) and to the inhibition of folate-dependent enzymes involved in the metabolism of purines and thymidylate, the inhibition caused by the accumulation of methotrexate polyglutamates and dihydrofolate polyglutamates.

The mechanism of methotrexate-induced hepatotoxicity is not yet fully elucidated, partly because the pathological changes in humans are rather difficult to reproduce in animal models, although experiments in rats have shown that, in a dose-dependent fashion, methotrexate produces liver damage ranging from focal to confluent necrosis of zone 3 hepatocytes, with early stage fibrosis (Hall et al., *Hepatology* 14(5): 906-10 (1991)). Other studies in rats have demonstrated that treatment with methotrexate produces intrahepatocytic fat deposits, along with fatty accumulations in hepatocytes that range from fine droplets to large vacuoles. The areas of necrosis showed signs of the hypoxia associated with congestive failure, as well as anemic infarcts, fibrotic foci of the collapse type, atrophy of the hepatic cords, and hemosiderosis (Custer et al., *J Natl Cancer Inst* 58(4):1011-1015 (1977)). Hepatotoxicity probably involves interference with triglyceride and other lipid biosynthetic pathways in the liver. For example, studies on rats have shown that methotrexate inhibits the biosynthesis of lipotropic substances such as methionine and choline through its interference with hepatic 1-carbon metabolism. The drug also inhibits the activity of vitamin B12, another lipotropic factor (Tuma et al., *Biochem Pharmacol* 24:1327-1331 (1975) and impairs RNA and protein synthesis, triglyceride secretion and total triglyceride esterification (Deboyser et al., *Toxic in Vitro* 6(2):129-132 (1992).

Methotrexate does not appear to be cytotoxic to cultured primary hepatocytes following short-term exposures (up to 3.5 hr), but significant effects on HepG2 growth curves have been observed at low concentrations during the course of 7-day exposures (Wu et al., *Proc Natl Acad Sci USA* 80(10): 3078-3080 (1983)). Additionally, it has been demonstrated that methotrexate increases hepatic glycogenolysis, oxygen consumption and calcium efflux and decreases glutathione levels (Yamamoto et al., *Biochem Pharmacol* 44(4):761-767, (1992); de Oliveira et al., *Res Commun Chem Pathol Pharmacol* 53(2):173-181 (1986); Lindenthal et al, *Eur J Pharmacol* 228(5-6):289-298 (1993)). Experiments on cultured rat hepatocytes have shown that methotrexate also inhibits the activity of hepatic N-acetyltransferase 2 (NAT2), although the drug has only a slight inhibitory effect on rat NAT1, enzymes that catalyze the acetylation of a variety of therapeutic arylamines (Zaher et al., *Toxicol in Vitro* 11:271-283 (1997)).

Phenobarbital, a barbiturate, is used as an anti-epileptic, sedative or hypnotic drug and can also be used to treat neuroses with related tension states, such as hypertension, coronary artery disease, gastrointestinal disturbances and preoperative apprehension. Phenobarbital is also found in medications to treat insomnia and headaches (*Remington: The Science and Practice of Pharmacy*, 19th Ed., A. R. Gennaro ed., pp. 1164-1165, Mack Publishing Co., Easton, Pa., 1995).

Phenobarbital induces a variety of drug metabolizing enzymes such as cytochrome P450 oxidoreductase, aldehyde dehydrogenases, UDP-glucuronyltransferase, GSTs, epoxide hydrolase, and an assortment of cytochrome P450 monooxygenases (Waxman et al., *Biochem J* 1281(Pt 3):577-592 (1992); Kaplowitz et al., *Biochem J* 146(2):351-356 (1975); Tank et al., *Biochem Pharmacol* 35(24):4563-4569 (1986). The induction of liver enzymes is usually accompanied by liver enlargement, proliferation of smooth endoplasmic reticulum, and tumor promotion (Waxman et al., supra; Rice et al., *Carcinogenesis* 15(2):395-402 (1994); Nims et al., *Carcinogenesis* 8(1):67-71, (1987). Incidences of cholestasis and hepatocellular injury have also been found (Selim et al., *Hepatology* 29(5):1347-1351 (1999); Gut et al., *Environ Health Perspect* 104(Suppl 6):1211-1218 (1999)). Phenobarbital has been classified as nongenotoxic hepatocarcinogen as it induces liver tumors in rodents but lacks detectable signs of genotoxicity using short term in vivo or in vitro assays (Whysner et al., *Pharmacol Ther* 71(1-2):153-191 (1996)).

The effects of phenobarbital on phospholipid metabolism in rat liver have been studied. In one study, phenobarbital, administered intraperitonially (i.p.), was found to cause an increase in the microsomal phosphatidylcholine content. Additionally, levels of glycerophosphate acyltransferase (GAT), phosphatidate cytidylyltransferase (PCT), phosphatidate phosphohydrolase (PPH) and choline phosphotransferase (CPT) were significantly increased (Hoshi et al., *Chem Pharm Bull* 38:3446-3448 (1990)).

Tacrine (1,2,3,4-tetrahydro-9-aminoacridine-hydrochloride), a strong acetylcholinesterase (AChE) inhibitor, is used in the treatment of mild to moderate cases Alzheimer's dimentias. Alzheimer's patients have synaptic loss, neuronal atrophy and degeneration of cholinergic nuclei in the forebrain, which are associated with reduced oxidative metabolism of glucose and decreased levels of ATP and acetyl CoA. Administration of AChE inhibitors, such as tacrine, is designed to increase cholinergic activity to combat this loss (Weinstock, *Neurodegeneration* 4(4):349-356 (1995)). The effect seen in the patients is a reversal of the cognitive and functional decline, but the drug does not appear to change the neurodegenerative process (*Goodman & Gilman's The Pharmacological Basis of Therapeutics* 9th Ed., Hardman et al. eds., p. 174, McGraw Hill, New York, 1996).

Hepatotoxicty caused by tacrine is typically reversible, although cases of severe hepatotoxicity have been seen (Blackard et al., *J Clin Gastroenterol* 26:57-59 (1998)). The toxicity is characterized by decreased levels of protein synthesis and the release of lactate dehydrogenase, as well as by increased transaminase levels and decreased levels of ATP, glycogen and glutathione. The decrease in protein synthesis may represent a signal leading to cell death (Lagadic-Gossmann et al., *Cell Biol Toxicol* 14(5):361-373 (1998)).

Preclinical studies have failed to detect adverse hepatic events, although tacrine displayed cytotoxicity to human hepatoma cell lines and primary rat hepatocytes (Viau et al., *Drug Chem Toxicol* 16:227-239 (1993)). While hepatotoxicity has been found in humans, in vivo rat studies have not shown a correlation between tacrine exposure and hepatotoxicity, and the mechanism of action is not completely understood. An in vitro study comparing the reaction of human and rat liver microsomal preparations to tacrine showed that the two species reacted differently to the drug, suggesting that the rat may not be the best model for monitoring tacrine-induced elevations in liver marker enzymes (Woolf et al., *Drug Metab Dispos* 21:874-882 (1993)).

While tacrine does not reveal classic signs of hepatotoxicity in rats, gene expression changes due to tacrine administration can be used to predict that the drug will be a liver toxin in humans. This suggests that toxicogenomics might be able to detect drugs that prove to be toxic in the clinic even when classical but more crude measures in preclinical screening fail to detect toxicity.

Tamoxifen is a nonsteroidal anti-estrogen used for breast cancer in males and females. Tamoxifen has been associated with changes in liver enzyme levels, disruption of mitochondrial metabolism and, occasionally, with a spectrum of more severe liver abnormalities including fatty liver, cholestasis, hepatic necrosis and NASH (nonalcoholic steatohepatitis) (Duthie et al., *Xenobiotica* 25(10):1151-1164 (1995); Cardoso et al., *Toxicol Appl Pharmacol* 176(3):145-152 (2001); Pinol et al., *Gastroenterol Hepatol* 23(2):57-61 (2000); and Farrell, *Semin Liver Dis* 22(2):185-194 (2002)). A few of these serious cases included fatalities. A few cases of liver cancer have also been reported. Additionally, studies in mice and rats have shown that tamoxifen significantly alters the activities of liver enzymes and can induce hepatic carcinomas (Caballero et al., *Int J Biochem Cell Biol* 33(7):681-690 (2001); Guzelian, *Semin Oncol* 24(1 Suppl 1):S1-105-121 (1997)).

Tetracycline is a broad spectrum antibiotic whose main mechanism of action is the inhibition of bacterial protein synthesis. Hepatic toxicity, principally steatosis, has been observed in patients receiving high doses of tetracycline. In rats and dogs, exposure to tetracycline has been shown to increase levels of total lipids and triglycerides in liver cells due to inhibition of mitochondrial lipid metabolism and beta-oxidation (Lewis et al., Am J Dig Dis 12:429-438, (1967); Amacher et al., *Fundam Appl Toxicol* 40(2):256-263 (1997).

Valproate (n-dipropylacetic acid, Depakene®) is routinely used to treat several types of epileptic seizures-absence seizures, myoclonic seizures and tonic-clonic seizures. Most other anti-epileptics are effective against only one type. Valproate acts on neurons to inhibit the sustained repetitive firing caused by depolarization of cortical or spinal cord neurons, and a prolonged recovery of inactivated voltage-activated $Na^+$ channels follows. The drug also acts by reducing the low-threshold $Ca^{2+}$ current and its multiple mechanisms contribute to its use in multiple types of seizures. Although valproate does not affect neuronal responses to GABA, it does increase the activity of the GABA synthetic enzyme, glutamic acid decarboxylase, and it inhibits enzymes that degrade GABA, GABA transaminase and succinic semialdehyde dehydrogenase (*Goodman and Gilman's The Pharmacological Basis of Therapeutics, 9th Ed.*, Hardman et al., eds., pp. 462, 476 and 477, McGraw-Hill, New York, 1996).

The most common side effects are gastrointestinal symptoms, including anorexia, nausea and vomiting. Effects on the CNS include sedation, ataxia and tremor. Rash, hair loss, increased appetite and teratogenic effects have also been observed (Briggs et al, *A Reference Guide to Fetal and Neonatal Risk. Drugs in Pregnancy and Lactation, 4th ed.*, p. 869, Williams & Wilkins, Baltimore, 1994). With respect to liver toxicity, valproate produces elevated levels of hepatic enzymes in about 40% of patients, which may be an asymptomatic condition, and elevated levels of hepatic lipids. Fulminant hepatitis, microvesicular steatosis (fatty degeneration), hepatocyte necrosis and hepatic failure can also result. It is believed that hepatotoxicity is caused by an accumulation of unsaturated metabolites of valproate, in particular 4-en-valproate, which is structurally similar to two known hepatotoxins, 4-en-pentanoate and methylenecyclopropylacetic acid (Eadie et al., *Med Toxicol Adverse Drug Exp* 3(2):85-106 (1988)).

In a study on rats, microvesicular steatosis caused by valproate was found to be accompanied by myeloid bodies, lipid vacuoles and mitochondrial abnormalities (Kesterson et al., *Hepatology* 4(6):1143-1152 (1984)). Experiments on cultured rat hepatocytes have shown that valproate produces a dose-dependent leakage of lactic acid dehydrogenase and increased amounts of acyl-CoA esters, compounds that interfere with the beta-oxidation of fatty acids (Vance et al., *Epilepsia* 35(5):1016-1022 (1994)). Administration of valproate to rats has also been shown to cause enhanced excretion of dicarboxylic acids, a sign of impaired mitochondrial beta-oxidation. Other metabolic effects include hypoglycemia, hyperammonemia, decreased levels of beta-hydroxybutyrate and carnitine and decreased activities of acyl-CoA dehydrogenases, enzymes involved in fatty acid oxidation. mRNA levels of genes involved in fatty acid oxidation, however, such as the short-, medium- and long-chain acyl-CoA dehydrogenases, were found to have increased (Kibayashi et al., *Pediatr Int* 41(1):52-60 (1999)).

Wy-14643, a tumor-inducing compound that acts in the liver, has been used to study the genetic profile of cells during the various stages of carcinogenic development, with a view toward developing strategies for detecting, diagnosing and treating cancers (Rockett et al., *Toxicology* 144(1-3):13-29 (2000)). In contrast to other carcinogens, Wy-14643 does not mutate DNA directly. Instead, it acts on the peroxisome proliferator activated receptor-alpha (PPARalpha), as well as on other signaling pathways that regulate growth (Johnson et al., *J Steroid Biochem Mol Biol* 77(1):59-71 (2001)). The effect is elevated and sustained cell replication, accompanied by a decrease in apoptosis (Rusyn et al., *Carcinogenesis* 21(12): 2141-2145 (2000)). These authors (Rusyn et al.) noted an increase in the expression of enzymes that repair DNA by base excision, but no increased expression of enzymes that do not repair oxidative damage to DNA. In a study on rodents, Johnson et al. noted that Wy-14643 inhibited liver-X-receptor-mediated transcription in a dose-dependent manner, as well as de novo sterol synthesis.

In experiments with mouse liver cells (Peters et al., *Carcinogenesis* 19(11): 1989-1994 (1998)), exposure to Wy-14643 produced increased levels of acyl CoA oxidase and proteins involved in cell proliferation: CDK-1, 2 and 4, PCNA and c-myc. Elevated levels may be caused by accelerated transcription that is mediated directly or indirectly by PPARalpha. It is likely that the carcinogenic properties of peroxisome proliferators are due to the PPARalpha-dependent changes in levels of cell cycle regulatory proteins.

Another study on rodents (Keller et al., *Biochim Biophys Acta* 1102(2):237-244 (1992)) showed that Wy-14643 was capable of uncoupling oxidative phosphorylation in rat liver mitochondria. Rates of urea synthesis from ammonia and bile flow, two energy-dependent processes, were reduced, indicating that the energy supply for these processes was disrupted as a result of cellular exposure to the toxin. Wy-14643 has also been shown to activate nuclear factor kappaB, NADPH oxidase and superoxide production in Kupffer cells (Rusyn et al., *Cancer Res* 60(17):4798-4803 (2000)). NADPH oxidase is known to induce mitogens, which cause proliferation of liver cells.

Toxicity Identification, Prediction and Modeling

The genes and gene expression information, as well as the portfolios and subsets of the genes provided in Tables 1-5XX may be used to predict or identify at least one toxic effect, including the hepatotoxicity of a test or unknown compound. As used, herein, at least one toxic effect includes, but is not limited to, a detrimental change in the physiological status of a cell or organism. The response may be, but is not required to be, associated with a particular pathology, such as tissue necrosis. Accordingly, the toxic effect includes effects at the molecular and cellular level. Hepatotoxicity is an effect as used herein and includes, but is not limited to, genotoxic and non-genotoxic carcinogenesis, cholestasis, hepatitis, liver enlargement, inflammation, necrosis, necrosis with steatosis, peroxisome proliferation, steatosis, and steatosis with hepatitis. In addition, hepatotoxicity includes the effect of direct-acting agents (such as metformin, rosiglitazone and dexamethasone), which are pharmaceuticals that act in the liver, but are not considered toxic to the liver. Exposure to these agents results in altered gene expression profiles. As used herein, a gene expression profile comprises any quantitative representation of the expression of at least one mRNA species in a cell sample or population and includes profiles made by various methods such as differential display, PCR, hybridization analysis, etc.

In general, assays to predict the toxicity or hepatotoxicity of a test agent (or compound or multi-component composition) comprise the steps of exposing a cell population to the test compound, assaying or measuring the level of relative or absolute gene expression of one or more of the genes in Tables 5A-5XX and comparing the identified expression level(s) to the expression levels disclosed in the Tables and database(s) disclosed herein. Assays may include the measurement of the expression levels of about 2, 3, 4, 5, 6, 7, 8, 9, 10, 15, 20, 25, 30, 50, 75, 100, 200, 300, 400, 500, 1000 or more genes from Tables 5A-5XX to create multi-gene expression profiles. In some embodiments, all or substantially all of the genes of Tables 5A-5XX may be used to predict toxicity, etc. In other embodiments, the genes or subsets of the genes for each individual toxin model, for instance, the genes of Table 5A, may be used. An "adequate amount" of the data of Tables 5A-5XX refers to an amount of information that allows toxicity identification or prediction (typically 2 or more genes). "Substantially" or nearly all of the data in the tables refers to at least about 80% of the data for an individual model.

In the methods of the invention, the gene expression level for a gene or genes induced by the test agent, compound or compositions may be comparable to the levels found in the Tables or databases disclosed herein if the expression level varies within a factor of about 2, about 1.5 or about 1.0 fold. In some cases, the expression levels are comparable if the agent induces a change in the expression of a gene in the same direction (e.g., up or down) as a reference toxin. "Comparing" may comprise determining the relationship of the database information to the sample gene expression profile with or without application of an algorithm to the results, differences or similarities between the two.

The cell population that is exposed to the test agent, compound or composition may be exposed in vitro or in vivo. For instance, cultured or freshly isolated hepatocytes, in particular rat hepatocytes, may be exposed to the agent under standard laboratory and cell culture conditions. In another assay format, in vivo exposure may be accomplished by administration of the agent to a living animal, for instance a laboratory rat.

Procedures for designing and conducting toxicity tests in in vitro and in vivo systems are well known, and are described in many texts on the subject, such as Loomis et al., *Loomis's Esstentials of Toxicology*, 4th Ed., Academic Press, New York, 1996; Echobichon, *The Basics of Toxicity Testing*, CRC Press, Boca Raton, 1992; Frazier, editor, *In Vitro Toxicity Testing*, Marcel Dekker, New York, 1992; and the like.

In in vitro toxicity testing, two groups of test organisms are usually employed: One group serves as a control and the other group receives the test compound in a single dose (for acute toxicity tests) or a regimen of doses (for prolonged or chronic toxicity tests). Because, in some cases, the extraction of tissue as called for in the methods of the invention requires sacrificing the test animal, both the control group and the group receiving compound must be large enough to permit removal of animals for sampling tissues, if it is desired to observe the dynamics of gene expression through the duration of an experiment.

In setting up a toxicity study, extensive guidance is provided in the literature for selecting the appropriate test organism for the compound being tested, route of administration, dose ranges, and the like. Water or physiological saline (0.9% NaCl in water) is the solute of choice for the test compound since these solvents permit administration by a variety of routes. When this is not possible because of solubility limitations, vegetable oils such as corn oil or organic solvents such as propylene glycol may be used.

Regardless of the route of administration, the volume required to administer a given dose is limited by the size of the animal that is used. It is desirable to keep the volume of each dose uniform within and between groups of animals. When rats or mice are used, the volume administered by the oral route generally should not exceed about 0.005 ml per gram of animal. Even when aqueous or physiological saline solutions are used for parenteral injection the volumes that are tolerated are limited, although such solutions are ordinarily thought of as being innocuous. The intravenous $LD_{50}$ of distilled water in the mouse is approximately 0.044 ml per gram and that of isotonic saline is 0.068 ml per gram of mouse. In some instances, the route of administration to the test animal should be the same as, or as similar as possible to, the route of administration of the compound to man for therapeutic purposes.

When a compound is to be administered by inhalation, special techniques for generating test atmospheres are necessary. The methods usually involve aerosolization or nebulization of fluids containing the compound. If the agent to be tested is a fluid that has an appreciable vapor pressure, it may be administered by passing air through the solution under controlled temperature conditions. Under these conditions, dose is estimated from the volume of air inhaled per unit time, the temperature of the solution, and the vapor pressure of the agent involved. Gases are metered from reservoirs. When particles of a solution are to be administered, unless the particle size is less than about 2 μm the particles will not reach the terminal alveolar sacs in the lungs. A variety of apparatuses and chambers are available to perform studies for detecting effects of irritant or other toxic endpoints when they are administered by inhalation. The preferred method of administering an agent to animals is via the oral route, either by intubation or by incorporating the agent in the feed.

When the agent is exposed to cells in vitro or in cell culture, the cell population to be exposed to the agent may be divided into two or more subpopulations, for instance, by dividing the population into two or more identical aliquots. In some preferred embodiments of the methods of the invention, the cells to be exposed to the agent are derived from liver tissue. For instance, cultured or freshly isolated rat hepatocytes may be used.

The methods of the invention may be used generally to predict at least one toxic response, and, as described in the Examples, may be used to predict the likelihood that a compound or test agent will induce various specific liver pathologies, such as genotoxic and non-genotoxic carcinogenesis, cholestasis, direct action toxicity, hepatitis, liver enlargement, inflammation, necrosis, necrosis with steatosis, peroxisome proliferation, steatosis, steatosis with hepatitis, or other pathologies associated with at least one of the toxins herein described. The methods of the invention may also be used to determine the similarity of a toxic response to one or more individual compounds. In addition, the methods of the invention may be used to predict or elucidate the potential cellular pathways influenced, induced or modulated by the compound or test agent due to the similarity of the expression profile compared to the profile induced by a known toxin (see Tables 5A-5G, 5J, 5K, 5M-SS, 5U-5Y, 5AA-5EE, 5HH-5JJ, 5MM, 5OO, 5PP and 5SS-5XX). Further, the link between a specific liver pathology that is the result of exposure to a toxin and a specific gene expression profile allows for distinction of the genes in Tables 5A-5XX as markers of liver toxicity.

Diagnostic Uses for the Toxicity Markers

As described above, the genes and gene expression information or portfolios of the genes with their expression information as provided in Tables 5A-5XX may be used as diagnostic markers for the prediction or identification of the physiological state of tissue or cell sample that has been exposed to a compound or to identify or predict the toxic effects of a compound or agent. For instance, a tissue sample such as a sample of peripheral blood cells or some other easily obtainable tissue sample may be assayed by any of the methods described above, and the expression levels from a gene or genes from Tables 5A-5XX may be compared to the expression levels found in tissues or cells exposed to the toxins described herein. These methods may result in the diagnosis of a physiological state in the cell or may be used to identify the potential toxicity of a compound, for instance a new or unknown compound or agent. The comparison of expression data, as well as available sequence or other information may be done by researcher or diagnostician or may be done with the aid of a computer and databases as described below.

In another format, the levels of a gene(s) of Tables 5A-5XX, its encoded protein(s), or any metabolite produced by the encoded protein may be monitored or detected in a sample, such as a bodily tissue or fluid sample to identify or diagnose a physiological state of an organism. Such samples may include any tissue or fluid sample, including urine, blood and easily obtainable cells such as peripheral lymphocytes.

Use of the Markers for Monitoring Toxicity Progression

As described above, the genes and gene expression information provided in Tables 5A-5XX may also be used as markers for the monitoring of toxicity progression, such as that found after initial exposure to a drug, drug candidate, toxin, pollutant, etc. For instance, a tissue or cell sample may be assayed by any of the methods described above, and the expression levels from a gene or genes from Tables 5A-5XX may be compared to the expression levels found in tissue or cells exposed to the hepatotoxins described herein. The comparison of the expression data, as well as available sequence or other information may be done by researcher or diagnostician or may be done with the aid of a computer and databases.

Use of the Toxicity Markers for Drug Screening

According to the present invention, the genes identified in Tables 5A-5XX may be used as markers or drug targets to evaluate the effects of a candidate drug, chemical compound or other agent on a cell or tissue sample. The genes may also be used as drug targets to screen for agents that modulate their expression and/or activity. In various formats, a candidate drug or agent can be screened for the ability to simulate the transcription or expression of a given marker or markers or to down-regulate or counteract the transcription or expression of a marker or markers. According to the present invention, one can also compare the specificity of a drug's effects by looking at the number of markers which the drug induces and comparing them. More specific drugs will have less transcriptional targets. Similar sets of markers identified for two drugs may indicate a similarity of effects. As used herein, an agent is said to modulate the expression of a nucleic acid of the invention if it is capable of up- or down-regulating expression of the nucleic acid in a cell.

Assays to monitor the expression of a marker or markers as defined in Tables 5A-5XX may utilize any available means of monitoring for changes in the expression level of the nucleic acids of the invention.

In one assay format, microarrays containing probes to one, two or more genes from Tables 5A-5XX may be used to directly monitor or detect changes in gene expression in the treated or exposed cell. Cell lines, tissues or other samples are first exposed to a test agent and in some instances, a known toxin, and the detected expression levels of one or more, or preferably 2 or more of the genes of Tables 5A-5XX are compared to the expression levels of those same genes exposed to a known toxin alone. Compounds that modulate the expression patterns of the known toxin(s) would be expected to modulate potential toxic physiological effects in vivo. The genes in Tables 5A-5XX are particularly appropriate marks in these assays as they are differentially expressed in cells upon exposure to a known hepatotoxin.

In another format, cell lines that contain reporter gene fusions between the open reading frame and/or the transcriptional regulatory regions of a gene in Tables 5A-5XX and any assayable fusion partner may be prepared. Numerous assayable fusion partners are known and readily available including the firefly luciferase gene and the gene encoding chloramphenicol acetyltransferase (Alam et al., *Anal Biochem* 188: 245-254 (1990)). Cell lines containing the reporter gene fusions are then exposed to the agent to be tested under appropriate conditions and time. Differential expression of the reporter gene between samples exposed to the agent and control samples identifies agents which modulate the expression of the nucleic acid.

Additional assay formats may be used to monitor the ability of the agent to modulate the expression of a gene identified in Tables 5A-5XX. For instance, as described above, mRNA expression may be monitored directly by hybridization of probes to the nucleic acids of the invention. Cell lines are exposed to the agent to be tested under appropriate conditions and time and total RNA or mRNA is isolated by standard procedures such those disclosed in Sambrook et al. (*Molecular Cloning: A Laboratory Manual, 3d Ed*. Cold Spring Harbor Laboratory Press, Cold Spring Harbor, N.Y., 2001).

In another assay format, cells or cell lines are first identified which express the gene products of the invention physiologically. Cell and/or cell lines so identified would be expected to comprise the necessary cellular machinery such that the fidelity of modulation of the transcriptional apparatus is maintained with regard to exogenous contact of agent with appropriate surface transduction mechanisms and/or the cytosolic cascades. Further, such cells or cell lines may be transduced or transfected with an expression vehicle (e.g., a plasmid or viral vector) construct comprising an operable non-translated 5'-promoter containing end of the structural gene encoding the gene products of Tables 5A-5XX fused to one or more antigenic fragments or other detectable markers, which are peculiar to the instant gene products, wherein said fragments are under the transcriptional control of said promoter and are expressed as polypeptides whose molecular weight can be distinguished from the naturally occurring polypeptides or may further comprise an immunologically distinct or other detectable tag. Such a process is well known in the art (see Sambrook et al., supra).

Cells or cell lines transduced or transfected as outlined above are then contacted with agents under appropriate conditions; for example, the agent comprises a pharmaceutically acceptable excipient and is contacted with cells comprised in an aqueous physiological buffer such as phosphate buffered saline (PBS) at physiological pH, Eagles balanced salt solution (BSS) at physiological pH, PBS or BSS comprising serum or conditioned media comprising PBS or BSS and/or serum incubated at 37° C. Said conditions may be modulated as deemed necessary by one of skill in the art. Subsequent to contacting the cells with the agent, said cells are disrupted and the polypeptides of the lysate are fractionated such that a polypeptide fraction is pooled and contacted with an antibody to be further processed by immunological assay (e.g., ELISA, immunoprecipitation or Western blot). The pool of proteins isolated from the agent-contacted sample is then compared with the control samples (no exposure and exposure to a known toxin) where only the excipient is contacted with the cells and an increase or decrease in the immunologically generated signal from the agent-contacted sample compared to the control is used to distinguish the effectiveness and/or toxic effects of the agent.

Another embodiment of the present invention provides methods for identifying agents that modulate at least one activity of a protein(s) encoded by the genes in Tables 5A-5XX. Such methods or assays may utilize any means of monitoring or detecting the desired activity.

In one format, the relative amounts of a protein (Tables 5A-5XX) between a cell population that has been exposed to the agent to be tested compared to an un-exposed control cell population and a cell population exposed to a known toxin may be assayed. In this format, probes such as specific antibodies are used to monitor the differential expression of the protein in the different cell populations. Cell lines or populations are exposed to the agent to be tested under appropriate conditions and time. Cellular lysates may be prepared from the exposed cell line or population and a control, unexposed cell line or population. The cellular lysates are then analyzed with the probe, such as a specific antibody.

Agents that are assayed in the above methods can be randomly selected or rationally selected or designed. As used herein, an agent is said to be randomly selected when the agent is chosen randomly without considering the specific sequences involved in the association of the a protein of the invention alone or with its associated substrates, binding partners, etc. An example of randomly selected agents is the use a chemical library or a peptide combinatorial library, or a growth broth of an organism.

As used herein, an agent is said to be rationally selected or designed when the agent is chosen on a nonrandom basis which takes into account the sequence of the target site and/or its conformation in connection with the agent's action. Agents can be rationally selected or rationally designed by utilizing the peptide sequences that make up these sites. For example, a rationally selected peptide agent can be a peptide whose amino acid sequence is identical to or a derivative of any functional consensus site.

The agents of the present invention can be, as examples, peptides, small molecules, vitamin derivatives, as well as carbohydrates. Dominant negative proteins, DNAs encoding these proteins, antibodies to these proteins, peptide fragments of these proteins or mimics of these proteins may be introduced into cells to affect function. "Mimic" used herein refers to the modification of a region or several regions of a peptide molecule to provide a structure chemically different from the parent peptide but topographically and functionally similar to the parent peptide (see G. A. Grant in: *Molecular Biology and Biotechnology*, Meyers, ed., pp. 659-664, VCH Publishers, New York, 1995). A skilled artisan can readily recognize that there is no limit as to the structural nature of the agents of the present invention.

Nucleic Acid Assay Formats

The genes identified as being differentially expressed upon exposure to a known hepatotoxin (Tables 5A-5XX) may be used in a variety of nucleic acid detection assays to detect or quantititate the expression level of a gene or multiple genes in a given sample. The genes described in Tables 5A-5XX may also be used in combination with one or more additional genes whose differential expression is associate with toxicity in a cell or tissue. In preferred embodiments, the genes in Tables 5A-5XX may be combined with one or more of the genes described in prior and related applications 60/353,171; 60/363,534; 60/371,135; 60/371,134; 60/370,248; 60/371,150; 60/371,413; 60/373,601; 60/374,139; 60/394,253; 60/378,652; 60/373,602; 60/378,653; 60/378,665; 60/378,370; 60/394,230; 60/407,688; 09/917,800; 10/060,087; PCT/US03/03194, entitled "Molecular Hepatotoxicology Modeling," filed Jan. 31, 2003; and PCT/US01/23872, all of which are incorporated by reference on page 1 of this application.

Any assay format to detect gene expression may be used. For example, traditional Northern blotting, dot or slot blot, nuclease protection, primer directed amplification, RT-PCR, semi- or quantitative PCR, branched-chain DNA and differential display methods may be used for detecting gene expression levels. Those methods are useful for some embodiments of the invention. In cases where smaller numbers of genes are detected, amplification based assays may be most efficient. Methods and assays of the invention, however, may be most efficiently designed with hybridization-based methods for detecting the expression of a large number of genes.

Any hybridization assay format may be used, including solution-based and solid support-based assay formats. Solid supports containing oligonucleotide probes for differentially expressed genes of the invention can be filters, polyvinyl chloride dishes, particles, beads, microparticles or silicon or glass based chips, etc. Such chips, wafers and hybridization methods are widely available, for example, those disclosed by Beattie (WO 95/11755).

Any solid surface to which oligonucleotides can be bound, either directly or indirectly, either covalently or non-covalently, can be used. A preferred solid support is a high density array or DNA chip. These contain a particular oligonucleotide probe in a predetermined location on the array. Each predetermined location may contain more than one molecule of the probe, but each molecule within the predetermined location has an identical sequence. Such predetermined locations are termed features. There may be, for example, from 2, 10, 100, 1000 to 10,000, 100,000 or 400,000 or more of such features on a single solid support. The solid support, or the area within which the probes are attached may be on the order of about a square centimeter. Probes corresponding to the genes of Tables 5A-5XX or from the related applications described above may be attached to single or multiple solid support structures, e.g., the probes may be attached to a single chip or to multiple chips to comprise a chip set.

Oligonucleotide probe arrays for expression monitoring can be made and used according to any techniques known in the art (see for example, Lockhart et al., *Nat Biotechnol* 14:1675-1680 (1996); McGall et al., *Proc Nat Acad Sci* USA 93:13555-13460 (1996)). Such probe arrays may contain at least two or more oligonucleotides that are complementary to or hybridize to two or more of the genes described in Tables 5A-5XX. For instance, such arrays may contain oligonucleotides that are complementary or hybridize to at least 2, 3, 4, 5, 6, 7, 8, 9, 10, 20, 30, 50, 70, 100 or more the genes described herein. Preferred arrays contain all or nearly all of the genes listed in Tables 5A-5XX, or individually, the gene sets of Tables 5A-5XX. In a preferred embodiment, arrays are constructed that contain oligonucleotides to detect all or nearly all of the genes in any one of or all of Tables 5A-5XX on a single solid support substrate, such as a chip.

The sequences of the expression marker genes of Tables 5A-5XX are in the public databases. Table 1 provides the GenBank Accession Number, SEQ ID NO: and GLGC ID No. (Gene Logic reference no.) for each of the sequences, while Table 2 provides identification information for the human homologues of the genes of Tables 1 and 5A-5XX. Table 3 identifies the metabolic pathways in which the genes of Tables 1 and 5A-5XX are believed to function. Table 4 defines the model codes used in Tables 1, 2, 3 and 5A-5XX. The sequences of the genes in GenBank are expressly herein incorporated by reference in their entirely as of the filing date of this application, as are related sequences, for instance, sequences from the same gene of different lengths, variant sequences, polymorphic sequences, genomic sequences of the genes and related sequences from different species, including the human counterparts, where appropriate. These sequences may be used in the methods of the invention or may be used to produce the probes and arrays of the invention. In some embodiments, the genes in Tables 5A-5XX that correspond to the genes or fragments previously associated with a toxic response may be excluded from the Tables.

As described above, in addition to the sequences of the GenBank Accession Nos. and GLGC ID Nos. disclosed in the Tables 5A-5XX, sequences such as naturally occurring variant or polymorphic sequences may be used in the methods and compositions of the invention. For instance, expression levels of various allelic or homologous forms of a gene disclosed in the Tables 5A-5XX may be assayed. Any and all nucleotide variations that do not alter the functional activity of a gene listed in the Tables 5A-5XX, including all naturally occurring allelic variants of the genes herein disclosed, may be used in the methods and to make the compositions (e.g., arrays) of the invention.

Probes based on the sequences of the genes described above may be prepared by any commonly available method. Oligonucleotide probes for screening or assaying a tissue or cell sample are preferably of sufficient length to specifically hybridize only to appropriate, complementary genes or transcripts. Typically the oligonucleotide probes will be at least about 10, 12, 14, 16, 18, 20 or 25 nucleotides in length. In some cases, longer probes of at least 30, 40, or 50 nucleotides will be desirable.

As used herein, oligonucleotide sequences that are complementary to one or more of the genes described in Tables 5A-5XX refer to oligonucleotides that are capable of hybridizing under stringent conditions to at least part of the nucleotide sequences of said genes. Such hybridizable oligonucleotides will typically exhibit at least about 75% sequence identity at the nucleotide level to said genes, preferably about 80% or 85% sequence identity or more preferably about 90% or 95% or more sequence identity to said genes.

"Bind(s) substantially" refers to complementary hybridization between a probe nucleic acid and a target nucleic acid and embraces minor mismatches that can be accommodated by reducing the stringency of the hybridization media to achieve the desired detection of the target polynucleotide sequence.

The terms "background" or "background signal intensity" refer to hybridization signals resulting from non-specific binding, or other interactions, between the labeled target nucleic acids and components of the oligonucleotide array (e.g., the oligonucleotide probes, control probes, the array substrate, etc.). Background signals may also be produced by intrinsic fluorescence of the array components themselves. A single background signal can be calculated for the entire array, or a different background signal may be calculated for each target nucleic acid. In a preferred embodiment, background is calculated as the average hybridization signal intensity for the lowest 5% to 10% of the probes in the array, or, where a different background signal is calculated for each target gene, for the lowest 5% to 10% of the probes for each gene. Of course, one of skill in the art will appreciate that where the probes to a particular gene hybridize well and thus appear to be specifically binding to a target sequence, they should not be used in a background signal calculation. Alternatively, background may be calculated as the average hybridization signal intensity produced by hybridization to probes that are not complementary to any sequence found in the sample (e.g. probes directed to nucleic acids of the opposite sense or to genes not found in the sample such as bacterial genes where the sample is mammalian nucleic acids). Background can also be calculated as the average signal intensity produced by regions of the array that lack any probes at all.

The phrase "hybridizing specifically to" refers to the binding, duplexing, or hybridizing of a molecule substantially to or only to a particular nucleotide sequence or sequences under stringent conditions when that sequence is present in a complex mixture (e.g., total cellular) DNA or RNA.

Assays and methods of the invention may utilize available formats to simultaneously screen at least about 100, preferably about 1000, more preferably about 10,000 and most preferably about 1,000,000 different nucleic acid hybridizations.

As used herein a "probe" is defined as a nucleic acid, capable of binding to a target nucleic acid of complementary sequence through one or more types of chemical bonds, usually through complementary base pairing, usually through hydrogen bond formation. As used herein, a probe may include natural (i.e., A, G, U, C, or T) or modified bases (7-deazaguanosine, inosine, etc.). In addition, the bases in probes may be joined by a linkage other than a phosphodiester bond, so long as it does not interfere with hybridization. Thus, probes may be peptide nucleic acids in which the constituent bases are joined by peptide bonds rather than phosphodiester linkages.

The term "perfect match probe" refers to a probe that has a sequence that is perfectly complementary to a particular target sequence. The test probe is typically perfectly complementary to a portion (subsequence) of the target sequence. The perfect match (PM) probe can be a "test probe", a "normalization control" probe, an expression level control probe and the like. A perfect match control or perfect match probe is, however, distinguished from a "mismatch control" or "mismatch probe."

The terms "mismatch control" or "mismatch probe" refer to a probe whose sequence is deliberately selected not to be perfectly complementary to a particular target sequence. For each mismatch (MM) control in a high-density array there typically exists a corresponding perfect match (PM) probe that is perfectly complementary to the same particular target sequence. The mismatch may comprise one or more bases.

While the mismatch(s) may be located anywhere in the mismatch probe, terminal mismatches are less desirable as a terminal mismatch is less likely to prevent hybridization of the target sequence. In a particularly preferred embodiment, the mismatch is located at or near the center of the probe such that the mismatch is most likely to destabilize the duplex with the target sequence under the test hybridization conditions.

The term "stringent conditions" refers to conditions under which a probe will hybridize to its target subsequence, but with only insubstantial hybridization to other sequences or to other sequences such that the difference may be identified. Stringent conditions are sequence-dependent and will be different in different circumstances. Longer sequences hybridize specifically at higher temperatures. Generally, stringent conditions are selected to be about 5° C. lower than the thermal melting point (Tm) for the specific sequence at a defined ionic strength and pH.

Typically, stringent conditions will be those in which the salt concentration is at least about 0.01 to 1.0 M Na$^+$ ion concentration (or other salts) at pH 7.0 to 8.3 and the temperature is at least about 30° C. for short probes (e.g., 10 to 50 nucleotides). Stringent conditions may also be achieved with the addition of destabilizing agents such as formamide.

The "percentage of sequence identity" or "sequence identity" is determined by comparing two optimally aligned sequences or subsequences over a comparison window or span, wherein the portion of the polynucleotide sequence in the comparison window may optionally comprise additions or deletions (i.e., gaps) as compared to the reference sequence (which does not comprise additions or deletions) for optimal alignment of the two sequences. The percentage is calculated by determining the number of positions at which the identical submit (e.g. nucleic acid base or amino acid residue) occurs in both sequences to yield the number of matched positions, dividing the number of matched positions by the total number of positions in the window of comparison and multiplying the result by 100 to yield the percentage of sequence identity. Percentage sequence identity when calculated using the programs GAP or BESTFIT (see below) is calculated using default gap weights.

Probe Design

One of skill in the art will appreciate that an enormous number of array designs are suitable for the practice of this invention. The high density array will typically include a number of test probes that specifically hybridize to the sequences of interest. Probes may be produced from any region of the genes identified in the Tables and the attached representative sequence listing. In instances where the gene reference in the Tables is an EST, probes may be designed from that sequence or from other regions of the corresponding full-length transcript that may be available in any of the sequence databases, such as those herein described. See WO 99/32660 for methods of producing probes for a given gene or genes. In addition, any available software may be used to produce specific probe sequences, including, for instance, software available from Molecular Biology Insights, Olympus Optical Co. and Biosoft International. In a preferred embodiment, the array will also include one or more control probes.

High density array chips of the invention include "test probes." Test probes may be oligonucleotides that range from about 5 to about 500, or about 7 to about 50 nucleotides, more preferably from about 10 to about 40 nucleotides and most preferably from about 15 to about 35 nucleotides in length. In other particularly preferred embodiments, the probes are 20 or 25 nucleotides in length. In another preferred embodiment, test probes are double or single strand DNA sequences. DNA sequences are isolated or cloned from natural sources or amplified from natural sources using native nucleic acid as templates. These probes have sequences complementary to particular subsequences of the genes whose expression they are designed to detect. Thus, the test probes are capable of specifically hybridizing to the target nucleic acid they are to detect.

In addition to test probes that bind the target nucleic acid(s) of interest, the high density array can contain a number of control probes. The control probes may fall into three categories referred to herein as 1) normalization controls; 2) expression level controls; and 3) mismatch controls.

Normalization controls are oligonucleotide or other nucleic acid probes that are complementary to labeled reference oligonucleotides or other nucleic acid sequences that are added to the nucleic acid sample to be screened. The signals obtained from the normalization controls after hybridization provide a control for variations in hybridization conditions, label intensity, "reading" efficiency and other factors that may cause the signal of a perfect hybridization to vary between arrays. In a preferred embodiment, signals (e.g., fluorescence intensity) read from all other probes in the array are divided by the signal (e.g., fluorescence intensity) from the control probes thereby normalizing the measurements.

Virtually any probe may serve as a normalization control. However, it is recognized that hybridization efficiency varies with base composition and probe length. Preferred normalization probes are selected to reflect the average length of the other probes present in the array, however, they can be selected to cover a range of lengths. The normalization control(s) can also be selected to reflect the (average) base composition of the other probes in the array, however in a preferred embodiment, only one or a few probes are used and they are selected such that they hybridize well (i.e., no secondary structure) and do not match any target-specific probes.

Expression level controls are probes that hybridize specifically with constitutively expressed genes in the biological sample. Virtually any constitutively expressed gene provides a suitable target for expression level controls. Typically expression level control probes have sequences complementary to subsequences of constitutively expressed "housekeeping genes" including, but not limited to the β-actin gene, the glyceraldehyde-3-phosphate dehydrogenase (GADPH) gene, the transferrin receptor gene and the like.

Mismatch controls may also be provided for the probes to the target genes, for expression level controls or for normalization controls. Mismatch controls are oligonucleotide probes or other nucleic acid probes identical to their corresponding test or control probes except for the presence of one or more mismatched bases. A mismatched base is a base selected so that it is not complementary to the corresponding base in the target sequence to which the probe would otherwise specifically hybridize. One or more mismatches are selected such that under appropriate hybridization conditions (e.g., stringent conditions) the test or control probe would be expected to hybridize with its target sequence, but the mismatch probe would not hybridize (or would hybridize to a significantly lesser extent) Preferred mismatch probes contain a central mismatch. Thus, for example, where a probe is a 20 mer, a corresponding mismatch probe will have the identical sequence except for a single base mismatch (e.g., substituting a G, a C or a T for an A) at any of positions 6 through 14 (the central mismatch).

Mismatch probes thus provide a control for non-specific binding or cross hybridization to a nucleic acid in the sample other than the target to which the probe is directed. For example, if the target is present the perfect match probes should be consistently brighter than the mismatch probes. In addition, if all central mismatches are present, the mismatch probes can be used to detect a mutation, for instance, a mutation of a gene in the accompanying Tables 5A-5XX. The difference in intensity between the perfect match and the mismatch probe provides a good measure of the concentration of the hybridized material.

Nucleic Acid Samples

Cell or tissue samples may be exposed to the test agent in vitro or in vivo. When cultured cells or tissues are used, appropriate mammalian liver extracts may also be added with the test agent to evaluate agents that may require biotransformation to exhibit toxicity. In a preferred format, primary isolates of animal or human hepatocytes which already express the appropriate complement of drug-metabolizing enzymes may be exposed to the test agent without the addition of mammalian liver extracts.

The genes which are assayed according to the present invention are typically in the form of mRNA or reverse transcribed mRNA. The genes may be cloned or not. The genes may be amplified or not. The cloning and/or amplification do not appear to bias the representation of genes within a population. In some assays, it may be preferable, however, to use polyA+ RNA as a source, as it can be used with less processing steps.

As is apparent to one of ordinary skill in the art, nucleic acid samples used in the methods and assays of the invention may be prepared by any available method or process. Methods of isolating total mRNA are well known to those of skill in the art. For example, methods of isolation and purification of nucleic acids are described in detail in Chapter 3 of *Laboratory Techniques in Biochemistry and Molecular Biology,*

Vol. 24, Hybridization With Nucleic Acid Probes: Theory and Nucleic Acid Probes, P. Tijssen, Ed., Elsevier Press, New York, 1993. Such samples include RNA samples, but also include cDNA synthesized from a mRNA sample isolated from a cell or tissue of interest. Such samples also include DNA amplified from the cDNA, and RNA transcribed from the amplified DNA. One of skill in the art would appreciate that it is desirable to inhibit or destroy RNase present in homogenates before homogenates are used.

Biological samples may be of any biological tissue or fluid or cells from any organism as well as cells raised in vitro, such as cell lines and tissue culture cells. Frequently the sample will be a tissue or cell sample that has been exposed to a compound, agent, drug, pharmaceutical composition, potential environmental pollutant or other composition. In some formats, the sample will be a "clinical sample" which is a sample derived from a patient. Typical clinical samples include, but are not limited to, sputum, blood, blood-cells (e.g., white cells), tissue or fine needle biopsy samples, urine, peritoneal fluid, and pleural fluid, or cells therefrom.

Biological samples may also include sections of tissues, such as frozen sections or formalin fixed sections taken for histological purposes.

Forming High Density Arrays

Methods of forming high density arrays of oligonucleotides with a minimal number of synthetic steps are known. The oligonucleotide analogue array can be synthesized on a single or on multiple solid substrates by a variety of methods, including, but not limited to, light-directed chemical coupling, and mechanically directed coupling (see Pirrung, U.S. Pat. No. 5,143,854).

In brief, the light-directed combinatorial synthesis of oligonucleotide arrays on a glass surface proceeds using automated phosphoramidite chemistry and chip masking techniques. In one specific implementation, a glass surface is derivatized with a silane reagent containing a functional group, e.g., a hydroxyl or amine group blocked by a photolabile protecting group. Photolysis through a photolithographic mask is used selectively to expose functional groups which are then ready to react with incoming 5' photoprotected nucleoside phosphoramidites. The phosphoramidites react only with those sites which are illuminated (and thus exposed by removal of the photolabile blocking group). Thus, the phosphoramidites only add to those areas selectively exposed from the preceding step. These steps are repeated until the desired array of sequences have been synthesized on the solid surface. Combinatorial synthesis of different oligonucleotide analogues at different locations on the array is determined by the pattern of illumination during synthesis and the order of addition of coupling reagents.

In addition to the foregoing, additional methods which can be used to generate an array of oligonucleotides on a single substrate are described in PCT Publication Nos. WO 93/09668 and WO 01/23614. High density nucleic acid arrays can also be fabricated by depositing pre-made or natural nucleic acids in predetermined positions. Synthesized or natural nucleic acids are deposited on specific locations of a substrate by light directed targeting and oligonucleotide directed targeting. Another embodiment uses a dispenser that moves from region to region to deposit nucleic acids in specific spots.

Hybridization

Nucleic acid hybridization simply involves contacting a probe and target nucleic acid under conditions where the probe and its complementary target can form stable hybrid duplexes through complementary base pairing. See WO 99/32660. The nucleic acids that do not form hybrid duplexes are then washed away leaving the hybridized nucleic acids to be detected, typically through detection of an attached detectable label. It is generally recognized that nucleic acids are denatured by increasing the temperature or decreasing the salt concentration of the buffer containing the nucleic acids. Under low stringency conditions (e.g., low temperature and/or high salt) hybrid duplexes (e.g., DNA:DNA, RNA:RNA, or RNA:DNA) will form even where the annealed sequences are not perfectly complementary. Thus, specificity of hybridization is reduced at lower stringency. Conversely, at higher stringency (e.g., higher temperature or lower salt) successful hybridization tolerates fewer mismatches. One of skill in the art will appreciate that hybridization conditions may be selected to provide any degree of stringency.

In a preferred embodiment, hybridization is performed at low stringency, in this case in 6×SSPET at 37° C. (0.005% Triton X-100), to ensure hybridization and then subsequent washes are performed at higher stringency (e.g., 1×SSPET at 37° C.) to eliminate mismatched hybrid duplexes. Successive washes may be performed at increasingly higher stringency (e.g., down to as low as 0.25×SSPET at 37° C. to 50° C.) until a desired level of hybridization specificity is obtained. Stringency can also be increased by addition of agents such as formamide. Hybridization specificity may be evaluated by comparison of hybridization to the test probes with hybridization to the various controls that can be present (e.g., expression level control, normalization control, mismatch controls, etc.).

In general, there is a tradeoff between hybridization specificity (stringency) and signal intensity. Thus, in a preferred embodiment, the wash is performed at the highest stringency that produces consistent results and that provides a signal intensity greater than approximately 10% of the background intensity. Thus, in a preferred embodiment, the hybridized array may be washed at successively higher stringency solutions and read between each wash. Analysis of the data sets thus produced will reveal a wash stringency above which the hybridization pattern is not appreciably altered and which provides adequate signal for the particular oligonucleotide probes of interest.

Signal Detection

The hybridized nucleic acids are typically detected by detecting one or more labels attached to the sample nucleic acids. The labels may be incorporated by any of a number of means well known to those of skill in the art. See WO 99/32660.

Databases

The present invention includes relational databases containing sequence information, for instance, for the genes of Tables 5A-5XX, as well as gene expression information from tissue or cells exposed to various standard toxins, such as those herein described (see Tables 5A-5XX). Databases may also contain information associated with a given sequence or tissue sample such as descriptive information about the gene associated with the sequence information (see Tables 1, 2 and 3), or descriptive information concerning the clinical status of the tissue sample, or the animal from which the sample was derived. The database may be designed to include different parts, for instance a sequence database and a gene expression database. Methods for the configuration and construction of such databases and computer-readable media to which such databases are saved are widely available, for instance, see U.S. Pat. No. 5,953,727, which is herein incorporated by reference in its entirety.

The databases of the invention may be linked to an outside or external database such as GenBank (www.ncbi.nlm.nih.gov/entrez.index.html); KEGG (www.genome.adjp/kegg); SPAD (www.grt.kyushu-u.ac.jp/spad/index.html); HUGO (www.gene.ucl.ac.uk/hugo); Swiss-Prot (www expasy.ch.sprot); Prosite (www expasy.ch/tools/scnpsit1.html); OMIM (www.nebi.nlm.nih.gov/omim); LocusLink (www.ncbi.nlm.nih.gov/LocusLink/); RefSeq (www.ncbi.nlm.nih.gov/LocusLink/refseq.html) and GDB (www.gdb.org). In a preferred embodiment, as described in Tables 1-3, the external database is GenBank and the associated databases maintained by the National Center for Biotechnology Information (NCBI) (www.ncbi.nlm.nih.gov).

Any appropriate computer platform, user interface, etc. may be used to perform the necessary comparisons between sequence information, gene expression information and any other information in the database or information provided as an input. For example, a large number of computer workstations are available from a variety of manufacturers, such has those available from Silicon Graphics. Client/server environments, database servers and networks are also widely available and appropriate platforms for the databases of the invention.

The databases of the invention may be used to produce, among other things, electronic Northerns that allow the user to determine the cell type or tissue in which a given gene is expressed and to allow determination of the abundance or expression level of a given gene in a particular tissue or cell.

The databases of the invention may also be used to present information identifying the expression level in a tissue or cell of a set of genes comprising one or more of the genes in Tables 5A-5XX, comprising the step of comparing the expression level of at least one gene in Tables 5A-5XX in a cell or tissue exposed to a test agent to the level of expression of the gene in the database. Such methods may be used to predict the toxic potential of a given compound by comparing the level of expression of a gene or genes in Tables 5A-5XX from a tissue or cell sample exposed to the test agent to the expression levels found in a control tissue or cell samples exposed to a standard toxin or hepatotoxin such as those herein described. Such methods may also be used in the drug or agent screening assays as described herein.

Kits

The invention further includes kits combining, in different combinations, high-density oligonucleotide arrays, reagents for use with the arrays, protein reagents encoded by the genes of the Tables, signal detection and array-processing instruments, gene expression databases and analysis and database management software described above. The kits may be used, for example, to predict or model the toxic response of a test compound, to monitor the progression of hepatic disease states, to identify genes that show promise as new drug targets and to screen known and newly designed drugs as discussed above.

The databases packaged with the kits are a compilation of expression patterns from human or laboratory animal genes and gene fragments (corresponding to the genes of Tables 5A-5XX). In particular, the database software and packaged information that may contain the databases saved to a computer-readable medium include the expression results of Tables 5A-5XX that can be used to predict toxicity of a test agent by comparing the expression levels of the genes of Tables 5A-5XX induced by the test agent to the expression levels presented in Tables 5A-5XX. In another format, database and software information may be provided in a remote electronic format, such as a website, the address of which may be packaged in the kit.

The kits may used in the pharmaceutical industry, where the need for early drug testing is strong due to the high costs associated with drug development, but where bioinformatics, in particular gene expression informatics, is still lacking. These kits will reduce the costs, time and risks associated with traditional new drug screening using cell cultures and laboratory animals. The results of large-scale drug screening of pre-grouped patient populations, pharmacogenomics testing, can also be applied to select drugs with greater efficacy and fewer side-effects. The kits may also be used by smaller biotechnology companies and research institutes who do not have the facilities for performing such large-scale testing themselves.

Databases and software designed for use with use with microarrays is discussed in Balaban et al., U.S. Pat. No. 6,229,911, a computer-implemented method for managing information, stored as indexed tables, collected from small or large numbers of microarrays, and U.S. Pat. No. 6,185,561, a computer-based method with data mining capability for collecting gene expression level data, adding additional attributes and reformatting the data to produce answers to various queries. Chee et al., U.S. Pat. No. 5,974,164, discloses a software-based method for identifying mutations in a nucleic acid sequence based on differences in probe fluorescence intensities between wild type and mutant sequences that hybridize to reference sequences.

Without further description, it is believed that one of ordinary skill in the art can, using the preceding description and the following illustrative examples, make and utilize the compounds of the present invention and practice the claimed methods. The following working examples therefore, specifically point out the preferred embodiments of the present invention, and are not to be construed as limiting in any way the remainder of the disclosure.

EXAMPLES

Example 1

Identification of Toxicity Markers in Rat Hepatocytes

To evaluate their toxicity, the hepatotoxins alpha-naphthylisothiocyante (ANIT), acetaminophen (APAP), AY-25329, carbon tetrachloride, clofibrate, diclofenac, 17α-ethinylestradiol, hydrazine, indomethacin, lipopolysaccharide, lovastatin, methotrexate, tacrine, valproate and control compositions were administered to cultures of primary rat hepatocytes from male Sprague-Dawley rats at various time points using administration diluents, protocols and dosing regimes as previously described in the art and in the prior applications discussed above, as well as in Table 6. Laboratory protocols for the administration of the hepatotoxins amiodarone, carbamazepine, chlorpromazine, CI-1000, CPA, diflunisal, DMN, gemfibrozil, imipramine, phenobarbital, tamoxifen, tetracycline and Wy-14643 also appear in Table 6. Identification of toxicity markers was performed by microarray analysis and by the AlamarBlue® assay, a classical measure of cytotoxicity. The AlamarBlue® assay was performed in triplicate.

The source of the primary rat hepatocytes was Sprague Dawley Outbred CDs Rats (CRL:CD®[SD] IGS BR, Charles River Laboratories). Hepatocyte cultures were obtained in 24-well matrigel coated plates for the AlamarBlue® assay (175,000 cells/cm$^2$) or in T-75 cm$^2$ matrigel coated flasks for RNA isolation for microarray analysis (187,000 cells/cm$^2$). Primary rat hepatocytes were received the day after the cells were removed from the animals. After arrival, the cells, the cells were incubated overnight (~15 hrs) before the toxin was added to the cultures. The vehicle used in the toxicity experiments was HIM culture medium (Hepatocyte Incubation Medium, In Vitro Technologies Cat. No. Z90009) containing 0.2% DMSO (Sigma Cat. No. D-5879). Toxin or vehicle was administered to hepatocyte cultures as follows. For each treatment, i.e., vehicle alone, vehicle+toxin at low dose, or vehicle+toxin at high dose, cells were harvested after 3, 6 and 24-hour incubations with the toxin solution or with the vehicle.

The AlamarBlue® assay was performed as follows, using only the 24-hour time point samples.
1. Primary rat hepatocyte cultures were prepared as described above in a matrigel-coated plates at 175,000 cells/cm$^2$.
2. The culture medium (HIM) was removed from each well and replaced with 500 µl of fresh HIM following arrival of the cells, and the cells were incubated overnight (approximately 15 hrs) at 37° C., 5% CO$_2$.
3. The next day, the HIM was removed and 500 µl of the medium containing either vehicle or a dose of toxin was added.
4. Lysis solution was used as a negative control. 450 µl medium+50 µl 9% Triton X100 were added to each of 3 wells containing cells, for a final Triton concentration of 1%.
5. The cells in all wells were incubated for 24 hours at 37° C., 5% CO$_2$.
6. HIM medium was removed, and a solution containing 500 µl of fresh HIM medium+50 µl AlamarBlue® (BioSource International, Inc., Cat. No. DAL1100) was added to each well.
7. The cells were incubated at 37° C., 5% CO$_2$ for 2 hours.
8. 100 µl medium was removed from each well of the 24-well plate and added to a well of a 96-well plate. The fluorescence was measured using 544 nm as the excitation and 590 nm as the emission on a Molecular Devices, SpectraMax Gemini, Softmax pro 2.6.1. Alternatively, two absorbance readings can be measured for the oxidized (600 nm) and the reduced (570 nm) form of AlamarBlueg. After obtaining absorbance readings, results were calculated according to the manufacturer's protocol provided in the product description.
9. The data were evaluated to determine whether or not the toxin reduced cell viability. If so, the dose of the toxin that reduced cell viability by ~10-20% was determined.

Collection of RNA from Rat Hepatocytes

More than 10$^7$ cells are typically prepared for each sample. RNA was collected at 3, 6 and 24 hours following addition of the toxin according to the following procedure.

The medium from the flasks was discarded, and the cells were washed once with 20 ml of warm (37° C.) RPMI-1640+ 10 mM HEPES medium (Life Technologies, Cat. No. 22400-089). 12 ml of Trizol (Life Technologies, Cat. No. 15596-018) was placed immediately into each T-75 flask. Each flask contained ~10-20 million cells. The contents of each flask were mixed vigorously for one minute with a vortex mixer and then aspirated up and down 5 times with a pipette. The contents of each flask (~12 ml each) was collected into a 50 ml conical polypropylene tissue culture tube (Falcon), snap frozen in liquid nitrogen and stored at ≦-86° C.

Microarray sample preparation was conducted with minor modifications, following the protocols set forth in the Affymetrix GeneChip® Expression Analysis Manual. Frozen cells were ground to a powder using a Spex Certiprep 6800 Freezer Mill. Total RNA was extracted with Trizol (GibcoBRL) utilizing the manufacturer's protocol. The total RNA yield for each sample was 200-500 µg per 300 mg cells. mRNA was isolated using the Oligotex mRNA Midi kit (Qiagen) followed by ethanol precipitation. Double stranded cDNA was generated from mRNA using the SuperScript Choice system (GibcoBRL). First strand cDNA synthesis was primed with a T7-(dT24) oligonucleotide. The cDNA was phenol-chloroform extracted and ethanol precipitated to a final concentration of 1 µg/ml. From 2 µg of cDNA, cRNA was synthesized using Ambion's T7 MegaScript in vitro Transcription Kit.

To biotin label the cRNA, nucleotides Bio-11-CTP and Bio-16-UTP (Enzo Diagnostics) were added to the reaction. Following a 37° C. incubation for six hours, impurities were removed from the labeled cRNA following the RNeasy Mini kit protocol (Qiagen). cRNA was fragmented (fragmentation buffer consisting of 200 mM Tris-acetate, pH 8.1, 500 mM KOAc, 150 mM MgOAc) for thirty-five minutes at 94° C. Following the Affymetrix protocol, 55 µg of fragmented cRNA was hybridized on the Affymetrix rat array set for twenty-four hours at 60 rpm in a 45° C. hybridization oven. The chips were washed and stained with Streptavidin Phycoerythrin (SAPE) (Molecular Probes) in Affymetrix fluidics stations. To amplify staining, SAPE solution was added twice with an anti-streptavidin biotinylated antibody (Vector Laboratories) staining step in between. Hybridization to the probe arrays was detected by fluorometric scanning (Hewlett Packard Gene Array Scanner). Data was analyzed using Affymetrix GeneChip® version 3.0 and Expression Data Mining Tool (EDMT) software (version 1.0), S-Plus, and the GeneExpress® software system.

Differential expression of genes between the toxin-exposed and control samples corresponding to patterns indicative of toxicity was determined using the following criteria.

Table 1 discloses those genes that are differentially expressed upon exposure to the named toxins with their corresponding SEQ ID NOS:, GenBank Accession or RefSeq ID Nos., GLGC ID Nos. (internal Gene Logic identification nos.), gene names and Unigene Sequence Cluster titles. The metabolic pathways in which the genes of Table 1 function are indicated in Table 3, and the corresponding human homologues are given in Table 2. The model codes, identified in Table 4, represent the various toxicity or liver pathology states associated with differential expression of each gene, as well as the individual toxin types associated with differential expression of each gene.

Tables 5A-5XX disclose the summary statistics for each of the comparisons performed. Each of these tables contains a set of predictive genes and creates a model for predicting the hepatoxicity of an unknown, i.e., untested compound. Each gene is identified by its Gene Logic identification number and can be cross-referenced to a gene name and representative SEQ ID NO. in Table 1. For each comparison of gene expression levels between samples in the toxicity group ("Tox" samples, i.e., samples affected by exposure to a specific toxin) and samples in the non-toxicity group ("Non-tox" samples, i.e., samples not affected by exposure to that same specific toxin), the group mean for Tox samples is the mean signal intensity, as normalized for the various chip parameters that are being assayed. The Non-tox mean represents the mean signal intensity, as normalized for the various chip parameters that are being assayed, in samples other than those treated with the high dose of the specific toxin. These samples were treated with a low dose of the specific toxin, or with vehicle alone, or with a different toxin. Tox samples were obtained from treated cells processed at the timepoint(s) indicated in the tables, while Non-tox samples were obtained from control cells processed at all time points in the experiments. For individual genes, an increase in the Tox group mean compared to the Non-tox group mean indicates up-regulation upon exposure to a toxin. Conversely, a decrease in the Tox group mean compared to the Non-tox group mean indicates down-regulation.

The mean values are derived from Average Difference (AveDiff) values for a particular gene, averaged across the corresponding samples. Each individual Average Difference value is calculated by integrating the intensity information from multiple probe pairs that are tiled for a particular fragment. The normalization multiplies each expression intensity for a given experiment (chip) by a global scaling factor. The intent of this normalization is to make comparisons of individual genes between chips possible. The scaling factor is calculated as follows:

1. From all the unnormalized expression values in the experiment, delete the largest 2% and smallest 2% of the values. That is, if the experiment yields 10,000 expression values, order the values and delete the smallest 200 and the largest 200.
2. Compute the trimmed mean, which is equal to the mean of the remaining values.
3. Compute the scale factor SF=100/(trimmed mean)

The value of 100 used here is the standard target value used. Some AveDiff values may be negative due to the general noise involved in nucleic acid hybridization experiments. Although many conclusions can be made corresponding to a negative value on the GeneChip platform, it is difficult to assess the meaning behind the negative value for individual fragments. Our observations show that, although negative values are observed at times within the predictive gene set, these values reflect a real biological phenomenon that is highly reproducible across all the samples from which the measurement was taken. For this reason, those genes that exhibit a negative value are included in the predictive set. It should be noted that other platforms of gene expression measurement may be able to resolve the negative numbers for the corresponding genes. The predictive ability of each of those genes should extend across platforms, however. Each mean value is accompanied by the standard deviation for the mean.

The linear discriminant analysis score (discriminant score), as disclosed in the tables, measures the ability of each gene to predict whether or not a sample is toxic. The discriminant score is calculated by the following steps:

Calculation of a Discriminant Score

Let $X_i$ represent the AveDiff values for a given gene across the Group 1 samples, i=1 . . . n.

Let $Y_i$ represent the AveDiff values for a given gene across the Group 2 samples, i=1 . . . t.

The calculations proceed as follows:

Calculate mean and standard deviation for $X_i$'s and $Y_i$'s, and denote these by $m_X$, $m_Y$, $s_X$, $s_Y$.

For all $X_i$'s and $Y_i$'s, evaluate the function $f(z)=((1/s_Y)*\exp(-0.5*((z-m_Y)/s_Y)^2))/(((1/s_Y)*\exp(-0.5*((z-m_Y)/s_Y)^2))+((1/s_X)*\exp(-0.5*((z-m_X)/s_X)^2)))$.

The number of correct predictions, say P, is then the number of $Y_i$'s such that $f(Y_i)>0.5$ plus the number of $X_i$'s such that $f(X_i)<0.5$.

The discriminant score is then P/(n+t).

Linear discriminant analysis uses both the individual measurements of each gene and the calculated measurements of all combinations of genes to classify samples. For each gene, a weight is derived from the mean and standard deviation of the Tox and Non-tox sample groups. Every gene is multiplied by a weight and the sum of these values results in a collective discriminate score. This discriminant score is then compared against collective centroids of the Tox and Non-tox groups. These centroids are the average of all tox and nontox samples respectively. Therefore, each gene contributes to the overall prediction. This contribution is dependent on weights that are large positive or negative numbers if the relative distances between the Tox and Non-tox samples for that gene are large and small numbers if the relative distances are small. The discriminant score for each unknown sample and centroid values can be used to calculate a probability between zero and one as to the group in which the unknown sample belongs.

Example 2

General Toxicity Modeling

Samples were selected for grouping into Tox and Non-tox groups by examining each study individually with Principal Components Analysis (PCA) to determine which treatments had an observable response. Only sample groups where confidence of the tox-responding or non-tox-responding status (expression level affected by exposure to a specific toxin or expression level not affected by exposure to a specific toxin, respectively) was established were included in building a general toxicity prediction model.

Linear discriminant models were generated to describe Tox and Non-tox samples. The top discriminant genes and/or EST's were used to determine toxicity by calculating each gene's contribution with homo and heteroscedastic treatment of variance and inclusion or exclusion of mutual information between genes. Prediction of samples within the database exceeded 80% true positives with a false positive rate of less than 5%. It was determined that combinations of genes and/or EST's generally provided a better prediction than individual genes and that the more genes and/or EST used, the better the prediction. Although the preferred embodiment includes fifty or more genes, many pairings or larger combinations of genes and/or EST can work better than individual genes. All combinations of two or more genes from the selected list could be used to predict toxicity. These combinations could be selected by pairing in an agglomerate, divisive, or random approach. Further, as yet undetermined genes and/or EST's could be combined with individual or a set of genes and/or EST's described here to increase predictive ability. However, the genes and/or EST's described here would contribute most of the predictive ability to any such undetermined combinations.

Other variations on the above method can provide adequate predictive ability. These include selective inclusion of components via agglomerate, divisive, or random approaches or extraction of loading and combining them in agglomerate, divisive, or random approaches. Also the use of composite variables in logistic regression to determine classification of samples can also be accomplished with linear discriminate analysis, neural or Bayesian networks, or other forms of regression and classification based on categorical or continual dependent and independent variables.

Example 3

Modeling Methods

The above modeling methods provide broad approaches of combining the expression of genes to predict sample toxicity. One could also provide no weight in a simple voting method or determine weights in a supervised or unsupervised method using agglomerate, divisive, or random approaches. All or selected combinations of genes may be combined in ordered, agglomerate, or divisive, supervised or unsupervised clustering algorithms with unknown samples for classification. Any form of correlation matrix may also be used to classify unknown samples. The spread of the group distribution and discriminate score alone provide enough information to enable a skilled person to generate all of the above types of models with accuracy that can exceed the discriminate ability of individual genes. Some examples of methods that could be used individually or in combination after transformation of data types include but are not limited to: Discriminant Analysis, Multiple Discriminant Analysis, logistic regression, multiple regression analysis, linear regression analysis, conjoint analysis, canonical correlation, hierarchical cluster analysis, k-means cluster analysis, self-organizing maps, multidimensional scaling, structural equation modeling, support vector machine determined boundaries, factor analysis, neural networks, bayesian classifications, and resampling methods.

Example 4

Grouping of Individual Compound and Pathology Classes

Samples were grouped into individual pathology classes based on known toxicological responses and observed clinical chemical and pathology measurements or into observable toxicity produced by a compound (Tables 5A-5XX). The top 10, 25, 50, 100 genes based on individual discriminate scores were used in a model to ensure that a combination of genes provided a better prediction than individual genes. As described above, all combinations of two or more genes from this list could potentially provide better prediction than individual genes when selected in any order or by ordered, agglomerate, divisive, or random approaches. In addition, combining these genes with other genes could provide better predictive ability, but most of this predictive ability would come from the genes listed herein.

A sample may be considered a Tox sample if it scores positive in any pathological or individual compound class represented here, or in any modeling method mentioned under general toxicology models, based on a combination of the sample's time point and dosage group in a study using an individual compound (with known or potentially toxic properties) by comparisons obtainable from the data. The pathological groupings and early and late phase models are preferred examples of all obtainable combinations of sample time and dose points. Most logical groupings with one or more genes and one or more sample dose and time points should produce better predictions of general toxicity, pathological specific toxicity, or similarity to a known toxin than individual genes.

Although the present invention has been described in detail with reference to examples above, it is understood that various modifications can be made without departing from the spirit of the invention. Accordingly, the invention is limited only by the following claims. All cited patents, patent applications and publications referred to in this application are herein incorporated by reference in their entirety.

TABLE 1

| SEQ ID NO. | GLGC ID NO. | GenBank Acc. or RefSeq ID No. | Model Code | Known Gene Name | Unigene Sequence Cluster Title |
| --- | --- | --- | --- | --- | --- |
| 29 | 16901 | AA799479 | r | HHs:NADH dehydrogenase (ubiquinone) Fe—S protein 8 (23 kD) (NADH-coenzyme Q reductase) | ESTs, Highly similar to NUIM_HUMAN NADH-ubiquinone oxidoreductase 23 kDa subunit, mitochondrial precursor (Complex I-23 KD) (CI-23 KD) (TYKY subunit) [*H. sapiens*] |
| 196 | 16756 | AA818089 | q, z | HHs:glycyl-tRNA synthetase | ESTs, Highly similar to SYG_HUMAN Glycyl-tRNA synthetase (Glycine--tRNA ligase) (GlyRS) [*H. sapiens*] |
| 231 | 5331 | AA818996 | ii, rr | HHs:glutaminyl-tRNA synthetase | ESTs, Moderately similar to SYQ_HUMAN Glutaminyl-tRNA synthetase (Glutamine--tRNA ligase) (GLNRS) [*H. sapiens*] |
| 735 | 12031 | AA893860 | General | HHs:threonyl-tRNA synthetase | ESTs, Moderately similar to SYTC_HUMAN Threonyl-tRNA synthetase, cytoplasmic (Threonine--tRNA ligase) (ThrRS) [*H. sapiens*] |
| 913 | 10569 | AA942681 | n, z, General | HHs:ATPase, H+ transporting, lysosomal 50/57 kD V1 subunit H | ESTs, Highly similar to VATH_HUMAN Vacuolar ATP synthase subunit H (V-ATPase H subunit) (Vacuolar proton pump H subunit) (V-ATPase 50/57 kDa subunits) (Vacuolar proton pump subunit SFD) (CGI-11) [*H. sapiens*] |
| 991 | 22283 | AA945172 | mm | HHs:leucine aminopeptidase 3 | ESTs, Highly similar to AMPL_HUMAN Cytosol aminopeptidase (Leucine aminopeptidase) (LAP) (Leucyl aminopeptidase) (Proline aminopeptidase) (Prolyl aminopeptidase) [*H. sapiens*] |
| 1202 | 16625 | AA998062 | j | HHs:Alg5, *S. cerevisiae*, homolog of | ESTs, Highly similar to T51776 dolichyl-phosphate beta-glucosyltransferase (EC 2.4.1.117) [imported] - human [*H. sapiens*] |
| 1305 | 22056 | AI008066 | p, mm | HHs:ubiquinol-cytochrome c reductase hinge protein | ESTs, Moderately similar to UCRH_HUMAN Ubiquinol-cytochrome C reductase complex 11 kDa protein, mitochondrial precursor (Mitochondrial hinge protein) (Cytochrome C1, nonheme 11 kDa protein) (Complex III subunit VIII) [*H. sapiens*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1667 | 10138 | AI059048 | m | HHs:Sp3 transcription factor | EST, Highly similar to SP3_HUMAN TRANSCRIPTION FACTOR SP3 (SPR-2) [H. sapiens] |
| 1753 | 16058 | AI071490 | General, vv | HHs:serine palmitoyltransferase, long chain base subunit 2 | ESTs, Highly similar to JC5180 serine C-palmitoyltransferase (EC 2.3.1.50) Lcb2 chain - mouse [M. musculus] |
| 1957 | 18278 | AI105080 | m | HHs:3-oxoacid CoA transferase | ESTs, Highly similar to SCOT_HUMAN Succinyl-CoA:3-ketoacid-coenzyme A transferase, mitochondrial precursor (Succinyl CoA:3-oxoacid CoA-transferase) [H. sapiens] |
| 2143 | 17027 | AI170679 | xx | HHs:UDP-glucose pyrophosphorylase 2 | ESTs, Highly similar to UDP-glucose pyrophosphorylase 2; UTP-glucose-1-phosphate uridyltransferase; UDP-glucose diphosphorylase; UGPase 2 [Homo sapiens] [H. sapiens] |
| 2434 | 3376 | AI179755 | w | HHs:Rho guanine nucleotide exchange factor (GEF) 5 | ESTs, Highly similar to Rho guanine nucleotide exchange factor 5; oncogene TIM; transforming immortalized mammary oncogene; guanine nucleotide regulatory protein TIM [Homo sapiens] [H. sapiens] |
| 2865 | 4714 | AI639518 | k, ww, xx | HHs:polymerase (RNA) II (DNA directed) polypeptide H | ESTs, Highly similar to S55370 RNA polymerase II chain hRPB17 - human [H. sapiens] |
| 3524 | 23424 | NM_021680 | x, z | HHs:alanyl-tRNA synthetase | ESTs, Highly similar to SYA_HUMAN Alanyl-tRNA synthetase (Alanine--tRNA ligase) (AlaRS) [H. sapiens] |
| 4301 | 242 | NM_145683 | u | HHs:protein tyrosine phosphatase, non-receptor type 7 | Rattus norvegicus cytosolic protein tyrosine phosphatase HePTP/LC-PTP mRNA, complete cds |
| 885 | 16945 | AA925541 | c | heterogeneous nuclear ribonucleoprotein L | heterogeneous nuclear ribonucleoprotein L |
| 886 | 17513 | AA925554 | h, u | succinate dehydrogenase complex, subunit A, flavoprotein (Fp) | succinate dehydrogenase complex, subunit A, flavoprotein (Fp) |
| 1354 | 22748 | AI009786 | gg, hh | ribosomal protein L41 | ribosomal protein L41 |
| 2879 | 18456 | D00688 | bb | monoamine oxidaseA | ESTs, Highly similar to 1903159A monoamine oxidase A [Rattus norvegicus] [R. norvegicus] |
| 2943 | 24513 | J02705 | v | Oncomodulin | Oncomodulin |
| 3078 | 24504 | NM_012574 | k | Glutamate receptor, ionotropic, N-methyl D-aspartate 2B | Glutamate receptor, ionotropic, N-methyl D-aspartate 2B |
| 3084 | 24735 | NM_012596 | pp | Leptin receptor (fatty) | Leptin receptor (fatty) |
| 3288 | 1561 | NM_016995 | d, v, uu | Complement component 4 binding protein, beta | Complement component 4 binding protein, beta |
| 3296 | 6598 | NM_017020 | j, n, xx | Interleukin 6 receptor | Interleukin 6 receptor |
| 3485 | 235 | NM_019347 | ii | Urea transporter, solute carrier family 14, member 2 | Urea transporter |
| 3680 | 22282 | NM_024394 | h, m, General, uu | 5-Hydroxytryptamine (serotonin) receptor 3A | 5-Hydroxytryptamine (serotonin) receptor 3A |
| 3728 | 301 | NM_031049 | jj | 2,3-oxidosqualene: lanosterol cyclase | 2,3-oxidosqualene: lanosterol cyclase |
| 3728 | 302 | NM_031049 | jj | 2,3-oxidosqualene: lanosterol cyclase | 2,3-oxidosqualene: lanosterol cyclase |
| 3728 | 303 | NM_031049 | k, jj | 2,3-oxidosqualene: lanosterol cyclase | 2,3-oxidosqualene: lanosterol cyclase |
| 3880 | 13186 | NM_031755 | n | carcinoembryonic antigen-related cell adhesion molecule | carcinoembryonic antigen-related cell adhesion molecule |
| 4143 | 13424 | NM_080899 | ww | inhibitor of kappa light polypeptide enhancer in B cells, kinase complex associated protein | inhibitor of kappa light polypeptide enhancer in B cells, kinase complex-associated protein |
| 4145 | 24604 | NM_080906 | r, pp | HIF-1 responsive RTP801 | HIF-1 responsive RTP801 |
| 4153 | 17512 | NM_130428 | w | succinate dehydrogenase complex, subunit A, flavoprotein (Fp) | succinate dehydrogenase complex, subunit A, flavoprotein (Fp) |
| 4396 | 1359 | U78977 | mm | ATPase, Class II, type 9A | ATPase, Class II, type 9A |
| 3445 | 18362 | NM_019187 | n, ff | Coenzyme Q (ubiquinone) | Coenzyme Q (ubiquinone) |
| 3709 | 25476 | NM_031009 | xx | angiotensin II type-1 receptor | angiotensin II type-1 receptor |
| 12 | 21815 | AA686423 | o | | ESTs, Highly similar to T46390 hypothetical protein DKFZp434C1920.1 - human (fragment) [H. sapiens] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 18 | 3636 | AA799336 | qq | | ESTs, Moderately similar to T00741 NADH dehydrogenase (ubiquinone) (EC 1.6.5.3) acyl carrier chain, mitochondrial - human (fragment) [*H. sapiens*] |
| 23 | 20957 | AA799440 | ff | | ESTs, Moderately similar to L13 protein [*Homo sapiens*] [*H. sapiens*] |
| 28 | 19675 | AA799475 | s, oo | | ESTs, Weakly similar to T08700 hypothetical protein DKFZp564G013.1 - human (fragment) [*H. sapiens*] |
| 42 | 16576 | AA799570 | c, u | | ESTs, Highly similar to hypothetical protein FLJ13725; KIAA1930 protein [*Homo sapiens*] [*H. sapiens*] |
| 44 | 20973 | AA799581 | v, General | | ESTs, Moderately similar to Y218_HUMAN Putative deoxyribonuclease KIAA0218 [*H. sapiens*] |
| 50 | 19472 | AA799616 | c, f, p, General, kk | | ESTs, Moderately similar to PTTG_HUMAN Pituitary tumor-transforming gene 1 protein-interacting protein (Pituitary tumor-transforming gene protein binding factor) (PTTG-binding factor) (PBF) [*H. sapiens*] |
| 51 | 20980 | AA799633 | dd, oo | | ESTs, Moderately similar to hypothetical protein MGC13016 [*Homo sapiens*] [*H. sapiens*] |
| 69 | 16730 | AA799766 | I | | ESTs, Moderately similar to JTV1; hypothetical protein PRO0992 [*Homo sapiens*] [*H. sapiens*] |
| 71 | 11531 | AA799773 | d | | ESTs, Weakly similar to A37098 gelation factor ABP-280, long form - human [*H. sapiens*] |
| 91 | 20811 | AA799899 | ee | | ESTs, Highly similar to R5RT18 ribosomal protein L18a, cytosolic [validated] - rat [*R. norvegicus*] |
| 103 | 9202 | AA800053 | c | | ESTs, Highly similar to T08775 hypothetical protein DKFZp586C1620.1 - human (fragment) [*H. sapiens*] |
| 105 | 23329 | AA800126 | tt | | ESTs, Highly similar to I55595 splicing factor - human [*H. sapiens*] |
| 115 | 22918 | AA800243 | o, p, w, ii, rr | | ESTs, Highly similar to CIDA_MOUSE Cell death activator CIDE-A (Cell death-inducing DFFA-like effector A) [*M. musculus*] |
| 120 | 17206 | AA800296 | u | | ESTs, Highly similar to PAP_HUMAN Poly(A) polymerase alpha (PAP) (Polynucleotide adenylyltransferase alpha) [*H. sapiens*] |
| 136 | 17997 | AA800671 | h, p, w, General | | ESTs, Moderately similar to A54854 Ras GTPase activating protein-related protein - human [*H. sapiens*] |
| 149 | 21379 | AA800738 | ll | | ESTs, Highly similar to T160_HUMAN 60 kDa Tat interactive protein (HIV-1 Tat interactive protein) [*H. sapiens*] |
| 155 | 19102 | AA800794 | ww | | ESTs, Highly similar to HT2A_HUMAN Zinc-finger protein HT2A (72 kDa Tat-interacting protein) (Tripartite motif-containing protein 32) [*H. sapiens*] |
| 160 | 10320 | AA800855 | k | | ESTs, ESTs, Highly similar to MLF2_MOUSE Myeloid leukemia factor 2 (Myelodysplasia-myeloid leukemia factor 2) [*M. musculus*] |
| 160 | 17775 | AA800855 | cc | | ESTs, Highly similar to MLF2_MOUSE Myeloid leukemia factor 2 (Myelodysplasia-myeloid leukemia factor 2) [*M. musculus*] |
| 164 | 19440 | AA800946 | ll | | EST, Moderately similar to B Chain B, Crystal Structure Of The D1d2 Sub-Complex From The Human Snrnp Core Domain [*H. sapiens*] |
| 170 | 21437 | AA801230 | z | | ESTs, Highly similar to hypothetical protein MGC19606 [*Homo sapiens*] [*H. sapiens*] |
| 208 | 6332 | AA818406 | u | | ESTs, Highly similar to LSM6_HUMAN U6 snRNA-associated Sm-like protein LSm6 [*H. sapiens*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 232 | 5527 | AA819027 | gg, hh | | ESTs, Highly similar to GLYC_MOUSE Serine hydroxymethyltransferase, cytosolic (Serine methylase) (Glycine hydroxymethyltransferase) (SHMT) [*M. musculus*] |
| 240 | 7208 | AA819337 | t, mm, qq | | ESTs, Highly similar to T47140 hypothetical protein DKFZp761K1115.1 -human (fragment) [*H. sapiens*] |
| 241 | 17024 | AA819356 | j | | ESTs, Moderately similar to hypothetical protein MGC15677 [*Homo sapiens*] [*H. sapiens*] |
| 287 | 19412 | AA849222 | jj | | ESTs, Weakly similar to T46904 hypothetical protein DKFZp761D081.1 - human [*H. sapiens*] |
| 295 | 22933 | AA849763 | y | | ESTs, Moderately similar to Y188_HUMAN Hypothetical protein KIAA0188 [*H. sapiens*] |
| 299 | 18876 | AA849790 | u | | ESTs, Highly similar to hypothetical protein FLJ11773 [*Homo sapiens*] [*H. sapiens*] |
| 301 | 14608 | AA849805 | j, ss | | ESTs, Highly similar to HLA-B associated transcript-5; BAT5 protein [*Homo sapiens*] [*H. sapiens*] |
| 303 | 22071 | AA849843 | uu, ww | | ESTs, Highly similar to T08661 anti-silencing protein ASF1 homolog DKFZp547E2110.1 - human [*H. sapiens*] |
| 331 | 14963 | AA851161 | ii | | ESTs, Highly similar to DYNC_HUMAN Dynactin complex 50 kDa subunit (50 kDa dynein-associated polypeptide) (Dynamitin) (DCTN-50) [*H. sapiens*] |
| 333 | 12769 | AA851192 | a, cc, jj | | ESTs, Highly similar to T46254 hypothetical protein DKFZp761H171.1 - human [*H. sapiens*] |
| 336 | 19187 | AA851230 | General, pp | | ESTs, Moderately similar to hypothetical protein MGC11102 [*Homo sapiens*] [*H. sapiens*] |
| 341 | 3833 | AA851255 | ss | | ESTs, Highly similar to T14743 hypothetical protein DKFZp586F1524.1 - human (fragment) [*H. sapiens*] |
| 347 | 11221 | AA851352 | ll | | ESTs, Highly similar to A24050 ribonucleoside-diphosphate reductase (EC 1.17.4.1) chain M1 - mouse [*M. musculus*] |
| 357 | 19269 | AA851785 | General | | ESTs, Highly similar to eukaryotic translation initiation factor 3, subunit 8 (110 kD) [*Homo sapiens*] [*H. sapiens*] |
| 363 | 16409 | AA852027 | pp | | ESTs, Weakly similar to DIA1_HUMAN Diaphanous protein homolog 1 (Diaphanous-related formin 1) (DRF1) [*H. sapiens*] |
| 368 | 10517 | AA858600 | nn | | ESTs, Highly similar to I54388 LZTR-1 - human [*H. sapiens*] |
| 392 | 15148 | AA859325 | w | | ESTs, Highly similar to hypothetical protein MGC14151 [*Homo sapiens*] [*H. sapiens*] |
| 403 | 23340 | AA859519 | jj | | ESTs, Highly similar to JC6127 RNA-binding protein type 1 - human [*H. sapiens*] |
| 403 | 23341 | AA859519 | bb | | ESTs, Highly similar to JC6127 RNA-binding protein type 1 - human [*H. sapiens*] |
| 423 | 19486 | AA859870 | l, nn | | ESTs, Weakly similar to Y063_HUMAN Hypothetical protein KIAA0063 (HA1234) [*H. sapiens*] |
| 436 | 23346 | AA859983 | c | | ESTs, Weakly similar to T50607 hypothetical protein DKFZp4341101 6.1 - human (fragment) [*H. sapiens*] |
| 440 | 23347 | AA860015 | c | | ESTs, Weakly similar to T50607 hypothetical protein DKFZp434I1016.1 - human (fragment) [*H. sapiens*] |
| 462 | 16042 | AA874827 | cc | | ESTs, Weakly similar to Y008_HUMAN Hypothetical protein KIAA0008 [*H. sapiens*] |
| 463 | 15182 | AA874832 | ff | | ESTs, Moderately similar to anaphase-promoting complex subunit 5 [*Homo sapiens*] [*H. sapiens*] |
| 469 | 15115 | AA874928 | r, v | | ESTs, Highly similar to SNX4_HUMAN Sorting nexin 4 [*H. sapiens*] |
| 474 | 16215 | AA874999 | j | | ESTs, Highly similar to protein translocation complex beta; protein transport protein SEC61 beta subunit [*Homo sapiens*] [*H. sapiens*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 493 | 7875 | AA875127 | x | | ESTs, Highly similar to cell division cycle 2-like 5, isoform 1; cholinesterase-related cell division controller; CDC2-related protein kinase 5 [*Homo sapiens*] [*H. sapiens*] |
| 498 | 15371 | AA875205 | xx | | ESTs, Highly similar to IF39__HUMAN Eukaryotic translation initiation factor 3 subunit 9 (eIF-3 eta) (eIF3 p116) (eIF3 p110) [*H. sapiens*] |
| 498 | 15372 | AA875205 | y, General, gg, hh, ll | | ESTs, Highly similar to IF39__HUMAN Eukaryotic translation initiation factor 3 subunit 9 (eIF-3 eta) (eIF3 p116) (eIF3 p110) [*H. sapiens*] |
| 505 | 15410 | AA875268 | r | | ESTs, Highly similar to NUKM__HUMAN NADH-ubiquinone oxidoreductase 20 kDa subunit, mitochondrial precursor (Complex I-20 KD) (CI-20 KD) (PSST subunit) [*H. sapiens*] |
| 513 | 17314 | AA875509 | r | | ESTs, Moderately similar to S15349 mdm2 protein - mouse [*M. musculus*] |
| 522 | 11889 | AA875641 | k | | ESTs, Highly similar to A Chain A, The Sh3 Domain Of Eps8 Exists As A Novel Intertwined Dimer [*M. musculus*] |
| 523 | 18152 | AA875661 | x | | ESTs, Highly similar to S58284 BCL7B protein - human [*H. sapiens*] |
| 537 | 16037 | AA891441 | j | | ESTs, Moderately similar to MPL3__RAT Microtubule-associated proteins 1A/1B light chain 3 (MAP1A/MAP1B LC3) [*R. norvegicus*] |
| 540 | 21952 | AA891537 | tt | | ESTs, Weakly similar to protein predicted by clone 23733 [*Homo sapiens*] [*H. sapiens*] |
| 561 | 17271 | AA891759 | a, s | | ESTs, Moderately similar to hypothetical protein MGC4308 [*Homo sapiens*] [*H. sapiens*] |
| 566 | 11966 | AA891800 | w | | ESTs, Weakly similar to F22G12.5.p [*Caenorhabditis elegans*] [*C. elegans*], ESTs, Weakly similar to IPYR__HUMAN Inorganic pyrophosphatase (Pyrophosphate phosphohydrolase) (PPase) [*H. sapiens*] |
| 579 | 17779 | AA891914 | w | | ESTs, Moderately similar to A47488 aminoacylase (EC 3.5.1.14) - human [*H. sapiens*] |
| 582 | 23862 | AA891933 | g | | ESTs, Moderately similar to A Chain A, Crystal Structure Of SmacDIABLO [*H. sapiens*] |
| 605 | 8317 | AA892234 | b, s, z, General | | ESTs, Moderately similar to microsomal glutathione S-transferase 3; microsomal glutathione S-transferase III [*Homo sapiens*] [*H. sapiens*] |
| 609 | 22903 | AA892250 | h, q, dd | | ESTs, Highly similar to SYK__HUMAN Lysyl-tRNA synthetase (Lysine--tRNA ligase) (LysRS) [*H. sapiens*] |
| 616 | 4373 | AA892310 | v | | ESTs, Highly similar to T08783 hypothetical protein DKFZp586O0120.1 - human (fragment) [*H. sapiens*] |
| 617 | 17405 | AA892313 | ii, rr | | ESTs, Moderately similar to beta-tubulin cofactor E [*Homo sapiens*] [*H. sapiens*] |
| 630 | 16469 | AA892462 | j, mm | | ESTs, Moderately similar to UCRY__HUMAN Ubiquinol-cytochrome C reductase complex 6.4 kDa protein (Complex III subunit XI) [*H. sapiens*] |
| 637 | 11994 | AA892507 | h | | ESTs, Moderately similar to S63540 protein DS 1, 24K - human [*H. sapiens*] |
| 673 | 22872 | AA892859 | g, rr | | ESTs, Weakly similar to PLO1__RAT Procollagen-lysine,2-oxoglutarate 5-dioxygenase 1 precursor (Lysyl hydroxylase 1) (LH1) [*R. norvegicus*] |
| 686 | 3439 | AA893000 | o | | ESTs, Moderately similar to T00335 hypothetical protein KIAA0564 - human (fragment) [*H. sapiens*] |
| 694 | 13856 | AA893183 | gg, hh | | ESTs, Weakly similar to S57447 HPBRII-7 protein - human [*H. sapiens*] |
| 694 | 13857 | AA893183 | bb | | ESTs, Weakly similar to S57447 HPBRII-7 protein - human [*H. sapiens*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 699 | 3877 | AA893224 | d | | ESTs, Highly similar to UBPJ_HUMAN Ubiquitin carboxyl-terminal hydrolase 19 (Ubiquitin thiolesterase 19) (Ubiquitin-specific processing protease 19) (Deubiquitinating enzyme 19) [*H. sapiens*] |
| 702 | 3879 | AA893237 | t, cc, xx | | ESTs, Moderately similar to hypothetical protein MB03205 [*Homo sapiens*] [*H. sapiens*] |
| 728 | 19411 | AA893667 | r | | ESTs, Weakly similar to T46904 hypothetical protein DKFZp761D081.1 - human [*H. sapiens*] |
| 731 | 24185 | AA893708 | y | | ESTs, Highly similar to T00333 hypothetical protein KIAA0560 - human [*H. sapiens*] |
| 732 | 17858 | AA893741 | c, d, oo | | ESTs, Moderately similar to T46305 hypothetical protein DKFZp434D1411.1 - human (fragment) [*H. sapiens*] |
| 772 | 22490 | AA899289 | ii | | ESTs, Moderately similar to KIAA1049 protein [*Homo sapiens*] [*H. sapiens*] |
| 775 | 4636 | AA899491 | m | | ESTs, Highly similar to SYW_MOUSE Tryptophanyl-tRNA synthetase (Tryptophan-tRNA ligase) (TrpRS) [*M. musculus*] |
| 785 | 21213 | AA899991 | f, General | | ESTs, ESTs, Highly similar to T46254 hypothetical protein DKFZp761H171.1 - human [*H. sapiens*] |
| 786 | 15373 | AA900018 | x | | ESTs, Highly similar to IF39_HUMAN Eukaryotic translation initiation factor 3 subunit 9 (eIF-3 eta) (eIF3 p116) (eIF3 p110) [*H. sapiens*] |
| 797 | 16754 | AA900474 | d | | ESTs, Moderately similar to T50619 hypothetical protein DKFZp762M136.1 - human (fragment) [*H. sapiens*] |
| 810 | 12335 | AA901065 | k, cc | | ESTs, Highly similar to T17225 hypothetical protein DKFZp564C246.1 - human [*H. sapiens*] |
| 816 | 17096 | AA901343 | g | | ESTs, Moderately similar to suppressor of G2 allele SKP1 [*Homo sapiens*] [*H. sapiens*] |
| 823 | 12354 | AA923957 | a, k, cc, tt | | ESTs, Weakly similar to UDP-N-acteylglucosamine pyrophosphorylase 1; AgX; sperm associated antigen 2; UDP-N-acteylglucosamine pyrophosphorylase 1; Sperm associated antigen 2 [*Homo sapiens*] [*H. sapiens*] |
| 830 | 4917 | AA924140 | p | | ESTs, Weakly similar to Y193_HUMAN Hypothetical protein KIAA0193 [*H. sapiens*] |
| 834 | 4931 | AA924261 | oo | | ESTs, Weakly similar to PRS4_MOUSE 26S PROTEASE REGULATORY SUBUNIT 4 (P26S4) [*R. norvegicus*] |
| 852 | 5009 | AA924737 | qq | | ESTs, Highly similar to T17237 hypothetical protein DKFZp434P106.1 - human (fragment) [*H. sapiens*] |
| 860 | 2462 | AA924913 | d | | ESTs, Moderately similar to T50619 hypothetical protein DKFZp762M136.1 - human (fragment) [*H. sapiens*] |
| 906 | 16468 | AA926137 | p, t, y, mm | | ESTs, Moderately similar to UCRY_HUMAN Ubiquinol-cytochrome C reductase complex 6.4 kDa protein (Complex III subunit XI) [*H. sapiens*] |
| 915 | 9942 | AA942697 | y | | ESTs, Highly similar to hypothetical protein MGC3133 [*Homo sapiens*] [*H. sapiens*] |
| 921 | 22102 | AA942845 | m | | ESTs, Weakly similar to Y218_HUMAN Putative deoxyribonuclease KIAA0218 [*H. sapiens*] |
| 931 | 21993 | AA943149 | t, ff | | ESTs, Weakly similar to T00084 hypothetical protein KIAA0512 - human [*H. sapiens*] |
| 939 | 21911 | AA943610 | s | | ESTs, Highly similar to T08795 hypothetical protein DKFZp586J1822.1 - human (fragment) [*H. sapiens*] |
| 968 | 17948 | AA944581 | f | | ESTs, Moderately similar to A57088 nucleoporin-like protein Rab - human [*H. sapiens*] |
| 969 | 22471 | AA944617 | bb | | ESTs, Highly similar to CU02_HUMAN Protein C21orf2 (C21orf-HUMF09G8.5) (YF5/A2) [*H. sapiens*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 972 | 22492 | AA944741 | dd | | ESTs, Moderately similar to KIAA1049 protein [Homo sapiens] [H. sapiens] |
| 980 | 23423 | AA944912 | dd | | ESTs, Moderately similar to ERC6_HUMAN Excision repair protein ERCC-6 (Cockayne syndrome protein CSB) [H. sapiens] |
| 1007 | 22636 | AA945724 | v | | ESTs, Weakly similar to T12543 hypothetical protein DKFZp434M154.1 - human (fragment) [H. sapiens] |
| 1009 | 9657 | AA945739 | e | | ESTs, Moderately similar to Y391_HUMAN Hypothetical protein KIAA0391 [H. sapiens] |
| 1011 | 21334 | AA945753 | pp | | ESTs, Moderately similar to ANM2_HUMAN Protein arginine N-methyltransferase 2 [H. sapiens] |
| 1034 | 21410 | AA946408 | c | | ESTs, Moderately similar to MCA3_HUMAN Multisynthetase complex auxiliary component p18 [H. sapiens] |
| 1038 | 18383 | AA946421 | m | | ESTs, Highly similar to S59641 transcription factor TFEB - mouse (fragment) [M. musculus] |
| 1054 | 17191 | AA955382 | c | | ESTs, Highly similar to T46457 hypothetical protein DKFZp434L032.1 - human (fragment) [H. sapiens] |
| 1062 | 23278 | AA955553 | l | | ESTs, Moderately similar to hypothetical protein IMAGE3455200 [Homo sapiens] [H. sapiens] |
| 1064 | 23637 | AA955587 | pp | | ESTs, Highly similar to A45142 cleavage stimulation factor 50K chain - human [H. sapiens] |
| 1080 | 24046 | AA956185 | e | | ESTs, Moderately similar to COQ6_HUMAN Putative ubiquinone biosynthesis monooxgenase COQ6 (CGI-10) [H. sapiens] |
| 1085 | 18669 | AA956453 | w | | ESTs, Highly similar to OBRG_MOUSE Leptin receptor gene-related protein (OB-R gene related protein) (OB-RGRP) [M. musculus] |
| 1087 | 23800 | AA956534 | j | | ESTs, Weakly similar to RNG1_HUMAN Polycomb complex protein RING1 (RNF1) [H. sapiens] |
| 1089 | 23852 | AA956746 | p | | ESTs, Highly similar to CHD4_HUMAN Chromodomain helicase-DNA-binding protein 4 (CHD-4) (Mi-2 autoantigen 218 kDa protein) (Mi2-beta) [H. sapiens] |
| 1104 | 18413 | AA957763 | ff | | ESTs, Highly similar to UBPJ_HUMAN Ubiquitin carboxyl-terminal hydrolase 19 (Ubiquitin thiolesterase 19) (Ubiquitin-specific processing protease 19) (Deubiquitinating enzyme 19) [H. sapiens] |
| 1111 | 15183 | AA963036 | l | | ESTs, Moderately similar to anaphase-promoting complex subunit 5 [Homo sapiens] [H. sapiens] |
| 1112 | 5952 | AA963102 | r | amino acid transporter system A2 | amino acid transporter system A2 |
| 1125 | 2270 | AA964116 | s | | ESTs, Moderately similar to tripartite motif-containing 37; RING-B-box-coiled-coil protein; MUL protein; Mulibrey nanism [Homo sapiens] [H. sapiens] |
| 1136 | 24166 | AA964630 | d, n | | ESTs, Moderately similar to T02345 hypothetical protein KIAA0324 - human (fragment) [H. sapiens] |
| 1153 | 2583 | AA965166 | u, mm | | ESTs, Moderately similar to IPYR_HUMAN Inorganic pyrophosphatase (Pyrophosphate phospho-hydrolase) (PPase) [H. sapiens] |
| 1161 | 2809 | AA996471 | p | | ESTs, Moderately similar to JM11 protein [Homo sapiens] [H. sapiens] |
| 1167 | 11928 | AA996829 | gg, hh | | ESTs, Moderately similar to T46305 hypothetical protein DKFZp434D1411.1 - human (fragment) [H. sapiens] |
| 1207 | 3367 | AA998110 | xx | | ESTs, Weakly similar to YCE3_HUMAN Hypothetical protein CGI-143 [H. sapiens] |
| 1208 | 12628 | AA998123 | General | | ESTs, Moderately similar to JC5707 HYA22 protein - human [H. sapiens] |
| 1219 | 26118 | AA998471 | d | | ESTs, Highly similar to I49668 binding protein - mouse [M. musculus] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1223 | 23648 | AA998547 | mm | | ESTs, Highly similar to Y144_HUMAN Hypothetical protein KIAA0144 [*H. sapiens*] |
| 1225 | 26120 | AA998619 | s | | ESTs, Weakly similar to T51776 dolichyl-phosphate beta-glucosyltransferase (EC 2.4.1.117) [imported] - human [*H. sapiens*] |
| 1231 | 3660 | AA998833 | j | | ESTs, Weakly similar to T46908 hypothetical protein DKFZp761G2423.1 - human [*H. sapiens*] |
| 1235 | 2526 | AA998979 | bb | | ESTs, Moderately similar to T00051 hypothetical protein KIAA0404 - human (fragment) [*H. sapiens*] |
| 1238 | 3710 | AA999064 | s, t | | ESTs, Highly similar to T47142 hypothetical protein DKFZp761P0724.1 - human (fragment) [*H. sapiens*] |
| 1254 | 23417 | AB022209 | l, General, kk | ribonucleoprotein F | ribonucleoprotein F |
| 1272 | 13464 | AF047707 | f, ss | UDP-glucose:ceramide glycosyltransferase | UDP-glucose:ceramide glycosyltransferase |
| 1303 | 17359 | AI007981 | mm | | ESTs, Moderately similar to UCRX_HUMAN Ubiquinol-cytochrome C reductase complex 7.2 kDa protein (Cytochrome C1, nonheme 7 kDa protein) (Complex III subunit X) (7.2 kDa cytochrome c1-associated protein subunit) (HSPC119) [*H. sapiens*] |
| 1325 | 22801 | AI009197 | a | | ESTs, Moderately similar to hypothetical protein IMAGE3455200 [*Homo sapiens*] [*H. sapiens*] |
| 1332 | 16956 | AI009390 | ee | | ESTs, Moderately similar to NIPM_HUMAN NADH-ubiquinone oxidoreductase 15 kDa subunit (Complex I-15 kDa) (CI-15 kDa) [*H. sapiens*] |
| 1337 | 11322 | AI009492 | j | | ESTs, Highly similar to hypothetical protein [*Homo sapiens*] [*H. sapiens*] |
| 1363 | 8047 | AI010100 | e | | ESTs, Highly similar to vacuolar protein sorting 18 (yeast), isoform 1; vacuolar protein sorting protein 18 [*Homo sapiens*] [*H. sapiens*] |
| 1402 | 23768 | AI011709 | ii | | ESTs, Moderately similar to S21977 Pm5 protein - human [*H. sapiens*] |
| 1406 | 18684 | AI011812 | pp | | ESTs, Highly similar to T12468 hypothetical protein DKFZp564O123.1 - human [*H. sapiens*] |
| 1432 | 5528 | AI012631 | bb, qq | | *Rattus norvegicus* mRNA for Vps54-like protein |
| 1433 | 12475 | AI012632 | c | | ESTs, Weakly similar to hypothetical protein FLJ14775 [*Homo sapiens*] [*H. sapiens*] |
| 1439 | 9386 | AI012785 | c | | ESTs, Weakly similar to T47142 hypothetical protein DKFZp761P0724.1 - human (fragment) [*H. sapiens*] |
| 1443 | 2937 | AI012951 | pp | | ESTs, Moderately similar to PEXD_HUMAN Peroxisomal membrane protein PEX13 (Peroxin-13) [*H. sapiens*] |
| 1455 | 11969 | AI013273 | rr | | ESTs, Highly similar to B27496 proteinase inhibitor nexin 1 precursor - rat (fragment) [*R. norvegicus*] |
| 1460 | 12794 | AI013442 | ee | | ESTs, Highly similar to T12539 hypothetical protein DKFZp434J154.1 - human [*H. sapiens*] |
| 1461 | 23444 | AI013448 | rr | | ESTs, Highly similar to chromosome 20 open reading frame 30; HSPC274 protein [*Homo sapiens*] [*H. sapiens*] |
| 1463 | 12795 | AI013482 | y | | ESTs, Highly similar to T17303 hypothetical protein DKFZp566F2124.1 - human (fragment) [*H. sapiens*] |
| 1486 | 2909 | AI013946 | m | | ESTs, Weakly similar to A34581 oxysterol-binding protein - human [*H. sapiens*] |
| 1494 | 15247 | AI014169 | o, ii, ll, pp, xx | upregulated by 1,25-dihydroxyvitamin D-3 | upregulated by 1,25-dihydroxyvitamin D-3 |
| 1504 | 7420 | AI029291 | l | | ESTs, Highly similar to CLPX_MOUSE ATP-dependent CLP protease ATP-binding subunit ClpX-like, mitochondrial precursor [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1508 | 7451 | AI029450 | l, z, General | | ESTs, Moderately similar to SYEP_HUMAN Bifunctional aminoacyl-tRNA synthetase [Includes: Glutamyl-tRNA synthetase (Glutamate--tRNA ligase); Prolyl-tRNA synthetase (Proline--tRNA ligase)] [*H. sapiens*] |
| 1550 | 5346 | AI043601 | gg, hh | | ESTs, Weakly similar to T08680 hypothetical protein DKFZp564P0622.1 - human (fragment) [*H. sapiens*] |
| 1583 | 7136 | AI044604 | s | | ESTs, Weakly similar to T12528 hypothetical protein DkFZp434N093.1 - human (fragment) [*H. sapiens*] |
| 1585 | 5556 | AI044638 | ii | | ESTs, Moderately similar to Y127_HUMAN Hypothetical protein KIAA0127 [*H. sapiens*] |
| 1603 | 5715 | AI045158 | v | | ESTs, Moderately similar to hypothetical protein MGC4675 [*Homo sapiens*] [*H. sapiens*] |
| 1605 | 11763 | AI045196 | tt | | ESTs, Weakly similar to A47328 natural killer cell tumor-recognition protein - human [*H. sapiens*] |
| 1613 | 6609 | AI045458 | ii, tt | | ESTs, Highly similar to I55595 splicing factor - human [*H. sapiens*] |
| 1623 | 6808 | AI045600 | a | | ESTs, Highly similar to S30034 translocating chain-associating membrane protein - human [*H. sapiens*] |
| 1631 | 5866 | AI045751 | y | | ESTs, Moderately similar to SYN_HUMAN Asparaginyl-tRNA synthetase, cytoplasmic (Asparagine--tRNA ligase) (AsnRS) [*H. sapiens*] |
| 1650 | 10080 | AI058639 | General | | EST, Weakly similar to PRTZ_HUMAN Vitamin K-dependent protein Z precursor [*H. sapiens*] |
| 1700 | 8496 | AI059974 | tt | | ESTs, Moderately similar to T17285 hypothetical protein DKFZp434N0535.1 - human (fragment) [*H. sapiens*] |
| 1703 | 8132 | AI060050 | p, bb | | ESTs, Highly similar to NGP1_HUMAN Autoantigen NGP-1 [*H. sapiens*] |
| 1706 | 10304 | AI060149 | b | | ESTs, Weakly similar to T48687 hypothetical protein DKFZp761G1923.1 - human (fragment) [*H. sapiens*] |
| 1710 | 4337 | AI060281 | ll | | ESTs, Weakly similar to T50633 hypothetical protein DKFZp762F1811.1 - human (fragment) [*H. sapiens*] |
| 1742 | 11596 | AI071194 | pp | | ESTs, Weakly similar to S16506 hypothetical protein - human [*H. sapiens*] |
| 1749 | 9615 | AI071289 | l, z | | ESTs, Highly similar to Y779_HUMAN Hypothetical protein KIAA0779 [*H. sapiens*] |
| 1761 | 9259 | AI071606 | q | | ESTs, Highly similar to UBP1_HUMAN Ubiquitin carboxyl-terminal hydrolase 1 (Ubiquitin thiolesterase 1) (Ubiquitin-specific processing protease 1) (Deubiquitinating enzyme 1) (hUBP) [*H. sapiens*] |
| 1773 | 17673 | AI071895 | ii | | EST, Moderately similar to I38937 DNA/RNA binding protein - human (fragment) [*H. sapiens*] |
| 1775 | 8665 | AI071965 | ee | | ESTs, Moderately similar to T17342 hypothetical protein DKFZp586K1924.1 - human (fragment) [*H. sapiens*], *R. norvegicus* hsp70.2 mRNA for heat shock protein 70 |
| 1840 | 16814 | AI101462 | jj | | ESTs, Highly similar to cisplatin resistance related protein CRR9p [*Homo sapiens*] [*H. sapiens*] |
| 1869 | 2972 | AI102606 | ss | | ESTs, Moderately similar to NADH dehydrogenase (ubiquinone) 1 alpha subcomplex, 10 (42 kD) [*Homo sapiens*] [*H. sapiens*] |
| 1871 | 7379 | AI102643 | d, dd, rr | | ESTs, Moderately similar to 2105233A transcription factor ISGF3gamma [*Mus musculus*] [*M. musculus*] |
| 1912 | 3940 | AI103718 | qq | | ESTs, Highly similar to I39383 angio-associated migratory cell protein - human [*H. sapiens*] |
| 1937 | 18395 | AI104388 | nn | heat shock 27 kD protein 1 | heat shock 27kD protein 1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1953 | 22957 | AI104897 | u, w | | ESTs, Moderately similar to MEA6_HUMAN Meningioma-expressed antigen 6/11 (MEA6) (MEA11) [*H. sapiens*] |
| 1955 | 24375 | AI104979 | q, z, dd, ee | | ESTs, Moderately similar to EBNA1 binding protein 2; nucleolar protein p40; homolog of yeast EBNA1-binding protein; nuclear FGF3 binding protein; EBNA1-binding protein 2 [*Homo sapiens*] [*H. sapiens*] |
| 1975 | 18466 | AI111828 | oo | | ESTs, Highly similar to Y196_HUMAN Hypothetical protein KIAA0196 [*H. sapiens*] |
| 1976 | 11339 | AI111840 | jj | | ESTs, Moderately similar to PMVK_HUMAN PHOSPHOMEVALONATE KINASE (PMKASE) [*H. sapiens*] |
| 2008 | 15196 | AI136610 | ee | | ESTs, Highly similar to RRP5_HUMAN RRP5 protein homolog (Fragment) [*H. sapiens*] |
| 2017 | 6552 | AI137062 | d | | ESTs, Highly similar to OM07_HUMAN Probable mitochondrial import receptor subunit TOM7 homolog (Translocase of outer membrane 7 kDa subunit homolog) (Protein AD-014) [*H. sapiens*] |
| 2032 | 7414 | AI137586 | n, p, z, General | | ESTs, Highly similar to IMB3_HUMAN Importin beta-3 subunit (Karyopherin beta-3 subunit) (Ran-binding protein 5) [*H. sapiens*] |
| 2033 | 14396 | AI137689 | s | | *Rattus norvegicus* mRNA for Vps54-like protein |
| 2042 | 6898 | AI144623 | p | | ESTs, Moderately similar to TRI3_HUMAN Thyroid receptor interacting protein 3 (TRIP-3) [*H. sapiens*] |
| 2051 | 12482 | AI144965 | p | | ESTs, Highly similar to SN24_HUMAN Possible global transcription activator SNF2L4 (SNF2-beta) (BRG-1 protein) (Mitotic growth and transcription activator) (Brahma protein homolog 1) [*H. sapiens*] |
| 2061 | 15399 | AI145451 | oo | | ESTs, Highly similar to RR41_HUMAN Exosome complex exonuclease RRP41 (Ribosomal RNA processing protein 41) [*H. sapiens*] |
| 2100 | 16727 | AI169287 | z, General, kk | | ESTs, Highly similar to T47146 hypothetical protein DKFZp761C169.1 - human (fragment) [*H. sapiens*] |
| 2107 | 11550 | AI169591 | a | | ESTs, Highly similar to S57447 HPBRII-7 protein - human [*H. sapiens*] |
| 2136 | 24048 | AI170570 | qq | | ESTs, Moderately similar to COQ6_HUMAN Putative ubiquinone biosynthesis monooxgenase COQ6 (OGI-10) [*H. sapiens*] |
| 2142 | 2750 | AI170666 | n, q, dd | | ESTs, Highly similar to ARGR_HUMAN Arginine-rich protein [*H. sapiens*] |
| 2146 | 1923 | AI170754 | r, z, ee | | ESTs, Highly similar to T50836 Yippee protein [imported] - human (fragment) [*H. sapiens*] |
| 2159 | 14941 | AI171196 | pp | | ESTs, Highly similar to MAN1_HUMAN Inner nuclear membrane protein Man1 [*H. sapiens*] |
| 2162 | 5953 | AI171231 | r, y, z, tt | amino acid transporter system A2 | amino acid transporter system A2 |
| 2166 | 11518 | AI171272 | e | | ESTs, Highly similar to similar to *S. cerevisiae* RER1 [*Homo sapiens*] [*H. sapiens*] |
| 2178 | 17746 | AI171615 | ss | | ESTs, Moderately similar to I39166 cellular apoptosis susceptibility protein CAS - human [*H. sapiens*] |
| 2192 | 6085 | AI171990 | ww | | ESTs, Highly similar to T50620 hypothetical protein DKFZp762M186.1 - human (fragment) [*H. sapiens*] |
| 2194 | 22876 | AI172041 | r, w, z, ee | | ESTs, Moderately similar to CGD7_HUMAN Protein CGI-137 (Protein AD-004) [*H. sapiens*] |
| 2199 | 6057 | AI172102 | dd | | ESTs, Highly similar to STXH_HUMAN Syntaxin 18 [*H. sapiens*] |
| 2205 | 11416 | AI172185 | t, ff | | ESTs, Highly similar to mitochondrial ribosomal protein L49; chromosome 11 open reading frame 4 [*Homo sapiens*] [*H. sapiens*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2213 | 11525 | AI172286 | p | | ESTs, Moderately similar to LPRC_HUMAN 130 kDa leucine-rich protein (LRP 130) (GP130) (Leucine-rich PPR-motif containing protein) [*H. sapiens*] |
| 2229 | 7740 | AI175011 | vv | | ESTs, Moderately similar to COF1_RAT COFILIN, NON-MUSCLE ISOFORM [*R. norvegicus*] |
| 2236 | 6454 | AI175342 | p, kk | | ESTs, Weakly similar to T31067 BIR repeat containing ubiquitin-conjugating enzyme BRUCE - mouse [*M. musculus*] |
| 2242 | 18562 | AI175515 | s | | ESTs, Moderately similar to PRTP_MOUSE Lysosomal protective protein precursor (Cathepsin A) (Carboxypeptidase C) (MO54) [*M. musculus*] |
| 2257 | 1587 | AI176063 | ii | | Rat general mitochondrial matrix processing protease (MPP) mRNA, 3' end |
| 2261 | 7711 | AI176125 | e | | ESTs, Moderately similar to T14773 hypothetical protein DKFZp564B0482.1 - human [*H. sapiens*] |
| 2268 | 12999 | AI176276 | General | | ESTs, Highly similar to UAP1_HUMAN UDP-N-acetylhexosamine pyrophosphorylase (Antigen X) (AGX) (Sperm-associated antigen 2) [Includes: UDP-N-acetylgalactosamine pyrophosphorylase (AGX-1); UDP-N-acetylglucosamine pyrophosphorylase (AGX-2)] [*H. sapiens*] |
| 2277 | 17920 | AI176422 | n, kk, pp | | ESTs, Highly similar to S41115 probable flavoprotein-ubiquinone oxidoreductase (EC 1.6.5.—) - human [*H. sapiens*] |
| 2277 | 17921 | AI176422 | p, kk | | ESTs, Highly similar to S41115 probable flavoprotein-ubiquinone oxidoreductase (EC 1.6.5.—) - human [*H. sapiens*] |
| 2282 | 13678 | AI176490 | u | | ESTs, Weakly similar to T00065 hypothetical protein KIAA0442 - human (fragment) [*H. sapiens*] |
| 2290 | 3619 | AI176588 | vv | | ESTs, Weakly similar to tumor protein p53-binding protein; topoisomerase I binding protein [*Homo sapiens*] [*H. sapiens*] |
| 2314 | 4190 | AI177016 | z, ee | | ESTs, Highly similar to LSM8_HUMAN U6 snRNA-associated Sm-like protein LSm8 [*H. sapiens*] |
| 2328 | 23162 | AI177353 | a, q, x, dd | | ESTs, Highly similar to A47220 dermatopontin precursor - human [*H. sapiens*] |
| 2338 | 6315 | AI177645 | bb | | ESTs, Weakly similar to S69890 mitogen inducible gene mig-2 - human [*H. sapiens*] |
| 2357 | 16739 | AI178151 | cc | | ESTs, Highly similar to T46366 hypothetical protein DKFZp434C0118.1 - human (fragment) [*H. sapiens*] |
| 2360 | 23248 | AI178267 | b, f, p, q, General, dd | | ESTs, Weakly similar to JC7185 chromosome 1 C1orf9 protein - human [*H. sapiens*] |
| 2371 | 8418 | AI178566 | u | | ESTs, Highly similar to T00260 hypothetical protein KIAA0605 - human [*H. sapiens*] |
| 2374 | 23456 | AI178665 | p | | ESTs, Moderately similar to T08719 hypothetical protein DKFZp566B183.1 - human [*H. sapiens*] |
| 2375 | 11374 | AI178672 | k | | ESTs, Weakly similar to G01614 zinc finger protein 127- human [*H. sapiens*] |
| 2391 | 1924 | AI178902 | r, z | | ESTs, Highly similar to T50836 Yippee protein [imported] - human (fragment) [*H. sapiens*] |
| 2400 | 4587 | AI179092 | ff | | ESTs, Moderately similar to RL22_RAT 60S RIBOSOMAL PROTEIN L22 [*R. norvegicus*] |
| 2402 | 13055 | AI179100 | General, jj | | ESTs, Highly similar to CN01_HUMAN Protein C14orf1 (HSPC288) (Protein AD-011) (x0006) [*H. sapiens*] |
| 2404 | 21631 | AI179125 | s | | ESTs, Highly similar to eukaryotic translation initiation factor 3, subunit 3 (gamma, 40 kD) [*Homo sapiens*] [*H. sapiens*] |
| 2406 | 17358 | AI179147 | b, ii, pp | | ESTs, Highly similar to B Chain B, Three-Dimensional Structure Of Human Electron Transfer Flavoprotein To 2.1 A Resolution [*H. sapiens*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2410 | 13606 | AI179289 | j | | ESTs, Weakly similar to S65464 pregnancy-associated plasma protein A precursor - human [*H. sapiens*] |
| 2438 | 23989 | AI179953 | ii, ss | | ESTs, Highly similar to 1604368A gap junction protein Cx26 [*Rattus norvegicus*] [*R. norvegicus*] |
| 2446 | 17365 | AI180249 | m | | ESTs, Highly similar to colon cancer-associated protein Mic1 [*Homo sapiens*] [*H. sapiens*] |
| 2453 | 7460 | AI180413 | r | | ESTs, Highly similar to NBRT apolipoprotein H precursor - rat [*R. norvegicus*] |
| 2489 | 21822 | AI228642 | oo | | ESTs, Highly similar to hypothetical protein MGC1936 [*Homo sapiens*] [*H. sapiens*] |
| 2502 | 23955 | AI229178 | e | | ESTs, Highly similar to S51635 fibroblast growth factor receptor 2b, keratinocyte growth factor receptor - rat [*R. norvegicus*] |
| 2508 | 11527 | AI229307 | rr, uu | | ESTs, Highly similar to S27958 transcription factor BTF2 62K chain - human [*H. sapiens*] |
| 2511 | 19138 | AI229413 | s | | ESTs, Moderately similar to T00054 hypothetical protein KIAA0415 - human (fragment) [*H. sapiens*] |
| 2513 | 23563 | AI229421 | pp | | ESTs, Moderately similar to S78100 MAPK-activated protein kinase (EC 2.7.1.—) 2 - mouse (fragment) [*M. musculus*] |
| 2523 | 2688 | AI229793 | k, s | | ESTs, Weakly similar to hypothetical protein FLJ20010 [*Homo sapiens*] [*H. sapiens*] |
| 2527 | 13879 | AI230004 | oo | | ESTs, Moderately similar to T00374 hypothetical protein KIAA0648 - human (fragment) [*H. sapiens*] |
| 2528 | 4722 | AI230038 | c, ll | | ESTs, Moderately similar to T08811 hypothetical protein DKFZp586M1523.1 - human (fragment) [*H. sapiens*] |
| 2535 | 4662 | AI230215 | ll | | ESTs, Moderately similar to hypothetical protein FLJ10468 [*Homo sapiens*] [*H. sapiens*] |
| 2536 | 15862 | AI230228 | m, n, u | | ESTs, Weakly similar to SERC_HUMAN Phosphoserine aminotransferase (PSAT) [*H. sapiens*] |
| 2555 | 24270 | AI230758 | rr | | ESTs, Moderately similar to cargo selection protein (mannose 6 phosphate receptor binding pr; cargo selection protein (mannose 6 phosphate receptor binding protein) [*Homo sapiens*] [*H. sapiens*] |
| 2557 | 8036 | AI230884 | c, tt | | ESTs, Highly similar to HMBA-inducible [*Homo sapiens*] [*H. sapiens*] |
| 2565 | 14303 | AI231159 | y | | ESTs, Highly similar to KIAA1049 protein [*Homo sapiens*] [*H. sapiens*] |
| 2576 | 19271 | AI231566 | f, q, pp, ww | | ESTs, Highly similar to MAX_RAT MAX protein [*R. norvegicus*] |
| 2588 | 24501 | AI232006 | m | translation elongation factor 1-delta subunit | translation elongation factor 1-delta subunit |
| 2606 | 15122 | AI232303 | g, General, dd | | ESTs, Weakly similar to JC5393 zinc finger protein KF-1 precursor - mouse [*M. musculus*] |
| 2619 | 14051 | AI232489 | w, z, dd, ee | | ESTs, Weakly similar to dual specificity phosphatase 11; RNA/RNP complex-interacting phosphatase; serine/threonine specific protein phosphatase [*Homo sapiens*] [H. sapiens] |
| 2620 | 3662 | AI232506 | o | | ESTs, Weakly similar to T46908 hypothetical protein DKFZp761G2423.1 - human [*H. sapiens*] |
| 2628 | 13645 | AI232694 | tt | | ESTs, Weakly similar to S24C_HUMAN Protein transport protein Sec24C (SEC24-related protein C) [*H. sapiens*] |
| 2638 | 17240 | AI233054 | mm | | ESTs, Weakly similar to UCRQ_HUMAN Ubiquinol-cytochrome C reductase complex ubiquinone-binding protein QP-C (Ubiquinol-cytochrome C reductase complex 9.5 kDa protein) (Complex III subunit VII) [*H. sapiens*] |
| 2646 | 11507 | AI233222 | ee | | ESTs, Highly similar to hypothetical protein MGC2803 [*Homo sapiens*] [*H. sapiens*] |
| 2661 | 18900 | AI233570 | ee | | ESTs, Highly similar to PSD8_HUMAN 26S |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| | | | | | proteasome non-ATPase regulatory subunit 8 (26S proteasome regulatory subunit S14) (p31) [*H. sapiens*] |
| 2663 | 7888 | AI233583 | n, kk | | ESTs, Highly similar to SYR_HUMAN ARGINYL-TRNA SYNTHETASE (ARGININE--TRNA LIGASE) (ARGRS) [*H. sapiens*], ESTs, Moderately similar to JC4365 arginine--tRNA ligase (EC 6.1.1.19) - human [*H. sapiens*] |
| 2669 | 7243 | AI233717 | z, ee | | ESTs, Moderately similar to ERHUAH coatomer complex alpha chain homolog - human [*H. sapiens*] |
| 2670 | 17210 | AI233746 | pp | | ESTs, Weakly similar to SC14_HUMAN SEC14-like protein 1 [*H. sapiens*] |
| 2695 | 14745 | AI234919 | bb, mm | | ESTs, Moderately similar to SYHUQT multifunctional aminoacyl-tRNA ligase - human [*H. sapiens*] |
| 2698 | 3875 | AI235047 | q | | ESTs, Highly similar to S50082 nuclear cap binding protein - human [*H. sapiens*] |
| 2717 | 20140 | AI235566 | g | | ESTs, Moderately similar to SYEP_HUMAN Bifunctional aminoacyl-tRNA synthetase [Includes: Glutamyl-tRNA synthetase (Glutamate--tRNA ligase); Prolyl-tRNA synthetase (Proline--tRNA ligase)] [*H. sapiens*] |
| 2722 | 24373 | AI235748 | l, y, ee, rr | | ESTs, Moderately similar to Y110_HUMAN Hypothetical protein KIAA0110 (HA0666) [*H. sapiens*] |
| 2725 | 14768 | AI235912 | f | | ESTs, Weakly similar to highly charged protein [*Homo sapiens*] [*H. sapiens*] |
| 2732 | 6976 | AI236072 | qq | | ESTs, Weakly similar to T08680 hypothetical protein DKFZp564P0622.1 - human (fragment) [*H. sapiens*] |
| 2738 | 14879 | AI236200 | ee | | ESTs, Moderately similar to M1A1_MOUSE Mannosyl-oligosacoharide 1,2-alpha-mannosidase IA (Processing alpha-1,2-mannosidase IA) (Alpha-1,2-mannosidase IA) (Mannosidase alpha class 1A member 1) (Man(9)-alpha-mannosidase) [*M. musculus*] |
| 2746 | 15398 | AI236566 | s | | ESTs, Moderately similar to T12473 hypothetical protein DKFZp564G1762.1 - human (fragment) [*H. sapiens*] |
| 2748 | 23249 | AI236597 | p, ff | | ESTs, Weakly similar to JC7185 chromosome 1 C1orf9 protein - human [*H. sapiens*] |
| 2781 | 21653 | AI237535 | l, qq | LPS-induced TNF-alpha factor | LPS-induced TNF-alpha factor |
| 2789 | 15248 | AI237654 | nn, xx | upregulated by 1,25-dihydroxyvitamin D-3 | upregulated by 1,25-dihydroxyvitamin D-3 |
| 2832 | 18533 | AI639231 | g | | ESTs, Highly similar to T46480 hypothetical protein DKFZp434L1850.1 - human (fragment) [*H. sapiens*] |
| 2839 | 25942 | AI639291 | cc | | ESTs, Weakly similar to S38783 integrin alpha chain - rat (fragment) [*R. norvegicus*] |
| 2843 | 14606 | AI639342 | d | | ESTs, Highly similar to YS64_HUMAN Hypothetical protein S164 [*H. sapiens*] |
| 2861 | 20468 | AI639494 | m | | ESTs, Weakly similar to G01614 zinc finger protein 127 - human [*H. sapiens*] |
| 2907 | 21864 | H31144 | pp | | ESTs, Moderately similar to 1914275A non-receptor Tyr kinase [*Homo sapiens*] [*H. sapiens*] |
| 2907 | 20456 | H31144 | ll, pp | | ESTs, Moderately similar to 1914275A non-receptor Tyr kinase [*Homo sapiens*] [*H. sapiens*] |
| 2917 | 17913 | H31707 | l, x, General, dd, uu | | ESTs, Moderately similar to T50621 hypothetical protein DKFZp762O076.1 - human (fragment) [*H. sapiens*] |
| 2918 | 4360 | H31813 | z, General | | ESTs, Moderately similar to T14781 hypothetical protein DKFZp586B1621.1 - human (fragment) [*H. sapiens*] |
| 3010 | 4224 | M31322 | ff, mm | sperm membrane protein (YWK-II) | sperm membrane protein (YWK-II) |
| 3010 | 4225 | M31322 | nn, uu | sperm membrane protein (YWK-II) | sperm membrane protein (YWK-II) |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3020 | 1586 | M57728 | oo, pp | | Rat general mitochondrial matrix processing protease (MPP) mRNA, 3' end |
| 3135 | 15174 | NM_012756 | j, ss | Insulin-like growth factor 2 receptor | Insulin-like growth factor 2 receptor |
| 3403 | 20583 | NM_017306 | k, nn | | ESTs, Highly similar to D3D2_RAT 3,2-TRANS-ENOYL-COA ISOMERASE, MITOCHONDRIAL PRECURSOR (DODECENOYL-COA DELTA-ISOMERASE) [*R. norvegicus*] |
| 3579 | 1867 | NM_022510 | ee | ribosomal protein L4 | ribosomal protein L4 |
| 3713 | 1024 | NM_031016 | k | muscarinic receptor m2 | muscarinic receptor m2 |
| 3725 | 1336 | NM_031042 | k | general transcription factor IIF, polypeptide 2 (30 kD subunit) | general transcription factor IIF, polypeptide 2 (30 kD subunit) |
| 3883 | 1105 | NM_031758 | nn | somatostatin receptor-like protein | somatostatin receptor-like protein |
| 3998 | 22919 | NM_053556 | uu, ww | maternal G10 transcript | maternal G10 transcript |
| 4074 | 20939 | NM_053884 | l, m, s, General, bb, qq, uu | ATPase, vacuolar, 14 kD | ATPase, vacuolar, 14 kD |
| 4149 | 18027 | NM_130407 | e | UDP glycosyltransferase 1 family, polypeptide A7 | UDP glycosyltransferase 1 family, polypeptide A7 |
| 4149 | 18028 | NM_130407 | e | UDP glycosyltransferase 1 family, polypeptide A7 | UDP glycosyltransferase 1 family, polypeptide A7 |
| 4183 | 21703 | NM_133525 | oo | putative c-Myc-responsive | putative c-Myc-responsive |
| 4205 | 15655 | NM_133621 | nn | global ischemia induced protein GIIG15B | global ischemia induced protein GIIG15B |
| 4212 | 12719 | NM_134373 | l, uu | Esau | Esau |
| 4221 | 14697 | NM_134419 | dd | protein associating with small stress protein PASS1 | protein associating with small stress protein PASS1 |
| 4234 | 13563 | NM_138530 | m, ff | MAWD binding protein | MAWD binding protein |
| 4258 | 1049 | NM_138901 | g | phosphatidylinositol glycan, class L | phosphatidylinositol glycan, class L |
| 4266 | 16176 | NM_139087 | u | cell growth regulatory with EF-hand domain | cell growth regulatory with EF-hand domain |
| 4280 | 22595 | NM_139253 | d | stem cell derived neuronal survival protein precursor | stem cell derived neuronal survival protein precursor |
| 4284 | 7859 | NM_139328 | kk | liver regeneration-related protein | liver regeneration-related protein |
| 4294 | 17277 | NM_145082 | g | | *Rattus norvegicus* glycine-, glutamate-, thienylcyclohexylpiperidine-binding protein mRNA, complete cds |
| 4297 | 6731 | NM_145096 | c | | *Rattus norvegicus* small rec (srec) mRNA, complete cds |
| 4310 | 6824 | NM_147138 | ll, ss | | *Rattus norvegicus* SNAP25 interacting protein 30 (Sip30) mRNA, complete cds |
| 4340 | 24351 | S74257 | ii, kk, ll, ww | | ESTs, Weakly similar to ABD4_MOUSE ATP binding cassette, sub-family D, member 4 (Peroxisomal membrane protein 69) (PMP69) (Peroxisomal membrane protein 1-like) (PXMP1-L) (P70R) [*M. musculus*] |
| 4382 | 21654 | U53184 | f, l, y, General, ee | LPS-induced TNF-alpha factor | LPS-induced TNF-alpha factor |
| 4399 | 23282 | U90725 | g, ff, tt | lipoprotein-binding protein | lipoprotein-binding protein |
| 4415 | 20810 | X14181 | l | | ESTs, Highly similar to R5RT18 ribosomal protein L18a, cytosolic [validated] - rat [*R. norvegicus*] |
| 4420 | 7459 | X15551 | a, j, n, r | | ESTs, Highly similar to NBRT apolipoprotein H precursor - rat [*R. norvegicus*] |
| 4423 | 23987 | X51615 | w, gg, hh | | ESTs, Highly similar to 1604368A gap junction protein Cx26 [*Rattus norvegicus*] [*R. norvegicus*] |
| 4463 | 4223 | X77934 | mm | sperm membrane protein (YWK-II) | sperm membrane protein (YWK-II) |
| 73 | 13683 | AA799788 | s | HHs:cell division cycle 34 | ESTs, Moderately similar to I54552 hypothetical serine proteinase - rat [*R. norvegicus*] |
| 82 | 16346 | AA799824 | a, e, f, s, General, kk, oo | HHs:ATPase, H+ transporting, lysosomal 42 kD, V1 subunit C, isoform 1 | ESTs, Highly similar to VATC_MOUSE Vacuolar ATP synthase subunit C (V-ATPase C subunit) (Vacuolar proton pump C subunit) [*M. musculus*] |
| 107 | 4832 | AA800190 | oo | HHs:phosphorylase, glycogen; brain | ESTs, Highly similar to S37300 glycogen phosphorylase (EC 2.4.1.1), brain - rat [*R. norvegicus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1206 | 3364 | AA998097 | General | HHs:selenium donor protein | ESTs, Moderately similar to SPS2_MOUSE Selenide, water dikinase 2 (Selenophosphate synthetase 2) (Selenium donor protein 2) [*M. musculus*] |
| 1715 | 17506 | AI070068 | n, kk | HHs:growth arrest and DNA-damage-inducible, beta | ESTs, Weakly similar to 2104282A Gadd45 gene [*Rattus norvegicus*] [*R. norvegicus*] |
| 1913 | 23829 | AI103754 | h | HHs:UDP-Gal:betaGlcNAc beta 1,4-galactosyltransferase, polypeptide | ESTs, Weakly similar to glycoprotein galactosyltransferase beta 1,4; beta-1,4-2 GalT; galactosyltransferase beta 1, 4; B-1,4-GalT1; beta-1 4-GalT1 [*Mus musculus*] [M. musculus] |
| 1919 | 15050 | AI103911 | r | HHs:ubiquinol-cytochrome c reductase, Rieske iron-sulfur polypeptide 1 | ESTs, Highly similar to A32296 ubiquinol--cytochrome-c reductase (EC 1.10.2.2) Rieske iron-sulfur protein precursor - rat (fragment) [*R. norvegicus*] |
| 1967 | 23596 | AI105435 | uu, vv | HHs:glutaryl-Coenzyme A dehydrogenase | ESTs, Highly similar to GCDH_MOUSE Glutaryl-CoA dehydrogenase, mitochondrial precursor (GCD) [*M. musculus*] |
| 2090 | 23152 | AI169170 | xx | HHs:eukaryotic translation initiation factor 4A, isoform 2 | ESTs, Highly similar to S00985 translation initiation factor eIF-4A II - mouse [*M. musculus*] |
| 2979 | 13682 | L38482 | p | HHs:cell division cycle 34 | ESTs, Moderately similar to I54552 hypothetical serine proteinase - rat [*R. norvegicus*] |
| 13 | 1599 | AA686470 | General | DNA damage inducible transcript 3 | DNA-damage inducible transcript 3 |
| 13 | 1600 | AA686470 | pp | DNA-damage inducible transcript 3 | DNA-damage inducible transcript 3 |
| 65 | 14250 | AA799729 | qq, vv | Phosphodiesterase 4B, cAMP-specific (dunce (*Drosophila*)-homolog phosphodiesterase E4) | ESTs, Phosphodiesterase 4B, cAMP-specific (dunce (*Drosophila*)-homolog phosphodiesterase E4) |
| 66 | 18060 | AA799735 | c, j, q, x | RuvB-like protein 1 | RuvB-like protein 1 |
| 66 | 18061 | AA799735 | dd, oo | RuvB-like protein 1 | RuvB-like protein 1 |
| 74 | 1680 | AA799792 | gg, hh | Carboxyl ester lipase | Carboxyl ester lipase |
| 163 | 15852 | AA800942 | gg, hh | Complement component 4 | Complement component 4 |
| 166 | 11901 | AA801058 | l, nn | aldehyde dehydrogenase family 9, subfamily A1 | aldehyde dehydrogenase family 9, subfamily A1 |
| 216 | 6054 | AA818658 | ww | Diphtheria toxin receptor (heparin binding epidermal growth factor - like growth factor) | Diphtheria toxin receptor (heparin binding epidermal growth factor - like growth factor) |
| 217 | 4230 | AA818669 | l, ss | RAB7, member RAS oncogene family | RAB7, member RAS oncogene family |
| 234 | 576 | AA819118 | vv | S - adenosylmethionine synthetase | S - adenosylmethionine synthetase |
| 236 | 6018 | AA819140 | x | carbonic anhydrase 3 | carbonic anhydrase 3 |
| 252 | 6288 | AA819554 | ww | brain-specific angiogenesis inhibitor 1-associated protein 2 | brain-specific angiogenesis inhibitor 1-associated protein 2 |
| 449 | 17742 | AA866302 | ss | 4-hydroxyphenylpyruvic acid dioxygenase | 4-hydroxyphenylpyruvic acid dioxygenase |
| 455 | 16333 | AA866414 | k | Solute carrier family 4, member 1, anion exchange protein 1 (kidney band 3) | Solute carrier family 4, member 1, anion exchange protein 1 (kidney band 3) |
| 484 | 1190 | AA875089 | ll | Calpastatin | Calpastatin |
| 549 | 19321 | AA891666 | t | melanoma antigen, family D, 1 | melanoma antigen, family D, 1 |
| 572 | 21674 | AA891828 | jj | procollagen, type I, alpha 2 | procollagen, type I, alpha 2 |
| 624 | 820 | AA892395 | a, s, ss, uu | Aldolase B, fructose-biphosphate | Aldolase B, fructose-biphosphate |
| 778 | 4661 | AA899709 | e | receptor activity modifying protein 3 | receptor activity modifying protein 3 |
| 805 | 23038 | AA900881 | t, mm | branched chain aminotransferase 1, cytosolic | branched chain aminotransferase 1, cytosolic |
| 835 | 20711 | AA924267 | o | Cytochrome P450, subfamily IVB, polypeptide 1 | Cytochrome P450, subfamily IVB, polypeptide 1 |
| 869 | 23451 | AA925243 | j | restin (Reed-Steinberg cell-espressed intermediate filament-associated protein) | restin (Reed-Steinberg cell-espressed intermediate filament-associated protein) |
| 1083 | 23700 | AA956382 | ff | Acetyl-CoA acyltransferase 3-oxo acyl-CoA thiolase A 1, peroxisomal | Acetyl CoA acyltransferase, 3-oxo acyl-CoA thiolase A 1, peroxisomal |
| 1194 | 20712 | AA997806 | b, uu | Cytochrome P450 subfamily IVB, polypeptide 1 | Cytochrome P450, subfamily IVB, polypeptide 1 |
| 1241 | 3081 | AA999171 | General | Signal transducer and activator of transcription 1 | Signal transducer and activator of transcription 1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1252 | 22567 | AB017544 | u, kk | peroxisomal membrane anchor protein | peroxisomal membrane anchor protein |
| 1256 | 19702 | AF008587 | p | hemochromatosis | hemochromatosis |
| 1271 | 22602 | AF044574 | o | putative peroxisomal 2,4-dienoyl-CoA reductase | putative peroxisomal 2,4-dienoyl-CoA reductase |
| 1271 | 22603 | AF044574 | o, kk | putative peroxisomal 2,4-dienoyl-CoA reductase | putative peroxisomal 2,4-dienoyl-CoA reductase |
| 1299 | 10108 | AI007857 | b, General, dd | HGF-regulated tyrosine kinase substrate | HGF-regulated tyrosine kinase substrate |
| 1376 | 17524 | AI010568 | ss | Growth hormone receptor | Growth hormone receptor |
| 1428 | 24411 | AI012577 | h, z | Insulin-like growth factor II (somatomedin A) | Insulin-like growth factor II (somatomedin A) |
| 1454 | 1332 | AI013222 | mm | Platelet-derived growth factor A chain | ESTs, Platelet-derived growth factor A chain |
| 1496 | 17957 | AI028975 | d | Adaptor protein complex AP-1, beta 1 subunit | Adaptor protein complex AP-1, beta 1 subunit |
| 1566 | 5648 | AI044035 | ss | protein phosphatase 4, regulatory subunit 1 | protein phosphatase 4, regulatory subunit 1 |
| 1626 | 24336 | AI045621 | r | Myristoylated alanine-rich protein kinase C substrate | Myristoylated alanine-rich protein kinase C substrate |
| 1666 | 19835 | AI058964 | ll | transporter protein; system N1 Na+ and H+-coupled glutamine transporter | transporter protein; system N1 Na+ and H+-coupled glutamine transporter |
| 1902 | 18679 | AI103496 | bb | GDP-dissociation inhibitor 1 | GDP-dissociation inhibitor 1 |
| 2105 | 4091 | AI169417 | l, rr, tt | Phosphoglycerate mutase 1 | Phosphoglycerate mutase 1 |
| 2164 | 23465 | AI171243 | ww | erythrocyte protein band 4.1-like 3 | erythrocyte protein band 4.1-like 3 |
| 2168 | 14960 | AI171319 | gg, hh | guanine nucleotide binding protein (G protein), beta polypeptide 2-like 1 | ESTs, Highly similar to SWI/SNF related, matrix associated, actin dependent regulator of chromatin, subfamily b, member 1; integrase interactor 1 [Mus musculus] [M. musculus], guanine nucleotide binding protein (G protein), beta polypeptide 2-like 1 |
| 2219 | 7579 | AI172453 | v | proteasome (prosome, macropain) 26S subunit, non-ATPase, 10 | proteasome (prosome, macropain) 26S subunit, non-ATPase, 10 |
| 2264 | 10182 | AI176185 | tt | FBJ murine osteosarcoma viral (v-fos) oncogene homolog | FBJ murine osteosarcoma viral (v-fos) oncogene homolog |
| 2299 | 16477A | I176701 | jj | Fatty acid binding protein 3, muscle and heart | Fatty acid binding protein 3, muscle and heart |
| 2306 | 17235 | AI176815 | n | Tissue inhibitor of metalloproteinase 3 | Tissue inhibitor of metalloproteinase 3 |
| 2330 | 14989 | AI177366 | b | Integrin beta 1 | Integrin, beta 1 |
| 2347 | 13558 | AI177901 | k | Adrenergic receptor beta 1 | Adrenergic receptor beta 1 |
| 2348 | 15315 | AI177911 | x | calpactin I heavy chain | calpactin I heavy chain |
| 2427 | 16081 | AI179610 | s, rr | Heme oxygenase | Heme oxygenase |
| 2537 | 4280 | AI230247 | c, v, General | selenoprotein P, plasma, 1 | selenoprotein P, plasma, 1 |
| 2546 | 1378 | AI230602 | m | Retinoblastoma-related gene | Retinoblastoma-related gene |
| 2561 | 18778 | AI230982 | ww | Eph receptor B2 (ELK-related protein tyrosine kinase) | Eph receptor B2 (ELK-related protein tyrosine kinase) |
| 2570 | 24326 | AI231292 | a, l, General, cc, qq | Cystatin C (cysteine proteinase inhibitor) | Cystatin C (cysteine proteinase inhibitor) |
| 2570 | 24327 | AI231292 | h, l, rr | Cystatin C (cysteine proteinase inhibitor) | Cystatin C (cysteine proteinase inhibitor) |
| 2571 | 19288 | AI231305 | e | Platelet-derived growth factor receptor alpha | Platelet-derived growth factor receptor alpha |
| 2647 | 17907 | AI233224 | t | Epidermal growth factor receptor, formerly avian erythroblastic leukemia viral (v-erbB) oncogene homolog (Erbb1) | Epidermal growth factor receptor, formerly avian erythroblastic leukemia viral (v-erbB) oncogene homolog (Erbb1) |
| 2706 | 19995 | AI235320 | p, t | mitochondrial aconitase (nuclear aco2 gene) | mitochondrial aconitase (nuclear aco2 gene) |
| 2712 | 2241 | AI235500 | ss | cofilin 1, non-muscle | cofilin 1, non-muscle |
| 2880 | 18686 | D00729 | o, ff, jj | dodecenoyl-Coenzyme A delta isomerase (3,2 trans-enoyl-Coenyme A isomerase) | Rat mRNA for delta3, delta2-enoyl-CoA isomerase, dodecenoyl-Coenzyme A delta isomerase (3,2 trans-enoyl-Coenyme A isomerase) |
| 2889 | 536 | D25290 | g | Cadherin 6 (K-cadherin) | Cadherin 6 (K-cadherin) |
| 2890 | 16610 | D28557 | n, General, oo, rr | cold shock domain protein A | cold shock domain protein A |
| 2897 | 935 | D49434 | bb, ww | Arylsulfatase B (MPS VI) | Arylsulfatase B (MPS VI) |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2946 | 20429 | J05035 | t, xx | Steroid-5-alpha-reductase, alpha polypeptide 1 (3-oxo-5 alpha-steroid delta 4-dehydrogenase alpha 1) | Steroid-5-alpha-reductase, alpha polypeptide 1 (3-oxo-5 alpha-steroid delta 4-dehydrogenase alpha 1) |
| 2946 | 20430 | J05035 | bb, qq | Steroid-5-alpha-reductase, alpha polypeptide 1 (3-oxo-5 alpha-steroid delta 4-dehydropenase alpha 1) | Steroid-5-alpha-reductase, alpha polypeptide 1 (3-oxo-5 alpha-steroid delta 4-dehydrogenase alpha 1) |
| 2947 | 1247 | J05181 | vv | Glutamylcysteine gamma synthetase light chain | Glutamylcysteine gamma synthetase light chain |
| 2949 | 20549 | K01701 | y | Oxytocin/neurophysin | Oxytocin/neurophysin |
| 2956 | 20865 | L00117 | g, w, rr | Elastase 1 | Elastase 1 |
| 2957 | 5616 | L00191 | j | Fibronectin 1 | Fibronectin 1 |
| 2959 | 24425 | L08812 | k | transcription factor EC | transcription factor EC |
| 2974 | 15073 | L22761 | ww | GATA binding protein 4 | GATA-binding protein 4 |
| 2975 | 12058 | L25387 | t | phosphofructokinase platelet | ESTs, Highly similar to A53047 6-phosphofructokinase (EC 2.7.1.11) - rat [*R. norvegicus*] |
| 2980 | 6406 | L38615 | v | Glutathione synthetase gene | Glutathione synthetase gene |
| 2985 | 21097 | M12112 | s | Angiotensinogen | Angiotensinogen |
| 2991 | 20714 | M14972 | o, r | Cytochrome P450, subfamily IVB, polypeptide 1 | Cytochrome P450, subfamily IVB, polypeptide 1 |
| 2995 | 24407 | M17960 | v | Insulin-like growth factor II (somatomedin A) | Insulin-like growth factor II (somatomedin A) |
| 3004 | 6626 | M24353 | l, k, General, ll | mannosidase 2, alpha 1 | ESTs, Highly similar to M2A1_RAT Alpha-mannosidase II (Mannosyl-oligosaccharide 1,3-1,6-alpha-mannosidase) (MAN II) (Golgi alpha-mannosidase II) (Mannosidase alpha class 2A member 1) [*R. norvegicus*] |
| 3005 | 668 | M25823 | jj | Protein tyrosine phosphatase, receptor-type, c polypeptide (antigen Cd45, leukocyte-common antigen/T200 glycoprotein) also RT7 | Protein tyrosine phosphatase, receptor-type, c polypeptide (antigen Cd45, leukocyte-common antigen/T200 glycoprotein) also RT7 |
| 3007 | 16930 | M27440 | h, o, ss, vv | Apolipoprotein B | Apolipoprotein B |
| 3011 | 23610 | M32754 | l | Inhibin, alpha | Inhibin, alpha |
| 3019 | 20713 | M57718 | o, r, xx | Cytochrome P450, subfamily IVB, polypeptide 1 | Cytochrome P450, subfamily IVB, polypeptide 1 |
| 3022 | 2465 | M59814 | ee, ww | Eph receptor B2 (ELK-related protein tyrosine kinase) | Eph receptor B2 (ELK-related protein tyrosine kinase) |
| 3023 | 457 | M60666 | c, nn | Tropomyosin 1 (alpha) | Tropomyosin 1 (alpha) |
| 3024 | 24253 | M61142 | s | Thimet oligopeptidase | Thimet oligopeptidase |
| 3043 | 17991 | M96626 | g | ATPase, Ca++ transporting, plasma membrane 3 | ATPase, Ca++ transporting, plasma membrane 3 |
| 3044 | 1678 | M96674 | l, General, nn, pp | glucagon receptor | glucagon receptor |
| 3046 | 23698 | NM_012489 | o, xx | Acetyl-CoA acyltransferase, 3-oxo acyl-CoA thiolase A 1, peroxisomal | Acetyl-CoA acyltransferase, 3-oxo acyl-CoA thiolase A 1, peroxisomal |
| 3046 | 23699 | NM_012489 | o, u, v, ss | Acetyl-CoA acyltransferase, 3-oxo acyl-CoA thiolase A 1, peroxisomal | Acetyl-CoA acyltransferase, 3-oxo acyl-CoA thiolase A 1, peroxisomal |
| 3047 | 265 | NM_012494 | gg, hh, jj | Angiotensin receptor 2 | Angiotensin receptor 2 |
| 3048 | 7062 | NM_012495 | t, bb, mm | Aldolase A, fructose-bisphosphate | Aldolase A, fructose-bisphosphate |
| 3048 | 7064 | NM_012495 | s | Aldolase A, fructose-bisphosphate | Aldolase A, fructose-bisphosphate |
| 3049 | 1655 | NM_012497 | n | Aldolase C, fructose-biphosphate | Aldolase C, fructose-biphosphate |
| 3050 | 1421 | NM_012500 | f | N-acylaminoacyl-peptide hydrolase | N-acylaminoacyl-peptide hydrolase |
| 3051 | 17787 | NM_012501 | ee | Apolipoprotein C-III | Apolipoprotein C-III |
| 3053 | 15675 | NM_012504 | General | ATPase, Na+K+ transporting, alpha 1 polypeptide | ATPase, Na+K+ transporting, alpha 1 polypeptide |
| 3053 | 15677 | NM_012504 | General, mm | ATPase, Na+K+ transporting, alpha 1 polypeptide | ATPase, Na+K+ transporting, alpha 1 polypeptide |
| 3054 | 855 | NM_012507 | ll | ATPase, Na+K+ transporting, beta polypeptide 2 | ATPase, Na+K+ transporting, beta polypeptide 2 |
| 3056 | 7427 | NM_012515 | ll | Benzodiazepin receptor (peripheral) | Benzodiazepin receptor (peripheral) |
| 3058 | 20518 | NM_012518 | e, nn | Calmodulin III | Calmodulin III |
| 3059 | 15740 | NM_012520 | p | Catalase | Catalase |
| 3059 | 15741 | NM_012520 | o, General, bb | Catalase | Catalase |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3060 | 24865 | NM_012521 | ss | Calcium-binding protein, intestinal, vitamin D-dependent (9-kDa CaBP) | Calcium-binding protein, intestinal, vitamin D-dependent (9-kDa CaBP) |
| 3061 | 11115 | NM_012531 | l, nn | Catecholamine-O-methyltransferase | Catecholamine-O-methyltransferase |
| 3061 | 11116 | NM_012531 | nn | Catecholamine-O-methyltransferase | Catecholamine-O-methyltransferase |
| 3063 | 20357 | NM_012534 | p, bb | Crystallin, alpha polypeptide A | Crystallin, alpha polypeptide A |
| 3064 | 488 | NM_012540 | j, w | Cytochrome P450, subfamily I (aromatic compound-inducible), member A1 (C6, form c) | Cytochrome P450, subfamily I (aromatic compound-inducible), member A1 (C6, form c) |
| 3064 | 489 | NM_012540 | e, tt | Cytochrome P450, subfamily I (aromatic compound-inducible), member A1 (C6, form c) | Cytochrome P450, subfamily I (aromatic compound-inducible), member A1 (C6, form c) |
| 3064 | 20705 | NM_012540 | j | Cytochrome P450, subfamily I (aromatic compound-inducible), member A2 (Q42, form d) | Cytochrome P450, subfamily I (aromatic compound-inducible), member A2 (Q42, form d) |
| 3065 | 20703 | NM_012541 | xx | Cytochrome P450, subfamily I (aromatic compound-inducible), member A2 (Q42, form d) | Cytochrome P450, subfamily I (aromatic compound-inducible), member A2 (Q42, form d) |
| 3066 | 225 | NM_012544 | j | Angiotensin I-converting enzyme (Dipeptidyl carboxypeptidase 1) | Angiotensin I-converting enzyme (Dipeptidyl carboxypeptidase 1) |
| 3067 | 23868 | NM_012551 | dd, oo, tt | Early growth response 1 | Early growth response 1 |
| 3067 | 23869 | NM_012551 | oo, tt | Early growth response 1 | Early growth response 1 |
| 3067 | 23871 | NM_012551 | tt, vv | Early growth response 1 | Early growth response 1 |
| 3067 | 23872 | NM_012551 | dd, tt | Early growth response 1 | Early growth response 1 |
| 3069 | 17676 | NM_012556 | g, j | Fatty acid binding protein 1, liver | Fatty acid binding protein 1, liver |
| 3072 | 11732 | NM_012561 | p | Follistatin | Follistatan |
| 3074 | 20717 | NM_012569 | c | Glutaminase | Glutaminase |
| 3075 | 4573 | NM_012570 | l, General | Glutamate dehydrogenase | Glutamate dehydrogenase |
| 3075 | 4574 | NM_012570 | h, l, p, General, dd, ii, uu | Glutamate dehydrogenase | Glutamate dehydrogenase |
| 3077 | 85 | NM_012572 | c | Glutamate receptor, ionotropic, kainate 4 | Glutamate receptor, ionotropic, kainate 4 |
| 3079 | 16024 | NM_012578 | m | Histone H1-0 | Histone H1-0 |
| 3079 | 16025 | NM_012578 | m, ww | Histone H1-0 | Histone H1-0 |
| 3079 | 16026 | NM_012578 | m, ww | Histone H1-0 | Histone H1-0 |
| 3081 | 20313 | NM_012585 | k | 5-Hydroxytryptamine (serotonin) receptor 1A | 5-Hydroxytryptamine (serotonan) receptor 1A |
| 3082 | 21162 | NM_012591 | d, u | Interferon regulatory factor 1 | Interferon regulatory factor 1 |
| 3083 | 4449 | NM_012592 | z, General | Isovaleryl Coenzyme A dehydrogenase | Isovaleryl Coenzyme A dehydrogenase |
| 3083 | 4450 | NM_012592 | p | Isovaleryl Coenzyme A dehydrogenase | Isovaleryl Coenzyme A dehydrogenase |
| 3085 | 2505 | NM_012597 | w | Lipase, hepatic | Lipase, hepatic |
| 3088 | 2628 | NM_012603 | f, l, y, z, General | Avian myelocytomatosis viral (v-myc) oncogene homolog | Avian myelocytomatosis viral (v-myc) oncogene homolog |
| 3088 | 2629 | NM_012603 | f, l, l, z, General, nn | Avian myelocytomatosis viral (v-myc) oncogene homolog | Avian myelocytomatosis viral (v-myc) oncogene homolog |
| 3089 | 16850 | NM_012608 | k | Membrane metallo-endopeptidase (neutral endopeptidase/enkephalinase) | Membrane metallo-endopeptidase (neutral endopeptidase/enkephalinase) |
| 3091 | 24506 | NM_012614 | d, v | Neuropeptide Y | Neuropeptide Y |
| 3092 | 23522 | NM_012615 | c, g, l, m, n, w, General, kk | Ornitine decarboxylase | Ornitine decarboxylase |
| 3092 | 23523 | NM_012615 | l, v | Ornitine decarboxylase | Ornitine decarboxylase |
| 3093 | 6055 | NM_012619 | b, l, General, uu | Phenylalanine hydroxylase | Phenylalanane hydroxylase |
| 3095 | 24568 | NM_012630 | g | Prolactin receptor | Prolactin receptor |
| 3096 | 18553 | NM_012631 | b, c, qq, vv | Prion protein, structural | Prion protein, structural |
| 3098 | 20798 | NM_012639 | ll | Murine leukemia viral (v-raf-1) oncogene homolog 1 (3611-MSV) | Murine leukemia viral (v-raf-1) oncogene homolog 1 (3611-MSV) |
| 3098 | 20799 | NM_012639 | p | Murine leukemia viral (v-raf-1) oncogene homolog 1 (3611-MSV) | Murine leukemia viral (v-raf-1) oncogene homolog 1 (3611-MSV) |
| 3100 | 16220 | NM_012656 | c, cc | Secreted acidic cystein-rich glycoprotein (osteonectin) | Secreted acidic cystein-rich glycoprotein (osteonectin) |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3103 | 24825 | NM_012668 | x, ee, ss | Tyrosine aminotransferase | Tyrosine aminotransferase |
| 3104 | 24427 | NM_012669 | pp | Transcription factor 1, hepatic; LF-B1 hepatic nuclear factor (HNF1): albumin proximal factor, also TCF1 | Transcription factor 1, hepatic, LF-B1, hepatic nuclear factor (HNF1): albumin proximal factor, also TCF1 |
| 3106 | 17117 | NM_012673 | w | Thymus cell surface antigen | Thymus cell surface antigen |
| 3110 | 4185 | NM_012681 | ee, gg, hh | Transthyretin (prealbumin, amyloidosis type I) | Transthyretin (prealbumin, amyloidosis type I) |
| 3110 | 4186 | NM_012681 | n, ee | Transthyretin (prealbumin, amyloidosis type I) | Transthyretin (prealbumin, amyloidosis type I) |
| 3111 | 5850 | NM_012687 | g | ThromboxA ane synthase 1 | ThromboxA ane synthase 1 |
| 3112 | 24453 | NM_012690 | a, s | ATP-binding cassette, sub-family B (MDR/TAP), member 4 (P-glycoprotein 3/multidrug resistance 2 | ATP-binding cassette, sub-family B (MDR/TAP), member 4 (P-glycoprotein 3/ multidrug resistance 2 |
| 3116 | 1850 | NM_012696 | a | T-kininogen, see also D11Elh1 and D11Mit8 | T-kininogen, see also D11Elh1 and D11Mit8 |
| 3116 | 1854 | NM_012696 | a | T-kininogen, see also D11Elh1 and D11Mit8 | T-kininogen, see also D11Elh1 and D11Mit8 |
| 3120 | 4002 | NM_012708 | p, General, nn | Low molecular mass polypeptide 2 | Low molecular mass polypeptide 2 |
| 3120 | 4003 | NM_012708 | p | Low molecular mass polypeptide 2 | Low molecular mass polypeptide 2 |
| 3120 | 4004 | NM_012708 | nn | Low molecular mass polypeptide 2 | Low molecular mass polypeptide 2 |
| 3120 | 4005 | NM_012708 | General | Low molecular mass polypeptide 2 | Low molecular mass polypeptide 2 |
| 3122 | 322 | NM_012715 | p, t, ff, ii, pp, xx | Adrenomedullin | Adrenomedullin |
| 3123 | 1632 | NM_012717 | d, y | Calcitonin receptor-like receptor | Calcitonin receptor-like receptor |
| 3127 | 1372 | NM_012734 | xx | Hexokinase 1 | Hexokinase 1 |
| 3137 | 1348 | NM_012776 | m | adrenergic receptor kinase, beta 1 | adrenergic receptor kinase, beta 1 |
| 3137 | 1349 | NM_012776 | ii, rr | adrenergic receptor kinase, beta 1 | adrenergic receptor kinase, beta 1 |
| 3139 | 11938 | NM_012783 | x | Basigin (Ox47 antigen or CE-9) (EMMPRIN in human) (neurothelin, HT7 or 5A11 in avian) | Basigin (Ox47 antigen or CE-9) (EMMPRIN in human) (neurothelin, HT7 or 5A11 in avian) |
| 3142 | 16947 | NM_012793 | a, b, e, m, s, z, General, qq, uu, vv | Guanidinoacetate methyltransferase | Guanidinoacetate methyltransferase |
| 3142 | 16948 | NM_012793 | qq, uu | Guanidinoacetate methyltransferase | Guanidinoacetate methyltransferase |
| 3143 | 961 | NM_012796 | p | glutathione S-transferase, theta 2 | glutathione S-transferase, theta 2 |
| 3147 | 15032 | NM_012816 | t | alpha methylacyl CoA racemase | alpha methylacyl-CoA racemase |
| 3148 | 326 | NM_012818 | ss | Arylalkylamine N - acetyltransferase (Serotonin N - acetyltransferase) | Arylalkylamine N - acetyltransferase (Serotonin N - acetyltransferase) |
| 3149 | 6780 | NM_012819 | n | Acyl Coenzyme A dehydrogenase, long chain | Acyl Coenzyme A dehydrogenase, long chain |
| 3151 | 20586 | NM_012826 | a, m, vv | Zn - alpha2 - glycoprotein | Zn - alpha2 - glycoprotein |
| 3151 | 20587 | NM_012826 | v, vv | Zn - alpha2 - glycoprotein | Zn - alpha2 - glycoprotein |
| 3152 | 15035 | NM_012836 | nn | Carboxypeptidase D precursor | Carboxypeptidase D precursor |
| 3153 | 2853 | NM_012838 | j, l, qq | Cystatin beta | Cystatin beta |
| 3153 | 2854 | NM_012838 | j, l, General, cc, rr | Cystatin beta | Cystatin beta |
| 3153 | 2855 | NM_012838 | l, cc | Cystatin beta | Cystatin beta |
| 3155 | 338 | NM_012843 | t, ff, mm | Epithelial membrane protein 1 | Epithelial membrane protein 1 |
| 3156 | 17541 | NM_012844 | l, s, General, ff, ll, ww | Epoxide hydrolase 1 (microsomal xenobiotic hydrolase) | Epoxide hydrolase 1 (microsomal xenobiotic hydrolase) |
| 3157 | 644 | NM_012846 | kk | Fibroblast growth factor 1 (heparin binding) | Fibroblast growth factor 1 (heparin binding) |
| 3158 | 20819 | NM_012847 | vv | Farnesyltransferase, subunit alpha | Farnesyltransferase, subunit alpha |
| 3165 | 15872 | NM_012879 | bb | Solute carrier family 2 A2 (gkucose transporter, type 2) | Solute carrier family 2 A2 (gkucose transporter, type 2) |
| 3166 | 16301 | NM_012883 | g, w, rr | Estrogen sulfotransferase | Estrogen sulfotransferase |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3166 | 4282 | NM_012883 | rr | Estrogen sulfotransferase, selenoprotein P, plasma, 1 | Estrogen sulfotransferase, selenoprotein P, plasma, 1 |
| 3167 | 16870 | NM_012887 | v | Thymopoietin (lamina associated polypeptide 2) | Thymopoietin (lamina associated polypeptide 2) |
| 3167 | 16871 | NM_012887 | r, z, ee, oo | Thymopoietin (lamina associated polypeptide 2) | Thymopoietin (lamina associated polypeptide 2) |
| 3167 | 16872 | NM_012887 | pp | Thymopoietin (lamina associated polypeptide 2) | Thymopoietin (lamina associated polypeptide 2) |
| 3169 | 16708 | NM_012895 | a, b, h, w | Adenosin kinase | Adenosin kinase |
| 3171 | 16273 | NM_012898 | k | alpha-2-HS-glycoprotein | alpha-2-HS-glycoprotein |
| 3171 | 16274 | NM_012898 | r | alpha-2-HS-glycoprotein | alpha-2-HS-glycoprotein |
| 3171 | 16275 | NM_012898 | r, ee | alpha-2-HS-glycoprotein | alpha-2-HS-glycoprotein |
| 3172 | 18564 | NM_012899 | k, w | aminolevulinate,delta-,dehydratase | aminolevulinate,delta-,dehydratase |
| 3173 | 7897 | NM_012901 | u | Alpha-1 microglobulin/bikunin | Alpha-1 microglobulin/bikunin |
| 3173 | 7898 | NM_012901 | e, r | Alpha-1 microglobulin/bikunin | Alpha-1 microglobulin/bikunin |
| 3173 | 7899 | NM_012901 | e | Alpha-1 microglobulin/bikunin | Alpha-1 microglobulin/bikunin |
| 3176 | 20590 | NM_012913 | n, kk | ATPase, Na+K+ transporting, beta polypeptide 3 | ATPase, Na+K+ transporting, beta polypeptide 3 |
| 3177 | 24783 | NM_012914 | p | ATPase, Ca++ transporting, ubiquitous | ATPase, Ca++ transporting, ubiquitous |
| 3179 | 776 | NM_012922 | u | Caspase 3, apoptosis related cysteine protease (ICE-like cysteine protease) | Caspase 3, apoptosis related cysteine protease (ICE-like cysteine protease) |
| 3179 | 777 | NM_012922 | z | Caspase 3, apoptosis related cysteine protease (ICE-like cysteine protease) | Caspase 3, apoptosis related cysteine protease (ICE-like cysteine protease) |
| 3182 | 1977 | NM_012930 | o, p, y, ff, xx | Carnitine palmitoyltransferase 2 | Carnitine palmitoyltransferase 2 |
| 3186 | 190 | NM_012940 | e | Cytochrome P450 1b1 | Cytochrome P450 1b1 |
| 3186 | 191 | NM_012940 | e | Cytochrome P450 1b1 | Cytochrome P450 1b1 |
| 3186 | 192 | NM_012940 | e | Cytochrome P450 1b1 | Cytochrome P450 1b1 |
| 3186 | 193 | NM_012940 | e, v | Cytochrome P450 1b1 | Cytochrome P450 1b1 |
| 3187 | 20928 | NM_012941 | ee | Cytochrom P450 Lanosterol 14 alpha-demethylase | Cytochrom P450 Lanosterol 14 alpha-demethylase |
| 3187 | 20929 | NM_012941 | jj | Cytochrom P450 Lanosterol 14 alpha-demethylase | Cytochrom P450 Lanosterol 14 alpha-demethylase |
| 3187 | 20931 | NM_012941 | uu | Cytochrom P450 Lanosterol 14 alpha-demethylase | Cytochrom P450 Lanosterol 14 alpha-demethylase |
| 3189 | 1285 | NM_012948 | r, x | Emerin | Emerin |
| 3190 | 1813 | NM_012953 | l, p, y, z, ee | Fos-like antigen 1 | Fos-like antigen 1 |
| 3192 | 5034 | NM_012966 | v | Heat shock 10 kD protein 1 (chaperonin 10) | Heat shock 10 kD protein 1 (chaperonin 10) |
| 3193 | 2554 | NM_012967 | vv | Intercellular adhesion molecule 1 | Intercellular adhesion molecule 1 |
| 3193 | 2555 | NM_012967 | vv | Intercellular adhesion molecule 1 | Intercellular adhesion molecule 1 |
| 3195 | 24528 | NM_012973 | g | Potassium (K+) channel protein, slowly activating (lsk) | Potassium (K+) channel protein, slowly activating (lsk) |
| 3200 | 24492 | NM_012987 | jj | Nestin | Nestin |
| 3201 | 764 | NM_012988 | c, p, r, z, General | Nuclear Factor IA | Nuclear Factor IA |
| 3201 | 765 | NM_012988 | h, q, z, General | Nuclear Factor IA | Nuclear Factor IA |
| 3202 | 16417 | NM_012991 | l, x, General, vv | Nucleoprotein 50 kD | Nucleoprotein 50 kD |
| 3203 | 17393 | NM_012992 | b, l, j, General, qq | Nucleoplasmin-related protein (Nuclear protein B23 | Nucleoplasmin-related protein (Nuclear protein B23 |
| 3203 | 17394 | NM_012992 | General | Nucleoplasmin-related protein (Nuclear protein B23 | Nucleoplasmin-related protein (Nuclear protein B23 |
| 3206 | 1640 | NM_013000 | pp | Peptidylglycine alpha-amidating monooxygenase | Peptidylglycine alpha-amidating monooxygenase |
| 3206 | 1649 | NM_013000 | n | Peptidylglycine alpha-amidating monooxygenase | Peptidylglycine alpha-amidating monooxygenase |
| 3208 | 25279 | NM_013011 | bb | Tyrosine 3-monooxygenase/tryptophan 5-monooxygenase activation protein, zeta polypeptide | Tyrosine 3-monooxygenase/tryptophan 5-monooxygenase activation protein, zeta polypeptide |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3208 | 3405 | NM_013011 | ss | Tyrosine 3-monooxygenaseltryptophan 5-monooxygenase activation protein, zeta polypeptide | Tyrosine 3-monooxygenase/tryptophan 5-monooxygenase activation protein, zeta polypeptide |
| 3210 | 11905 | NM_013016 | s, x | Protein tyrosine phosphatase, non-receptor type substrate 1 (SHP substrate 1) | Protein tyrosine phosphatase, non-receptor type substrate 1 (SHP substrate 1) |
| 3212 | 1588 | NM_013026 | j, t, mm, ww | Syndecan 1 | Syndecan 1 |
| 3212 | 1589 | NM_013026 | mm | Syndecan 1 | Syndecan 1 |
| 3213 | 17894 | NM_013027 | v | Selenoprotein W muscle 1 | Selenoprotein W muscle 1 |
| 3214 | 1734 | NM_013028 | oo | Short stature homeobox 2 | Short stature homeobox 2 |
| 3216 | 313 | NM_013033 | g | Solute carrier family 5, member alpha 1 (Na+/glucose cotransporter) | Solute carrier family 5, member alpha 1 (Na+/glucose cotransporter) |
| 3217 | 24809 | NM_013036 | g | Somatostatin receptor subtype 4 *Rattus norvegicus* Sprague-Dawley major hippocampal somatostatin receptor (SSTR4) mRNA | Somatostatin receptor subtype 4 *Rattus norvegicus* Sprague-Dawley major hippocampal somatostatin receptor (SSTR4) mRNA |
| 3218 | 115 | NM_013037 | u | Interleukin 1 receptor-like 1 (Fos-responsive gene 1) | Interleukin 1 receptor-like 1 (Fos-responsive gene 1) |
| 3221 | 12013 | NM_013050 | l, nn | Ubiquitin conjugating enzyme E2I | Ubiquitin conjugating enzyme E2I |
| 3221 | 12014 | NM_013050 | l, j, y | Ubiquitin conjugating enzyme E2I | Ubiquitin conjugating enzyme E2I |
| 3222 | 16683 | NM_013052 | r | Tyrosine 3-monooxygenase/tryptophan 5-monooxygenase activation protein, eta polypeptide | Tyrosine 3-monooxygenase/tryptophan 5-monooxygenase activation protein, eta polypeptide |
| 3222 | 16684 | NM_013052 | pp | Tyrosine 3-monooxygenase/tryptophan 5-monooxygenase activation protein, eta polypeptide | Tyrosine 3-monooxygenase/tryptophan 5-monooxygenase activation protein, eta polypeptide |
| 3224 | 12370 | NM_013055 | u | Mitogen activated protein kinase 12 (Zipper (leucine) protein kinase) | Mitogen activated protein kinase 12 (Zipper (leucine) protein kinase) |
| 3232 | 13282 | NM_013078 | n, jj | Ornithine carbamoyltransferase | Ornithine carbamoyltransferase |
| 3232 | 13283 | NM_013078 | h, l, m, s, General, cc, uu | Ornithine carbamoyltransferase | Ornithine carbamoyltransferase |
| 3239 | 15296 | NM_013102 | k | FK506 binding protein 2 (13 kDa), FK506-binding protein 1 (12 kD) | FK506-binding protein 1 (12 kD) |
| 3240 | 1885 | NM_013103 | l, u, z | Transcription factor 2 hepatic; LF-B3; variant hepatic nuclear factor | Transcription factor 2, hepatic; LF-B3; variant hepatic nuclear factor |
| 3242 | 24195 | NM_013111 | f, q | Solute carrier family 7 member A1 (amino acid transporter cationic 1) | Solute carrier family 7 member A1 (amino acid transporter cationic 1) |
| 3242 | 24196 | NM_013111 | f, l, q, z, General, dd | Solute carrier family 7 member A1 (amino acid transporter cationic 1) | Solute carrier family 7 member A1 (amino acid transporter cationic 1) |
| 3246 | 14300 | NM_013129 | pp | Interleukin 15 | Interleukin 15 |
| 3248 | 650 | NM_013134 | vv | 3-hydroxy-3-methylglutaryl-Coenzyme A reductase | 3-hydroxy-3-methylglutaryl-Coenzyme A reductase |
| 3248 | 651 | NM_013134 | t | 3-hydroxy-3-methylglutaryl-Coenzyme A reductase | 3-hydroxy-3-methylglutaryl-Coenzyme A reductase |
| 3248 | 652 | NM_013134 | n, t | 3-hydroxy-3-methylglutaryl-Coenzyme A reductase | 3-hydroxy-3-methylglutaryl-Coenzyme A reductase |
| 3250 | 1712 | NM_013138 | nn | Inositol 1, 4, 5-triphosphate receptor 3 | Inositol 1, 4, 5-triphosphate receptor 3 |
| 3251 | 5837 | NM_013143 | s | Meprin 1 alpha | Meprin 1 alpha |
| 3254 | 21683 | NM_013154 | d, g | CCAAT/enhancerbinding, protein (C/EBP) delta | CCAAT/enhancerbinding, protein (C/EBP) delta |
| 3256 | 3430 | NM_013156 | g, General, oo, pp, uu | Cathepsin L | Cathepsin L |
| 3256 | 3431 | NM_013156 | z, cc | Cathepsin L | Cathepsin L |
| 3260 | 447 | NM_013165 | tt | Cholecystokinin B receptor | Cholecystokinin B receptor |
| 3261 | 24750 | NM_013167 | cc | Uncoupling protein 3, mitochondrial | Uncoupling protein 3, mitochondrial |
| 3273 | 20854 | NM_013200 | j, nn | Carnitine palmitoyltransferase 1 beta, muscle isoform | Carnitine palmitoyltransferase 1 beta, muscle isoform |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3273 | 20856 | NM_013200 | o, jj | Carnitine palmitoyltransferase 1 beta, muscle isoform | Carnitine palmitoyltransferase 1 beta, muscle isoform |
| 3275 | 23361 | NM_013216 | r | Ras homolog enriched in brain | Ras homolog enriched in brain |
| 3282 | 21078 | NM_016986 | l, o, ss | Acyl-Coenzyme A dehydrogenase, C-4 to C-12 straight-chain | Acyl-Coenzyme A dehydrogenase, C-4 to C-12 straight-chain |
| 3283 | 15612 | NM_016987 | ee | ATP citrate lyase | ATP citrate lyase |
| 3283 | 15613 | NM_016987 | ii, ll, ww | ATP citrate lyase | ATP citrate lyase |
| 3285 | 24868 | NM_016992 | nn | Arginine vasopressin (Diabetes insipidus) | Arginine vasopressin (Diabetes insipidus) |
| 3285 | 24869 | NM_016992 | g | Arginine vasopressin (Diabetes insipidus) | Arginine vasopressin (Diabetes insipidus) |
| 3290 | 15620 | NM_017005 | p | Fumarate hydratase | Fumarate hydratase |
| 3291 | 8417 | NM_017008 | l | Glyceraldehyde-3-phosphate dehydrogenase | Glyceraldehyde-3-phosphate dehydrogenase |
| 3294 | 17815 | NM_017015 | p, r, w, z | Glucuronidase, beta | Glucuronidase, beta |
| 3295 | 649 | NM_017017 | cc | Hepatocyte growth factor (scatter factor) | Hepatocyte growth factor (scatter factor) |
| 3298 | 11836 | NM_017023 | g | Potassium inwardly rectifying channel, subfamily J | Potassium inwardly-rectifying channel, subfamily J |
| 3299 | 670 | NM_017024 | a, m, v, cc uu, vv | Lecithin cholesterol acyltransferase | Lecithin-cholesterol acyltransferase |
| 3301 | 4500 | NM_017037 | m, General, ii, qq, uu, vv | Peripheral myelin protein | Peripheral myelin protein |
| 3302 | 3202 | NM_017039 | t | Protein phosphatase 2 (formerly 2A), catalytic subunit, alpha isoform | Protein phosphatase 2 (formerly 2A), catalytic subunit, alpha isoform |
| 3302 | 3203 | NM_017039 | oo | Protein phosphatase 2 (formerly 2A), catalytic subunit, alpha isoform | Protein phosphatase 2 (formerly 2A), catalytic subunit, alpha isoform |
| 3303 | 24697 | NM_017048 | rr | Solute carrier family 4, member 2, anion exchange protein 2 | Solute carrier family 4, member 2, anion exchange protein 2 |
| 3304 | 20876 | NM_017050 | k, tt | Superoxide dismutase 1, soluble | Superoxide dismutase 1, soluble |
| 3305 | 1877 | NM_017052 | w | Sorbitol dehydrogenase | Sorbitol dehydrogenase |
| 3309 | 6653 | NM_017068 | tt | Lysosomal-associated membrane protein 2 | Lysosomal-associated membrane protein 2 |
| 3310 | 20649 | NM_017072 | b, General, kk, vv | Carboamyl-phosphate synthetase 1 | Carboamyl-phosphate synthetase 1 |
| 3310 | 20650 | NM_017072 | b, c, General, cc, kk, uu, vv | Carboamyl-phosphate synthetase 1 | Carboamyl-phosphate synthetase 1 |
| 3312 | 18957 | NM_017075 | o, xx | Acetyl-Co A acetyltransferase 1, mitochondrial | Acetyl-Co A acetyltransferase 1, mitochondrial |
| 3312 | 18958 | NM_017075 | o, jj | Acetyl-Co A acetyltransferase 1, mitochondrial | Acetyl-Co A acetyltransferase 1, mitochondrial |
| 3317 | 1550 | NM_017084 | uu | Glycine methyltransferase | Glycine methyltransferase |
| 3317 | 1551 | NM_017084 | uu | Glycine methyltransferase | Glycine methyltransferase |
| 3317 | 1552 | NM_017084 | g, uu | Glycine methyltransferase | Glycine methyltransferase |
| 3318 | 1383 | NM_017088 | General | GDP-dissociation inhibitor 1 | GDP-dissociation inhibitor 1 |
| 3320 | 6013 | NM_017096 | e, w, rr, vv | C-reactive protein | C-reactive protein |
| 3324 | 20745 | NM_017113 | a, k, l, cc, tt, uu | granulin | granulin |
| 3324 | 20746 | NM_017113 | a, j, l, cc, ss, uu, vv | granulin | granulin |
| 3325 | 21538 | NM_017116 | gg, hh | calpain 2 | calpain 2 |
| 3327 | 21663 | NM_017126 | l, pp | ferredoxin 1 | ferredoxin 1 |
| 3328 | 1305 | NM_017127 | oo | Choline kinase | Choline kinase |
| 3328 | 1306 | NM_017127 | f, l, General, kk, qq, vv | Choline kinase | Choline kinase |
| 3330 | 24693 | NM_017134 | a, b, l, General, cc | arginase 1 liver | arginase 1, liver |
| 3331 | 16681 | NM_017136 | r, w, jj | squalene epoxidase | squalene epoxidase |
| 3331 | 16682 | NM_017136 | t, mm | squalene epoxidase | squalene epoxidase |
| 3332 | 24885 | NM_017138 | q, ll | laminin receptor 1 | laminin receptor 1 |
| 3332 | 24886 | NM_017138 | l, ll | laminin receptor 1 | laminin receptor 1 |
| 3333 | 492 | NM_017140 | l | dopamine receptor 3 | dopamine receptor 3 |
| 3334 | 24105 | NM_017141 | a | DNA polymerase beta | DNA polymerase beta |
| 3334 | 24107 | NM_017141 | d, g | DNA polymerase beta | DNA polymerase beta |
| 3337 | 15364 | NM_017147 | l | cofilin 1, non-muscle | cofilin 1, non-muscle |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3339 | 16953 | NM_017151 | h, ll | ribosomal protein S15 | ribosomal protein S15 |
| 3339 | 16954 | NM_017151 | bb, gg, hh | ribosomal protein S15 | ribosomal protein S15 |
| 3339 | 16955 | NM_017151 | e | ribosomal protein S15 | ribosomal protein S15 |
| 3340 | 21643 | NM_017152 | u, General, ee, ll | ribosomal protein S17 | ribosomal protein S17 |
| 3341 | 1694 | NM_017153 | h, z, General, ee | ribosomal protein S3a | ribosomal protein S3a |
| 3344 | 70 | NM_017159 | b, c, y | histidine ammonia lyase | histidine ammonia lyase |
| 3345 | 17105 | NM_017160 | ee | ribosomal protein S6 | ribosomal protein S6 |
| 3346 | 595 | NM_017161 | bb, mm | Adenosine A2b receptor | Adenosine A2b receptor |
| 3356 | 24670 | NM_017189 | a, n | asialoglycoprotein receptor 2 | asialoglycoprotein receptor 2 |
| 3359 | 20779 | NM_017201 | u | S-adenosylhomocysteine hydrolase | S-adenosylhomocysteine hydrolase |
| 3360 | 14694 | NM_017202 | ff | cytochrome c oxidase, subunit IVa | cytochrome c oxidase, subunit IVa |
| 3363 | 1703 | NM_017210 | mm | deiodinase, iodothyronine type III | deiodinase, iodothyronine type III |
| 3363 | 1704 | NM_017210 | mm, xx | deiodinase, iodothyronine type III | deiodinase, iodothyronine type III |
| 3365 | 317 | NM_017218 | h, General, bb, pp | avian erythroblastosis oncogene B 3 | avian erythroblastosis oncogene B 3 |
| 3368 | 18147 | NM_017226 | cc | peptidyl arginine deiminase, type II | peptidyl arginine deiminase, type II |
| 3369 | 442 | NM_017229 | y | phosphodiesterase 3B, cGMP-inhibited | phosphodiesterase 3B, cGMP-inhibited |
| 3370 | 20192 | NM_017232 | s | prostaglandin-endoperoxide synthase 2 | prostaglandin-endoperoxide synthase 2 |
| 3370 | 20193 | NM_017232 | qq, vv | prostaglandin-endoperoxide synthase 2 | prostaglandin-endoperoxide synthase 2 |
| 3371 | 17740 | NM_017233 | ss | 4-hydroxyphenylpyruvic acid dioxygenase | 4-hydroxyphenylpyruvic acid dioxygenase |
| 3373 | 15598 | NM_017236 | rr | phosphatidylethanolamine binding protein | phosphatidylethanolamine binding protein |
| 3376 | 24582 | NM_017243 | kk, pp | phosphoribosyl pyrophosphate synthetase 1 | phosphoribosyl pyrophosphate synthetase 1 |
| 3378 | 1418 | NM_017246 | u, cc | mitogen activated protein kinase kinase 5 | mitogen activated protein kinase kinase 5 |
| 3380 | 614 | NM_017251 | General, rr, uu | gap junction membrane channel protein beta 1 | gap junction membrane channel protein beta 1 |
| 3381 | 23037 | NM_017253 | t, mm | branched chain aminotransferase 1, cytosolic | branched chain aminotransferase 1, cytosolic |
| 3382 | 1496 | NM_017255 | qq, vv | purinergic receptor P2Y, G-protein coupled 2 | purinergic receptor P2Y, G-protein coupled 2 |
| 3384 | 15300 | NM_017259 | n, p, rr | Early induced gene, B-cell translocation gene 2 | Early induced gene, B-cell translocation gene 2 |
| 3384 | 15301 | NM_017259 | n, p, ss, tt | Early induced gene, B-cell translocation gene 2 | Early induced gene, B-cell translocation gene 2 |
| 3384 | 15299 | NM_017259 | p | Early induced gene, B-cell translocation gene 2 | Early induced gene, B-cell translocation gene 2 |
| 3385 | 15224 | NM_017264 | f | protease (prosome, macropain) 28 subunit, alpha | protease (prosome, macropain) 28 subunit, alpha |
| 3386 | 20600 | NM_017268 | q, w, jj | 3-hydroxy-3-methylglutaryl-Coenzyme A synthase 1 | 3-hydroxy-3-methylglutaryl-Coenzyme A synthase 1 |
| 3386 | 20601 | NM_017268 | q, w, jj | 3-hydroxy-3-methylglutaryl-Coenzyme A synthase 1 | 3-hydroxy-3-methylglutaryl-Coenzyme A synthase 1 |
| 3387 | 570 | NM_017271 | a, l, v, General, dd, oo | nuclear distribution gene C homolog (Aspergillus) | nuclear distribution gene C homolog (Aspergillus) |
| 3390 | 17959 | NM_017277 | w | Adaptor protein complex AP-1, beta 1 subunit | Adaptor protein complex AP-1, beta 1 subunit |
| 3391 | 15141 | NM_017278 | gg, hh | proteasome (prosome, macropain) subunit, alpha type 1 | proteasome (prosome, macropain) subunit, alpha type 1 |
| 3392 | 5747 | NM_017279 | p | proteasome (prosome, macropain) subunit, alpha type 2 | proteasome (prosome, macropain) subunit, alpha type 2 |
| 3392 | 5748 | NM_017279 | xx | proteasome (prosome, macropain) subunit, alpha type 2 | proteasome (prosome, macropain) subunit, alpha type 2 |
| 3393 | 1447 | NM_017281 | t | proteasome (prosome, macropain) subunit, alpha type 4 | proteasome (prosome, macropain) subunit, alpha type 4 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3394 | 3254 | NM_017282 | e, kk, mm, nn | proteasome (prosome, macropain) subunit, alpha type 5 | proteasome (prosome, macropain) subunit, alpha type 5 |
| 3394 | 3256 | NM_017282 | l, j, xx | proteasome (prosome, macropain) subunit, alpha type 5 | proteasome (prosome, macropain) subunit, alpha type 5 |
| 3400 | 15819 | NM_017298 | u | calcium channel, voltage-dependent, L type, alpha 1D subunit | calcium channel, voltage-dependent, L type, alpha 1D subunit |
| 3401 | 1531 | NM_017300 | General, ff, rr, uu | bile acid-Coenzyme A dehydrogenase: amino acid n-acyltransferase | bile acid-Coenzyme A dehydrogenase: amino acid n-acyltransferase |
| 3402 | 14002 | NM_017305 | qq | glutamate cysteine ligase, modifier subunit | glutamate-cysteine ligase, modifier subunit |
| 3402 | 14003 | NM_017305 | qq, vv | glutamate cysteine ligase, modifier subunit | glutamate-cysteine ligase, modifier subunit |
| 3403 | 18685 | NM_017306 | o | dodecenoyl-Coenzyme A delta isomerase (3,2 trans-enoyl-Coenyme A isomerase) | dodecenoyl-Coenzyme A delta isomerase (3,2 trans-enoyl-Coenyme A isomerase) |
| 3403 | 18687 | NM_017306 | o, ff, rr | dodecenoyl-Coenzyme A delta isomerase (3,2 trans-enoyl-Coenyme A isomerase) | Rat mRNA for delta3, delta2-enoyl-CoA isomerase, dodecenoyl-Coenzyme A delta isomerase (3,2 trans-enoyl-Coenyme A isomerase) |
| 3405 | 19671 | NM_017309 | k, mm | protein phosphatase 3, regulatory subunit B, alpha isoform (calcineurin B, type I) | protein phospatase 3, regulatory subunit B, alpha isoform (calcineurin B, type I) |
| 3406 | 16844 | NM_017311 | r | ATP synthase, H+ transporting, mitochondrial F0 complex, subunit c (subunit 9), isoform 1 | ATP synthase, H+ transporting, mitochondrial F0 complex, subunit c (subunit 9), isoform 1 |
| 3420 | 21846 | NM_017355 | gg, hh | ras-related GTP-binding protein 4b | ras-related GTP-binding protein 4b |
| 3422 | 20417 | NM_017359 | General | ras-related protein rab10 | ras-related protein rab10 |
| 3427 | 455 | NM_019131 | k, bb, ll, mm, nn | Tropomyosin 1 (alpha) | Tropomyosin 1 (alpha) |
| 3429 | 16227 | NM_019137 | gg, hh | Zinc-finger transcription factor NGFI-C (early response gene) | Zinc-finger transcription factor NGFI-C (early response gene) |
| 3430 | 13715 | NM_019139 | gg, hh | Glial cell line derived neutrophic factor | ESTs, Glial cell line derived neutrophic factor |
| 3431 | 14971 | NM_019140 | n, bb | Protein tyrosine phosphatase, receptor type, D | Protein tyrosine phosphatase, receptor type, D |
| 3431 | 14975 | NM_019140 | dd | Protein tyrosine phosphatase, receptor type, D | Protein tyrosine phosphatase, receptor type, D |
| 3433 | 5617 | NM_019143 | k | Fibronectin 1 | Fibronectin 1 |
| 3433 | 5618 | NM_019143 | k | Fibronectin 1 | Fibronectin 1 |
| 3433 | 5619 | NM_019143 | General | Fibronectin 1 | Fibronectin 1 |
| 3433 | 5622 | NM_019143 | l, ii | Fibronectin 1 | Fibronectin 1 |
| 3435 | 20863 | NM_019152 | g | calpain 1 | calpain 1 |
| 3437 | 21090 | NM_019158 | General, dd, ff, nn | aquaporin 8 | aquaporin 8 |
| 3438 | 20256 | NM_019163 | ii | presenilin 1 | presenilin 1 |
| 3440 | 7489 | NM_019169 | g | synuclein, alpha | synuclein, alpha |
| 3444 | 24019 | NM_019186 | ss, tt | ADP-ribosylation-like 4 | ADP-ribosylation-like 4 |
| 3446 | 15242 | NM_019191 | f, General, ii | MAD homolog 2 (*Drosophila*) | MAD homolog 2 (*Drosophila*) |
| 3447 | 22065 | NM_019195 | bb, nn | integrin-associated protein | integrin-associated protein |
| 3448 | 18572 | NM_019201 | pp, tt | C-terminal binding protein 1 | C-terminal binding protein 1 |
| 3450 | 19241 | NM_019206 | l, y, General, qq | Serine/threonine kinase 10 | Serine/threonine kinase 10 |
| 3452 | 2078 | NM_019220 | p, s, pp | amino terminal enhancer of split | amino-terminal enhancer of split |
| 3452 | 2079 | NM_019220 | z | amino terminal enhancer of split | amino-terminal enhancer of split |
| 3454 | 20938 | NM_019223 | t | NADH dehydrogenase Fe—S protein 6 | NADH dehydrogenase Fe—S protein 6 |
| 3458 | 16449 | NM_019238 | jj | farnesyl diphosphate farnesyl transferase 1 | farnesyl diphosphate farnesyl transferase 1 |
| 3458 | 16450 | NM_019238 | jj, oo, ss | farnesyl diphosphate farnesyl transferase 1 | farnesyl diphosphate farnesyl transferase 1 |
| 3458 | 16451 | NM_019238 | bb, jj | farnesyl diphosphate farnesyl transferase 1 | farnesyl diphosphate farnesyl transferase 1 |
| 3458 | 16452 | NM_019238 | jj | farnesyl diphosphate farnesyl transferase 1 | farnesyl diphosphate farnesyl transferase 1 |
| 3461 | 21109 | NM_019243 | r | prostaglandin F2 receptor negative regulator | prostaglandin F2 receptor negative regulator |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3462 | 888 | NM_019246 | n | proprotein convertase subtilisin/kexin type 7 | proprotein convertase subtilisin/kexin type 7 |
| 3463 | 24849 | NM_019248 | e, u | neurotrophic tyrosine kinase, receptor, type 3 | neurotrophic tyrosine kinase, receptor, type 3 |
| 3465 | 1450 | NM_019251 | x | blocked early in transport 1 homolog (S. cerevisiae) | blocked early in transport 1 homolog (S. cerevisiae) |
| 3466 | 10340 | NM_019252 | d, j, tt | dolichol-phosphate (beta-D) mannosyltransferase 2 | dolichol-phosphate (beta-D) mannosyltransferase 2 |
| 3468 | 7693 | NM_019258 | g | cystatin 8 (cystatin-related epididymal spermatogenic) | cystatin 8 (cystatin-related epididymal spermatogenic) |
| 3469 | 15259 | NM_019259 | rr | complement component 1, q subcomponent binding protein | complement component 1, q subcomponent binding protein |
| 3471 | 15763 | NM_019265 | k | sodium channel, voltage-gated, type XI, alpha polypeptide | sodium channel, voltage-gated, type XI, alpha polypeptide |
| 3472 | 23625 | NM_019269 | o | solute carrier family 22 (organic cation transporter), member 5 | solute carrier family 22 (organic cation transporter), member 5 |
| 3473 | 1412 | NM_019271 | ww | stress 70 protein chaperone, microsome-associated, 60 kD human homolog | stress 70 protein chaperone, microsome-associated, 60 kD human homolog |
| 3474 | 1129 | NM_019274 | nn | collagen-like tail subunit (single strand of homotrimer) of asymmetric acetylcholinesterase | collagen-like tail subunit (single strand of homotrimer) of asymmetric acetylcholinesterase |
| 3476 | 20734 | NM_019283 | q, z, General, jj | solute carrier family 3 (activators of dibasic and neutral amino acid transport), member 2 | solute carrier family 3 (activators of dibasic and neutral amino acid transport), member 2 |
| 3476 | 20735 | NM_019283 | l, l, q, z, General | solute carrier family 3 (activators of dibasic and neutral amino acid transport), member 2 | solute carrier family 3 (activators of dibasic and neutral amino acid transport), member 2 |
| 3477 | 22219 | NM_019286 | c, vv | Alcohol dehydrogenase (class I), alpha polypeptide | Alcohol dehydrogenase (class I) alpha polypeptide |
| 3487 | 1389 | NM_019350 | g | synaptotagmin 5 | synaptotagmin 5 |
| 3489 | 23491 | NM_019359 | k, v | calponin 3, acidic | calponin 3, acidic |
| 3491 | 18819 | NM_019367 | gg, hh, ii | palmitoyl-protein thioesterase 2 | palmitoyl-protein thioesterase 2 |
| 3498 | 20443 | NM_019379 | n, q, dd, oo | vesicle docking protein, 115 kDa | vesicle docking protein, 115 kDa |
| 3500 | 24626 | NM_019381 | h, x, General | Testis enhanced gene transcript | Testis enhanced gene transcript |
| 3509 | 18714 | NM_020075 | y | eukaryotic initiation factor 5 (eIF-5) | eukaryotic initiation factor 5 (eIF-5) |
| 3509 | 18715 | NM_020075 | l | eukaryotic initiation factor 5 (eIF-5) | eukaryotic initiation factor 5 (eIF-5) |
| 3509 | 18716 | NM_020075 | p, gg, hh | eukaryotic initiation factor 5 (eIF-5) | eukaryotic initiation factor 5 (eIF-5) |
| 3510 | 20493 | NM_020076 | b, k, l, General, bb, ff, qq, tt, uu | 3-hydroxyanthranilate 3,4-dioxygenase | 3-hydroxyanthranilate 3,4-dioxygenase |
| 3510 | 20494 | NM_020076 | cc, ii, ss | 3-hydroxyanthranilate 3,4-dioxygenase | 3-hydroxyanthranilate 3,4-dioxygenase |
| 3526 | 22916 | NM_021740 | ff | prothymosin alpha | prothymosin alpha |
| 3527 | 19709 | NM_021742 | d | nuclear receptor subfamily 5, group A, member 2 | nuclear receptor subfamily 5, group A, member 2 |
| 3529 | 19712 | NM_021745 | t, General, ff, kk, oo | nuclear receptor subfamily 1, group H, member 4 | nuclear receptor subfamily 1, group H, member 4 |
| 3532 | 20090 | NM_021757 | v, ww | pleiotropic regulator 1 | pleiotropic regulator 1 |
| 3534 | 17936 | NM_021766 | qq | progesterone receptor membrane component 1 | progesterone receptor membrane component 1 |
| 3535 | 20162 | NM_021835 | u, tt | Avian sarcoma virus 17 (v-jun) oncogene homolog | Avian sarcoma virus 17 (v-jun) oncogene homolog |
| 3535 | 22350 | NM_021835 | tt | Avian sarcoma virus 17 (v-jun) oncogene homolog | Avian sarcoma virus 17 (v-jun) oncogene homolog |
| 3535 | 22351 | NM_021835 | kk, tt | Avian sarcoma virus 17 (v-jun) oncogene homolog | Avian sarcoma virus 17 (v-jun) oncogene homolog |
| 3535 | 22352 | NM_021835 | y, kk, ss, tt | Avian sarcoma virus 17 (v-jun) oncogene homolog | Avian sarcoma virus 17 (v-jun) oncogene homolog |
| 3539 | 243 | NM_021989 | ii, rr | tissue inhibitor of metalloproteinase 2 | ESTs, tissue inhibitor of metalloproteinase 2 |
| 3543 | 25699 | NM_022180 | General, tt | Hepatic nuclear factor 4 (alpha transcription factor 4) | Hepatic nuclear factor 4 (alpha transcription factor 4) |
| 3543 | 20257 | NM_022180 | General | Hepatic nuclear factor 4 (alpha transcription factor 4) | Hepatic nuclear factor 4 (alpha transcription factor 4) |
| 3550 | 20312 | NM_022224 | bb | phosphotriesterase related | phosphotriesterase related |
| 3553 | 10509 | NM_022268 | p, General | liver glycogen phosphorylase | liver glycogen phosphorylase |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3553 | 25814 | NM_022268 | l | liver glycogen phosphorylase | liver glycogen phosphorylase |
| 3558 | 1914 | NM_022380 | g | signal transducer and activator of transcription 5b | signal transducer and activator of transcription 5b |
| 3559 | 11454 | NM_022381 | c, f, kk, tt | Proliferating cell nuclear antigen | Proliferating cell nuclear antigen |
| 3559 | 11455 | NM_022381 | c, f, jj, kk, nn | Proliferating cell nuclear antigen | Proliferating cell nuclear antigen |
| 3569 | 402 | NM_022403 | c, l, vv, xx | tryptophan-2,3-dioxygenase | tryptophan-2,3-dioxygenase |
| 3570 | 20915 | NM_022407 | b, ff | Aldehyde dehydrogenase 1, subfamily A1 | Aldehyde dehydrogenase 1, subfamily A1 |
| 3571 | 4647 | NM_022498 | h, r, w, rr | Protein phosphatase 1, catalytic subunit, gamma isoform 1 | Protein phosphatase 1, catalytic subunit, gamma isoform 1 |
| 3572 | 9183 | NM_022499 | s, nn | Parvalbumin (calcium binding protein) | Parvalbumin (calcium binding protein) |
| 3574 | 2515 | NM_022501 | ww | cysteine-rich protein 2 | cysteine-rich protein 2 |
| 3576 | 1347 | NM_022506 | h, l | ribosomal protein L31 | ribosomal protein L31 |
| 3581 | 3027 | NM_022514 | h, w, ee, ll, qq | ribosomal protein L27 | ribosomal protein L27 |
| 3582 | 2696 | NM_022515 | z, General, ee | ribosomal protein L24 | ribosomal protein L24 |
| 3582 | 2697 | NM_022515 | ee, ll | ribosomal protein L24 | ribosomal protein L24 |
| 3593 | 8984 | NM_022539 | ww | methionine aminopeptidase 2 | methionine aminopeptidase 2 |
| 3596 | 21062 | NM_022585 | c, kk, tt, ww | ornithine decarboxylase antizyme inhibitor | ornithine decarboxylase antizyme inhibitor |
| 3596 | 21063 | NM_022585 | ff | ornithine decarboxylase antizyme inhibitor | ornithine decarboxylase antizyme inhibitor |
| 3611 | 17567 | NM_022672 | h, gg, hh | ribosomal protein S14 | ribosomal protein S14 |
| 3613 | 24564 | NM_022676 | bb | protein phosphatase 1, regulatory (inhibitor) subunit 1A | protein phosphatase 1, regulatory (inhibitor) subunit 1A |
| 3617 | 17729 | NM_022697 | h, v, x | ribosomal protein L28 | ribosomal protein L28 |
| 3621 | 24344 | NM_022701 | pp | flotillin 1 | flotillin 1 |
| 3630 | 24838 | NM_022924 | tt | coagulation factor II | coagulation factor II |
| 3635 | 19669 | NM_022944 | x | SH2-containing inositol phosphatase 2 | SH2-containing inositol phosphatase 2 |
| 3641 | 15727 | NM_022953 | g | Slit 1 | Slit 1 |
| 3647 | 4228 | NM_023950 | u | RAB7, member RAS oncogene family | RAB7, member RAS oncogene family |
| 3649 | 21238 | NM_024125 | t, ff | Liver activating protein (LAP, also NF-IL6, nuclear factor-IL6, previously designated TCF5) | Liver activating protein (LAP, also NF-IL6, nuclear factor-IL6, previously designated TCF5) |
| 3649 | 21239 | NM_024125 | d, l, z | Liver activating protein (LAP, also NF-IL6, nuclear factor-IL6, previously designated TCF5) | Liver activating protein (LAP, also NF-IL6, nuclear factor-IL6, previously designated TCF5) |
| 3650 | 352 | NM_024127 | s, General | DNA damage-inducible transcript 1 | DNA-damage-inducible transcript 1 |
| 3650 | 353 | NM_024127 | n, z General, ee, kk, qq, ww | DNA damage-inducible transcript 1 | DNA-damage-inducible transcript 1 |
| 3650 | 354 | NM_024127 | n, r, General, qq, vv | DNA-damage-inducible transcript 1 | DNA-damage-inducible transcript 1 |
| 3652 | 17226 | NM_024131 | b, ff, vv | D-dopachrome tautomerase | D-dopachrome tautomerase |
| 3652 | 17227 | NM_024131 | b, f, ff, vv | D-dopachrome tautomerase | D-dopachrome tautomerase |
| 3653 | 851 | NM_024132 | c, kk | fatty acid amide hydrolase | fatty acid amide hydrolase |
| 3654 | 1598 | NM_024134 | f, l, o, p, q, General, cc, dd, kk, ll, qq | DNA-damage inducible transcript 3 | DNA-damage inducible transcript 3 |
| 3656 | 1878 | NM_024138 | cc | guanine nucleotide binding protein (G protein), gamma 7 subunit | guanine nucleotide binding protein (G protein), gamma 7 subunit |
| 3657 | 20801 | NM_024148 | m, cc, oo, uu, ww | apurinic/apyrimidinic endonuclease 1 | apurinic/apyrimidinic endonuclease 1 |
| 3661 | 561 | NM_024156 | nn | annexin VI | annexin VI |
| 3662 | 22079 | NM_024157 | a, General, uu, vv | complement factor I | complement factor I |
| 3664 | 4655 | NM_024346 | u | Scgn10 like-protein | Scgn10 like-protein |
| 3665 | 17764 | NM_024351 | h, l, w, uu | heat shock 70 kD protein 8 | heat shock 70 kD protein 8 |
| 3665 | 17765 | NM_024351 | l | heat shock 70 kD protein 8 | heat shock 70 kD protein 8 |
| 3667 | 15350 | NM_024356 | p | GTP cyclohydrolase 1 | GTP cyclohydrolase 1 |
| 3668 | 1146 | NM_024359 | a, m | hypoxia inducible factor 1, alpha subunit | hypoxia inducible factor 1, alpha subunit |
| 3668 | 1148 | NM_024359 | a | hypoxia inducible factor 1, alpha subunit | hypoxia inducible factor 1, alpha subunit |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3670 | 20772 | NM_024363 | c, v, oo | heterogeneous nuclear ribonucleoproteins methyltransferase-like 2 (*S. cerevisiae*) | heterogeneous nuclear ribonucleoproteins methyltransferase-like 2 (*S. cerevisiae*) |
| 3673 | 20380 | NM_024381 | o | Glycerol kinase | Glycerol kinase |
| 3681 | 19993 | NM_024398 | o, xx | mitochondrial aconitase (nuclear aco2 gene) | mitochondrial aconitase (nuclear aco2 gene) |
| 3685 | 1835 | NM_024483 | e | adrenergic receptor, alpha 1d | adrenergic receptor, alpha 1d |
| 3686 | 21039 | NM_024484 | ii | aminolevulinic acid synthase 1 | aminolevulinic acid synthase 1 |
| 3697 | 1928 | NM_030872 | z, General, ee, kk | pyruvate dehydrogenase kinase 2 subunit p45 (PDK2) | pyruvate dehydrogenase kinase 2 subunit p45 (PDK2) |
| 3699 | 17377 | NM_030989 | jj | Tumor protein p53 (Li-Fraumeni syndrome) | Tumor protein p53 (Li-Fraumeni syndrome) |
| 3706 | 91 | NM_031006 | ll | adenosine deaminase RNA-specific | adenosine deaminase RNA-specific |
| 3710 | 15682 | NM_031011 | a | S-Adenosylmethionine decarboxylase 1 | S-Adenosylmethionine decarboxylase 1 |
| 3710 | 15683 | NM_031011 | kk, oo | S-Adenosylmethionine decarboxylase 1 | S-Adenosylmethionine decarboxylase 1 |
| 3712 | 15700 | NM_031013 | k | liver multidrug resistance-associated protein 6 | liver multidrug resistance-associated protein 6 |
| 3721 | 626 | NM_031032 | b, h, m, s, x, General, dd, oo | glia maturation factor beta | glia maturation factor beta |
| 3733 | 7351 | NM_031059 | g | homeo box, msh-like 1 | homeo box, msh-like 1 |
| 3734 | 400 | NM_031062 | jj, ww | mevalonate pyrophosphate decarboxylase | mevalonate pyrophosphate decarboxylase |
| 3735 | 21701 | NM_031063 | jj | mevalonate kinase | mevalonate kinase |
| 3736 | 11849 | NM_031065 | j, z, General, ll | ribosomal protein L10a | ribosomal protein L10a |
| 3744 | 1376 | NM_031094 | a | Retinoblastoma-related gene | Retinoblastoma-related gene |
| 3749 | 20462 | NM_031102 | h, m | ribosomal protein L18 | ribosomal protein L18 |
| 3751 | 19268 | NM_031104 | gg, hh | ribosomal protein L22 | ribosomal protein L22 |
| 3757 | 24615 | NM_031112 | General | ribosomal protein S24 | ribosomal protein S24 |
| 3759 | 1579 | NM_031117 | c, oo, ww | SNRPN upstream reading frame, small nuclear ribonucleoparticle-associated protein (snRNP) mRNA, clone Sm51 | small nuclear ribonucleoparticle-associated protein (snRNP) mRNA, clone Sm51 |
| 3775 | 16157 | NM_031235 | oo | three-PDZ containing protein similar to *C. elegans* PAR3 (partitioning defect) | three-PDZ containing protein similar to *C. elegans* PAR3 (partitioning defect) |
| 3779 | 1857 | NM_031315 | o, xx | acyl-CoA thioesterase 1, cytosolic | acyl-CoA thioesterase 1, cytosolic |
| 3780 | 15661 | NM_031318 | a, b, m, uu, vv | t-complex testis expressed 1 | t-complex testis expressed 1 |
| 3780 | 15662 | NM_031318 | m, General | t-complex testis expressed 1 | t-complex testis expressed 1 |
| 3780 | 15663 | NM_031318 | m | t-complex testis expressed 1 | t-complex testis expressed 1 |
| 3783 | 4234 | NM_031330 | m, ff | argininosuccinate lyase, heterogeneous nuclear ribonucleoprotein A/B | heterogeneous nuclear ribonucleoprotein A/B |
| 3793 | 15608 | NM_031355 | n | mitochondrial voltage dependent anion channel 3 | mitochondrial voltage dependent anion channel 3 |
| 3795 | 24645 | NM_031502 | a, d, k, l, dd, uu | Amylase 1 | Amylase 1 |
| 3798 | 24410 | NM_031511 | g | Insulin-like growth factor II (somatomedin A) | Insulin-like growth factor II (somatomedin A) |
| 3801 | 1783 | NM_031521 | oo | Cell adhesion molecule, neural (CD56) | Cell adhesion molecule, neural (CD56) |
| 3806 | 16047 | NM_031541 | j, General ll | CD36 antigen (collagen type I receptor thrombospondin receptor) like 1 (scavanger receptor class B type 1) | CD36 antigen (collagen type I receptor, thrombospondin receptor)-like 1 (scavanger receptor class B type 1) |
| 3808 | 1504 | NM_031544 | a, l, General, uu | Adenosine monophosphate deaminase 3 | Adenosine monophosphate deaminase 3 |
| 3809 | 18389 | NM_031545 | gg, hh | Brain natriuretic factor | Brain natriuretic factor |
| 3810 | 28 | NM_031546 | v, rr | Regucalcin | Regucalcin |
| 3813 | 15411 | NM_031559 | o, y, ff | Carnitine palmitoyltransferase 1 alpha, liver isoform | Carnitine palmitoyltransferase 1 alpha, liver isoform |
| 3814 | 18315 | NM_031561 | o | CD36 antigen (collagen type I receptor, thrombospondin receptor) | CD36 antigen (collagen type I receptor, thrombospondin receptor) |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3814 | 18316 | NM_031561 | o | CD36 antigen (collagen type I receptor, thrombospondin receptor) | CD36 antigen (collagen type I receptor, thrombospondin receptor) |
| 3814 | 18317 | NM_031561 | o | CD36 antigen (collagen type I receptor, thrombospondin receptor) | CD36 antigen (collagen type I receptor, thrombospondin receptor) |
| 3814 | 18318 | NM_031561 | j | CD36 antigen (collagen type I receptor, thrombospondin receptor) | CD36 antigen (collagen type I receptor, thrombospondin receptor) |
| 3814 | 18319 | NM_031561 | o | CD36 antigen (collagen type I receptor, thrombospondin receptor) | CD36 antigen (collagen type I receptor, thrombospondin receptor) |
| 3814 | 25139 | NM_031561 | o | CD36 antigen (collagen type I receptor, thrombospondin receptor) | CD36 antigen (collagen type I receptor, thrombospondin receptor) |
| 3815 | 16164 | NM_031563 | h, m, n, General | nuclease sensitive element binding protein 1 | nuclease sensitive element binding protein 1 |
| 3820 | 24219 | NM_031579 | n, General | protein tyrosine phosphatase 4a1 | protein tyrosine phosphatase 4a1 |
| 3821 | 1444 | NM_031583 | ww | chondroitin sulfate proteoglycan 6 | chondroitin sulfate proteoglycan 6 |
| 3822 | 405 | NM_031587 | f, k, w, cc | peroxisomal membrane protein 2, 22 kDa | peroxisomal membrane protein 2, 22 kDa |
| 3824 | 5496 | NM_031589 | e, k, l, m, General, dd, qq, ss | glucose-6-phosphatase, transport protein 1 | glucose-6-phosphatase, transport protein 1 |
| 3824 | 5497 | NM_031589 | a, k, l, qq | glucose-6-phosphatase, transport protein 1 | glucose-6-phosphatase, transport protein 1 |
| 3826 | 21843 | NM_031594 | e, ee, tt, ww | purinergic receptor P2X, ligand-gated ion channel 4 | purinergic receptor P2X, ligand-gated ion channel 4 |
| 3829 | 19344 | NM_031603 | ee | tyrosine 3-monooxygenase/tryptophan 5-monooxygenase activatioprotein, epsilon polypeptide | tyrosine 3-monooxygenase/tryptophan 5-monooxygenase activatioprotein, epsilon polypeptide |
| 3832 | 11296 | NM_031606 | b, m, General, oo, ww, xx | phosphatase and tensin homolog (mutated in multiple advanced cancers 1) | phosphatase and tensin homolog (mutated in multiple advanced cancers 1) |
| 3832 | 11297 | NM_031606 | ss | phosphatase and tensin homolog (mutated in multiple advanced cancers 1) | phosphatase and tensin homolog (mutated in multiple advanced cancers 1) |
| 3833 | 19023 | NM_031609 | cc | Neuroblastoma, suppression of tumorigenicity 1 (DNA segment human D1S1733E) | Neuroblastoma, suppression of tumorigenicity 1 (DNA segment human D1S1733E) |
| 3834 | 12132 | NM_031612 | ss | apelin | apelin |
| 3835 | 24235 | NM_031614 | uu | thioredoxin reductase 1 | thioredoxin reductase 1 |
| 3836 | 1925 | NM_031616 | a, g | zinc finger protein 265 | zinc finger protein 265 |
| 3840 | 15767 | NM_031623 | n, y, z, General, dd | growth factor receptor bound protein 14 | growth factor receptor bound protein 14 |
| 3842 | 20940 | NM_031629 | y, nn | proteasome (prosome, macropain) subunit, beta type, 4 | proteasome (prosome, macropain) subunit, beta type, 4 |
| 3842 | 20941 | NM_031629 | bb | proteasome (prosome, macropain) subunit, beta type, 4 | proteasome (prosome, macropain) subunit, beta type, 4 |
| 3842 | 20942 | NM_031629 | mm | proteasome (prosome, macropain) subunit, beta type, 4 | proteasome (prosome, macropain) subunit, beta type, 4 |
| 3844 | 6554 | NM_031640 | f | plasma glutamate carboxypeptidase | plasma glutamate carboxypeptidase |
| 3847 | 18368 | NM_031648 | k | FXYD domain-containing ion transport regulator 1 | FXYD domain-containing ion transport regulator 1 |
| 3847 | 18369 | NM_031648 | s | FXYD domain-containing ion transport regulator 1 | FXYD domain-containing ion transport regulator 1 |
| 3849 | 866 | NM_031657 | gg, hh, pp | G protein-coupled receptor kinase 6 | G protein-coupled receptor kinase 6 |
| 3851 | 24881 | NM_031663 | pp | solute carrier family 18 (vesicular monoamine), member 3 | solute carrier family 18 (vesicular monoamine), member 3 |
| 3853 | 5358 | NM_031675 | t, ee, mm | Actinin, alpha 4 | Actinin, alpha 4 |
| 3855 | 15823 | NM_031680 | g | pyrimidinergic receptor P2Y, G-protein coupled, 4 | pyrimidinergic receptor P2Y, G-protein coupled, 4 |
| 3858 | 1004 | NM_031685 | m, x, dd | golgi SNAP receptor complex member 2 | golgi SNAP receptor complex member 2 |
| 3861 | 21575 | NM_031698 | xx | ribophorin II | ribophorin II |
| 3863 | 20404 | NM_031700 | General | claudin 3 | claudin 3 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3863 | 20405 | NM_031700 | a, l, General, cc, ss | claudin 3 | claudin 3 |
| 3865 | 811 | NM_031705 | c, s, General, ll | dihydropyrimidinase | dihydropyrimidinase |
| 3865 | 812 | NM_031705 | s, oo | dihydropyrimidinase | dihydropyrimidinase |
| 3866 | 16204 | NM_031706 | l, x, General | ribosomal protein S8 | ribosomal protein S8 |
| 3867 | 18055 | NM_031707 | nn | RuvB-like protein 1 | RuvB-like protein 1 |
| 3867 | 18056 | NM_031707 | c | RuvB-like protein 1 | RuvB-like protein 1 |
| 3869 | 21693 | NM_031714 | p, tt | heat responsive protein 12 | heat responsive protein 12 |
| 3870 | 1339 | NM_031715 | e, bb | phosphofructokinase, muscle | phosphofructokinase, muscle |
| 3871 | 19049 | NM_031719 | e | chloride channel, nucleotide-sensitive, 1A | chloride channel, nucleotide-sensitive, 1A |
| 3871 | 19050 | NM_031719 | e, p | chloride channel, nucleotide-sensitive, 1A | chloride channel, nucleotide-sensitive, 1A |
| 3873 | 23883 | NM_031731 | n, General, ee | alcohol dehydrogenase family 3, subfamily A2 | alcohol dehydrogenase family 3, subfamily A2 |
| 3873 | 23884 | NM_031731 | ii | alcohol dehydrogenase family 3, subfamily A2 | alcohol dehydrogenase family 3, subfamily A2 |
| 3876 | 1214 | NM_031741 | z, jj | nuclear receptor subfamily 1, group H, member 4, solute carrier family 2 (facilitated glucose transporter), member 5, synaptojanin 2 binding protein | solute carrier family 2 (facilitated glucose transporter), member 5 |
| 3881 | 11611 | NM_031756 | w | gamma-glutamyl carboxylase | gamma-glutamyl carboxylase |
| 3887 | 16115 | NM_031775 | bb | caspase 6 | caspase 6 |
| 3895 | 15864 | NM_031797 | x | Kangai 1 (suppression of tumorigenicity 6, prostate; CD82 antigen (R2 leukocyte antigen, antigen detected by monoclonal and antibody IA4)) | ESTs, Kangai 1 (suppression of tumorigenicity 6, prostate; CD82 antigen (R2 leukocyte antigen, antigen detected by monoclonal and antibody IA4)) |
| 3903 | 22321 | NM_031832 | f, j, General, ss | lectin, galactose binding, soluble 3 | lectin, galactose binding, soluble 3 |
| 3913 | 16726 | NM_031855 | General, dd | Ketohexokinase | Ketohexokinase |
| 3915 | 19190 | NM_031969 | s | Calmodulin 1 (phosphorylase kinase, delta) | Calmodulin 1 (phosphorylase kinase, delta) |
| 3915 | 19193 | NM_031969 | l, dd | Calmodulin 1 (phosphorylase kinase, delta) | Calmodulin 1 (phosphorylase kinase, delta) |
| 3915 | 19195 | NM_031969 | c | Calmodulin 1 (phosphorylase kinase, delta) | Calmodulin 1 (phosphorylase kinase, delta) |
| 3915 | 19196 | NM_031969 | rr | Calmodulin 1 (phosphorylase kinase, delta) | Calmodulin 1 (phosphorylase kinase, delta) |
| 3915 | 25802 | NM_031969 | c, x | Calmodulin 1 (phosphorylase kinase, delta) | Calmodulin 1 (phosphorylase kinase, delta) |
| 3917 | 16865 | NM_031973 | a, cc, uu | dipeptidyl peptidase 7 | dipeptidyl peptidase 7 |
| 3918 | 17075 | NM_031974 | l, General, kk, ll, ss | clathrin light chain | clathrin light chain |
| 3920 | 17601 | NM_031976 | ww | 5'-AMP-activated protein kinase, beta subunit | 5'-AMP-activated protein kinase, beta subunit |
| 3921 | 15470 | NM_031978 | u, mm | 26S proteasome, subunit p112 | 26S proteasome, subunit p112 |
| 3924 | 18501 | NM_031984 | s, v, mm, xx | cerebellar Ca-binding protein, spot 35 protein | cerebellar Ca-binding protein, spot 35 protein |
| 3927 | 20554 | NM_031987 | o | carnitine O-octanoyltransferase | carnitine O-octanoyltransferase |
| 3927 | 20555 | NM_031987 | o | carnitine O-octanoyltransferase | carnitine O-octanoyltransferase |
| 3928 | 18640 | NM_032057 | p, ee | Inositol (myo)-1(or 4)-monophosphatase 1 | Inositol (myo)-1(or 4)-monophosphatase 1 |
| 3932 | 590 | NM_032080 | b, c, m, kk | glycogen synthase kinase 3 beta | glycogen synthase kinase 3 beta |
| 3932 | 591 | NM_032080 | b, c, l, z, General, tt, vv | glycogen synthase kinase 3 beta | glycogen synthase kinase 3 beta |
| 3935 | 17474 | NM_032614 | u | thioredoxin-like 2 | thioredoxin-like 2 |
| 3937 | 20490 | NM_032617 | ll | RAB11B, member RAS oncogene family | RAB11B, member RAS oncogene family |
| 3943 | 1409 | NM_033349 | t, jj | Hydroxyacyl glutathione hydrolase | Hydroxyacyl glutathione hydrolase |
| 3944 | 12363 | NM_033351 | oo | Fc fragment immunoglobulin G receptor | Fc fragment immunoglobulin G receptor |
| 3944 | 12364 | NM_033351 | o | Fc fragment immunoglobulin G receptor | Fc fragment immunoglobulin G receptor |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3946 | 23895 | NM_033485 | tt | Prostate apoptosis response protein 4 | Prostate apoptosis response protein 4 |
| 3948 | 1423 | NM_052801 | mm | von Hippel-Lindau syndrome | von Hippel-Lindau syndrome |
| 3948 | 1424 | NM_052801 | ww | von Hippel-Lindau syndrome | von Hippel-Lindau syndrome |
| 3950 | 25024 | NM_052809 | b, o, vv | cytosolic cysteine dioxygenase 1 | cytosolic cysteine dioxygenase 1 |
| 3950 | 15028 | NM_052809 | b, qq, vv | cytosolic cysteine dioxygenase 1 | cytosolic cysteine dioxygenase 1 |
| 3951 | 412 | NM_053288 | y | Orosomucoid 1 | Orosomucoid 1 |
| 3953 | 1524 | NM_053293 | General | Glutathione S-transferase 1 (theta) | Glutathione S-transferase 1 (theta) |
| 3954 | 1187 | NM_053295 | t | Calpastatin | Calpastatin |
| 3956 | 15749 | NM_053309 | cc | homer, neuronal immediate early gene, 2 | homer, neuronal immediate early gene, 2 |
| 3956 | 15750 | NM_053309 | e | homer, neuronal immediate early gene, 2 | homer, neuronal immediate early gene, 2 |
| 3956 | 15751 | NM_053309 | x | homer, neuronal immediate early gene, 2 | homer, neuronal immediate early gene, 2 |
| 3957 | 17473 | NM_053319 | pp, tt | dynein, cytoplasmic, light chain 1 | dynein, cytoplasmic, light chain 1 |
| 3959 | 25480 | NM_053329 | x | insulin-like growth factor binding protein, acid labile subunit | insulin-like growth factor binding protein, acid labile subunit |
| 3962 | 14934 | NM_053337 | m, x, ll, ww | Msx-interacting-zinc finger | Msx-interacting-zinc finger |
| 3964 | 18949 | NM_053345 | f | general transcription factor IIa, 2 (12 kD subunit) | general transcription factor IIa, 2 (12 kD subunit) |
| 3968 | 623 | NM_053369 | jj | transcription factor 4 | transcription factor 4 |
| 3970 | 3844 | NM_053371 | j | fractured callus expressed transcript 1 | fractured callus expressed transcript 1 |
| 3982 | 22586 | NM_053469 | a, n, y | hepcidin antimicrobial peptide | hepcidin antimicrobial peptide |
| 3983 | 21866 | NM_053472 | s | cytochrome c oxidase, subunit IVb | cytochrome c oxidase, subunit IVb |
| 3990 | 2016 | NM_053527 | d | CDC5 (cell division cycle 5, *S. pombe*, homolog)-like | CDC5 (cell division cycle 5, *S. pombe*, homolog)-like |
| 4001 | 10986 | NM_053571 | c, l, m, General | regucalcin gene promotor region related protein | regucalcin gene promotor region related protein |
| 4002 | 19252 | NM_053576 | x | peroxiredoxin 5 | peroxiredoxin 5 |
| 4004 | 21154 | NM_053584 | m, z, dd, ee | golgi SNAP receptor complex member 1 | golgi SNAP receptor complex member 1 |
| 4016 | 15925 | NM_053607 | m | long-chain fatty acid coenzyme A ligase 5 | long-chain fatty acid coenzyme A ligase 5 |
| 4017 | 20243 | NM_053615 | ff | casein kinase 1, alpha 1 | casein kinase 1, alpha 1 |
| 4018 | 3062 | NM_053617 | a, cc | carboxypeptidase B2 (plasma) | carboxypeptidase B2 (plasma) |
| 4019 | 926 | NM_053619 | g | complement component 5, receptor 1 | complement components, receptor 1 |
| 4021 | 659 | NM_053622 | q | nuclear pore membrane glycoprotein 121 kD | nuclear pore membrane glycoprotein 121 kD |
| 4025 | 23305 | NM_053638 | jj | isocitrate dehydrogenase 3 (NAD+) alpha | isocitrate dehydrogenase 3 (NAD+) alpha |
| 4029 | 1120 | NM_053655 | g, n | dynamin 1-like | dynamin 1-like |
| 4038 | 13369 | NM_053742 | v | phosphotidylinositol transfer protein, beta | phosphotidylinositol transfer protein, beta |
| 4039 | 10512 | NM_053743 | k, mm | CDC37 (cell division cycle 37, *S. cerevisiae*, homolog) | CDC37 (cell division cycle 37, *S. cerevisiae*, homolog) |
| 4041 | 15376 | NM_053747 | x, General, kk | ubiquilin 1 | ubiquilin 1 |
| 4044 | 7927 | NM_053765 | e, t | UDP-N-acetylglucosamine-2-epimerase/N-acetylmannosamine kinase | UDP-N-acetylglucosamine-2-epimerase/N-acetylmannosamine kinase |
| 4046 | 15995 | NM_053769 | r, ff | protein tyrosine phosphatase, non-receptor type 16 | protein tyrosine phosphatase, non-receptor type 16 |
| 4046 | 15996 | NM_053769 | n, ff, kk | protein tyrosine phosphatase, non-receptor type 16 | protein tyrosine phosphatase, non-receptor type 16 |
| 4046 | 15997 | NM_053769 | d, n, r, w, y | protein tyrosine phosphatase, non-receptor type 16 | protein tyrosine phosphatase, non-receptor type 16 |
| 4080 | 794 | NM_053902 | l | kynureninase (L-kynurenine hydrolase) | kynureninase (L-kynurenine hydrolase) |
| 4082 | 17937 | NM_053911 | ss, uu | pleckstrin homology, Sec7 and coiled/coil domains 2 | pleckstrin homology, Sec7 and coiled/coil domains 2 |
| 4085 | 15857 | NM_053948 | b, e, bb, oo, ww | polymerase (RNA) II (DNA directed)polypeptide G | polymerase (RNA) II (DNA directed)polypeptide G |
| 4090 | 19991 | NM_053961 | cc | mitochondrial aconitase (nuclear aco2 gene) | mitochondrial aconitase (nuclear aco2 gene) |
| 4108 | 22849 | NM_057099 | c | proteasome (prosome, macropain) subunit beta type 6 | proteasome (prosome, macropain) subunit beta type 6 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4111 | 9527 | NM_057104 | c, q, General, jj | ectonucleotide pyrophosphatase/phosphodiesterase 2 | ectonucleotide pyrophosphatase/phosphodiesterase 2 |
| 4112 | 5492 | NM_057105 | e | UDP glycosyltransferase 1 family, polypeptide A6 | ESTs, UDP glycosyltransferase 1 family, polypeptide A6 |
| 4112 | 5493 | NM_057105 | e | UDP glycosyltransferase 1 family, polypeptide A6 | ESTs, UDP glycosyltransferase 1 family, polypeptide A6 |
| 4112 | 15124 | NM_057105 | jj | UDP glycosyltransferase 1 family, polypeptide A6, UDP glycosyltransferase 1 family, polypeptide A7, UDP-glucuronosyltransferase 1 family, member 1 | UDP glycosyltransferase 1 family, polypeptide A6, UDP glycosyltransferase 1 family, polypeptide A7, UDP-glucuronosyltransferase 1 family, member 1 |
| 4112 | 15126 | NM_057105 | t, jj | UDP glycosyltransferase 1 family, polypeptide A6, UDP glycosyltransferase 1 family, polypeptide A7, UDP-glucuronosyltransferase 1 family, member 1 | UDP glycosyltransferase 1 family, polypeptide A6, UDP glycosyltransferase 1 family, polypeptide A7, UDP-glucuronosyltransferase 1 family, member 1 |
| 4112 | 15127 | NM_057105 | k, t, General, mm | UDP glycosyltransferase 1 family, polypeptide A6, UDP glycosyltransferase 1 family, polypeptide A7, UDP-glucuronosyltransferase 1 family, member 1 | UDP glycosyltransferase 1 family, polypeptide A6, UDP glycosyltransferase 1 family, polypeptide A7, UDP-glucuronosyltransferase 1 family, member 1 |
| 4113 | 3743 | NM_057107 | nn | fatty acid Coenzyme A ligase, long chain 3 | fatty acid Coenzyme A ligase, long chain 3 |
| 4121 | 19834 | NM_057139 | v | transporter protein; system N1 Na+ and H+-coupled glutamine transporter | transporter protein; system N1 Na+ and H+-coupled glutamine transporter |
| 4126 | 15408 | NM_057197 | rr | 2,4-dienoyl CoA reductase 1, mitochondrial | 2,4-dienoyl CoA reductase 1, mitochondrial |
| 4126 | 15409 | NM_057197 | ff, ii, jj | 2,4-dienoyl CoA reductase 1, mitochondrial | 2,4-dienoyl CoA reductase 1, mitochondrial |
| 4132 | 24653 | NM_080580 | e | RAB3D, member RAS oncogene family | RAB3D, member RAS oncogene family |
| 4133 | 17956 | NM_080583 | m, vv | adaptor-related protein complex 2, beta 1 subunit | adaptor-related protein complex 2, beta 1 subunit |
| 4133 | 17958 | NM_080583 | ff, xx | adaptor-related protein complex 2, beta 1 subunit | adaptor-related protein complex 2, beta 1 subunit |
| 4134 | 16108 | NM_080585 | d, q, gg, hh | N-ethylmaleimide sensitive fusion protein attachment protein alpha | N-ethylmaleimide sensitive fusion protein attachment protein alpha |
| 4134 | 16109 | NM_080585 | e, q | N-ethylmaleimide sensitive fusion protein attachment protein alpha | N-ethylmaleimide sensitive fusion protein attachment protein alpha |
| 4136 | 19831 | NM_080781 | b, q, x, dd | coatomer protein complex, subunit beta 1 | coatomer protein complex, subunit beta 1 |
| 4138 | 25693 | NM_080783 | jj, xx | galactose-4-epimerase, UDP | galactose-4-epimerase, UDP |
| 4139 | 25799 | NM_080886 | a, f, n, x, cc, ff, jj, uu | sterol-C4-methyl oxidase-like | sterol-C4-methyl oxidase-like |
| 4139 | 21842 | NM_080886 | a, f, jj, pp | sterol-C4-methyl oxidase-like | sterol-C4-methyl oxidase-like |
| 4148 | 8167 | NM_130406 | q, ll | Fas-associated factor 1 | Fas-associated factor 1 |
| 4154 | 13515 | NM_130430 | y | proteasome (prosome, macropain) 26S subunit, non-ATPase, 9 | proteasome (prosome, macropain) 26S subunit, non-ATPase, 9 |
| 4156 | 14959 | NM_130734 | h, x, General, dd, ee | guanine nucleotide binding protein (G protein), beta polypeptide 2-like 1 | guanine nucleotide binding protein (G protein), beta polypeptide 2-like 1 |
| 4159 | 22220 | NM_130780 | vv | Alcohol dehydrogenase (class I), alpha polypeptide | Alcohol dehydrogenase (class I), alpha polypeptide |
| 4165 | 25730 | NM_133290 | r, t | zinc finger protein 36 | zinc finger protein 36 |
| 4166 | 20879 | NM_133295 | j | carboxylesterase 3 | carboxylesterase 3 |
| 4167 | 19456 | NM_133298 | l, cc, qq, uu | glycoprotein (transmembrane) nmb | glycoprotein (transmembrane) nmb |
| 4167 | 4048 | NM_133298 | l, cc, qq, uu | glycoprotein (transmembrane) nmb | glycoprotein (transmembrane) nmb |
| 4167 | 4049 | NM_133298 | l, cc, tt, uu | glycoprotein (transmembrane) nmb | glycoprotein (transmembrane) nmb |
| 4184 | 2788 | NM_133528 | z, ee | preimplantation protein 3 | preimplantation protein 3 |
| 4222 | 21098 | NM_134432 | qq | Angiotensinogen | Angiotensinogen |
| 4226 | 12215 | NM_138502 | o | monoglyceride lipase | monoglyceride lipase |
| 4228 | 16179 | NM_138508 | xx | Sterol carrier protein 2, liver | Sterol carrier protein 2, liver |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4228 | 16180 | NM_138508 | h, l, General, dd, ii, oo | Sterol carrier protein 2, liver | Sterol carrier protein 2, liver |
| 4238 | 14822 | NM_138708 | m, s | Rab geranylgeranyl transferase componenet, subunit beta | Rab geranylgeranyl transferase componenet, subunit beta |
| 4240 | 16248 | NM_138827 | t, mm | Solute carrier family 2 a 1 (facilitated glucose transporter) brain | Solute carrier family 2 a 1 (facilitated glucose transporter) brain |
| 4240 | 16249 | NM_138827 | p, ff | Solute carrier family 2 a 1 (facilitated glucose transporter) brain | Solute carrier family 2 a 1 (facilitated glucose transporter) brain |
| 4240 | 16250 | NM_138827 | mm | Solute carrier family 2 a 1 (facilitated glucose transporter) brain | Solute carrier family 2 a 1 (facilitated glucose transporter) brain |
| 4240 | 16251 | NM_138827 | mm | Solute carrier family 2 a 1 (facilitated glucose transporter) brain | Solute carrier family 2 a 1 (facilitated glucose transporter) brain |
| 4241 | 16400 | NM_138828 | m, x | Apolipoprotein E, | Apolipoprotein E, |
| 4271 | 17203 | NM_139099 | pp | ATP synthase, H+ transporting, mitochondrial F1 complex, epsilon subunit | ATP synthase, H+ transporting, mitochondrial F1 complex, epsilon subunit |
| 4271 | 17204 | NM_139099 | p, x, mm | ATP synthase H+ transporting, mitochondrial F1 complex, epsilon subunit | ATP synthase, H+ transporting, mitochondrial F1 complex, epsilon subunit |
| 4272 | 17549 | NM_139100 | m, ee | solute carrier family 25 (mitochondrial carrier; adenine nucleotide translocator), member 3 | solute carrier family 25 (mitochondrial carrier; adenine nucleotide translocator), member 3 |
| 4311 | 1382 | NM_147177 | c, e, dd | RuvB-like protein 1 | RuvB-like protein 1 |
| 4326 | 5624 | R47122 | bb, cc | Fibronectin 1 | Fibronectin 1 |
| 4335 | 1471 | S68809 | e | S100 calcium binding protein A1 | ESTs, Highly similar to S10A_RAT S-100 protein, alpha chain [*R. norvegicus*] |
| 4351 | 20431 | S81448 | qq, xx | Steroid-5-alpha-reductase, alpha polypeptide 1 (3-oxo-5 alpha-steroid delta 4-dehydropenase alpha 1) | Steroid-5-alpha-reductase, alpha polypeptide 1 (3-oxo-5 alpha-steroid delta 4-dehydrogenase alpha 1) |
| 4363 | 16675 | U17565 | ww | mini chromosome maintenance deficient 6 (*S. cerevisiae*) | mini chromosome maintenance deficient 6 (*S. cerevisiae*) |
| 4377 | 15851 | U42719 | vv | Complement component 4 | Complement component 4 |
| 4378 | 19543 | U44948 | ww | cysteine-rich protein 2 | cysteine-rich protein 2 |
| 4390 | 1715 | U72660 | o, mm | Ninjurin | Ninjurin |
| 4404 | 818 | X02291 | a, s, ff, qq, tt, uu | Aldolase B, fructose-biphosphate | Aldolase B, fructose-biphosphate |
| 4408 | 20715 | X07259 | o, xx | Cytochrome P450, subfamily IVB, polypeptide 1 | Cytochrome P450, subfamily IVB, polypeptide 1 |
| 4412 | 20597 | X12459 | b, ff | Arginosuccinate synthetase 1 | Arginosuccinate synthetase 1 |
| 4421 | 575 | X15734 | a, l | S - adenosylmethionine synthetase | S - adenosylmethionine synthetase |
| 4429 | 20427 | X53378 | General, ll | ribosomal protein S13 | ribosomal protein S13 |
| 4439 | 25702 | X58465 | l | Ribosomal protein S5 | Ribosomal protein S5 |
| 4439 | 10109 | X58465 | h, l, ee, ll | Ribosomal protein S5 | Ribosomal protein S5 |
| 4483 | 19694 | Z48444 | ee | A disintegrin and metalloprotease domain (ADAM) 10 | A disintegrin and metalloprotease domain (ADAM) 10 |
| 4484 | 15569 | Z78279 | bb | procollagen, type I, alpha 1 | procollagen, type I, alpha 1 |
| 63 | 20995 | AA799724 | General | HMm:RNA polymerase 1-3 (16 kDa subunit) | ESTs, Highly similar to RPA9_MOUSE DNA-directed RNA polymerase 116 kDa polypeptide (RPA16) [*M. musculus*] |
| 63 | 20996 | AA799724 | b, f, General, kk, nn, qq | HMm:RNA polymerase 1-3 (16 kDa subunit) | ESTs, Highly similar to RPA9_MOUSE DNA-directed RNA polymerase 116 kDa polypeptide (RPA16) [*M. musculus*] |
| 416 | 14138 | AA859700 | p, General | HMm:protoporphyrinogen oxidase | ESTs, Highly similar to PPOX_MOUSE PROTOPORPHYRINOGEN OXIDASE (PPO) [*M. musculus*] |
| 464 | 16074 | AA874874 | t | HMm:alcohol dehydrogenase 5 | ESTs, Highly similar to ADHX_RAT ALCOHOL DEHYDROGENASE CLASS III (ALCOHOL DEHYDROGENASE 2) (GLUTATHIONE-DEPENDENT FORMALDEHYDE DEHYDROGENASE) (FDH) (FALDH) (ALCOHOL DEHYDROGENASE-B2) [*R. norvegicus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 480 | 20389 | AA875045 | oo | HMm:phosphodiesterase 6D, cGMP-specific, rod, delta | ESTs, Highly similar to CNRD_MOUSE Retinal rod rhodopsin-sensitive cGMP 3',5'-cyclic phosphodiesterase delta-subunit GMP-PDE delta) [*M. musculus*] |
| 483 | 21589 | AA875084 | y, nn | HMm:transducin-like enhancer of split 1, homolog of *Drosophila* E(spl) | ESTs, Highly similar to TLE4_RAT Transducin-like enhancer protein 4 (ESP2 protein) [*R. norvegicus*] |
| 552 | 9090 | AA891690 | h, s | HMm:tumor necrosis factor (ligand) superfamily, member 13 | ESTs, Highly similar to tumor necrosis factor (ligand) superfamily, member 13 [*Mus musculus*] [*M. musculus*] |
| 668 | 11997 | AA892828 | ll | HMm:pyruvate dehydrogenase (lipoamide) beta | ESTs, Highly similar to S15892 pyruvate dehydrogenase (lipoamide) (EC 1.2.4.1) beta chain - rat [*R. norvegicus*] |
| 705 | 17754 | AA893246 | a, w | HMm:ATPase, H+ transporting, lysosomal 34 kD, V1 subunit D | ESTs, Highly similar to VATD_MOUSE Vacuolar ATP synthase subunit D (V-ATPase D subunit) (Vacuolar proton pump D subunit) (V-ATPase 28 kDa accessory protein) [*M. musculus*] |
| 1076 | 24289 | AA955986 | t | HMm:galactokinase | ESTs, Highly similar to GAL1_MOUSE Galactokinase (Galactose kinase) [*M. musculus*] |
| 1098 | 12000 | AA957319 | bb | HMm:pyruvate dehydrogenase (lipoamide) beta | ESTs, Highly similar to S15892 pyruvate dehydrogenase (lipoamide) (EC 1.2.4.1) beta chain - rat [*R. norvegicus*] |
| 1126 | 2308 | AA964227 | l, General | HMm:methylenetetrahydrofolate dehydrogenase (NAD+ dependent), methenyltetrahydrofolate cyclohydrolase | ESTs, Highly similar to A33267 methylenetetrahydrofolate dehydrogenase (NAD+) (EC 1.5.1.15)/ methenyltetrahydrofolate cyclohydrolase (EC 3.5.4.9) precursor - mouse [*M. musculus*] |
| 1284 | 20214 | AF091567 | xx | olfactory receptor 41 | olfactory receptor 41 |
| 1285 | 20236 | AF091570 | cc | olfactory receptor 41 | olfactory receptor 41 |
| 1286 | 25222 | AF091574 | g | olfactory receptor 41 | olfactory receptor 41 |
| 1336 | 15452 | AI009484 | s | HMm:gelsolin | ESTs, Highly similar to GELS_MOUSE Gelsolin (Actin-depolymerizing factor) (ADF) (Brevin) [*M. musculus*] |
| 1456 | 21302 | AI013297 | o | HMm:NADH dehydrogenase (ubiquinone) Fe—S protein 4 | ESTs, Moderately similar to NADH dehydrogenase (ubiquinone) Fe—S protein 4; NADH dehydrogenase (ubiquinone) Fe—S protein 4 (18 kDa) [*Mus musculus*] [*M. musculus*] |
| 1565 | 7935 | AI043945 | General | HMm:ferrochelatase | ESTs, Highly similar to A37972 ferrochelatase (EC 4.99.1.1) precursor - mouse [*M. musculus*] |
| 1809 | 9421 | AI072885 | pp | HMm:inositol polyphosphate-1-phosphatase | ESTs, Moderately similar to INPP_MOUSE Inositol polyphosphate 1-phosphatase (IPPase) (IPP) [*M. musculus*] |
| 2020 | 23788 | AI137176 | ss | HMm:alpha-N-acetylglucosaminidase (Sanfilippo disease IIIB) | ESTs, Moderately similar to alpha-N-acetylglucosaminidase (Sanfilippo disease IIIB); alpha-N-acetylglucosaminidase, lysosomal [*Mus musculus*] [*M. musculus*] |
| 2259 | 5876 | AI176117 | oo | HMm:pyruvate dehydrogenase (lipoamide) beta | ESTs, ESTs, Highly similar to S15892 pyruvate dehydrogenase (lipoamide) (EC 1.2.4.1) beta chain - rat [*R. norvegicus*] |
| 2387 | 4279 | AI178808 | k | HMm:interleukin 2 receptor, gamma chain | ESTs, Highly similar to I49280 interleukin-2 receptor gamma chain precursor - mouse [*M. musculus*] |
| 2689 | 16781 | AI234527 | ll, qq | HMm:glutathione S-transferase, alpha 4 | ESTs, Highly similar to S23433 glutathione transferase (EC 2.5.1.18) 8 - rat [*R. norvegicus*] |
| 2860 | 20082 | AI639488 | h, r, General, ii | HMm:transformed mouse 3T3 cell double minute 2 | ESTs, Highly similar to A42772 mdm2 protein - rat (fragments) [*R. norvegicus*] |
| 2878 | 14882 | D00362 | w, ll, rr | Esterase 2 | Esterase 2 |
| 2928 | 4378 | H32966 | y | HMm:Tnf receptor-associated factor 2 | ESTs, Highly similar to I61512 TNF receptor associated factor 2 - mouse [*M. musculus*] |
| 2997 | 14881 | M20629 | j, dd, ll | Esterase 2 | Esterase 2 |
| 3034 | 1379 | M83676 | qq, vv | RAB12, member RAS oncogene family | RAB12, member RAS oncogene family |
| 3183 | 18694 | NM_012931 | mm | v-crk-associated tyrosine kinase substrate | v-crk-associated tyrosine kinase substrate |
| 3194 | 709 | NM_012968 | h | Interleukin 1 receptor accessory protein | Interleukin 1 receptor accessory protein |
| 3204 | 9917 | NM_012993 | qq | N-arginine dibasic convertase 1 | N-arginine dibasic convertase 1 |
| 3204 | 9918 | NM_012993 | ll | N-arginine dibasic convertase 1 | N-arginine dibasic convertase 1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3207 | 24718 | NM_013003 | tt | Phosphatidylethanolamine N-methyltransferase | Phosphatidylethanolamine N-methyltransferase |
| 3223 | 14421 | NM_013053 | o | Tyrosine 3-monooxygenase/tryptophan 5-monooxygenase activation protein, theta polypeptide | Tyrosine 3-monooxygenase/tryptophan 5-monooxygenase activation protein, theta polypeptide |
| 3313 | 923 | NM_017076 | f, l, n, p, kk, xx | Tumor-associated glycoprotein pE4 | Tumor-associated glycoprotein pE4 |
| 3361 | 18050 | NM_017204 | nn | microtubule-associated protein 6 | microtubule-associated protein 6 |
| 3399 | 707 | NM_017293 | b | kinase interacting with leukemia-associated gene (stathmin) | kinase interacting with leukemia-associated gene (stathmin) |
| 3475 | 2439 | NM_019277 | m, ss | SEC15 homolog (*S. cerevisiae*) | SEC15 homolog (*S. cerevisiae*) |
| 3562 | 695 | NM_022388 | y | corticosteroid induced protein | corticosteroid-induced protein |
| 3669 | 8879 | NM_024360 | u | hairy and enhancer of split 1, (*Drosophila*) | hairy and enhancer of split 1 (*Drosophila*) |
| 3831 | 67 | NM_031605 | cc | cytochrome P450, 4a10 | cytochrome P450, 4a10 |
| 3860 | 16664 | NM_031695 | v | sialyltransferase 5 | sialyltransferase 5 |
| 3868 | 16918 | NM_031709 | x, z, ee, gg, hh, ll | ribosomal protein S12 | ribosomal protein S12 |
| 3955 | 20235 | NM_053302 | bb | adrenomedullin receptor | ESTs, Weakly similar to dual-specificity phosphatase [*Mus musculus*] [*M. musculus*] |
| 4117 | 1888 | NM_057130 | n, bb | BH3 interacting (with BCL2 family) domain, apoptosis agonist | BH3 interacting (with BCL2 family) domain, apoptosis agonist |
| 4185 | 1394 | NM_133536 | l, v, xx | RAB3C, member RAS oncogene family | RAB3C, member RAS oncogene family |
| 4305 | 1448 | NM_145783 | oo | HMm:cytochrome c oxidase, subunit Va | Rat CoxVa mRNA for mitochondrial cytochrome c oxidase subunit Va |
| 4353 | 13520 | S87522 | c | HMm:leukotriene A4 hydrolase | ESTs, Highly similar to S20444 leukotriene-A4 hydrolase (EC 3.3.2.6) - rat [*R. norvegicus*] |
| 4449 | 16780 | X62660 | b, m, qq, vv | HMm:glutathione S-transferase, alpha 4 | ESTs, Highly similar to S23433 glutathione transferase (EC 2.5.1.18) 8 - rat [*R. norvegicus*] |
| 6 | 6049 | AA685178 | a, General, cc, rr | | ESTs, Highly similar to T30827 nascent polypeptide-associated complex alpha chain, non-muscle splice form - mouse [*M. musculus*] |
| 16 | 22646 | AA799301 | r | | ESTs, Highly similar to LIGA_MOUSE Ligatin [*M. musculus*] |
| 22 | 6581 | AA799412 | v | | ESTs, Weakly similar to I67424 hERR-2 homolog - rat (fragment) [*R. norvegicus*] |
| 32 | 6505 | AA799499 | p | | ESTs, Moderately similar to RIKEN cDNA 2700033I16 [*Mus musculus*] [*M. musculus*] |
| 34 | 16942 | AA799520 | ee | | ESTs, Highly similar to ITMB_MOUSE Integral membrane protein 2B (E25B protein [*M. musculus*] |
| 35 | 21120 | AA799526 | pp | | ESTs, Highly similar to RIKEN cDNA 1700043E15 [*Mus musculus*] [*M. musculus*] |
| 40 | 16959 | AA799550 | u | | ESTs, Moderately similar to RIKEN cDNA 9130413I22 [*Mus musculus*] [*M. musculus*] |
| 52 | 20093 | AA799637 | u | | ESTs, Weakly similar to A55071 hydrogen peroxide-inducible protein hic-5 - mouse [*M. musculus*] |
| 53 | 18226 | AA799641 | u, rr, ss | | ESTs, Moderately similar to I53063 testicular tumor overexpressed protein - mouse [*M. musculus*] |
| 76 | 18880 | AA799801 | bb, ii | | ESTs, Moderately similar to predicted gene ICRFP703B1614Q5.6; ICRFP703N2430Q5.6, C11orf17 [*Mus musculus*] [*M. musculus*] |
| 87 | 18378 | AA799888 | bb | | ESTs, Highly similar to nuclear localization signal protein absent in velo-cardio-facial patients [*Mus musculus*] [*M. musculus*] |
| 90 | 15011 | AA799893 | l, s, z, kk, nn | | ESTs, Highly similar to DDRT helix-destabilizing protein - rat [*R. norvegicus*] |
| 95 | 18881 | AA799992 | a, d | | ESTs, Moderately similar to predicted gene ICRFP703B1614Q5.6; ICRFP703N2430Q5.6; C11orf17 [*Mus musculus*] [*M. musculus*] |
| 95 | 18883 | AA799992 | a | | ESTs, ESTs, Moderately similar to predicted |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| | | | | | gene ICRFP703B1614Q5.6; ICRFP703N2430Q5.6; C11orf17 [*Mus musculus*] [*M. musculus*] |
| 96 | 2098 | AA799995 | l | ribosomal protein L14 | ribosomal protein L14 |
| 106 | 21064 | AA800175 | m, ww | | ESTs, Highly similar to JC7136 peptidylprolyl isomerase (EC 5.2.1.8) - mouse [*M. musculus*] |
| 110 | 15659 | AA800199 | ss | | ESTs, Weakly similar to B39066 proline-rich protein 15 - rat [*R. norvegicus*] |
| 116 | 18442 | AA800258 | f, pp, ww | | ESTs, Moderately similar to low density lipoprotein B [*Mus musculus*] [*M. musculus*] |
| 133 | 16463 | AA800663 | k | | ESTs, Highly similar to RAN binding protein 16 [*Mus musculus*] [*M. musculus*] |
| 158 | 22025 | AA800849 | ss | | ESTs, Moderately similar to 0806162L protein URF5 [*Mus musculus*] [*M. musculus*] |
| 168 | 23115 | AA801165 | d | Testis-specific histone 2a | Testis-specific histone 2a |
| 175 | 1397 | AA817787 | s, General | | ESTs, Highly similar to potassium channel modulatory factor DEBT-91; clone DEBT-91 [*Mus musculus*] [*M. musculus*] |
| 188 | 2431 | AA817945 | ff | | ESTs, Highly similar to TBCA_MOUSE TUBULIN-SPECIFIC CHAPERONE A (TUBULIN-FOLDING COFACTOR A) (CFA) (TCP1-CHAPERONIN COFACTOR A) [*M. musculus*] |
| 193 | 2845 | AA818026 | h | | ESTs, Weakly similar to PSD7_MOUSE 26S proteasome non-ATPase regulatory subunit 7 (26S proteasome regulatory subunit S12) (Proteasome subunit p40) (Mov34 protein) [*M. musculus*] |
| 198 | 3275 | AA818112 | f, uu | | ESTs, Weakly similar to neugrin; neurite outgrowth associated protein [*Mus musculus*] [*M. musculus*] |
| 213 | 14123 | AA818554 | g | | *R. norvegicus* mRNA for tropomyosin isoform 6 |
| 225 | 4491 | AA818798 | xx | | *Rattus norvegicus* mRNA for cathepsin Y, partial cds |
| 235 | 11978 | AA819129 | b | | ESTs, Moderately similar to S27161 glutathione transferase (EC 2.5.1.18) 5 - rat [*R. norvegicus*] |
| 237 | 6329 | AA819259 | j, p | | ESTs, Moderately similar to S31799 apolipoprotein C2 precursor - mouse [*M. musculus*] |
| 239 | 9000 | AA819318 | r | | ESTs, Highly similar to JC4141 YL-1 protein - mouse [*M. musculus*] |
| 248 | 5169 | AA819488 | l, General | | ESTs, Weakly similar to B34488 calpain (EC 3.4.22.17) large chain 3 - rat [*R. norvegicus*] |
| 260 | 19451 | AA819788 | ll | | ESTs, Weakly similar to 28 kD interferon alpha responsive protein [*Mus musculus*] [*M. musculus*] |
| 264 | 230 | AA819870 | uu | | *Rattus norvegicus* complement C8 beta (C8b) mRNA, partial cds |
| 265 | 19566 | AA819879 | c | | ESTs, Weakly similar to phosducin-like protein 2; protein B [*Mus musculus*] [*M. musculus*] |
| 266 | 320 | AA819905 | ee | stearoyl-Coenzyme A | stearoyl-Coenzyme A desaturase 1 desaturase 1 |
| 271 | 23759 | AA848402 | u | | ESTs, Weakly similar to A57284 spermatid perinuclear RNA-binding protein Spnr - mouse [*M. musculus*] |
| 282 | 7749 | AA848804 | jj | | ESTs, Highly similar to BTF3_MOUSE Transcription factor BTF3 (RNA polymerase B transcription factor 3) [*M. musculus*] |
| 306 | 18696 | AA849965 | q, nn, qq, xx | | ESTs, Highly similar to MO25_MOUSE MO25 protein [*M. musculus*] |
| 315 | 19042 | AA850378 | t | | ESTs, Moderately similar to methyl-CpG binding domain protein 2 [*Mus musculus*] [*M. musculus*] |
| 317 | 13975 | AA850450 | xx | | *Rattus norvegicus* mRNA for class I beta-tubulin, complete cds |
| 323 | 16132 | AA850885 | ee | unknown Glu-Pro dipeptide repeat protein | unknown Glu-Pro dipeptide repeat protein |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 327 | 2847 | AA850919 | cc | | ESTs, Weakly similar to FAS_RAT FATTY ACID SYNTHASE [INCLUDES: EC 2.3.1.38; EC 2.3.1.39; EC 2.3.1.41; EC 1.1.1.100; EC 4.2.1.61; EC 1.3.1.10; EC 3.1.2.14] [*R. norvegicus*] |
| 328 | 3924 | AA851017 | ff | | ESTs, Highly similar to molybdenum cofactor synthesis 2 [*Mus musculus*] [*M. musculus*] |
| 332 | 4490 | AA851184 | ii | | *Rattus norvegicus* mRNA for cathepsin Y, partial cds |
| 335 | 17823 | AA851214 | y | | ESTs, Highly similar to hypothetical protein MGC7474 [*Mus musculus*] [*M. musculus*] |
| 338 | 19189 | AA851237 | dd | | ESTs, Highly similar to UBPI_MOUSE Ubiquitin carboxyl-terminal hydrolase 18 (Ubiquitin thiolesterase 18) (Ubiquitin-specific processing protease 18) (Deubiquitinating enzyme 18) (43 kDa ubiquitin-specific protease) [*M. musculus*] |
| 346 | 883 | AA851347 | t | | ESTs, Highly similar to SNX5_MOUSE Sorting nexin 5 [*M. musculus*] |
| 349 | 21489 | AA851443 | e | | ESTs, Weakly similar to I49523 tumor necrosis factor alpha-induced protein 2 - mouse [*M. musculus*] |
| 355 | 6687 | AA851739 | General | | ESTs, Highly similar to tousled-like kinase 2 (*Arabidopsis*); protein kinase U-alpha; Tousled-like kinase (*Arabidopsis*) [*Mus musculus*] [*M. musculus*] |
| 356 | 18697 | AA851776 | j | | ESTs, Highly similar to MO25_MOUSE MO25 protein [*M. musculus*] |
| 358 | 14292 | AA851791 | c | | ESTs, Weakly similar to CBP_MOUSE CREB-binding protein [*M. musculus*] |
| 365 | 18001 | AA858573 | x, bb, gg, hh | spp-24 precursor | spp-24 precursor |
| 375 | 6380 | AA858758 | o | | ESTs, Weakly similar to RIKEN cDNA 1500031O19 [*Mus musculus*] [*M. musculus*] |
| 379 | 6403 | AA858879 | y | | ESTs, Highly similar to proteasome (prosome, macropain) 26S subunit, non-ATPase, 13; 26S proteasome subunit p40.5 [*Mus musculus*] [*M. musculus*] |
| 381 | 14589 | AA858982 | p, y | | ESTs, Highly similar to LIM only 4 [*Mus musculus*] [*M. musculus*] |
| 382 | 16985 | AA858990 | rr | | ESTs, Highly similar to EF1G_MOUSE Elongation factor 1-gamma (EF-1-gamma) (eEF-1B gamma) [*M. musculus*] |
| 383 | 17559 | AA858994 | ll | parathymosin | parathymosin |
| 388 | 6440 | AA859130 | w, pp | | ESTs, Weakly similar to JC2524 phosphoprotein phosphatase (EC 3.1.3.16) 1A-beta - rat [*R. norvegicus*] |
| 396 | 15172 | AA859362 | p | | ESTs, Highly similar to BAG3_MOUSE BAG-family molecular chaperone regulator-3 (BCL 2 binding athanogene-3) (BAG-3) (Bcl-2-bindina protein Bis) [*M. musculus*] |
| 408 | 17142 | AA859612 | gg, hh | | EST, Moderately similar to 0806162J protein URF4 [*Mus musculus*] [*M. musculus*] |
| 434 | 22593 | AA859977 | tt | | ESTs, Highly similar to HS9B_RAT Heat shock protein HSP 90-beta (HSP 84) [*R. norvegicus*] |
| 441 | 4222 | AA860024 | ll, rr | | ESTs, Highly similar to EF1G_MOUSE Elongation factor 1-gamma (EF-1-gamma) (eEF-1B gamma) [*M. musculus*] |
| 442 | 13974 | AA860030 | n, qq, ss | | *Rattus norvegicus* mRNA for class I beta-tubulin, complete cds |
| 460 | 16013 | AA866482 | r, x | | ESTs, Highly similar to FGD1_MOUSE Putative Rho/Rac guanine nucleotide exchange factor (Rho/Rac GEF) (Faciogenital dysplasia protein homolog) [*M. musculus*] |
| 461 | 16029 | AA874803 | ss | | ESTs, Moderately similar to 0806162L protein URF5 [*Mus musculus*] [*M. musculus*] |
| 470 | 16146 | AA874934 | y | | ESTs, Moderately similar to A Chain A, The C2b-Domain Of Rabphilin: Structural Variations In A Janus-Faced Domain [*R. norvegicus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 471 | 17303 | AA874990 | u | | ESTs, Weakly similar to RIKEN cDNA 6330407G11 [*Mus musculus*] [*M. musculus*] |
| 481 | 16319 | AA875047 | tt | | ESTs, Highly similar to TCPZ_MOUSE T-complex protein 1, zeta subunit (TCP-1-zeta) (CCT-zeta) (CCT-zeta-1) [*M. musculus*] |
| 504 | 15205 | AA875263 | m | | ESTs, Highly similar to microspherule protein 1; nucleolar protein [*Mus musculus*] [*M. musculus*] |
| 514 | 24470 | AA875523 | jj | | ESTs, Highly similar to MLES_RAT Myosin light chain alkali, smooth-muscle isoform (MLC3SM) [*R. norvegicus*] |
| 514 | 24471 | AA875523 | y | | ESTs, Highly similar to MLES_RAT Myosin light chain alkali, smooth-muscle isoform (MLC3SM) [*R. norvegicus*] |
| 518 | 18911 | AA875615 | s, qq | | ESTs, Highly similar to PMC1_MOUSE Polymyositis/scleroderma autoantigen 1 (Autoantigen PM/Scl 1) (Polymyositis/scleroderma autoantigen 75 kDa) (PM/Scl-75) (P75 polymyositis-scleroderma overlap syndrome associated autoantigen) [*M. musculus*] |
| 521 | 2846 | AA875639 | bb, ll, rr | | ESTs, Weakly similar to FAS_RAT FATTY ACID SYNTHASE [INCLUDES: EC 2.3.1.38; EC 2.3.1.39; EC 2.3.1.41; EC 1.1.1.100; EC 4.2.1.61; EC 1.3.1.10; EC 3.1.2.14] [*R. norvegicus*] |
| 525 | 5384 | AA891041 | vv | jun B proto-oncogene | jun B proto-oncogene |
| 539 | 21951 | AA891535 | f, s, pp | | ESTs, Highly similar to hippocampus abundant gene transcript 1 [*Mus musculus*] [*M. musculus*] |
| 542 | 17225 | AA891553 | l, nn | | ESTs, Moderately similar to IF37_MOUSE Eukaryotic translation initiation factor 3 subunit 7 (eIF-3 zeta) (eIF3 p66) [*M. musculus*] |
| 548 | 22858 | AA891591 | w | programmed cell death 8 (apoptosis-inducing factor) | programmed cell death 8 (apoptosis-inducing factor) |
| 559 | 6535 | AA891746 | r | | ESTs, Highly similar to endothelial differentiation-related factor 1; hypothetical protein 1-9 [*Mus musculus*] [*M. musculus*] |
| 567 | 6967 | AA891810 | pp | | ESTs, Moderately similar to g1-related zinc finger protein [*Mus musculus*] [*M. musculus*] |
| 567 | 6968 | AA891810 | q, x, ss | | ESTs, Moderately similar to g1-related zinc finger protein [*Mus musculus*] [*M. musculus*] |
| 575 | 16023 | AA891872 | w | | ESTs, Highly similar to NNTM_MOUSE NAD(P) transhydrogenase, mitochondrial precursor (Pyridine nucleotide transhydrogenase) (Nicotinamide nucleotide transhydrogenase) [*M. musculus*] |
| 588 | 17088 | AA891998 | General, cc, oo, uu | | ESTs, Highly similar to JC4978 oxidative stress protein A170 - mouse [*M. musculus*] |
| 589 | 16836 | AA892005 | r | | ESTs, Weakly similar to PGC1_RAT Membrane associated progesterone receptor component 1 (Acidic 25 kDa protein) (25-DX) [*R. norvegicus*] |
| 599 | 19469 | AA892112 | r | | ESTs, Weakly similar to PROD_MOUSE PROLINE OXIDASE, MITOCHONDRIAL PRECURSOR (PROLINE DEHYDROGENASE) *M. musculus*] |
| 607 | 3427 | AA892246 | nn | | ESTs, Weakly similar to serine/threonine kinase 25 (yeast); Ste20-like kinase; serine/threonine kinase 25 (Ste20, yeast homolog); Yeast Sps1/Ste20-related kinase 1 [*Mus musculus*] [*M. musculus*] |
| 618 | 18208 | AA892318 | gg, hh | | ESTs, Highly similar to JC7219 nuclear protein SR-25 - mouse [*M. musculus*] |
| 618 | 18209 | AA892318 | r, bb | | ESTs, Highly similar to JC7219 nuclear protein SR-25 - mouse [*M. musculus*] |
| 627 | 23194 | AA892417 | c | ephrin A1 | ephrin A1 |
| 639 | 13160 | AA892531 | f, pp | | ESTs, Weakly similar to B39066 proline-rich protein 15 - rat [*R. norvegicus*] |
| 640 | 15154 | AA892532 | q, x, dd, tt | | *R. norvegicus* (Wistar) CaBP1 mRNA |
| 641 | 17468 | AA892545 | General | | ESTs, Moderately similar to organic cationic transporter-like 2 [*Mus musculus*] [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 655 | 20065 | AA892647 | c | germinal histone H4 gene | germinal histone H4 gene |
| 660 | 4524 | AA892759 | f, s, ff, pp, qq, vv | synaptosomal-associated protein, 23 kD | synaptosomal-associated protein, 23 kD |
| 670 | 17581 | AA892835 | f | | ESTs, Moderately similar to BTF3_MOUSE Transcription factor BTF3 (RNA polymerase B transcription factor 3) [*M. musculus*] |
| 685 | 3381 | AA892993 | jj | | ESTs, Moderately similar to high mobility group protein 20 B; BRCA2-associated factor 35 [*Mus musculus*] [*M. musculus*] |
| 689 | 3865 | AA893065 | k, p | | ESTs, Weakly similar to THDE_RAT Thyrotropin-releasing hormone degrading ectoenzyme (TRH-degrading ectoenzyme) (TRH-DE) (TRH-specific aminopeptidase) (Thyroliberinase) (Pyroglutamyl-peptidase II) (PAP-II) [*R. norvegicus*] |
| 693 | 14859 | AA893173 | e | | ESTs, Highly similar to vacuolar protein sorting 29 (*S. pombe*); vacuolar protein sorting 29 (yeast); vacuolar sorting protein 29 [*Mus musculus*] [*M. musculus*] |
| 706 | 16168 | AA893280 | z, nn | | ESTs, Moderately similar to ADFP_MOUSE ADIPOPHILIN (ADIPOSE DIFFERENTIATION-RELATED PROTEIN) (ADRP) [*M. musculus*] |
| 708 | 17900 | AA893353 | gg, hh, rr | | ESTs, Highly similar to DNPE_MOUSE Aspartyl aminopeptidase [*M. musculus*] |
| 710 | 4678 | AA893384 | v | | ESTs, Moderately similar to IRF3_MOUSE Interferon regulatory factor 3 (IRF-3) [*M. musculus*] |
| 715 | 13088 | AA893495 | x | | ESTs, Highly similar to A40066 corticosteroid-binding globulin precursor - rat [*R. norvegicus*] |
| 750 | 24473 | AA894200 | y | | ESTs, Highly similar to MLES_RAT Myosin light chain alkali, smooth-muscle isoform (MLC3SM) [*R. norvegicus*] |
| 751 | 22783 | AA894207 | cc | | ESTs, Weakly similar to dual-specificity phosphatase [*Mus musculus*] [*M. musculus*] |
| 766 | 15009 | AA899106 | pp | cyclin D2 | cyclin D2 |
| 792 | 21649 | AA900351 | l, uu | | ESTs, Weakly similar to RIKEN cDNA 3930402F23 [*Mus musculus*] [*M. musculus*] |
| 803 | 3944 | AA900688 | ww | | ESTs, Weakly similar to A45988 dentin matrix acidic phosphoprotein AG1 - rat [*R. norvegicus*] |
| 808 | 18379 | AA900993 | u | | ESTs, Highly similar to nuclear localization signal protein absent in velo-cardio-facial patients [*Mus musculus*] [*M. musculus*] |
| 813 | 4857 | AA901237 | mm | | ESTs, Weakly similar to CYCK_MOUSE Cyclin K [*M. musculus*] |
| 839 | 4944 | AA924405 | h | | ESTs, Weakly similar to NFH_MOUSE Neurofilament triplet H protein (200 kDa neurofilament protein) (Neurofilament heavy polypeptide) (NF-H) [*M. musculus*] |
| 846 | 16806 | AA924591 | r nn | | Rat Cyp4a locus, encoding cytochrome P450 (IVA3) mRNA, complete cds |
| 851 | 4994 | AA924658 | k | | ESTs, Moderately similar to PIN2/TRF1-interacting protein [*Mus musculus*] [*M. musculus*] |
| 874 | 23159 | AA925318 | l, q, x, dd | I-kappa-B-beta | I-kappa-B-beta |
| 882 | 22125 | AA925503 | ss | ribosomal protein S27 | ribosomal protein S27 |
| 908 | 11691 | AA926193 | t, mm | sulfotransferase family, cytosolic, 1C, member 2 | sulfotransferase family, cytosolic, 1C, member 2 |
| 911 | 14223 | AA926352 | h | | ESTs, Highly similar to Trk-fused gene; TFG [*Mus musculus*] [*M. musculus*] |
| 914 | 20910 | AA942693 | x | | ESTs, Highly similar to RIKEN cDNA 5730406I15 [*Mus musculus*] [*M. musculus*] |
| 919 | 22677 | AA942718 | t, ff, pp | B cell lymphoma 2 like | B cell lymphoma 2 like |
| 944 | 21600 | AA943997 | r | | ESTs, Highly similar to C184L-22 [*Mus musculus*] [*M. musculus*] |
| 946 | 2762 | AA944165 | c | | ESTs, Highly similar to C10_MOUSE Putative C10 protein (B-cell receptor-associated protein 37) [*M. musculus*] |
| 949 | 22017 | AA944209 | d | | ESTs, Moderately similar to PIM1_RAT Proto-oncogene serine/threonine-protein kinase pim-1 [*R. norvegicus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 962 | 19480 | AA944442 | oo | | ESTs, Weakly similar to SL13_RAT SKELETAL MUSCLE LIM-PROTEIN 3 (SLIM 3) (LIM-DOMAIN PROTEIN DRAL) (FOUR AND A HALF LIM DOMAINS PROTEIN 2) (FHL-2) [*R. norvegicus*] |
| 965 | 2175 | AA944528 | ii | | ESTs, Weakly similar to T9S2_MOUSE Transmembrane 9 superfamily protein member 2 precursor [*M. musculus*] |
| 988 | 23813 | AA945149 | b, vv | | ESTs, Moderately similar to S27161 glutathione transferase (EC 2.5.1.18) 5 - rat [*R. norvegicus*] |
| 990 | 16635 | AA945171 | k | | ESTs, Highly similar to APC4_RAT APOLIPOPROTEIN C-IV PRECURSOR (APO-CIV) (APOLIPOPROTEIN E-LINKED) (ECL) [*R. norvegicus*] |
| 995 | 22029 | AA945284 | dd | | ESTs, Moderately similar to 0806162L protein URF5 [*Mus musculus*] [*M. musculus*] |
| 996 | 7683 | AA945320 | a | | ESTs, Highly similar to IMA3_MOUSE Importin alpha-3 subunit (Karyopherin alpha-3 subunit) (Importin alpha Q2) [*M. musculus*] |
| 1005 | 13751 | AA945699 | kk | synaptosomal-associated protein, 23 kD | synaptosomal-associated protein, 23 kD |
| 1010 | 22639 | AA945746 | t | | ESTs, Highly similar to SPT4_HUMAN Transcription initiation protein SPT4 homolog 1 [*M. musculus*] |
| 1020 | 18110 | AA945932 | u | Annexin A3 | Annexin A3, ESTs, ESTs, Weakly similar to LURT3 annexin III - rat [*R. norvegicus*] |
| 1028 | 21157 | AA946189 | l | | ESTs, Moderately similar to RGP1_MOUSE Ran-GTPase activating protein 1 [*M. musculus*] |
| 1032 | 18280 | AA946361 | c | | ESTs, Weakly similar to CBP_MOUSE CREB-binding protein [*M. musculus*] |
| 1072 | 17540 | AA955914 | f, pp | | EST, EST, Moderately similar to FBRL_MOUSE Fibrillarin (Nucleolar protein 1) [*M. musculus*], ESTs, Highly similar to S38342 fibrillarin - mouse [*M. musculus*] |
| 1075 | 22576 | AA955983 | m,dd | | ESTs, Weakly similar to FLAP_RAT 5-lipoxygenase activating protein (FLAP) (MK-886-binding protein) [*R. norvegicus*] |
| 1093 | 16578 | AA957143 | d | | ESTs, Highly similar to DP30_MOUSE Dpy-30-like protein [*M. musculus*] |
| 1093 | 16579 | AA957143 | bb | | ESTs, Highly similar to DP30_MOUSE Dpy-30-like protein [*M. musculus*] |
| 1095 | 22357 | AA957264 | k | | *Rattus norvegicus* hypothetical RNA binding protein RDA288 mRNA, complete cds |
| 1106 | 24156 | AA957803 | k | | ESTs, Moderately similar to RNP_RAT Ribonuclease pancreatic precursor (RNase 1) (RNase A) (RL1) [*R. norvegicus*] |
| 1120 | 2205 | AA963808 | t | | ESTs, Highly similar to zinc finger RNA binding protein [*Mus musculus*] [*M. musculus*] |
| 1122 | 8430 | AA964033 | t | | *Rattus norvegicus* NonO/p54nrb homolog mRNA, partial cds |
| 1133 | 12563 | AA964533 | m | | ESTs, Highly similar to RIKEN cDNA 1500003K04 [*Mus musculus*] [*M. musculus*] |
| 1145 | 2326 | AA964892 | ii | | ESTs, Highly similar to CA14_MOUSE COLLAGEN ALPHA 1(IV) CHAIN PRECURSOR [*M. musculus*] |
| 1169 | 2939 | AA996885 | ll | | ESTs, Moderately similar to SY19_MOUSE Small inducible cytokine A19 precursor (CCL19) (Epstein-Barr virus induced molecule 1 ligand chemokine) (EBI1-ligand chemokine) (ELC) [*M. musculus*] |
| 1170 | 3054 | AA996899 | gg, hh | spermatogenesis associated 2 | spermatogenesis associated 2 |
| 1173 | 2958 | AA996944 | ee | | ESTs, Weakly similar to ring finger protein 23; RING-B box-coiled coil-B30.2 [*Mus musculus*] [*M. musculus*] |
| 1185 | 16883 | AA997345 | dd | | ESTs, Highly similar to RIKEN cDNA 1190017B19 [*Mus musculus*] [*M. musculus*] |
| 1191 | 3250 | AA997765 | n | fibrillin-1 | fibrillin-1 |
| 1210 | 14149 | AA998172 | y | platelet-activating factor acetylhydrolase alpha 2 subunit (PAF-AH alpha 2) | platelet-activating factor acetylhydrolase alpha 2 subunit (PAF-AH alpha 2) |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1218 | 3558 | AA998461 | oo | | ESTs, Moderately similar to gene trap ROSA 26 antisense, Philippe Soriano; gene trap ROSA 26 antisense [*Mus musculus*] [*M. musculus*] |
| 1221 | 6965 | AA998523 | h | | ESTs, Moderately similar to C54354 calnexin precursor - rat [*R. norvegicus*] |
| 1228 | 22210 | AA998690 | p | | ESTs, Highly similar to IF6_MOUSE Eukaryotic translation initiation factor 6 (eIF-6) (B4 integrin interactor) (CAB) (p27(BBP)) [*M. musculus*] |
| 1229 | 20271 | AA998747 | cc, mm | procollagen-lysine, 2-oxoglutarate 5-dioxygenase (lysine hydroxylase, Ehlers-Danlos syndrome type VI) | procollagen-lysine, 2-oxoglutarate 5-dioxygenase (lysine hydroxylase, Ehlers-Danlos syndrome type VI) |
| 1245 | 16304 | AB008424 | e, j | | Rat cytochrome P-450 IID3 mRNA, complete cds |
| 1248 | 13973 | AB011679 | y, ee | | *Rattus norvegicus* mRNA for class I beta-tubulin, complete cds |
| 1266 | 4292 | AF034896 | e, h | | *Rattus norvegicus* olfactory receptor-like protein (SCR D-8) mRNA, complete cds |
| 1269 | 8426 | AF036335 | pp | | *Rattus norvegicus* NonO/p54nrb homolog mRNA, partial cds |
| 1269 | 8427 | AF036335 | pp | | *Rattus norvegicus* NonO/p54nrb homolog mRNA, partial cds |
| 1273 | 17597 | AF051943 | oo | nucleoside diphosphate kinase type 6 | nucleoside diphosphate kinase type 6 |
| 1273 | 17598 | AF051943 | oo | nucleoside diphosphate kinase type 6 | nucleoside diphosphate kinase type 6 |
| 1276 | 15801 | AF061443 | p | | *Rattus norvegicus* G protein-coupled receptor LGR4 (LGR4) mRNA, complete cds |
| 1310 | 4233 | AI008409 | h | unknown Glu-Pro dipeptide repeat protein | unknown Glu-Pro dipeptide repeat protein |
| 1315 | 24151 | AI008793 | u | | ESTs, Highly similar to T2D5_RAT Transcription initiation factor TFIID 70 kDa subunit (TAFII-70) (TAFII-80) (TAFII80) (p80) [*R. norvegicus*] |
| 1316 | 16701 | AI008838 | ff | | ESTs, Highly similar to RIKEN cDNA 1300002A08 [*Mus musculus*] [*M. musculus*] |
| 1326 | 9150 | AI009198 | h | | ESTs, Highly similar to UNRI_MOUSE UNR-interacting protein (Serine-threonine kinase receptor-associated protein) [*M. musculus*] |
| 1338 | 19092 | AI009501 | h, w | | ESTs, Highly similar to SUI1_MOUSE Protein translation factor SUI1 homolog [*M. musculus*] |
| 1341 | 3926 | AI009592 | e, o | | ESTs, Highly similar to molybdenum cofactor synthesis 2 [*Mus musculus*] [*M. musculus*] |
| 1352 | 8431 | AI009761 | y | | *Rattus norvegicus* NonO/p54nrb homolog mRNA, partial cds |
| 1368 | 15644 | AI010256 | a, d, n, kk | H3 histone, family 3B | H3 histone, family 3B |
| 1375 | 15624 | AI010449 | qq | follistatin-related protein precursor | follistatin-related protein precursor |
| 1387 | 4203 | AI011082 | j | | ESTs, Highly similar to IMA3_MOUSE Importin alpha-3 subunit (Karyopherin alpha-3 subunit) (Importin alpha Q2) [*M. musculus*] |
| 1388 | 22030 | AI011177 | n | | ESTs, Moderately similar to 0806162L protein URF5 [*Mus musculus*] [*M. musculus*] |
| 1393 | 16702 | AI011436 | ss | | ESTs, Highly similar to RIKEN cDNA 1300002A08 [*Mus musculus*] [*M. musculus*] |
| 1398 | 3941 | AI011598 | xx | | ESTs, Moderately similar to LMA5_MOUSE Laminin alpha-5 chain precursor [*M. musculus*] |
| 1400 | 3995 | AI011678 | l, jj | Ryudocan/syndecan 2 | Ryudocan/syndecan 2 |
| 1404 | 14267 | AI011738 | d, o | | ESTs, Highly similar to P044_RAT 0-44 protein [*R. norvegicus*] |
| 1413 | 7104 | AI012103 | oo | | ESTs, Moderately similar to low density lipoprotein B [*Mus musculus*] [*M. musculus*] |
| 1426 | 12766 | AI012505 | ee | | ESTs, Highly similar to diacylglycerol O-acyltransferase 2; diacylglycerol acyltransferase 2 [*Mus musculus*] [*M. musculus*] |
| 1464 | 4251 | AI013494 | e | ATP-binding cassette, sub-family F (GCN20), member 1 | ATP-binding cassette, sub-family F (GCN20), member 1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1474 | 7310 | AI013816 | ff | | ESTs, Moderately similar to RIKEN cDNA 0610006I08 [*Mus musculus*] [*M. musculus*] |
| 1476 | 21950 | AI013861 | h | 3-hydroxyisobutyrate dehydrogenase | 3-hydroxyisobutyrate dehydrogenase |
| 1480 | 7316 | AI013883 | s | | ESTs, Highly similar to MKR1_MOUSE Makorin 1 [*M. musculus*] |
| 1493 | 23530 | AI014148 | t, w | | ESTs, Highly similar to A4B1_MOUSE Adapter-related protein complex 4 beta 1 subunit (Beta subunit of AP-4) (AP-4 adapter complex beta subunit) [*M. musculus*] |
| 1505 | 2699 | AI029306 | ii | | ESTs, Highly similar to I58376 hypothetical protein unp - mouse [*M. musculus*] |
| 1515 | 4679 | AI029847 | General | | ESTs, Moderately similar to IRF3_MOUSE Interferon regulatory factor 3 (IRF-3) [*M. musculus*] |
| 1546 | 16169 | AI030932 | nn, rr | | ESTs, Moderately similar to ADFP_MOUSE ADIPOPHILIN (ADIPOSE DIFFERENTIATION-RELATED PROTEIN) (ADRP) [*M. musculus*] |
| 1553 | 18002 | AI043655 | g, x, dd | spp-24 precursor | spp-24 precursor |
| 1560 | 7913 | AI043849 | ff | | ESTs, Weakly similar to ELL_MOUSE RNA POLYMERASE II ELONGATION FACTOR ELL (ELEVEN-NINETEEN LYSINE-RICH LEUKEMIA PROTEIN) [*M. musculus*] |
| 1571 | 15240 | AI044241 | General | | ESTs, Highly similar to CIDB_MOUSE Cell death activator CIDE-B (Cell death-inducing DFFA-like effector B) [*M. musculus*] |
| 1590 | 18422 | AI044827 | e | | ESTs, Highly similar to nitrilase 1 [*Mus musculus*] [*M. musculus*] |
| 1602 | 5712 | AI045154 | n | | ESTs, Moderately similar to ORC5_MOUSE Origin recognition complex subunit 5 [*M. musculus*] |
| 1608 | 6241 | AI045321 | bb | | ESTs, Weakly similar to IGEB_MOUSE IGE-BINDING PROTEIN [*M. musculus*] |
| 1633 | 21490 | AI045764 | jj | | ESTs, Weakly similar to I49523 tumor necrosis factor alpha-induced protein 2 - mouse [*M. musculus*] |
| 1644 | 15241 | AI058382 | General | | ESTs, Highly similar to CIDB_MOUSE Cell death activator CIDE-B (Cell death-inducing DFFA-like effector B) [*M. musculus*] |
| 1677 | 965 | AI059340 | l | huntingtin-associated protein interacting protein (duo) | huntingtin-associated protein interacting protein (duo) |
| 1684 | 8347 | AI059519 | dd | | ESTs, Weakly similar to EGRT epidermal growth factor precursor - rat [*R. norvegicus*] |
| 1698 | 900 | AI059963 | ii, jj | vacuolar protein sorting homolog r-vps33b | vacuolar protein sorting homolog r-vps33b |
| 1709 | 8590 | AI060207 | nn | | ESTs, Highly similar to splicing factor 3b, subunit 1, 155 kDa [*Mus musculus*] [*M. musculus*] |
| 1718 | 9054 | AI070138 | dd | | ESTs, Moderately similar to RIKEN cDNA 1110028N05 [*Mus musculus*] [*M. musculus*] |
| 1729 | 17871 | AI070601 | ii | | ESTs, Weakly similar to NOE1_RAT Noelin precursor (Neuronal olfactomedin-related ER localized protein) (Olfactomedin 1) (Pancortin) (1B426B) [*R. norvegicus*] |
| 1789 | 8856 | AI072402 | b, h, u | | ESTs, Weakly similar to S42977 finger protein 30 - mouse [*M. musculus*] |
| 1795 | 12863 | AI072467 | nn | | ESTs, Highly similar to 2207230A transcription factor ATBF1 [*Mus musculus*] [*M. musculus*] |
| 1806 | 9399 | AI072812 | a | | ESTs, Highly similar to glioma-amplified sequence-41 [*Mus musculus*] [*M. musculus*] |
| 1811 | 15308 | AI072896 | nn | | ESTs, Weakly similar to catenin delta 2; neural plakophilin-related arm-repeat protein; catenin (cadherin-associated protein), delta 2 (neural plakophilin-related arm-repeat protein); neurojungin [*Mus musculus*] [*M. musculus*] |
| 1817 | 20834 | AI073056 | cc | kinesin light chain 1 | kinesin light chain 1 |
| 1854 | 15080 | AI102045 | l | | ESTs, Moderately similar to NIF1_MOUSE Nuclear LIM interactor-interacting factor 1 (NLI-interacting factor 1) (NIF-like protein) [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1864 | 13892 | AI102438 | gg, hh | | ESTs, Highly similar to CNIH_MOUSE CORNICHON HOMOLOG [M. musculus] |
| 1866 | 15218 | AI102495 | cc | | ESTs, Moderately similar to PNPH_MOUSE Purine nucleoside phosphorylase (Inosine phosphorylase) (PNP) [M. musculus] |
| 1873 | 5910 | AI102689 | k | | ESTs, Highly similar to RPP20 protein [Mus musculus] [M. musculus] |
| 1886 | 18607 | AI103105 | z | | ESTs, Highly similar to RL12_RAT 60S RIBOSOMAL PROTEIN L12 [R. norvegicus] |
| 1907 | 2297 | AI103602 | General | | ESTs, Highly similar to SAP3_MOUSE Ganglioside GM2 activator precursor (GM2-AP) (Cerebroside sulfate activator protein) (Shingolipid activator protein 3) (SAP-3) [M. musculus] |
| 1909 | 13317 | AI103637 | ee | | ESTs, Moderately similar to RIKEN cDNA 2810411G23 [Mus musculus] [M. musculus] |
| 1918 | 4402 | AI103874 | kk | | ESTs, Weakly similar to FKB1_RAT FK506-BINDING PROTEIN (FKBP-12) (PEPTIDYL-PROLYL CIS-TRANS ISOMERASE) (PPIASE) (ROTAMASE) (IMMUNOPHILIN FKBP12) [R. norvegicus] |
| 1922 | 20833 | AI104035 | mm | | ESTs, Highly similar to COXG_MOUSE Cytochrome c oxidase polypeptide VIb (AED) [M. musculus] |
| 1928 | 8372 | AI104256 | pp | | ESTs, Highly similar to MUS81 endonuclease [Mus musculus] [M. musculus] |
| 1931 | 22211 | AI104279 | tt | | ESTs, Highly similar to IF6_MOUSE Eukaryotic translation initiation factor 6 (eIF-6) (B4 integrin interactor) (CAB) (p27(BBP)) [M. musculus] |
| 1946 | 22822 | AI104679 | p, z | | ESTs, Moderately similar to RIKEN cDNA 2310016K22; RIKEN cDNA 2310016K22 gene [Mus musculus] [M. musculus] |
| 1958 | 6225 | AI105105 | ss | | ESTs, Highly similar to tangerin [Mus musculus] [M. musculus] |
| 1959 | 21253 | AI105110 | ii, ww | | ESTs, Highly similar to S58180 sui1 protein - mouse (fragment) [M. musculus] |
| 1960 | 18742 | AI105131 | bb, qq | | ESTs, Highly similar to lung alpha/beta hydrolase 1; alpha/beta hydrolase-1 [Mus musculus] [M. musculus] |
| 1986 | 7266 | AI112237 | d, kk, nn | | ESTs, Moderately similar to RIKEN cDNA 1810011O01 [Mus musculus] [M. musculus] |
| 1987 | 9575 | AI112250 | General, kk, nn | protein tyrosine phosphatase type IVA, member 2 | protein tyrosine phosphatase type IVA, member 2 |
| 1989 | 2501 | AI112343 | f, nn, ww | ubiquitin fusion degradation 1-like | ubiquitin fusion degradation 1-like |
| 1990 | 23099 | AI112365 | y, nn, ww | | ESTs, Highly similar to MGN_HUMAN Mago nashi protein homolo [M. musculus] |
| 1995 | 2296 | AI112979 | q, x, General | | ESTs, Highly similar to SAP3_MOUSE Ganglioside GM2 activator precursor (GM2-AP) (Cerebroside sulfate activator protein) (Shingolipid activator protein 3) (SAP-3) [M. musculus] |
| 2004 | 23653 | AI136396 | bb | farnesyltransferase beta subunit | farnesyltransferase beta subunit |
| 2013 | 24212 | AI136747 | c | | ESTs, Highly similar to H33_HUMAN Histone H3.3 (H3.A) (H3.B) (H3.3Q) [M. musculus] |
| 2016 | 13090 | AI136977 | m, ll | | ESTs, Highly similar to S14538 transition protein - mouse [M. musculus] |
| 2016 | 13091 | AI136977 | v | | ESTs, Highly similar to S14538 transition protein - mouse [M. musculus] |
| 2028 | 11270 | AI137480 | nn | | ESTs, Weakly similar to A39066 proline-rich protein 4 - rat [R. norvegicus] |
| 2030 | 18943 | AI137495 | d, ll | | ESTs, Highly similar to H2A1_RAT Histone H2A.1 [R. norvegicus] |
| 2065 | 19034 | AI145768 | u | | ESTs, Weakly similar to A55817 cyclin-dependent kinase p130-PITSLRE - mouse [M. musculus] |
| 2071 | 23224 | AI146033 | h, z, ll | translocase of inner mitochondrial membrane 9 homolog (yeast) | translocase of inner mitochondrial membrane 9 homolog (yeast) |
| 2077 | 11693 | AI168953 | mm | sulfotransferase family, cytosolic, 1C, member 2 | sulfotransferase family, cytosolic, 1C, member 2 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2080 | 16580 | AI168989 | oo | | ESTs, Highly similar to DP30_MOUSE Dpy-30-like protein [*M. musculus*] |
| 2097 | 6732 | AI169269 | kk | | ESTs, Highly similar to dim1 (*S. pombe*) [*Mus musculus*] [*M. musculus*] |
| 2099 | 16879 | AI169284 | ww | | ESTs, Highly similar to AR61_MOUSE ARL-6 interacting protein-1 (Aip-1) (TBX2 protein) [*M. musculus*] |
| 2101 | 24213 | AI169289 | c | | ESTs, Highly similar to H33_HUMAN Histone H3.3 (H3.A) (H3.B) (H3.3Q) [*M. musculus*] |
| 2114 | 21660 | AI169751 | b, dd | | *Rattus norvegicus* interferon-inducible protein variant 10 mRNA, complete cds |
| 2116 | 3909 | AI169903 | l | | ESTs, Moderately similar to lymphocyte antigen 96 [*Mus musculus*] [*M. musculus*] |
| 2122 | 18367 | AI170064 | j | | ESTs, Moderately similar to JC7279 Down syndrome critical region gene-2 (DSCR2) protein - mouse [*M. musculus*] |
| 2134 | 23966 | AI170442 | t, mm | | ESTs, Highly similar to JE0223 destrin - rat [*R. norvegicus*] |
| 2154 | 16170 | AI170894 | ii | | ESTs, Moderately similar to ADFP_MOUSE ADIPOPHILIN (ADIPOSE DIFFERENTIATION-RELATED PROTEIN) (ADRP) [*M. musculus*] |
| 2167 | 20905 | AI171273 | t, mm | | ESTs, Moderately similar to C54819 actin-capping protein beta chain, splice form 2 - mouse [*M. musculus*] |
| 2171 | 17529 | AI171460 | u | | ESTs, Weakly similar to HCD2_RAT 3-hydroxyacyl-CoA dehydrogenase type II (Type II HADH) (Endoplasmic reticulum-associated amyloid beta-peptide binding protein) [*R. norvegicus*] |
| 2175 | 15684 | AI171535 | n, General | | ESTs, Weakly similar to PAB1_MOUSE Polyadenylate-binding protein 1 (Poly(A)-binding protein 1) (PABP 1) (PABP1) [*M. musculus*] |
| 2183 | 6582 | AI171726 | bb | | ESTs, Weakly similar to I67424 hERR-2 homolog - rat (fragment) [*R. norvegicus*] |
| 2196 | 7733 | AI172086 | z | | ESTs, Highly similar to SH3 domain binding glutamic acid-rich protein-like 3 [*Mus musculus*] [*M. musculus*] |
| 2197 | 9537 | AI172097 | y | heat shock transcription factor 1 | heat shock transcription factor 1 |
| 2200 | 1398 | AI172105 | kk | | ESTs, Highly similar to potassium channel modulatory factor DEBT-91; clone DEBT-91 [*Mus musculus*] [*M. musculus*] |
| 2207 | 6147 | AI172236 | u | | ESTs, Highly similar to RIKEN cDNA 1110063B05 [*Mus musculus*] [*M. musculus*] |
| 2210 | 2140 | AI172272 | gg, hh | | ESTs, Weakly similar to A53004 transcription elongation factor S-II - rat [*R. norvegicus*] |
| 2211 | 4193 | AI172274 | dd | | ESTs, Weakly similar to A Chain A, 2-Enoyl-Coa Hydratase, Data Collected At 100 K, Ph 6.5 [*R. norvegicus*] |
| 2225 | 13098 | AI172610 | c, ii | | ESTs, Moderately similar to STT3_MOUSE OLIGOSACCHARYL TRANSFERASE STT3 SUBUNIT HOMOLOG (85) (INTEGRAL MEMBRANE PROTEIN 1) [*M. musculus*] |
| 2231 | 4926 | AI175034 | ll | | ESTs, Highly similar to RIKEN cDNA 2410002O22 [*Mus musculus*] [*M. musculus*] |
| 2243 | 18507 | AI175551 | z | | ESTs, Highly similar to EF1B_MOUSE Elongation factor 1-beta (EF-1-beta) [*M. musculus*] |
| 2251 | 24214 | AI175794 | s | | ESTs, Highly similar to H33_HUMAN Histone H3.3 (H3.A) (H3.B) (H3.3Q) [*M. musculus*] |
| 2252 | 19004 | AI175875 | ii | | *Rattus norvegicus* Sprague-Dawley lipid-binding protein mRNA, complete cds |
| 2253 | 7647 | AI175991 | d | | ESTs, Moderately similar to minichromosome maintenance deficient (*S. cerevisiae*) 3-associate; nuclear protein GANP [*Mus musculus*] [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2258 | 24745 | AI176101 | d, j | | ESTs, Highly similar to MTRP_MOUSE Lysosomal-associated transmembrane protein 4A (Golgi 4-transmembrane spanning transporter) (Mouse transporter protein) (MTP) [*M. musculus*] |
| 2276 | 19006 | AI176393 | f | | *Rattus norvegicus* Sprague-Dawley lipid-binding protein mRNA, complete cds |
| 2278 | 15191 | AI176456 | t, w | | ESTs, Highly similar to SMRT2 metallothionein II - rat [*R. norvegicus*] |
| 2281 | 21661 | AI176479 | y, nn | | *Rattus norvegicus* interferon-inducible protein variant 10 mRNA, complete cds |
| 2283 | 2993 | AI176492 | j, ll | | ESTs, Highly similar to eukaryotic translation initiation factor 3, subunit 2 (beta, 36 kD); TGF-beta receptor binding protein; DNA segment, Chr 4, ERATO Doi 632, expressed [*Mus musculus*] [*M. musculus*] |
| 2294 | 3034 | AI176613 | b | | ESTs, Moderately similar to PEX7_MOUSE PEROXISOMAL TARGETING SIGNAL 2 RECEPTOR (PTS2 RECEPTOR) (PEROXIN 7) [*M. musculus*] |
| 2300 | 23403 | AI176714 | bb | | ESTs, Highly similar to CHD1_MOUSE CHROMODOMAIN-HELICASE-DNA BINDING PROTEIN 1 (CHD-1) [*M. musculus*] |
| 2317 | 3862 | AI177052 | nn, tt | Nuclear pore complex protein | Nuclear pore complex protein |
| 2325 | 14083 | AI177181 | n | | ESTs, Weakly similar to FYV1_MOUSE FYVE finger-containing phosphoinositide kinase (1-phosphatidylinositol-4-phosphate kinase) (PIP5K) (PtdIns(4)P-5-kinase) (p235) [*M. musculus*] |
| 2337 | 14910 | AI177631 | z | | ESTs, Moderately similar to MYPS_RAT MYOSIN-BINDING PROTEIN C, SLOW-TYPE (SLOW MYBP-C) (C-PROTEIN, SKELETAL MUSCLE SLOW-ISOFORM) [*R. norvegicus*] |
| 2349 | 1131 | AI177919 | nn, pp, ww | | Rat cytochrome P450CMF1b mRNA, complete cds |
| 2351 | 19184 | AI178025 | d | | ESTs, Highly similar to TGIF_MOUSE 5'-TG-3' INTERACTING FACTOR (HOMEOBOX PROTEIN TGIF) [*M. musculus*] |
| 2354 | 13389 | AI178104 | d | | ESTs, Highly similar to RIKEN cDNA 2400009B11 [*Mus musculus*] [*M. musculus*] |
| 2381 | 15091 | AI178740 | f | | ESTs, Highly similar to A56418 transcription factor delta - mouse [*M. musculus*] |
| 2383 | 2825 | AI178752 | l, nn | | ESTs, Highly similar to CLN3_MOUSE CLN3 PROTEIN (BATTENIN) [*M. musculus*] |
| 2397 | 19041 | AI179049 | oo | | ESTs, Weakly similar to RN12_MOUSE RING finger protein 12 (LIM domain interacting RING finger protein) (RING finger LIM domain-binding protein) (R-LIM) [*M. musculus*] |
| 2401 | 5887 | AI179099 | j, o | | ESTs, Moderately similar to VNN1_MOUSE Pantetheinase precursor (Pantetheine hydrolase) (Vascular non-inflammatory molecule 1) (Vanin 1) [*M. musculus*] |
| 2411 | 16703 | AI179300 | ff | | ESTs, Highly similar to RIKEN cDNA 1300002A08 [*Mus musculus*] [*M. musculus*] |
| 2436 | 14803 | AI179906 | r | | ESTs, Highly similar to transformed mouse 3T3 cell double minute 4 [*Mus musculus*] [*M. musculus*] |
| 2441 | 2099 | AI180015 | w, tt | ribosomal protein L14 | ribosomal protein L14 |
| 2443 | 9821 | AI180114 | ss | | ESTs, Highly similar to NIP2_MOUSE BCL2/ADENOVIRUS E1B 19-KDA PROTEIN-INTERACTING PROTEIN 2 [*M. musculus*] |
| 2462 | 22366 | AI227743 | tt | | ESTs, Highly similar to Fas-activated serine/threonine kinase [*Mus musculus*] [*M. musculus*] |
| 2470 | 14230 | AI228064 | y | | ESTs, Weakly similar to A47179 homeotic protein LH-2 - rat [*R. norvegicus*] |
| 2472 | 16970 | AI228112 | tt | protein phosphatase 2 (formerly 2A), regulatory subunit B (PR 52), alpha isoform | protein phosphatase 2 (formerly 2A), regulatory subunit B (PR 52), alpha isoform |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2479 | 22915 | AI228299 | m, ll | | ESTs, Highly similar to craniofacial development protein 1 [Mus musculus] [*M. musculus*] |
| 2483 | 22455 | AI228524 | s | | ESTs, Moderately similar to RIKEN cDNA 1700021F05 [*Mus musculus*] [*M. musculus*] |
| 2495 | 15078 | AI228830 | s | stearoyl-Coenzyme A desaturase 2 | Rat DNA polymerase alpha mRNA, 3' end, stearoyl-Coenzyme A desaturase 2 |
| 2521 | 13977 | AI229707 | j, bb, nn | | *Rattus norvegicus* mRNA for class I beta-tubulin, complete cds |
| 2545 | 13555 | AI230547 | d | | ESTs, Moderately similar to 1920362A tumor suppressor gene mgl1 [*Mus musculus*] [*M. musculus*] |
| 2554 | 22387 | AI230753 | a, tt | | ESTs, Highly similar to BI3__MOUSE Brain protein I3 [*M. musculus*] |
| 2560 | 14224 | AI230956 | rr | | ESTs, Highly similar to Trk-fused gene; TFG [*Mus musculus*] [*M. musculus*] |
| 2563 | 2299 | AI231094 | w | | ESTs, Highly similar to SAP3__MOUSE Ganglioside GM2 activator precursor (GM2-AP) (Cerebroside sulfate activator protein) (Shingolipid activator protein 3) (SAP-3) [*M. musculus*] |
| 2575 | 13092 | AI231547 | oo | | ESTs, Highly similar to S14538 transition protein - mouse [*M. musculus*] |
| 2578 | 4703 | AI231606 | k, r | | ESTs, Moderately similar to RIKEN cDNA 6330579B17 [*Mus musculus*] [*M. musculus*] |
| 2583 | 17297 | AI231785 | ii, rr | | ESTs, Moderately similar to Niemann Pick type C2 [*Mus musculus*] [*M. musculus*] |
| 2595 | 14102 | AI232131 | rr | | ESTs, Highly similar to I48253 beta-N-acetylhexosaminidase (EC 3.2.1.52) alpha chain precursor - mouse [*M. musculus*] |
| 2596 | 19274 | AI232135 | ii | | ESTs, Highly similar to COG2__MOUSE Coatomer gamma-2 subunit (Gamma-2 coat protein) (Gamma-2 COP) [*M. musculus*] |
| 2602 | 409 | AI232268 | p, r | low density lipoprotein receptor-related protein associated protein 1 | low density lipoprotein receptor-related protein associated protein 1 |
| 2608 | 15582 | AI232320 | k, o, oo | | Rat mitochondrial 3-hydroxy-3-methylglutaryl CoA synthase mRNA, complete cds |
| 2618 | 14547 | AI232431 | z, ww | | ESTs, Highly similar to TLP1__MOUSE TATA BOX BINDING PROTEIN-LIKE PROTEIN 1 (TBP-LIKE PROTEIN 1) (21-KDA TBP-LIKE PROTEIN) [*M. musculus*] |
| 2622 | 8709 | AI232534 | ii | | ESTs, Weakly similar to DnaJ (Hsp40) homolog, subfamily B, member 3; heat shock protein, DNAJ-like 3 [*Mus musculus*] [*M. musculus*] |
| 2640 | 14098 | AI233114 | j | | ESTs, Moderately similar to S29510 ubiquinol--cytochrome-c reductase (EC 1.10.2.2) core protein II precursor- rat [*R. norvegicus*] |
| 2652 | 10378 | AI233300 | l | | ESTs, Moderately similar to CO5__MOUSE Complement C5 precursor (Hemolytic complement) [Contains: C5A anaphylatoxin] [*M. musculus*] |
| 2676 | 15685 | AI233870 | m | | ESTs, Weakly similar to PAB1__MOUSE Polyadenylate-binding protein 1 (Poly(A)-binding protein 1) (PABP 1) (PABP1) [*M. musculus*] |
| 2700 | 15034 | AI235054 | s | | ESTs, Weakly similar to RIKEN cDNA 0610008N23 [*Mus musculus*] [*M. musculus*] |
| 2703 | 15004 | AI235224 | k | tissue inhibitor of metalloproteinase 1 | tissue inhibitor of metalloproteinase 1 |
| 2711 | 15858 | AI235455 | rr | | ESTs, Moderately similar to B54745 beta-N-acetylhexosaminidase (EC 3.2.1.52) beta chain - mouse [*M. musculus*] |
| 2728 | 3617 | AI236021 | d | | ESTs, Highly similar to JC4857 hepatocarcinogenesis-related transcription factor - rat [*R. norvegicus*] |
| 2731 | 20788 | AI236053 | qq | acyl-coenzyme A:cholesterol acyltransferase | acyl-coenzyme A:cholesterol acyltransferase |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2733 | 11465 | AI236084 | q | | ESTs, Moderately similar to TNR9_MOUSE Tumor necrosis factor receptor superfamily member 9 precursor (4-1BB ligand receptor) (T-cell antigen 4-1BB) (CD137 antigen) [*M. musculus*] |
| 2736 | 9543 | AI236164 | k | | ESTs, Moderately similar to A41641 mannosyl-oligosaccharide 1,3-1,6-alpha-mannosidase (EC 3.2.1.114) - mouse [*M. musculus*] |
| 2747 | 19035 | AI236576 | pp, rr | | ESTs, Highly similar to S06147 GTP-binding protein rab1B - rat [*R. norvegicus*] |
| 2752 | 7691 | AI236611 | v, x, bb | isopentenyl-diphosphate delta isomerase | isopentenyl-diphosphate delta isomerase |
| 2764 | 15850 | AI236795 | b, tt | | ESTs, ESTs, Highly similar to HS9B_RAT Heat shock protein HSP 90-beta (HSP 84) [*R. norvegicus*] |
| 2769 | 11404 | AI237002 | v, w, bb | spermidine synthase | spermidine synthase |
| 2777 | 14841 | AI237372 | v | | ESTs, Highly similar to RTC1_MOUSE RNA 3'-terminal phosphate cyclase (RNA-3'-phosphate cyclase) (RNA cyclase) [*M. musculus*] |
| 2785 | 3489 | AI237620 | n | | ESTs, Highly similar to IF36_HUMAN Eukaryotic translation initiation factor 3 subunit 6 (eIF-3 p48) (Mammary tumor-associated protein INT-6) (Viral integration site protein INT-6) [*M. musculus*] |
| 2786 | 18854 | AI237636 | l | | ESTs, Weakly similar to CNE6_MOUSE Copine VI (Neuronal-copine) (N-copine) [*M. musculus*] |
| 2787 | 14837 | AI237638 | k, mm | | EST, Highly similar to VAT1_MOUSE Synaptic vesicle membrane protein VAT-1 homolog [*M. musculus*] |
| 2807 | 17108 | AI639017 | bb | | ESTs, Weakly similar to T17453 ERG-associated protein ESET - mouse [*M. musculus*] |
| 2813 | 18504 | AI639044 | cc | | ESTs, Moderately similar to T4S9_MOUSE TRANSMEMBRANE 4 SUPERFAMILY, MEMBER 8 (TETRASPANIN 5) (TSPAN-5) [*M. musculus*] |
| 2848 | 19152 | AI639387 | c | | ESTs, Highly similar to RT06_MOUSE Mitochondrial 28S ribosomal protein S6 (MRP-S6) [*M. musculus*] |
| 2868 | 23220 | AJ000347 | pp | 3'(2'),5'-bisphosphate nucleotidase | 3'(2')5'-bisphosphate nucleotidase |
| 2870 | 14332 | AJ0001044 | q, ff | tumor-associated calcium signal transducer 1 | tumor-associated calcium signal transducer 1 |
| 2873 | 9866 | AJ005424 | ss | mitogen-activated protein kinase 7 | mitogen-activated protein kinase 7 |
| 2873 | 9867 | AJ005424 | tt | mitogen-activated protein kinase 7 | mitogen-activated protein kinase 7 |
| 2883 | 19053 | D12770 | j, o | solute carrier family 25 (mitochondrial adenine nucleotide translocator) member 4 | solute carrier family 25 (mitochondrial adenine nucleotide translocator) member 4 |
| 2930 | 16986 | H33020 | bb | | ESTs, Highly similar to EF1G_MOUSE Elongation factor 1-gamma (EF-1-gamma) (eEF-1B gamma) [*M. musculus*] |
| 2953 | 23485 | K02816 | ww | pR-ET2 encoded oncodevelopmental protein | pR-ET2 encoded oncodevelopmental protein |
| 2953 | 23486 | K02816 | kk, ww | pR-ET2 encoded oncodevelopmental protein | pR-ET2 encoded oncodevelopmental protein |
| 2976 | 13499 | L26267 | s | nuclear factor kappa B p105 subunit | nuclear factor kappa B p105 subunit |
| 2994 | 19256 | M15562 | xx | | Rat (diabetic BB) MHC class II alpha chain RT1.D alpha (u) |
| 3008 | 11956 | M28255 | ff | cytochrome c oxidase, subunit VIIIa | cytochrome c oxidase, subunit VIIIa |
| 3009 | 17123 | M29295 | nn, tt | small nuclear ribonucleoprotein polypeptides B and B1 | small nuclear ribonucleoprotein polypeptides B and B1 |
| 3013 | 15579 | M33648 | d, k, l, o, ff, oo, ss | | Rat mitochondrial 3-hydroxy-3-methylglutaryl CoA synthase mRNA, complete cds |
| 3013 | 15580 | M33648 | k, l, o, ff | | Rat mitochondrial 3-hydroxy-3-methylglutaryl CoA synthase mRNA, complete cds |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3014 | 16807 | M33936 | k, o, v, ss, uu, xx | | Rat Cyp4a locus, encoding cytochrome P450 (IVA3) mRNA, complete cds |
| 3018 | 17145 | M38566 | b, qq | Serine protease inhibitor | Serine protease inhibitor |
| 3029 | 20836 | M75148 | l, General, qq | kinesin light chain 1 | kinesin light chain 1 |
| 3030 | 1138 | M76740 | cc | Mucin3 | Mucin3 |
| 3035 | 24651 | M83678 | u, y, nn | RAB13 | RAB13 |
| 3041 | 25467 | M93297 | t | ornithine aminotransferase | ornithine aminotransferase |
| 3042 | 3424 | M94557 | o | Single-stranded DNA-binding protein | ESTs, Highly similar to SSB_RAT SINGLE-STRANDED DNA-BINDING PROTEIN, MITOCHONDRIAL PRECURSOR (MT-SSB) (MTSSB) (P16) [*R. norvegicus*] |
| 3080 | 17292 | NM_012584 | General, cc | Hydroxy-delta-5-steroid dehydrogenase, 3 beta- and steroid delta-isomerase | Hydroxy-delta-5-steroid dehydrogenase, 3 beta- and steroid delta-isomerase |
| 3086 | 382 | NM_012599 | a, d, gg, hh | Mannose binding protein A, serum | Mannose binding protein A, serum |
| 3101 | 17147 | NM_012657 | e, n, r, ii | Serine protease inhibitor | Serine protease inhibitor |
| 3101 | 17148 | NM_012657 | r, ii | Serine protease inhibitor | Serine protease inhibitor |
| 3108 | 1514 | NM_012678 | b, t | Tropomyosin 4 | Tropomyosin 4 |
| 3117 | 1602 | NM_012697 | dd, mm | Organic cation transporter | Organic cation transporter |
| 3124 | 18730 | NM_012730 | a, j | Cytochrome P450, subfamily IID2 | Cytochrome P450, subfamily IID2 |
| 3134 | 13731 | NM_012755 | bb | Fyn proto-oncogene | Fyn proto-oncogene |
| 3136 | 17257 | NM_012766 | x, ll, rr, ww | Cyclin D3 | Cyclin D3 |
| 3136 | 17258 | NM_012766 | l, k, nn, ww | Cyclin D3 | Cyclin D3 |
| 3215 | 17174 | NM_013030 | gg, hh | | *R. norvegicus* ASI mRNA for mammalian equivalent of bacterial large ribosomal subunit protein L22 |
| 3227 | 1859 | NM_013063 | p, y, nn | ADP-ribosyltransferase (NAD+; poly (ADP-ribose) polymerase) | ADP-ribosyltransferase (NAD+; poly (ADP-ribose) polymerase) |
| 3228 | 675 | NM_013066 | g | Microtubule-associated protein 2 | Microtubule-associated protein 2 |
| 3229 | 19335 | NM_013067 | x, dd | Ribophorin I | Ribophorin I |
| 3234 | 1529 | NM_013082 | b, e, h, l, General | Ryudocan/syndecan 2 | Ryudocan/syndecan 2 |
| 3241 | 1793 | NM_013105 | jj | Cytochrome P450, subfamily IIIA, polypeptide 3 | Cytochrome P450, subfamily IIIA, polypeptide 3 |
| 3241 | 1794 | NM_013105 | jj | Cytochrome P450, subfamily IIIA, polypeptide 3 | Cytochrome P450, subfamily IIIA, polypeptide 3 |
| 3241 | 1795 | NM_013105 | jj | Cytochrome P450, subfamily IIIA, polypeptide 3 | Cytochrome P450, subfamily IIIA, polypeptide 3 |
| 3241 | 1796 | NM_013105 | v | Cytochrome P450, subfamily IIIA, polypeptide 3 | Cytochrome P450, subfamily IIIA, polypeptide 3 |
| 3241 | 1797 | NM_013105 | j, r, jj | Cytochrome P450, subfamily IIIA, polypeptide 3 | Cytochrome P450, subfamily IIIA, polypeptide 3, *Rattus norvegicus* Sprague Dawley testosterone 6-beta-hydroxylase, cytochrome P450/6-beta-A, (CYP3A2) mRNA. complete cds |
| 3243 | 428 | NM_013112 | x | Apolipoprotein A-II | Apolipoprotein A-II |
| 3244 | 23709 | NM_013113 | l, w, z | ATPase Na+/K+ transporting beta 1 polypeptide | ATPase Na+/K+ transporting beta 1 polypeptide |
| 3244 | 23710 | NM_013113 | ww | ATPase Na+/K+ transporting beta 1 polypeptide | ATPase Na+/K+ transporting beta 1 polypeptide |
| 3245 | 22582 | NM_013120 | b, kk | Glucokinase regulatory protein | Glucokinase regulatory protein |
| 3247 | 16650 | NM_013132 | a | Annexin V | Annexin V |
| 3249 | 20150 | NM_013135 | oo | RAS p21 protein activator | RAS p21 protein activator |
| 3252 | 16982 | NM_013144 | f, r, z, ee, ff, rr | Insulin-like growth factor binding protein 1 | Insulin-like growth factor binding protein 1 |
| 3253 | 46 | NM_013151 | l, vv | Plasminogen activator, tissue | Plasminogen activator, tissue |
| 3257 | 1309 | NM_013159 | e, bb, oo | Insulin degrading enzyme | Insulin degrading enzyme |
| 3262 | 1451 | NM_013168 | tt | Hydroxymethylbilane synthase | Hydroxymethylbilane synthase |
| 3262 | 1452 | NM_013168 | ii | Hydroxymethylbilane synthase | Hydroxymethylbilane synthase |
| 3264 | 24774 | NM_013176 | uu | Transcription factor 12 | Transcription factor 12 |
| 3267 | 1258 | NM_013185 | o | Hemopoietic cell tyrosine kinase | Hemopoietic cell tyrosine kinase |
| 3268 | 1255 | NM_013189 | ff, xx | Guanine nucleotide binding protein, alpha | Guanine nucleotide binding protein, alpha |
| 3269 | 1300 | NM_013190 | t | Phosphofructokinase, liver, B-type | Phosphofructokinase, liver, B-type |
| 3271 | 21396 | NM_013198 | k, jj | Monoamine oxidase B | Monoamine oxidase B |
| 3276 | 20826 | NM_013218 | gg, hh | adenylate kinase 3 | adenylate kinase 3 |
| 3277 | 18313 | NM_013220 | x | cardiac ankyrin repeat protein | cardiac ankyrin repeat protein |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3279 | 1567 | NM_013223 | p, s | hemin-sensitive initiation factor 2a kinase | hemin-sensitive initiation factor 2a kinase |
| 3280 | 815 | NM_013224 | h, l, ll, oo | ribosomal protein S26 | ribosomal protein S26 |
| 3297 | 80 | NM_017021 | cc | Interleukin 9 receptor | Interleukin 9 receptor |
| 3315 | 1523 | NM_017079 | General | CD1D antigen | CD1D antigen |
| 3319 | 1968 | NM_017091 | g | Proprotein convertase subtilisin/kexin type 2 | Proprotein convertase subtilisin/kexin type 2 |
| 3322 | 20653 | NM_017104 | s | Colony stimulating factor 3 (granulocyte) | Colony stimulating factor 3 (granulocyte) |
| 3343 | 2968 | NM_017158 | n | cytochrome P450, 2c39 | cytochrome P450, 2c39 |
| 3343 | 2970 | NM_017158 | f, rr, ss | cytochrome P450, 2c39 | cytochrome P450, 2c39 |
| 3348 | 20702 | NM_017166 | General, dd, oo, pp | Leukemia-associated cytosolic phosphoprotein stathmin | Leukemia-associated cytosolic phosphoprotein stathmin |
| 3366 | 18445 | NM_017220 | y | growth and transformation-dependent protein | growth and transformation-dependent protein |
| 3407 | 18142 | NM_017314 | r | ubiquitin C | ubiquitin C |
| 3409 | 1894 | NM_017320 | ii, nn, pp | cathepsin S | cathepsin S |
| 3410 | 17516 | NM_017321 | o, ii, jj, tt | iron-responsive element-binding protein | iron-responsive element-binding protein |
| 3411 | 24766 | NM_017322 | k | stress activated protein kinase alpha II | stress activated protein kinase alpha II |
| 3411 | 24767 | NM_017322 | u | stress activated protein kinase alpha II | stress activated protein kinase alpha II |
| 3413 | 24247 | NM_017332 | n, rr | fatty acid synthase | fatty acid synthase |
| 3414 | 2000 | NM_017333 | g | endothelin receptor | endothelin receptor |
| 3415 | 25515 | NM_017339 | g | isl-1 = homeobox | isl-1 = homeobox |
| 3417 | 16381 | NM_017343 | l, y, z, General, ee | myosin regulatory light chain | myosin regulatory light chain |
| 3417 | 16382 | NM_017343 | z | myosin regulatory light chain | myosin regulatory light chain |
| 3418 | 520 | NM_017345 | n | neural cell adhesion molecule L1 | neural cell adhesion molecule L1 |
| 3424 | 20778 | NM_019124 | a, ww | rabaptin 5 | rabaptin 5 |
| 3434 | 17304 | NM_019144 | d, p, gg, hh | Acid phosphatase 5, tartrate resistant | Add phosphatase 5, tartrate resistant |
| 3455 | 1386 | NM_019226 | d | dynein, cytoplasmic, heavy chain 1 | dynein, cytoplasmic, heavy chain 1 |
| 3478 | 10016 | NM_019289 | v, x | Actin-related protein complex 1b | Actin-related protein complex 1b |
| 3479 | 23678 | NM_019290 | l, u, General | B-cell translocation gene 3 | B-cell translocation gene 3 |
| 3479 | 23679 | NM_019290 | General, ss | B-cell translocation gene 3 | B-cell translocation gene 3 |
| 3481 | 17507 | NM_019299 | w | clathrin, heavy polypeptide (Hc) | clathrin, heavy polypeptide (Hc) |
| 3484 | 51 | NM_019335 | u | Protein kinase, interferon-inducible double stranded RNA dependent | Protein kinase, interferon-inducible double stranded RNA dependent |
| 3484 | 52 | NM_019335 | u | Protein kinase, interferon-inducible double stranded RNA dependent | Protein kinase, interferon-inducible double stranded RNA dependent |
| 3488 | 4592 | NM_019356 | h | eukaryotic translation initiation factor 2, subunit 1 (alpha) | eukaryotic translation initiation factor 2, subunit 1 (alpha) |
| 3494 | 20057 | NM_019370 | General, nn | alkaline phosphodiesterase | alkaline phosphodiesterase |
| 3496 | 15066 | NM_019373 | cc, rr | apolipoprotein M | apolipoprotein M |
| 3502 | 24066 | NM_019384 | d, kk | CTD-binding SR-like rA1 | CTD-bindin SR-like rA1 |
| 3503 | 16 | NM_019386 | b, l, q, General, dd, kk | tissue-type transglutaminase | tissue-type transglutaminase |
| 3505 | 20716 | NM_019623 | b, l, General, gg, hh, ll, uu | cytochrome P450 4F1 | cytochrome P450 4F1 |
| 3511 | 18702 | NM_020080 | oo | nuclear protein E3-3 orf1 | nuclear protein E3-3 orf1 |
| 3514 | 13485 | NM_020306 | d, bb | a disintegrin and metalloproteinase domain 17 | a disintegrin and metalloproteinase domain 17 |
| 3514 | 13486 | NM_020306 | s | a disintegrin and metalloproteinase domain 17 | a disintegrin and metalloproteinase domain 17 |
| 3517 | 18727 | NM_021577 | g, m | argininosuccinate lyase | argininosuccinate lyase |
| 3520 | 18544 | NM_021592 | e | eHand protein | eHand protein |
| 3525 | 19696 | NM_021699 | l, nn | serine/threonine kinase | serine/threonine kinase |
| 3528 | 19710 | NM_021744 | bb | CD14 antigen | CD14 antigen |
| 3530 | 19824 | NM_021750 | c, General, kk | cysteine sulfinate decarboxylase | cysteine-sulfinate decarboxylase |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3530 | 19825 | NM_021750 | l, General dd, ii, qq, vv | cysteine sulfinate decarboxylase | cysteine-sulfinate decarboxylase |
| 3531 | 20035 | NM_021754 | qq | Nopp140 associated protein | Nopp140 associated protein |
| 3531 | 20036 | NM_021754 | r | Nopp140 associated protein | Nopp140 associated protein |
| 3533 | 17884 | NM_021765 | q | beta prime COP | beta prime COP |
| 3533 | 17885 | NM_021765 | q | beta prime COP | beta prime COP |
| 3536 | 20161 | NM_021836 | oo | jun B proto-oncogene | jun B proto-oncogene |
| 3537 | 18839 | NM_021840 | g | histone 2a | histone 2a |
| 3538 | 20129 | NM_021850 | gg, hh | Bcl-w protein | Bcl-w protein |
| 3542 | 17100 | NM_022179 | d, h, l, ee | Hexokinase 3 | Hexokinase 3 |
| 3542 | 17101 | NM_022179 | b, General, ii, kk, ss | Hexokinase 3 | Hexokinase 3 |
| 3545 | 20194 | NM_022192 | v | putative protein kinase C inhibitor | putative protein kinase C inhibitor |
| 3546 | 20204 | NM_022196 | f | leukemia inhibitory factor | leukemia inhibitory factor |
| 3548 | 20269 | NM_022214 | bb | CXC chemokine LIX | CXC chemokine LIX |
| 3549 | 20299 | NM_022220 | j | L-gulono-gamma-lactone oxidase | L-gulono-gamma-lactone oxidase |
| 3551 | 762 | NM_022245 | t, mm | cytochrome b5 | cytochrome b5 |
| 3552 | 6585 | NM_022266 | y | connective tissue growth factor | connective tissue growth factor |
| 3557 | 17158 | NM_022298 | c, f, vv, xx | alpha-tubulin | alpha-tubulin |
| 3557 | 17160 | NM_022298 | nn | alpha-tubulin | alpha-tubulin |
| 3557 | 17161 | NM_022298 | y, nn, tt | alpha-tubulin | alpha-tubulin |
| 3560 | 23980 | NM_022383 | w | cyclase-associated protein homologue | cyclase-associated protein homologue |
| 3563 | 12082 | NM_022389 | jj | 7-dehydrocholesterol reductase | 7-dehydrocholesterol reductase |
| 3563 | 12083 | NM_022389 | jj | 7-dehydrocholesterol reductase | 7-dehydrocholesterol reductase |
| 3564 | 13479 | NM_022390 | e, y, xx | quinoid dihydropteridine reductase | quinoid dihydropteridine reductase |
| 3564 | 13480 | NM_022390 | r, ss | quinoid dihydropteridine reductase | quinoid dihydropteridine reductase |
| 3566 | 23060 | NM_022394 | u | scaffold attachment factor B | scaffold attachment factor B |
| 3578 | 1610 | NM_022509 | ee, gg, hh | survival motor neuron | survival motor neuron |
| 3578 | 1611 | NM_022509 | h, l | survival motor neuron | survival motor neuron |
| 3580 | 2384 | NM_022513 | b, k, l, qq, uu, vv | dopa/tyrosine sulfotransferase | dopa/tyrosine sulfotransferase |
| 3584 | 4145 | NM_022518 | j, ii | ADP-ribosylation factor 1 | ADP-ribosylation factor 1 |
| 3584 | 4153 | NM_022518 | bb | ADP-ribosylation factor 1 | ADP-ribosylation factor 1 |
| 3586 | 4242 | NM_022521 | xx | ornithine aminotransferase | ornithine aminotransferase |
| 3587 | 4256 | NM_022522 | oo, uu | caspase 2 | caspase 2 |
| 3587 | 4257 | NM_022522 | k, mm | caspase 2 | caspase 2 |
| 3588 | 4412 | NM_022523 | j, x | CD151 antigen | CD151 antigen |
| 3597 | 20803 | NM_022592 | d, q | transketolase | transketolase |
| 3600 | 20944 | NM_022597 | m, ff, ii | cathepsin B | cathepsin B |
| 3601 | 20960 | NM_022598 | a | cellular nucleic acid binding protein | cellular nucleic acid binding protein |
| 3604 | 21115 | NM_022602 | r, z, ss | serine threonine kinase pim3 | serine threonine kinase pim3 |
| 3606 | 21211 | NM_022607 | t, nn | MIPP65 protein | MIPP65 protein |
| 3614 | 20506 | NM_022686 | ii | germinal histone H4 gene | germinal histone H4 gene |
| 3615 | 20509 | NM_022689 | f, cc, dd, ff | synaptosomal-associated protein, 23 kD | synaptosomal-associated protein, 23 kD |
| 3616 | 17586 | NM_022694 | u, ff | p105 coactivator | p105 coactivator |
| 3616 | 17587 | NM_022694 | u, w | p105 coactivator | p105 coactivator |
| 3618 | 17757 | NM_022698 | y | bcl-2 associated death agonist | bcl-2 associated death agonist |
| 3619 | 17808 | NM_022699 | h, ll | ribosomal protein L30 | ribosomal protein L30 |
| 3624 | 24540 | NM_022707 | u | phospholamban | phospholamban |
| 3625 | 53 | NM_022714 | v, jj | corticotropin-releasing factor receptor subtype 2 | corticotropin-releasing factor receptor subtype 2 |
| 3628 | 194 | NM_022861 | s | Munc13-1 | Munc13-1 |
| 3632 | 2006 | NM_022936 | o, xx | cytosolic epoxide hydrolase | cytosolic epoxide hydrolase |
| 3632 | 2007 | NM_022936 | o, s | cytosolic epoxide hydrolase | cytosolic epoxide hydrolase |
| 3632 | 2008 | NM_022936 | o, s, xx | cytosolic epoxide hydrolase | cytosolic epoxide hydrolase |
| 3632 | 2009 | NM_022936 | n, o | cytosolic epoxide hydrolase | cytosolic epoxide hydrolase |
| 3634 | 15696 | NM_022939 | e | syntaxin 12 | syntaxin 12 |
| 3637 | 18100 | NM_022948 | y | tricarboxylate carrier-like protein | tricarboxylate carrier-like protein |
| 3638 | 18107 | NM_022949 | b, l, General, ee | ribosomal protein L14 | ribosomal protein L14 |
| 3639 | 21491 | NM_022951 | tt | putative protein phosphatase 1 nuclear targeting subunit | putative protein phosphatase 1 nuclear targeting subunit |
| 3643 | 1053 | NM_022962 | pp | CL1BA protein | CL1BA protein |
| 3645 | 8266 | NM_023103 | a, j, r, cc | alpha(1)-inhibitor 3, variant I | alpha(1)-inhibitor 3, variant I |
| 3645 | 8267 | NM_023103 | r | alpha(1)-inhibitor 3, variant I | alpha(1)-inhibitor 3, variant I |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3645 | 8268 | NM_023103 | r, mm, xx | alpha(1)-inhibitor 3, variant I | alpha(1)-inhibitor 3, variant I |
| 3645 | 8269 | NM_023103 | r, jj, xx | alpha(1)-inhibitor 3, variant I | alpha(1)-inhibitor 3, variant I |
| 3646 | 23976 | NM_023104 | jj | acetoacetyl-CoA synthetase | acetoacetyl-CoA synthetase |
| 3659 | 17517 | NM_024151 | q, u, dd | ADP-ribosylation factor 4 | ADP-ribosylation factor 4 |
| 3663 | 220 | NM_024161 | c, m | cysteine string protein | cysteine string protein |
| 3671 | 771 | NM_024368 | a, qq | src related tyrosine kinase | src related tyrosine kinase |
| 3672 | 23489 | NM_024375 | xx | prepro bone inducing protein | prepro bone inducing protein |
| 3674 | 768 | NM_024382 | u, rr | leuserpin-2 | leuserpin-2 |
| 3676 | 2733 | NM_024385 | bb, jj | hematopoietically expressed homeobox | hematopoietically expressed homeobox |
| 3678 | 713 | NM_024391 | pp | 17-beta hydroxysteroid dehydrogenase type 2 | 17-beta hydroxysteroid dehydrogenase type 2 |
| 3679 | 25070 | NM_024392 | o, General | peroxisomal multifunctional enzyme type II | peroxisomal multifunctional enzyme type II |
| 3679 | 9929 | NM_024392 | p, w, ss | peroxisomal multifunctional enzyme type II | peroxisomal multifunctional enzyme type II |
| 3679 | 9931 | NM_024392 | o, xx | peroxisomal multifunctional enzyme type II | peroxisomal multifunctional enzyme type II |
| 3682 | 13633 | NM_024403 | w | activating transcription factor ATF-4 | activating transcription factor ATF 4 |
| 3682 | 13634 | NM_024403 | r, w, z, General, ee, rr | activating transcription factor ATF-4 | activating transcription factor ATF-4 |
| 3688 | 17916 | NM_024488 | g, q | CDK5 activator-binding protein C53 | CDK5 activator-binding protein C53 |
| 3690 | 10305 | NM_030835 | ee, ff | ribosome associated membrane protein 4 | ribosome associated membrane protein 4 |
| 3690 | 10306 | NM_030835 | b, q, x, General, dd | ribosome associated membrane protein 4 | ribosome associated membrane protein 4 |
| 3690 | 10308 | NM_030835 | l, q | ribosome associated membrane protein 4 | ribosome associated membrane protein 4 |
| 3692 | 18728 | NM_030846 | b, ww | growth factor receptor bound protein 2 | growth factor receptor bound protein 2 |
| 3692 | 18023 | NM_030846 | k | growth factor receptor bound protein 2 | growth factor receptor bound protein 2 |
| 3693 | 21509 | NM_030847 | f | epithelial membrane protein 3 | epithelial membrane protein 3 |
| 3695 | 1035 | NM_030851 | y | Bradykinin receptor B1 | Bradykinin receptor B1 |
| 3701 | 8815 | NM_030991 | ff | | ESTs, Highly similar to LAS1_MOUSE LIM AND SH3 DOMAIN PROTEIN 1 (LASP-1) (MLN 50) [*M. musculus*] |
| 3701 | 25130 | NM_030991 | k | Synaptosomal-associated protein, 25 kDa | Synaptosomal-associated protein, 25 kDa |
| 3702 | 1991 | NM_030995 | xx | Microtubule-associated protein 1a | Microtubule-associated protein 1a |
| 3704 | 135 | NM_031003 | l, General | 4-aminobutyrate aminotransferase | 4-aminobutyrate aminotransferase |
| 3715 | 24658 | NM_031018 | ff | RATF2 | RATF2 |
| 3717 | 1480 | NM_031021 | g | casein kinase II beta subunit | casein kinase II beta subunit |
| 3718 | 1624 | NM_031023 | q, z, General | di-N-acetylchitobiase | di-N-acetylchitobiase |
| 3723 | 15886 | NM_031035 | k, nn | GTP-binding protein (G-alpha-i2) | GTP-binding protein (G-alpha-i2) |
| 3724 | 21095 | NM_031039 | e | glutamic-pyruvate transaminase (alanine aminotransferase) | glutamic-pyruvate transaminase (alanine aminotransferase) |
| 3726 | 17726 | NM_031043 | jj | glycogenin | glycogenin |
| 3726 | 17727 | NM_031043 | pp, uu | glycogenin | glycogenin |
| 3726 | 25328 | NM_031043 | e, bb | glycogenin | glycogenin |
| 3727 | 1731 | NM_031047 | tt | unction plakoglobin | unction plakoglobin |
| 3731 | 9516 | NM_031053 | g | mismatch repair protein | mismatch repair protein |
| 3737 | 24768 | NM_031073 | nn | neurotrophin-3 (HDNF/NT-3) | neurotrophin-3 (HDNF/NT-3) |
| 3740 | 4683 | NM_031083 | d, f | phosphatidylinositol 4-kinase | phosphatidylinositol 4-kinase |
| 3740 | 4684 | NM_031083 | k | phosphatidylinositol 4-kinase | phosphatidylinositol 4-kinase |
| 3743 | 15201 | NM_031093 | gg, hh | #NAME? | #NAME? |
| 3743 | 15203 | NM_031093 | l, m, s, w, General, tt | #NAME? | #NAME? |
| 3745 | 1515 | NM_031095 | uu | renin-binding protein | renin-binding protein |
| 3745 | 1516 | NM_031095 | x | renin-binding protein | renin-binding protein |
| 3745 | 1517 | NM_031095 | ss | renin-binding protein | renin-binding protein |
| 3746 | 12639 | NM_031099 | l, General, ee, ll | ribosomal protein L5 | ribosomal protein L5 |
| 3753 | 16929 | NM_031108 | h, l, w, z, General, ee, ii, ll | mRNA for ribosomal protein S9 | mRNA for ribosomal protein S9 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3754 | 16847 | NM_031109 | h, xx | ribosomal protein S10 | ribosomal protein S10 |
| 3759 | 1580 | NM_031117 | oo, ww | small nuclear ribonucleoparticle-associated protein (snRNP) mRNA, clone Sm51 | small nuclear ribonucleoparticle-associated protein (snRNP) mRNA, clone Sm51 |
| 3761 | 14970 | NM_031127 | l, p, x, z, General, kk, nn | sulfite oxidase | sulfite oxidase |
| 3763 | 13358 | NM_031135 | xx | TGFB inducible early growth response | TGFB inducible early growth response |
| 3764 | 15052 | NM_031136 | s | thymosin beta-4 | thymosin beta-4 |
| 3767 | 15185 | NM_031140 | s, ii | vimentin | vimentin |
| 3770 | 1291 | NM_031149 | w | for proteasomal ATPase (SUG1) | for proteasomal ATPase (SUG1) |
| 3771 | 1201 | NM_031150 | v | zona pellucida 2 glycoprotein | zona pellucida 2 glycoprotein |
| 3776 | 1963 | NM_031236 | xx | Alpha1,2-fucosyltransferase a | Alpha1,2-fucosyltransferase a |
| 3781 | 1422 | NM_031324 | ss | prolyl endopeptidase | prolyl endopeptidase |
| 3782 | 18597 | NM_031325 | y, uu | UDP-glucose dehydrogeanse | UDP-glucose dehydrogeanse |
| 3784 | 18373 | NM_031331 | ii, ww | proteasome (prosome, macropain) 26S subunit, non-ATPase,4 | proteasome (prosome, macropain) 26S subunit, non-ATPase,4 |
| 3784 | 18375 | NM_031331 | h | proteasome (prosome, macropain) 26S subunit, non-ATPase,4 | proteasome (prosome, macropain) 26S subunit, non-ATPase,4 |
| 3785 | 6671 | NM_031333 | t, General, mm | cadherin 2, type 1, N-cadherin (neuronal) | cadherin 2, type 1, N-cadherin (neuronal) |
| 3785 | 6672 | NM_031333 | g | cadherin 2, type 1, N-cadherin (neuronal) | cadherin 2, type 1, N-cadherin (neuronal) |
| 3785 | 6673 | NM_031333 | j | cadherin 2, type 1, N-cadherin (neuronal) | cadherin 2, type 1, N-cadherin (neuronal) |
| 3788 | 11962 | NM_031337 | rr | sialyltransferase 9 (CMP-NeuAc:lactosylceramide alpha-2,3-sialyltransferase; GM3 synthase) | sialyltransferase 9 (CMP-NeuAc:lactosylceramide alpha-2,3-sialyltransferase; GM3 synthase) |
| 3788 | 11963 | NM_031337 | xx | sialyltransferase 9 (CMP-NeuAc:lactosylceramide alpha-2,3-sialyltransferase; GM3 synthase) | sialyltransferase 9 (CMP-NeuAc:lactosylceramide alpha-2,3-sialyltransferase; GM3 synthase) |
| 3790 | 4346 | NM_031343 | k | solute carrier family 6 (neurotransmitter transporter,noradrenalin), member 2 | solute carrier family 6 (neurotransmitter transporter,noradrenalin), member 2 |
| 3791 | 5821 | NM_031351 | ll | attractin | attractin |
| 3792 | 18538 | NM_031353 | t, y, mm | voltage-dependent anion channel 1 | voltage-dependent anion channel 1 |
| 3792 | 18539 | NM_031353 | t, mm | voltage-dependent anion channel 1 | voltage-dependent anion channel 1 |
| 3803 | 3292 | NM_031531 | dd | Serine protease inhibitor | Serine protease inhibitor |
| 3804 | 14633 | NM_031533 | b, l, s, General, vv | Androsterone UDP-glucuronosyltransferase | Androsterone UDP-glucuronosyltransferase |
| 3805 | 444 | NM_031535 | t, mm | B cell lymphoma 2 like | B cell lymphoma 2 like |
| 3805 | 445 | NM_031535 | t, mm | B cell lymphoma 2 like | B cell lymphoma 2 like, ESTs, Moderately similar to ilvB (bacterial acetolactate synthase)-like; acetolactate synthase homolog [Homo sapiens] [H. sapiens] |
| 3805 | 446 | NM_031535 | t, w, ii, ll, mm | B cell lymphoma 2 like | B cell lymphoma 2 like, ESTs, Moderately similar to ilvB (bacterial acetolactate synthase)-like; acetolactate synthase homolog [Homo sapiens] [H. sapiens] |
| 3817 | 15024 | NM_031572 | General, ll, qq | Cytochrom P450 15-beta gene | Cytochrom P450 15-beta gene |
| 3817 | 15025 | NM_031572 | bb, qq | Cytochrom P450 15-beta gene | Cytochrom P450 15-beta gene |
| 3823 | 18005 | NM_031588 | j | neuregulin 1 | neuregulin 1 |
| 3823 | 18011 | NM_031588 | dd | neuregulin 1 | neuregulin 1 |
| 3846 | 20766 | NM_031643 | nn | mitogen-activated protein kinase kinase 1 | mitogen-activated protein kinase kinase 1 |
| 3846 | 20767 | NM_031643 | s | mitogen-activated protein kinase kinase 1 | mitogen-activated protein kinase kinase 1 |
| 3877 | 13543 | NM_031749 | q, oo | glucosidase 1 | glucosidase 1 |
| 3877 | 13544 | NM_031749 | c | glucosidase 1 | glucosidase 1 |
| 3877 | 13545 | NM_031749 | e | glucosidase 1 | glucosidase 1 |
| 3877 | 25209 | NM_031749 | v, w, bb, rr | glucosidase 1 | glucosidase 1 |
| 3878 | 16624 | NM_031751 | k | Shank1 | Shank1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3879 | 20724 | NM_031753 | w | activated leukocyte cell adhesion molecule | activated leukocyte cell adhesion molecule |
| 3882 | 16003 | NM_031757 | j | matrix metalloproteinase 24 (membrane-inserted) | matrix metalloproteinase 24 (membrane-inserted) |
| 3884 | 4314 | NM_031760 | b, m, dd, uu, vv | ATP-binding cassette, sub-family B (MDR/TAP), member 11 | ATP-binding cassette, sub-family B (MDR/TAP), member 11 |
| 3888 | 14184 | NM_031776 | j | guanine deaminase | guanine deaminase |
| 3888 | 14185 | NM_031776 | j, r, y | guanine deaminase | guanine deaminase |
| 3889 | 1184 | NM_031778 | cc | Shab-related delayed-rectifier K+ channel (Kv9.3) | Shab-related delayed rectifier K+ channel (Kv9.3) |
| 3891 | 4325 | NM_031784 | u, v, tt | potassium channel regulatory protein KChAP | potassium channel regulatory protein KChAP |
| 3897 | 1000 | NM_031809 | j | cyclic nucleotide-gated channel beta subunit 1 | cyclic nucleotide-gated channel beta subunit 1 |
| 3898 | 16155 | NM_031810 | bb, ff | defensin beta 1 | defensin beta 1 |
| 3899 | 16039 | NM_031811 | b, c, ee, xx | transaldolase 1 | transaldolase 1 |
| 3907 | 10176 | NM_031837 | w | E-septin | E-septin |
| 3911 | 1302 | NM_031841 | pp | stearoyl-Coenzyme A desaturase 1, stearoyl-Coenzyme A desaturase 2 | stearoyl-Coenzyme A desaturase 1 |
| 3916 | 1475 | NM_031971 | ee | Heat shock protein 70-1 | ESTs, Highly similar to S10A_RAT S-100 protein, alpha chain [*R. norvegicus*], Heat shock protein 70-1 |
| 3919 | 16257 | NM_031975 | l, s, General, ll, rr | parathymosin | parathymosin |
| 3922 | 17805 | NM_031980 | b, General, gg, hh, vv | UDP-glucuronosyltransferase | UDP-glucuronosyltransferase |
| 3922 | 17806 | NM_031980 | General, ii, ll | UDP-glucuronosyltransferase | UDP-glucuronosyltransferase |
| 3923 | 15265 | NM_031981 | p, w, ff | p47 protein | p47 protein |
| 3925 | 18898 | NM_031985 | pp | S6 kinase | S6 kinase |
| 3929 | 964 | NM_032062 | v | huntingtin-associated protein interacting protein (duo) | huntingtin-associated protein interacting protein (duo) |
| 3939 | 19148 | NM_033096 | oo | Protein phosphatase type 1B (formely 2C), Mg-dependent, beta isoform | Protein phosphatase type 1B (formely 2C), Mg-dependent, beta isoform |
| 3941 | 4723 | NM_033235 | j, ll, qq | Malate dehydrogenase-like enzyme | Malate dehydrogenase-like enzyme |
| 3941 | 4724 | NM_033235 | j | Malate dehydrogenase-like enzyme | Malate dehydrogenase-like enzyme |
| 3942 | 2577 | NM_033236 | u, bb | Proteasome (prosome, macropain) 26S subunit, ATPase | Proteasome (prosome, macropain) 26S subunit, ATPase |
| 3949 | 24484 | NM_052806 | k | Acetylcholine receptor beta 4 | Acetylcholine receptor beta 4 |
| 3961 | 23211 | NM_053334 | f, nn | calcium modulating ligand | calcium modulating ligand |
| 3963 | 15790 | NM_053341 | u | regulator of G-protein signaling 19 | regulator of G-protein signaling 19 |
| 3966 | 2548 | NM_053359 | rr | ATX1 (antioxidant protein 1) homolog 1 (yeast) | ATX1 (antioxidant protein 1) homolog 1 (yeast) |
| 3967 | 19512 | NM_053365 | xx | adipocyte lipid-binding protein | adipocyte lipid-binding protein |
| 3969 | 12223 | NM_053370 | nn, qq | translocase of inner mitochondrial membrane 8 (yeast) homolog A | translocase of inner mitochondrial membrane 8 (yeast) homolog A |
| 3971 | 13492 | NM_053400 | ss | transducin like enhancer of split 3 homolog of *Drosophila* | transducin-like enhancer of split 3, homolog of *Drosophila* |
| 3972 | 16017 | NM_053401 | a | brain expressed X-linked 3 | brain expressed X-linked 3 |
| 3972 | 16018 | NM_053401 | a, j | brain expressed X-linked 3 | brain expressed X-linked 3 |
| 3973 | 6773 | NM_053410 | rr | acyl-CoA:dihydroxyacetonephosphate acyltransferase | acyl-CoA:dihydroxyacetonephosphate acyltransferase |
| 3974 | 13903 | NM_053412 | General | interleukin enhancer binding factor 3 | interleukin enhancer binding factor 3 |
| 3976 | 6186 | NM_053430 | ii | Flap structure-specific endonuclease 1 | Flap structure-specific endonuclease 1 |
| 3977 | 2242 | NM_053433 | l | flavin-containing monooxygenase 3 | flavin-containing monooxygenase 3 |
| 3981 | 23274 | NM_053467 | b, j, q, ee | integral membrane protein Tmp21-I (p23) | integral membrane protein Tmp21-I (p23) |
| 3981 | 23276 | NM_053467 | n | integral membrane protein Tmp21-I (p23) | integral membrane protein Tmp21-I (p23) |
| 3984 | 3860 | NM_053477 | g, o, ff, ii | malonyl-CoA decarboxylase | malonyl-CoA decarboxylase |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3985 | 4290 | NM_053487 | o, y, xx | peroxisomal membrane protein Pmp26p (Peroxin-11) | peroxisomal membrane protein Pmp26p (Peroxin-11) |
| 3986 | 23558 | NM_053507 | General | expressed in non-metastatic cells 3, protein (nucleoside diphosphate kinase) | expressed in non-metastatic cells 3, protein (nucleoside diphosphate kinase) |
| 3987 | 16133 | NM_053516 | dd, jj | unknown Glu-Pro dipeptide. repeat protein | unknown Glu-Pro dipeptide repeat protein |
| 3988 | 19199 | NM_053522 | u | ras-like protein | ras-like protein |
| 3988 | 19200 | NM_053522 | k, l, s, cc | ras-like protein | ras-like protein |
| 3988 | 19205 | NM_053522 | cc, pp | ras-like protein | ras-like protein |
| 3988 | 19206 | NM_053522 | a, cc | ras-like protein | ras-like protein |
| 3989 | 18826 | NM_053523 | x, ff, nn, ss | homocysteine-inducible, endoplasmic reticulum stress-inducible, ubiquitin-like domain member 1 | homocysteine-inducible, endoplasmic reticulum stress-inducible, ubiquitin-like domain member 1 |
| 3992 | 31 | NM_053537 | j | solute carrier family 22 (organic anion transporter), member 7 | solute carrier family 22 (organic anion transporter), member 7 |
| 3992 | 32 | NM_053537 | h, k, l, uu | solute carrier family 22 (organic anion transporter), member 7 | solute carrier family 22 (organic anion transporter), member 7 |
| 3993 | 1058 | NM_053539 | d, o, q, v, jj, pp | isopentenyl-diphosphate delta isomerase | isopentenyl-diphosphate delta isomerase |
| 3994 | 12496 | NM_053541 | kk | low density lipoprotein receptor-related protein 3 | low density lipoprotein receptor-related protein 3 |
| 3995 | 15829 | NM_053551 | y, nn, xx | pyruvate dehydrogenase kinase, isoenzyme 4 | pyruvate dehydrogenase kinase, isoenzyme 4 |
| 3996 | 1198 | NM_053554 | t, mm | phosphatidylinositol binding clathrin assembly protein | phosphatidylinositol binding clathrin assembly protein |
| 3997 | 11843 | NM_053555 | General | vesicle-associated membrane protein 5 | vesicle-associated membrane protein 5 |
| 3997 | 11844 | NM_053555 | v | vesicle-associated membrane protein 5 | vesicle-associated membrane protein 5 |
| 3999 | 4327 | NM_053563 | w, tt | nuclear RNA helicase DECD variant of DEAD box family | nuclear RNA helicase, DECD variant of DEAD box family |
| 4000 | 21940 | NM_053568 | General | phosphate cytidylyltransferase 2, ethanolamine | phosphate cytidylyltransferase 2, ethanolamine |
| 4000 | 21941 | NM_053568 | ff | phosphate cytidylyltransferase 2, ethanolamine | phosphate cytidylyltransferase 2, ethanolamine |
| 4003 | 22617 | NM_053578 | d | vacuolar proton-ATPase subunit M9.2 | vacuolar proton-ATPase subunit M9.2 |
| 4005 | 21423 | NM_053586 | r | cytochrome c oxidase subunit Vb | cytochrome c oxidase subunit Vb |
| 4005 | 21424 | NM_053586 | e, General | cytochrome c oxidase subunit Vb | cytochrome c oxidase subunit Vb |
| 4008 | 20842 | NM_053590 | mm | proteasome (prosome, macropain) subunit, beta type 1 | proteasome (prosome, macropain) subunit, beta type 1 |
| 4009 | 20896 | NM_053592 | w, x, bb | Deoxyuridinetriphosphatase (dUTPase) | Deoxyuridinetriphosphatase (dUTPase) |
| 4011 | 21709 | NM_053596 | kk, ss | Endothelin-converting enzyme 1 | Endothelin-converting enzyme 1 |
| 4012 | 11830 | NM_053598 | General | diphosphoinositol polyphosphate phosphohydolase type II | diphosphoinositol polyphosphate phosphohydolase type II |
| 4012 | 18795 | NM_053598 | bb | diphosphoinositol polyphosphate phosphohydolase type II | diphosphoinositol polyphosphate phosphohydolase type II |
| 4012 | 23192 | NM_053598 | a, pp | diphosphoinositol polyphosphate phosphohydolase type II | diphosphoinositol polyphosphate phosphohydolase type II |
| 4013 | 1390 | NM_053599 | c, p, v | ephrin A1 | ephrin A1 |
| 4024 | 857 | NM_053633 | tt | early growth response 2 | early growth response 2 |
| 4027 | 21637 | NM_053653 | kk | vascular endothelial growth factor C | vascular endothelial growth factor C |
| 4028 | 7228 | NM_053654 | jj | platelet-activating factor acetylhydrolase, isoform 1b, alpha1 subunit | platelet-activating factor acetylhydrolase, isoform 1b, alpha1 subunit |
| 4030 | 1318 | NM_053656 | g | purinergic receptor P2X, ligand-gated ion channel, 2 | purinergic receptor P2X, ligand-gated ion channel, 2 |
| 4031 | 3454 | NM_053662 | ii, tt | cyclin L | cyclin L |
| 4031 | 3455 | NM_053662 | w, tt | cyclin L | cyclin L |
| 4033 | 24204 | NM_053670 | b, General, uu | calcitonin gene-related peptide-receptor component protein | calcitonin gene-related peptide-receptor component protein |
| 4034 | 6784 | NM_053671 | v | TATA element modulatory factor 1 | TATA element modulatory factor 1 |
| 4035 | 1957 | NM_053674 | ii | phytanoyl-CoA hydroxylase (Refsum disease) | phytanoyl-CoA hydroxylase (Refsum disease) |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4036 | 16122 | NM_053698 | mm | Cbp/p300 interacting transactivator with Glu/Asp rich carboxy terminal domain 2 | Cbp/p300-interacting transactivator, with Glu/Asp-rich carboxy-terminal domain, 2 |
| 4036 | 16123 | NM_053698 | ee | Cbp/p300 interacting transactivator, with Glu/Asp-rich carboxy-terminal domain, 2 | Cbp/p300-interacting transactivator, with Glu/Asp-rich carboxy-terminal domain, 2 |
| 4037 | 13622 | NM_053713 | l | Kruppel-like factor 4 (gut) | Kruppel-like factor 4 (gut) |
| 4037 | 22411 | NM_053713 | f, qq | Kruppel-like factor 4 (gut) | Kruppel-like factor 4 (gut) |
| 4037 | 25379 | NM_053713 | qq | Kruppel-like factor 4 (gut) | Kruppel-like factor 4 (gut) |
| 4040 | 4324 | NM_053744 | cc | delta-like homolog (*Drosophila*) | delta-like homolog (*Drosophila*) |
| 4048 | 3828 | NM_053785 | b, ss | transmembrane 4 superfamily member 4 | transmembrane 4 superfamily member 4 |
| 4051 | 6004 | NM_053796 | rr | junctional adhesion molecule 1 | junctional adhesion molecule 1 |
| 4051 | 6005 | NM_053796 | a, q, s | junctional adhesion molecule 1 | junctional adhesion molecule 1 |
| 4053 | 25594 | NM_053799 | m | aspartyl-tRNA synthetase | aspartyl-tRNA synthetase |
| 4054 | 15615 | NM_053800 | u | thioredoxin | thioredoxin |
| 4056 | 15800 | NM_053810 | w, cc | synaptosomal-associated protein, 29 kD | synaptosomal-associated protein, 29 kD |
| 4062 | 20270 | NM_053827 | bb, mm | procollagen-lysine, 2-oxoglutarate 5-dioxygenase (lysine hydroxylase, Ehlers-Danlos syndrome type VI) | procollagen-lysine, 2-oxoglutarate 5-dioxygenase (lysine hydroxylase, Ehlers-Danlos syndrome type VI) |
| 4063 | 17154 | NM_053835 | d | clathrin, light polypeptide (Lcb) | clathrin, light polypeptide (Lcb) |
| 4064 | 16590 | NM_053838 | v | natriuretic peptide receptor 2 | natriuretic peptide receptor 2 |
| 4065 | 17299 | NM_053842 | ww | mitogen activated protein kinase 1 | mitogen activated protein kinase 1 |
| 4067 | 1508 | NM_053845 | e, uu, vv | ureidopropionase, beta | ureidopropionase, beta |
| 4068 | 19018 | NM_053849 | y, xx | protein disulfide isomerase related protein (calcium-binding protein, intestinal-related) | protein disulfide isomerase related protein (calcium-binding protein, intestinal-related) |
| 4069 | 24705 | NM_053850 | ww | biliverdin reductase A | biliverdin reductase A |
| 4079 | 1337 | NM_053895 | p, tt | FGF receptor activating protein 1 | FGF receptor activating protein 1 |
| 4083 | 15706 | NM_053921 | u | peroxisomal biogenesis factor 12 | peroxisomal biogenesis factor 12 |
| 4086 | 1288 | NM_053949 | l, s | potassium voltage-gated channel, subfamily H (eag-related), member 2 | potassium voltage-gated channel, subfamily H (eag-related), member 2 |
| 4087 | 1029 | NM_053953 | mm | interleukin 1 receptor, type II | interleukin 1 receptor, type II |
| 4088 | 15822 | NM_053957 | General | amyloid beta (A4) precursor protein-binding, family B, member 3 | amyloid beta (A4) precursor protein-binding, family B, member 3 |
| 4089 | 6538 | NM_053959 | l | myc box dependent interacting protein 1 | myc box dependent interacting protein 1 |
| 4089 | 6539 | NM_053959 | ss, uu | myc box dependent interacting protein 1 | myc box dependent interacting protein 1 |
| 4090 | 16552 | NM_053961 | General | endoplasmic retuclum protein 29 | endoplasmic retuclum protein 29 |
| 4090 | 16554 | NM_053961 | f | endoplasmic retuclum protein 29 | endoplasmic retuclum protein 29 |
| 4092 | 15135 | NM_053971 | w | ribosomal protein L6 | ribosomal protein L6 |
| 4092 | 15136 | NM_053971 | h | ribosomal protein L6 | ribosomal protein L6 |
| 4093 | 1764 | NM_053974 | ff, pp | eukaryotic translation initiation factor 4E | eukaryotic translation initiation factor 4E |
| 4096 | 1292 | NM_053980 | m | ADP-ribosylation factor related protein 1 | ADP-ribosylation factor related protein 1 |
| 4098 | 15642 | NM_053985 | d, r, kk, rr | H3 histone, family 3B | H3 histone, family 3B |
| 4098 | 15645 | NM_053985 | n, rr | H3 histone, family 3B | H3 histone, family 3B |
| 4099 | 18025 | NM_053989 | vv | progestin induced protein | progestin induced protein |
| 4100 | 16809 | NM_053990 | l, oo | protein tyrosine phosphatase, non-receptor type 2 | protein tyrosine phosphatase, non-receptor type 2 |
| 4102 | 24430 | NM_053996 | w | proline transporter | proline transporter |
| 4103 | 16965 | NM_053999 | v | protein phosphatase 2 (formerly 2A), regulatory subunit B (PR 52), alpha isoform | protein phosphatase 2 (formerly 2A), regulatory subunit B (PR 52), alpha isoform |
| 4104 | 21066 | NM_054001 | c, v, ii, rr | CD36 antigen (collagen type I receptor, thrombospondin receptor)-like 2 | CD36 antigen (collagen type I receptor, thrombospondin receptor)-like 2 |
| 4105 | 16566 | NM_054004 | u | TBP-interacting protein 120A | TBP-interacting protein 120A |
| 4106 | 17431 | NM_054006 | rr | unr protein | unr protein |
| 4114 | 15391 | NM_057114 | l | peroxiredoxin 1 | peroxiredoxin 1 |
| 4115 | 20254 | NM_057116 | ii | protein phosphatase 2 (formerly 2A), regulatory subunit B (PR 52), gamma isoform | protein phosphatase 2 (formerly 2A), regulatory subunit B (PR 52), gamma isoform |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4118 | 15151 | NM_057131 | ss | phosphoribosyl pyrophosphate synthetase-associated protein 2 | phosphoribosyl pyrophosphate synthetase-associated protein 2 |
| 4120 | 8592 | NM_057137 | q, xx | phenylalkylamine Ca2+ antagonist (emopamil) binding protein | phenylalkylamine Ca2+ antagonist (emopamil) binding protein |
| 4124 | 358 | NM_057146 | u, vv | complement component 9 | complement component 9 |
| 4125 | 706 | NM_057147 | ll | sec22 homolog | sec22 homolog |
| 4131 | 23129 | NM_078622 | t, ff | phosphate cytidylyltransferase 1, choline, alpha isoform | phosphate cytidylyltransferase 1, choline, alpha isoform |
| 4135 | 23550 | NM_080698 | f | fibromodulin | fibromodulin |
| 4140 | 23033 | NM_080888 | tt | BCL2/adenovirus E1B 19 kDa-interacting protein 3-like | BCL2/adenovirus E1B 19 kDa-interacting protein 3-like |
| 4141 | 23477 | NM_080891 | w | Fas death domain-associated protein | Fas death domain-associated protein |
| 4142 | 6143 | NM_080892 | e | selenium binding protein 2 | selenium binding protein 2 |
| 4146 | 4739 | NM_130400 | ff | Dihydrofolate reductase 1 (active) | Dihydrofolate reductase 1 (active) |
| 4147 | 11421 | NM_130405 | w, tt | src associated in mitosis 68 kDa | src associated in mitosis, 68 kDa |
| 4150 | 3579 | NM_130409 | uu | complement component factor h | complement component factor h |
| 4151 | 3458 | NM_130412 | ii | stromal cell derived factor 4 | stromal cell derived factor 4 |
| 4152 | 6909 | NM_130413 | qq | src family associated phosphoprotein 2 | src family associated phosphoprotein 2 |
| 4155 | 18293 | NM_130433 | o, ii, ss, xx | acetyl-Coenzyme A acyltransferase 2 (mitochondrial 3-oxoacyl-Coenzyme A thiolase) | acetyl-Coenzyme A acyltransferase 2 (mitochondrial 3-oxoacyl-Coenzyme A thiolase) |
| 4157 | 3880 | NM_130749 | bb | MAP/microtubule affinity-regulating kinase 3 | MAP/microtubule affinity-regulating kinase 3 |
| 4158 | 18846 | NM_130755 | b, dd | citrate synthase | citrate synthase |
| 4161 | 16767 | NM_130826 | o | hydroxyacyl-Coenzyme A dehydrogenase/3-ketoacyl-Coenzyme A hiolase/enoyl-Coenzyme A hydratase (trifunctional protein), alpha subunit | hydroxyacyl-Coenzyme A dehydrogenase/3-ketoacyl-Coenzyme A hiolase/enoyl-Coenzyme A hydratase (trifunctional protein), alpha subunit |
| 4161 | 16768 | NM_130826 | o, ss | hydroxyacyl-Coenzyme A dehydrogenase/3-ketoacyl-Coenzyme A hiolase/enoyl-Coenzyme A hydratase (trifunctional protein), alpha subunit | hydroxyacyl-Coenzyme A dehydrogenase/3-ketoacyl-Coenzyme A hiolase/enoyl-Coenzyme A hydratase (trifunctional protein), alpha subunit |
| 4169 | 25405 | NM_133307 | s, t, mm | protein kinase C, delta | protein kinase C, delta |
| 4178 | 17634 | NM_133418 | q, z, General, uu | solute carrier family 25 (mitochondrial carrier; dicarboxylate transporter), member 10 | solute carrier family 25 (mitochondrial carrier; dicarboxylate transporter), member 10 |
| 4178 | 17635 | NM_133418 | l, x | solute carrier family 25 (mitochondrial carrier; dicarboxylate transporter), member 10 | solute carrier family 25 (mitochondrial carrier; dicarboxylate transporter), member 10 |
| 4178 | 17636 | NM_133418 | pp | solute carrier family 25 (mitochondrial carrier; dicarboxylate transporter), member 10 | solute carrier family 25 (mitochondrial carrier; dicarboxylate transporter), member 10 |
| 4179 | 19326 | NM_133419 | q, ss | dyskeratosis congenita 1, dyskerin | dyskeratosis congenita 1, dyskerin |
| 4192 | 25821 | NM_133570 | cc | gastrin-releasing peptide | gastrin-releasing peptide |
| 4198 | 1271 | NM_133593 | e | adaptor-related protein complex AP-3, mu 1 subunit | adaptor-related protein complex AP-3, mu 1 subunit |
| 4199 | 1546 | NM_133595 | a, s, uu, vv | GTP cyclohydrolase I feedback regulatory protein | GTP cyclohydrolase I feedback regulatory protein |
| 4200 | 17758 | NM_133606 | k, o, v, xx | enoyl-Coenzyme A, hydratase/3-hydroxyacyl Coenzyme A dehydrogenase | enoyl-Coenzyme A, hydratase/3-hydroxyacyl Coenzyme A dehydrogenase |
| 4203 | 699 | NM_133617 | b, q, General | serine (or cysteine) proteinase inhibitor, clade A (alpha 1 antiproteinase antitrypsin), member 10 | serine (or cysteine) proteinase inhibitor, clade A (alpha-1 antiproteinase, antitrypsin), member 10 |
| 4204 | 1728 | NM_133618 | b, m, o, cc | hydroxyacyl-Coenzyme A dehydrogenase/3-ketoacyl-Coenzyme A thiolase/enoyl-Coenzyme A hydratase (trifunctional protein), beta subunit | hydroxyacyl-Coenzyme A dehydrogenase/3-ketoacyl-Coenzyme A thiolase/enoyl-Coenzyme A hydratase (trifunctional protein), beta subunit |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4207 | 1463 | NM_134334 | e, jj | cathepsin D | cathepsin D |
| 4208 | 16456 | NM_134346 | w | RAP1B, member of RAS oncogene family | RAP1B, member of RAS oncogene family |
| 4208 | 16457 | NM_134346 | u | RAP1B, member of RAS oncogene family | RAP1B, member of RAS oncogene family |
| 4209 | 517 | NM_134350 | ee | Myxovirus (influenza) resistance, homolog of murine Mx (also interferon-inducible protein IFI78), myxovirus (influenza virus) resistance 3 | myxovirus (influenza virus) resistance 3 |
| 4210 | 606 | NM_134352 | f, kk, tt | Plasminogen activator, urokinase receptor | Plasminogen activator, urokinase receptor |
| 4211 | 14876 | NM_134361 | h | small inducible cytokine subfamily C, member 1 (lymphotactin) | small inducible cytokine subfamily C, member 1 (lymphotactin) |
| 4214 | 1530 | NM_134397 | h, vv | LL5 protein | LL5 protein |
| 4216 | 1557 | NM_134403 | qq, ss, vv | Cca3 protein | Cca3 protein |
| 4218 | 2641 | NM_134408 | w, General | calcium-independent alpha-latrotoxin receptor homolog 2 | calcium-independent alpha-latrotoxin receptor homolog 2 |
| 4223 | 2801 | NM_134449 | jj, oo | PKC-delta binding protein | PKC-delta binding protein |
| 4223 | 2802 | NM_134449 | c | PKC-delta binding protein | PKC-delta binding protein |
| 4227 | 5208 | NM_138504 | w, rr | pregnancy-induced growth inhibitor | pregnancy-induced growth inhibitor |
| 4230 | 534 | NM_138512 | b, u | cytochrome P450 2c22 | cytochrome P450 2c22 |
| 4231 | 15054 | NM_138515 | o | cytochrome P450 2D18 | cytochrome P450 2D18 |
| 4232 | 24672 | NM_138517 | jj | | Rat natural killer (NK) cell protease 1 (RNKP-1) mRNA, complete cds |
| 4243 | 23166 | NM_138839 | m, rr | Vacuole Membrane Protein 1 | Vacuole Membrane Protein 1 |
| 4244 | 1896 | NM_138840 | g | trans-golgi network protein 1 | trans-golgi network protein 1 |
| 4244 | 1899 | NM_138840 | w | trans-golgi network protein 1 | trans-golgi network protein 1 |
| 4249 | 17530 | NM_138877 | s | Diaphorase (NADH) (cytochrome b-5 reductase) | Diaphorase (NADH) (cytochrome b-5 reductase) |
| 4249 | 17532 | NM_138877 | l, z, General, nn | Diaphorase (NADH) (cytochrome b-5 reductase) | Diaphorase (NADH) (cytochrome b-5 reductase) |
| 4249 | 17533 | NM_138877 | General, gg, hh, ll | Diaphorase (NADH) (cytochrome b-5 reductase) | Diaphorase (NADH) (cytochrome b-5 reductase) |
| 4249 | 25039 | NM_138877 | General, ss | Diaphorase (NADH) (cytochrome b-5 reductase) | Diaphorase (NADH) (cytochrome b-5 reductase) |
| 4251 | 4593 | NM_138881 | a | Best5 rotein | Best5 protein |
| 4251 | 4594 | NM_138881 | a, qq | Best5 protein | Best5 protein |
| 4251 | 4595 | NM_138881 | k | Best5 protein | Best5 protein |
| 4252 | 7395 | NM_138883 | p, ff | ATP synthase H+ transporting mitochondrial F1 complex, O subunit (oligomycin sensitivity conferring protein) | ATP synthase, H+ transporting, mitochondrial F1 complex, O subunit (oligomycin sensitivity conferring protein) |
| 4253 | 14964 | NM_138884 | s, uu | aldo-keto reductase family 1, member D1 (delta 4-3-ketosteroid-5-beta-reductase) | aldo-keto reductase family 1, member D1 (delta 4-3-ketosteroid-5-beta-reductase) |
| 4253 | 14965 | NM_138884 | m | aldo-keto reductase family 1, member D1 (delta 4-3-ketosteroid-5-beta-reductase) | aldo-keto reductase family 1, member D1 (delta 4-3-ketosteroid-5-beta-reductase) |
| 4257 | 18867 | NM_138900 | b, h, General, dd, rr | complement component 1, s subcomponent | complement component 1, s subcomponent |
| 4262 | 17185 | NM_138919 | dd | unc-50 related protein (UNCL) | unc-50 related protein (UNCL) |
| 4263 | 287 | NM_139042 | xx | guanylyl cyclase with kinase-like domain, soluble | guanylyl cyclase with kinase-like domain, soluble |
| 4265 | 1674 | NM_139086 | e | syncollin | syncollin |
| 4267 | 809 | NM_139089 | ee | small inducible cytokine B subfamily (Cys-X-Cys), member 10 | small inducible cytokine B subfamily (Cys-X-Cys), member 10 |
| 4268 | 737 | NM_139093 | e, tt | CTD-binding SR-like protein rA9 | CTD-binding SR-like protein rA9 |
| 4274 | 17684 | NM_139102 | d, h, uu | dimethylglycine dehydrogenase precursor | dimethylglycine dehydrogenase precursor |
| 4275 | 18108 | NM_139105 | l, w, General, uu, vv | ribonuclease/angiogenin inhibitor | ribonuclease/angiogenin inhibitor |
| 4276 | 18450 | NM_139106 | r, ss | ATP synthase, H+ transporting, mitochondrial F1 complex, delta subunit | ATP synthase, H+ transporting, mitochondrial F1 complex, delta subunit |
| 4279 | 1301 | NM_139192 | n | stearoyl-Coenzyme A desaturase 1 | stearoyl-Coenzyme A desaturase 1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4286 | 8717 | NM_139333 | gg, hh | neuronal differentiation-related gene | neuronal differentiation-related gene |
| 4289 | 23681 | NM_144746 | General, rr | | *Rattus norvegicus* protein phosphatase 2A B regulatory subunit delta isoform mRNA, complete cds |
| 4304 | 1798 | NM_145779 | a, d, m, uu, vv | | *R. norvegicus* alpha-1-macroglobulin mRNA, complete cds |
| 4308 | 20740 | NM_145878 | bb, pp | | *Rattus norvegicus* Sprague-Dawley lipid-binding protein mRNA, complete cds |
| 4313 | 16963 | NM_147214 | r, ee | Caldesmon 1, protein phosphatase 2 (formerly 2A), regulatory subunit B (PR 52), alpha isoform | Caldesmon 1, protein phosphatase 2 (formerly 2A), regulatory subunit B (PR 52), alpha isoform |
| 4315 | 10544 | NM_152935 | m | | *Rattus norvegicus* outer mitochondrial membrane receptor rTOM20 mRNA, complete cds |
| 4315 | 10545 | NM_152935 | cc | | *Rattus norvegicus* outer mitochondrial membrane receptor rTOM20 mRNA, complete cds |
| 4316 | 12700 | NM_152936 | w | | Rat pancreatic secretory trypsin inhibitor type II (PSTI-II) mRNA, complete cds |
| 4320 | 1130 | NM_153313 | a, cc | | Rat cytochrome P450CMF1b mRNA, complete cds |
| 4321 | 14632 | NM_153314 | f, uu | Androsterone UDP-glucuronosyltransferase | Androsterone UDP-glucuronosyltransferase |
| 4321 | 14346 | NM_153314 | b, l, j, General, qq, vv, ww | | Rat UDP-glucuronosyltransferase mRNA, complete cds |
| 4321 | 14347 | NM_153314 | b, General, vv | | Rat UDP-glucuronosyltransferase mRNA, complete cds |
| 4322 | 7789 | NM_153630 | d | | *Rattus norvegicus* putative four repeat ion channel mRNA, complete cds |
| 4343 | 21981 | S75019 | ss, vv | | ESTs, Highly similar to B54676 antiquitin - rat (fragment) [*R. norvegicus*] |
| 4347 | 24469 | S77858 | m, rr | | ESTs, Highly similar to MLES_RAT Myosin light chain alkali, smooth-muscle isoform (MLC3SM) [*R. norvegicus*] |
| 4365 | 17999 | U19485 | a, g, x, bb, rr | spp-24 precursor | spp-24 precursor |
| 4365 | 18000 | U19485 | g, x, cc, dd | spp-24 precursor | spp-24 precursor |
| 4366 | 228 | U20194 | uu | | *Rattus norvegicus* complement C8 beta (C8b) mRNA, partial cds |
| 4366 | 229 | U20194 | General | | *Rattus norvegicus* complement C8 beta (C8b) mRNA, partial cds |
| 4368 | 1537 | U27518 | ss | | *Rattus norvegicus* UDP-glucuronosyltransferase mRNA, complete cds |
| 4371 | 21488 | U32575 | e, xx | | ESTs, Weakly similar to I49523 tumor necrosis factor alpha-induced protein 2 - mouse [*M. musculus*] |
| 4391 | 3387 | U75411 | cc | | Rat Ig active lambda2-like chain mRNA, 3' end |
| 4413 | 672 | X13722 | ff, jj | | Rat mRNA for LDL-receptor |
| 4416 | 15653 | X14210 | ee, ll | NADH ubiquinone oxidoreductase subunit B13 | NADH ubiquinone oxidoreductase subunit B13 |
| 4417 | 18541 | X14671 | h, gg, hh | | ESTs, Highly similar to RL26_RAT 60S RIBOSOMAL PROTEIN L26 [*R. norvegicus*] |
| 4419 | 19244 | X15013 | h, gg, hh | | ESTs, Highly similar to RL7A_HUMAN 60S ribosomal protein L7a (Surfeit locus protein 3) (PLA-X polypeptide) [*R. norvegicus*] |
| 4430 | 18606 | X53504 | h, j, General, gg, hh, ll | | ESTs, Highly similar to RL12_RAT 60S RIBOSOMAL PROTEIN L12 [*R. norvegicus*] |
| 4433 | 24577 | X55153 | h, v, General | | ESTs, Highly similar to R6RTP2 acidic ribosomal protein P2, cytosolic [validated] - rat [*R. norvegicus*] |
| 4438 | 17175 | X58389 | rr | | *R. norvegicus* ASI mRNA for mammalian equivalent of bacterial large ribosomal subunit protein L22 |
| 4444 | 21657 | X61381 | b, x, General, bb, dd, ll, nn, qq | | *Rattus norvegicus* interferon-inducible protein variant 10 mRNA, complete cds |
| 4456 | 22424 | X67788 | z, gg, hh | villin 2 | villin 2 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4458 | 602 | X68101 | bb | | *R. norvegicus* trg mRNA |
| 4459 | 588 | X69834 | a, ii, rr | | *R. norvegicus* mRNA for serine protease inhibitor 2.4 |
| 4460 | 16300 | X70706 | j | plastin 3 (T-isoform) | plastin 3 (T-isoform) |
| 4468 | 463 | X83579 | f, q, u, ww | cyclin-dependent kinase 7 (MO15 homolog, *Xenopus laevis*, cdk-activating kinase) | cyclin-dependent kinase 7 (MO15 homolog, *Xenopus laevis*, cdk-activating kinase) |
| 4478 | 17146 | Y07534 | b, qq | Serine protease inhibitor | Serine protease inhibitor |
| 4480 | 20695 | Y09000 | gg, hh | Dendrin | Dendrin |
| 4481 | 407 | Z11995 | gg, hh | low density lipoprotein receptor-related protein associated protein 1 | low density lipoprotein receptor-related protein associated protein 1 |
| 872 | 16499 | AA925300 | d | HHs:mitogen-activated protein kinase kinase kinase 3 | ESTs, Weakly similar to mitogen activated protein kinase kinase kinase 1 [*Rattus norvegicus*] [*R. norvegicus*] |
| 1908 | 2069 | AI103616 | bb | HHs:ras-related C3 botulinum toxin substrate 1 (rho family, small GTP binding protein Rac1) | ESTs, Weakly similar to ras-like protein [*Rattus norvegicus*] [*R. norvegicus*] |
| 2650 | 5778 | AI233246 | ii | HHs:polymerase (RNA) II (DNA directed) polypeptide B (140 kD) | ESTs, Weakly similar to RNA polymerase I (127 kDa subunit) [*Rattus norvegicus*] [*R. norvegicus*] |
| 2654 | 5779 | AI233350 | I | HHs:polymerase (RNA) II (DNA directed) polypeptide B (140 kD) | ESTs, Weakly similar to RNA polymerase I (127 kDa subunit) [*Rattus norvegicus*] [*R. norvegicus*] |
| 4387 | 11 | U70210 | g | amyloid beta (A4) precursor protein-binding, family B, member 2 | amyloid beta (A4) precursor protein-binding, family B, member 2 |
| 123 | 18115 | AA800339 | d, General, ee, kk | Transferrin | Transferrin |
| 184 | 2143 | AA817892 | e, gg, hh, jj | guanine nucleotide binding protein beta 2 subunit | guanine nucleotide binding protein beta 2 subunit |
| 420 | 2263 | AA859757 | e | collagen, type V, alpha 1 | collagen, type V, alpha 1 |
| 435 | 23324 | AA859980 | a, c, d, jj | T-complex 1 | T-complex 1 |
| 435 | 18578 | AA859980 | a, c, q, jj, ss | T-complex 1 | T-complex 1 |
| 445 | 17111 | AA860062 | ee | Albumin | Albumin |
| 497 | 15342 | AA875172 | k | SH3-domain kinase binding protein 1 | SH3-domain kinase binding protein 1 |
| 499 | 18897 | AA875207 | g | Hemoglobin, beta | Hemoglobin, beta |
| 592 | 17345 | AA892014 | c | HLA-B associated transcript 1A | HLA-B associated transcript 1A |
| 592 | 17346 | AA892014 | k | HLA-B associated transcript 1A | HLA-B associated transcript 1A |
| 656 | 23180 | AA892649 | j, l, General, cc | gamma-aminobutyric acid receptor associated protein | gamma-aminobutyric acid receptor associated protein |
| 663 | 12118 | AA892775 | l, General, gg, hh, kk | Lysozyme | Lysozyme |
| 704 | 20986 | AA893242 | o | fatty acid Coenzyme A ligase, long chain 2 | fatty acid Coenzyme A ligase, long chain 2 |
| 756 | 6377 | AA894273 | t, qq | dimethylarginine dimethylaminohydrolase 1 | dimethylarginine dimethylaminohydrolase 1 |
| 989 | 19421 | AA945152 | n, ee | dimethylarginine dimethylaminohydrolase 1 | dimethylarginine dimethylaminohydrolase 1 |
| 1094 | 24230 | AA957218 | ii | Cyclin D1 | Cyclin D1 |
| 1246 | 14583 | AB008807 | dd, uu | glutathione S-transferase omega 1 | ESTs, Highly similar to GTO1_RAT Glutathione transferase omega 1 (GSTO 1-1) (Glutathione-dependent dehydroascorbate reductase) [*R. norvegicus*] |
| 1249 | 17963 | AB012231 | h | nuclear factor I/B | nuclear factor I/B |
| 1250 | 24414 | AB012234 | ii | Nuclear factor I/X (CCAAT-binding transcription factor) | Nuclear factor I/X (CCAAT-binding transcription factor) |
| 1251 | 4307 | AB012600 | s | aryl hydrocarbon receptor nuclear translocator-like | aryl hydrocarbon receptor nuclear translocator-like |
| 1257 | 20438 | AF009656 | e, u | hypoxanthine guanine phosphoribosyl transferase | hypoxanthine guanine phosphoribosyl transferase |
| 1259 | 4308 | AF015953 | ww | aryl hydrocarbon receptor nuclear translocator-like | aryl hydrocarbon receptor nuclear translocator-like |
| 1278 | 16006 | AF062594 | m, ii | nucleosome assembly protein 1-like 1 | nucleosome assembly protein 1-like 1 |
| 1314 | 7785 | AI008758 | vv | Dipeptidyl peptidase 4 | Dipeptidyl peptidase 4 |
| 1410 | 16010 | AI011922 | e | nucleosome assembly protein 1-like 1 | nucleosome assembly protein 1-like 1 |
| 1465 | 17065 | AI013531 | qq | carbonyl reductase 1 | carbonyl reductase 1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1596 | 20983 | AI044900 | o, v | fatty acid Coenzyme A ligase, long chain 2 | fatty acid Coenzyme A ligase, long chain 2 |
| 1938 | 18277 | AI104399 | t | Triosephosphate isomerase 1 | Triosephosphate isomerase 1 |
| 1961 | 17171 | AI105137 | oo, rr | Somatostatin | ESTs, Highly similar to GTK1_RAT Glutathione S-transferase, mitochondrial (GST 13-13) (Glutathione S-transferase subunit 13) (GST class-kappa) [*R. norvegicus*], Somatostatin |
| 2031 | 16510 | AI137583 | b, w, ii, rr, tt | Inhibitor of DNA binding 2, dominant negative helix-loop-helix protein | Inhibitor of DNA binding 2, dominant negative helix-loop-helix protein |
| 2235 | 12614 | AI175294 | General | ribosomal protein L21 | ribosomal protein L21 |
| 2424 | 19427 | AI179510 | pp | dimethylarginine dimethylaminohydrolase 1 | dimethylarginine dimethylaminohydrolase 1 |
| 2465 | 22845 | AI227887 | t | cell division cycle 42 | cell division cycle 42 |
| 2487 | 18612 | AI228624 | a, c, e, kk | ribosomal protein L29 | ribosomal protein L29 |
| 2532 | 23041 | AI230130 | e | ectonucleoside triphosphate diphosphohydrolase 2 | ectonucleoside triphosphate diphosphohydrolase 2 |
| 2767 | 14666 | AI236912 | z | Ngfi-A binding protein 1 | Ngfi-A binding protein 1 |
| 2823 | 19112 | AI639157 | w | ribosomal protein L13 | ribosomal protein L13 |
| 2896 | 9135 | D45247 | b, mm | proteasome beta type subunit 5 | ESTs, Highly similar to PSB5_RAT Proteasome subunit beta type 5 precursor (Proteasome epsilon chain) (Macropain epsilon chain) (Multicatalytic endopeptidase complex epsilon chain) (Proteasome subunit X) (Proteasome chain 6) [*R. norvegicus*] |
| 2901 | 20984 | D90109 | o, gg, hh, oo, uu | fatty acid Coenzyme A ligase, long chain 2 | fatty acid Coenzyme A ligase, long chain 2 |
| 2939 | 26368 | H34047 | jj | T-complex 1 | T-complex 1 |
| 2960 | 17508 | L08814 | e, gg, hh, oo | Structure specific recognition protein 1 | Structure specific recognition protein 1 |
| 2978 | 21146 | L35558 | gg, hh | Solute carrier family 1 A1 (brain glutamate transporter) | Solute carrier family 1 A1 (brain glutamate transporter) |
| 2989 | 1466 | M14050 | p, q, General, dd, ff | Heat shock 70 kD protein 5 | ESTs, Heat shock 70 kD protein 5 |
| 3017 | 21399 | M36410 | General | sepiapterin reductase | sepiapterin reductase |
| 3017 | 21400 | M36410 | n, x, General, dd, ee | sepiapterin reductase | sepiapterin reductase |
| 3027 | 13547 | M63983 | e | hypoxanthine guanine phosphoribosyl transferase | ESTs, Moderately similar to ICA2_MOUSE Intercellular adhesion molecule-2 precursor (ICAM-2) (CD102) (Lymphocyte function-associated AG-1 counter-receptor) [*M. musculus*], hypoxanthine guanine phosphoribosyl transferase |
| 3028 | 10743 | M64780 | l, p, z, General | Agrin | Agrin |
| 3028 | 10744 | M64780 | l, p, z, General, ii, nn, rr | Agrin | Agrin |
| 3031 | 21670 | M80601 | f, l, z, General | programmed cell death 2 | programmed cell death 2 |
| 3045 | 22513 | NM_012488 | nn | Alpha-2-macroglobulin | Alpha 2-macroglobulin |
| 3052 | 20153 | NM_012503 | b, g, v | Asialoglycoprotein receptor 1 (hepatic lectin) | Asialoglycoprotein receptor 1 (hepatic lectin) |
| 3057 | 563 | NM_012516 | l, vv | Complement component 4 binding protein, alpha | Complement component 4 binding protein, alpha |
| 3062 | 16520 | NM_012532 | b, u | Ceruloplasmin (ferroxidase) | Ceruloplasmin (ferroxidase) |
| 3068 | 21834 | NM_012555 | x | Ets avian erythroblastosis virus E2 oncogene homolog 1 (tumor progression locus 1) | Ets avian erythroblastosis virus E2 oncogene homolog 1 (tumor progression locus 1) |
| 3068 | 21835 | NM_012555 | y | Ets avian erythroblastosis virus E2 oncogene homolog 1 (tumor progression locus 1) | Ets avian erythroblastosis virus E2 oncogene homolog 1 (tumor progression locus 1) |
| 3082 | 20126 | NM_012591 | u, nn | Interferon regulatory factor 1, sirtuin 2 (silent mating type information regulation 2, homolog) 2 (*S. cerevisiae*) | Interferon regulatory factor 1, sirtuin 2 (silent mating type information regulation 2, homolog) 2 (*S. cerevisiae*) |
| 3097 | 1840 | NM_012637 | g | protein tyrosine phosphatase, non-receptor type 1 | protein tyrosine phosphatase, non-receptor type 1 |
| 3097 | 1841 | NM_012637 | ww | protein tyrosine phosphatase, non-receptor type 1 | protein tyrosine phosphatase, non-receptor type 1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3097 | 1844 | NM_012637 | ww | protein tyrosine phosphatase, non-receptor type 1 | ESTs, protein tyrosine phosphatase, non-receptor type 1 |
| 3105 | 21794 | NM_012670 | g, m, s | T-complex 1 | T-complex 1 |
| 3125 | 16613 | NM_012732 | c | Cholesterol esterase (pancreatic) | Cholesterol esterase (pancreatic) |
| 3125 | 10260 | NM_012732 | y | Cholesterol esterase (pancreatic) | Cholesterol esterase (pancreatic) |
| 3126 | 23806 | NM_012733 | b, qq | Retinol-binding protein 1 | Retinol-binding protein 1 |
| 3130 | 426 | NM_012738 | l, General, cc, nn, vv | Apolipoprotein A-I | Apolipoprotein A-I |
| 3130 | 427 | NM_012738 | f, l, x, General, nn, vv | Apolipoprotein A-I | Apolipoprotein A-I |
| 3140 | 7783 | NM_012789 | qq | Dipeptidyl peptidase 4 | Dipeptidyl peptidase 4 |
| 3140 | 7784 | NM_012789 | General, kk | Dipeptidyl peptidase 4 | Dipeptidyl peptidase 4 |
| 3141 | 24113 | NM_012791 | r | dual-specificity tyrosine-(Y)-phosphorylation regulated kinase 1a | dual-specificity tyrosine-(Y)-phosphorylation regulated kinase 1a |
| 3145 | 556 | NM_012803 | b, u, x, dd | Protein C | Protein C |
| 3146 | 21729 | NM_012804 | o, ff | ATP-binding cassette, sub-family D (ALD), member 3 | ATP-binding cassette, sub-family D (ALD), member 3 |
| 3146 | 21730 | NM_012804 | o, v | ATP-binding cassette, sub-family D (ALD), member 3 | ATP-binding cassette, sub-family D (ALD), member 3 |
| 3161 | 18767 | NM_012857 | qq | Lysosomal associated membrane protein 1 (120 kDa) | Lysosomal associated membrane protein 1 (120 kDa) |
| 3161 | 18770 | NM_012857 | m, ff, ii, rr | Lysosomal associated membrane protein 1 (120 kDa) | Lysosomal associated membrane protein 1 (120 kDa) |
| 3168 | 16721 | NM_012891 | o, General, cc, kk, uu | Acyl-Coa dehydrogenase, Very long chain | Acyl Coa dehydrogenase, Very long chain |
| 3174 | 23 | NM_012907 | ii | Apolipoprotein B editing protein | Apolipoprotein B editing protein |
| 3175 | 24431 | NM_012912 | c, n, General, kk, tt | Activating transcription factor 3 | Activating transcription factor 3 |
| 3180 | 20755 | NM_012923 | m, u | Cyclin G1 | Cyclin G1 |
| 3184 | 13723 | NM_012935 | u | Crystallin, alpha polypeptide 2 | Crystallin, alpha polypeptide 2, ESTs, ESTs, Weakly similar to T46637 transcription factor 1, neural - rat [*R. norvegicus*] |
| 3185 | 9109 | NM_012939 | l, General | Cathepsin H | Cathepsin H |
| 3198 | 1525 | NM_012980 | v | Matrix metalloproteinase 11 (stromelysin 3) | Matrix metalloproteinase 11 (stromelysin 3) |
| 3215 | 18078 | NM_013030 | r | Solute carrier family 17 (sodium/hydrogen exchanger), member 2 | *Rattus norvegicus* mRNA for NaPi-2 alpha, complete cds, Solute carrier family 17 (sodium/hydrogen exchanger), member 2 |
| 3219 | 730 | NM_013040 | cc | ATP-binding cassette, sub-family C (CFTR/MRP), member 9 | ATP-binding cassette, sub-family C (CFTR/MRP), member 9 |
| 3226 | 16511 | NM_013060 | rr | Inhibitor of DNA binding 2, dominant negative helix-loop-helix protein | Inhibitor of DNA binding 2, dominant negative helix-loop-helix protein |
| 3265 | 24490 | NM_013178 | s, cc | Sodium channel, voltage-gated, type IV, alpha polypeptide | Sodium channel, voltage-gated, type IV, alpha polypeptide |
| 3266 | 10499 | NM_013184 | r, ii | Neurotrophin 5 (neurotrophin 4/5), ribosomal protein S23 | ribosomal protein S23 |
| 3272 | 1693 | NM_013199 | e | Dynamin 2 | Dynamin 2 |
| 3284 | 24649 | NM_016988 | b, e, l, w, General | Acid phosphatase 2, lysozymal | Acid phosphatase 2, lysozymal |
| 3287 | 1958 | NM_016994 | b, General, uu, vv | Complement component 3 | Complement component 3 |
| 3287 | 1959 | NM_016994 | f, u, uu | Complement component 3 | Complement component 3 |
| 3289 | 1698 | NM_017000 | e | Diaphorase (NADH/NADPH) | Diaphorase (NADH/NADPH) |
| 3292 | 18989 | NM_017013 | qq, vv | Glutathione-S-transferase, alpha type (Yc?) | Glutathione-S-transferase, alpha type (Yc?) |
| 3300 | 24861 | NM_017033 | p, General | Phosphoglucomutase 1 | Phosphoglucomutase 1 |
| 3300 | 24862 | NM_017033 | x, General | Phosphoglucomutase 1 | Phosphoglucomutase 1 |
| 3308 | 1942 | NM_017061 | a | Lysyl oxidase | Lysyl oxidase |
| 3308 | 1946 | NM_017061 | ss | Lysyl oxidase | Lysyl oxidase |
| 3314 | 1262 | NM_017077 | c, v, rr, xx | Hepatocyte nuclear factor 3 gamma | Hepatocyte nuclear factor 3 gamma |
| 3316 | 23660 | NM_017080 | a, l, vv | Hydroxysteroid dehydrogenase 11 beta type 1 | Hydroxysteroid dehydrogenase, 11 beta type 1 |
| 3321 | 4392 | NM_017101 | mm | Peptidyiprolyl isomerase A (cyclophilin A) | Peptidylprolyl isomerase A (cyclophilin A) |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3321 | 4393 | NM_017101 | bb, mm | Peptidyiprolyl isomerase A (cyclophilin A) | Peptidyiprolyl isomerase A (cyclophilin A) |
| 3323 | 1548 | NM_017112 | b, General | hepsin | hepsin |
| 3326 | 1435 | NM_017125 | l, cc, rr | Cd63 antigen | Cd63 antigen |
| 3329 | 169 | NM_017131 | f | calsequestrin 2 | calsequestrin 2 |
| 3335 | 10503 | NM_017143 | a, x, dd | coagulation factor X | coagulation factor X |
| 3335 | 10504 | NM_017143 | d, dd | coagulation factor X | coagulation factor X |
| 3338 | 5351 | NM_017150 | j | ribosomal protein L29 | ribosomal protein L29 |
| 3347 | 17686 | NM_017165 | o | glutathione peroxidase 4 | glutathione peroxidase 4 |
| 3349 | 8182 | NM_017170 | a, bb | serum amyloid P-component | serum amyloid P-component |
| 3350 | 20919 | NM_017172 | v, nn | zinc finger protein 36, C3H type-like 1 | zinc finger protein 36, C3H type-like 1 |
| 3351 | 114 | NM_017175 | oo | protein kinase C-like 1 | protein kinase C-like 1 |
| 3352 | 3512 | NM_017177 | d, o, q, v, dd | choline kinase-like | choline kinase-like |
| 3352 | 3513 | NM_017177 | d, n, dd | choline kinase-like | choline kinase-like |
| 3353 | 3174 | NM_017178 | qq | bone morphogenetic protein 2 | bone morphogenetic protein 2 |
| 3354 | 23961 | NM_017181 | b, uu, vv | fumarylacetoacetate hydrolase | fumarylacetoacetate hydrolase |
| 3355 | 15434 | NM_017187 | y | high mobility group box 2 | high mobility group box 2 |
| 3355 | 15437 | NM_017187 | r, y, ww | high mobility group box 2 | high mobility group box 2 |
| 3358 | 9124 | NM_017199 | j, ii | signal sequence receptor, delta | signal sequence receptor, delta |
| 3358 | 9125 | NM_017199 | u, dd, ii, ll | signal sequence receptor, delta | signal sequence receptor, delta |
| 3358 | 9126 | NM_017199 | g | signal sequence receptor, delta | signal sequence receptor, delta |
| 3362 | 5005 | NM_017209 | n | nuclear receptor binding factor 1 | nuclear receptor binding factor 1 |
| 3372 | 21743 | NM_017235 | jj | hydroxysteroid 17-beta dehydrogenase 7 | hydroxysteroid 17-beta dehydrogenase 7 |
| 3372 | 21744 | NM_017235 | bb, ii, jj | hydroxysteroid 17-beta dehydrogenase 7 | ESTs, Highly similar to DHB7_RAT ESTRADIOL 17 BETA-DEHYDROGENASE 7 (17-BETA-HSD 7) (17-BETA-HYDROXYSTEROID DEHYDROGENASE 7) (PRL RECEPTOR ASSOCIATED PROTEIN) (PRAP) [R. norvegicus] |
| 3374 | 10427 | NM_017237 | bb | ubiquitin carboxy-terminal hydrolase L1 | ubiquitin carboxy-terminal hydrolase L1 |
| 3374 | 10429 | NM_017237 | cc | ubiquitin carboxy-terminal hydrolase L1 | ubiquitin carboxy-terminal hydrolase L1 |
| 3375 | 1498 | NM_017239 | v | myosin heavy chain, polypeptide 6, cardiac muscle, alpha | myosin heavy chain, polypeptide 6, cardiac muscle, alpha |
| 3377 | 17561 | NM_017245 | mm | eukaryotic translation elongation factor 2 | eukaryotic translation elongation factor 2 |
| 3377 | 17562 | NM_017245 | h, t, mt | eukaryotic translation elongation factor 2, mitogen activated protein kinase kinase 2 | eukaryotic translation elongation factor 2, mitogen activated protein kinase kinase 2 |
| 3377 | 17563 | NM_017245 | gg, hh | eukaryotic translation elongation factor 2 | eukaryotic translation elongation factor 2 |
| 3379 | 17502 | NM_017248 | rr | heterogeneous nuclear ribonucleoprotein A1 | heterogeneous nuclear ribonucleoprotein A1 |
| 3379 | 15012 | NM_017248 | kk | heterogeneous nuclear ribonucleoprotein A1 | ESTs, Highly similar to DDRT helix-destabilizing protein - rat [R. norvegicus], heterogeneous nuclear ribonucleoprotein A1 |
| 3383 | 19 | NM_017258 | s, ss, tt | B-cell translocation gene 1, anti-proliferative | B-cell translocation gene 1, anti-proliferative |
| 3395 | 15535 | NM_017283 | ll | proteasome (prosome, macropain) subunit, alpha type 6 | proteasome (prosome, macropain) subunit, alpha type 6 |
| 3396 | 12523 | NM_017285 | tt | proteasome (prosome, macropain) subunit, beta type, 3 | proteasome (prosome, macropain) subunit, beta type, 3 |
| 3396 | 12524 | NM_017285 | kk | proteasome (prosome, macropain) subunit, beta type, 3 | proteasome (prosome, macropain) subunit, beta type, 3 |
| 3397 | 20579 | NM_017288 | u | sodium channel, voltage-gated, type I, beta polypeptide | sodium channel, voltage-gated, type I, beta polypeptide |
| 3404 | 23130 | NM_017307 | j, z, General | solute carrier family 25 (mitochondrial carrier; citrate transporter) member 1 | solute carrier family 25 (mitochondrial carrier; citrate transporter) member 1 |
| 3412 | 1630 | NM_017325 | qq, vv | runt related transcription factor 1 | runt related transcription factor 1 |
| 3428 | 24785 | NM_019133 | n | Synapsin I | Synapsin I |
| 3439 | 1608 | NM_019166 | e | synaptogyrin 1 | ESTs, Moderately similar to SNG1_RAT SYNAPTOGYRIN 1 (P29) [R. norvegicus], synaptogyrin 1 |
| 3441 | 17064 | NM_019170 | uu | carbonyl reductase 1 | carbonyl reductase 1 |
| 3442 | 269 | NM_019180 | d | mast cell protease 6 | mast cell protease 6 |
| 3451 | 2632 | NM_019213 | s | jumping translocation breakpoint | jumping translocation breakpoint |
| 3453 | 15348 | NM_019222 | k, m | coronin, actin binding protein 1B | coronin, actin binding protein 1B |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3456 | 20433 | NM_019232 | tt, xx | serum/glucocorticoid regulated kinase | serum/glucocorticoid regulated kinase |
| 3457 | 15504 | NM_019237 | d | procollagen C-proteinase enhancer protein | procollagen C-proteinase enhancer protein |
| 3460 | 17908 | NM_019242 | f, General, ee, pp | interferon-related developmental regulator 1 | interferon-related developmental regulator 1 |
| 3464 | 1973 | NM_019249 | h, q, r, w, z, General, ee, nn | protein tyrosine phosphatase, receptor type, F | protein tyrosine phosphatase, receptor-type, F |
| 3467 | 13450 | NM_019255 | k | calcium channel, voltage-dependent, gamma subunit 1 | calcium channel, voltage-dependent gamma subunit 1 |
| 3493 | 1818 | NM_019369 | a, uu | inter-alpha-inhibitor H4 heavy chain | inter-alpha-inhibitor H4 heavy chain |
| 3495 | 1323 | NM_019371 | t, mm | EGL nine homolog 3 (*C. elegans*) | EGL nine homolog 3 (*C. elegans*) |
| 3495 | 1324 | NM_019371 | t, mm | EGL nine homolog 3 (*C. elegans*) | EGL nine homolog 3 (*C. elegans*) |
| 3507 | 574 | NM_019905 | m | calpactin I heavy chain, hydroxyacid oxidase 3 (medium-chain), unknown Glu-Pro dipeptide repeat protein | calpactin I heavy chain, hydroxyacid oxidase 3 (medium-chain), unknown Glu-Pro dipeptide repeat protein |
| 3512 | 12087 | NM_020082 | d | ribonuclease 4 | ribonuclease 4 |
| 3519 | 19059 | NM_021587 | a | transforming growth factor-beta (TGF-beta) masking protein large subunit | transforming growth factor-beta (TGF-beta) masking protein large subunit |
| 3522 | 19679 | NM_021653 | a, d, ii | Thyroxine deiodinase, type I | Thyroxine deiodinase, type I |
| 3544 | 23782 | NM_022183 | xx | topoisomerase (DNA) II alpha | topoisomerase (DNA) II alpha |
| 3556 | 19422 | NM_022297 | j, z | dimethylarginine dimethylaminohydrolase 1 | dimethylarginine dimethylaminohydrolase 1 |
| 3556 | 19423 | NM_022297 | l | dimethylarginine dimethylaminohydrolase 1 | dimethylarginine dimethylaminohydrolase 1 |
| 3573 | 8214 | NM_022500 | f, n | ferritin light chain 1 | ferritin light chain 1 |
| 3575 | 5319 | NM_022502 | r, u, z | palmitoyl-protein thioesterase | palmitoyl-protein thioesterase |
| 3577 | 1468 | NM_022507 | dd | protein kinase C, zeta | protein kinase C, zeta |
| 3589 | 4601 | NM_022524 | g | sushi-repeat-containing protein, X chromosome | sushi-repeat-containing protein, X chromosome |
| 3599 | 20925 | NM_022594 | o | Peroxisomal enoyl hydratase-like protein | Peroxisomal enoyl hydratase-like protein |
| 3612 | 17661 | NM_022674 | c, d, oo, xx | H2A histone family, member Z | H2A histone family, member Z |
| 3651 | 1785 | NM_024130 | x, oo | dynactin 1 | d nactin 1 |
| 3689 | 1853 | NM_030826 | g | Glutathione peroxidase 1 | ESTs, Glutathione peroxidase 1 |
| 3700 | 20410 | NM_030990 | g, bb, cc | Proteolipid protein (Pelizaeus-Merzbacher disease, spastic paraplegia 2, uncomplicated) | Proteolipid protein (Pelizaeus-Merzbacher disease, spastic paraplegia 2, uncomplicated) |
| 3705 | 21165 | NM_031005 | mm | actinin, alpha 1 | actinin, alpha 1 |
| 3705 | 21166 | NM_031005 | t, mm | actinin, alpha 1 | actinin, alpha 1 |
| 3707 | 997 | NM_031007 | u | adenylyl cyclase 2 | adenylyl cyclase 2 |
| 3722 | 690 | NM_031034 | t, v, General, mm | guanine nucleotide binding protein (G protein) alpha 12 | guanine nucleotide binding protein (G protein) alpha 12 |
| 3722 | 691 | NM_031034 | t, mm | guanine nucleotide binding protein (G protein) alpha 12 | guanine nucleotide binding protein (G protein) alpha 12 |
| 3738 | 1855 | NM_031074 | d | nucleoporin 98 | nucleoporin 98 |
| 3748 | 23854 | NM_031101 | General | ribosomal protein L13 | ribosomal protein L13 |
| 3750 | 16938 | NM_031103 | ee | ribosomal protein L19 | ribosomal protein L19 |
| 3758 | 19040 | NM_031114 | qq, vv | S-100 related protein clone 42C | S-100 related protein, clone 42C |
| 3762 | 15539 | NM_031132 | v | proteasome (prosome, macropain) subunit, alpha type 6, transforming growth factor-b type II receptor | proteasome (prosome, macropain) subunit, alpha type 6, transforming growth factor-b type II receptor |
| 3786 | 3519 | NM_031334 | h, o, dd | Cadherin 1 | Cadherin 1 |
| 3796 | 18990 | NM_031509 | e | Glutathione-S-transferase, alpha type (Yc?) | Glutathione-S-transferase, alpha type (Yc?) |
| 3797 | 17427 | NM_031510 | p | Isocitrate dehydrogenase 1, soluble | Isocitrate dehydrogenase 1, soluble |
| 3800 | 12580 | NM_031514 | m, v | Janus kinase 2 (a protein tyrosine kinase) | Janus kinase 2 (a protein tyrosine kinase) |
| 3802 | 20448 | NM_031530 | vv | Small inducible gene JE | Small inducible gene JE |
| 3802 | 20449 | NM_031530 | vv | Small inducible gene JE | Small inducible gene JE |
| 3812 | 692 | NM_031557 | g | Prostaglandin I2 (prostacyclin) synthase | Prostaglandin I2 (prostacyclin) synthase |
| 3816 | 9620 | NM_031570 | h, General, ll | ribosomal protein S7 | ribosomal protein S7 |
| 3816 | 9621 | NM_031570 | General, rr | ribosomal protein S7 | ribosomal protein S7 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3828 | 14295 | NM_031599 | f, l, pp | eukaryotic translation initiation factor 2 alpha kinase 3 | eukaryotic translation initiation factor 2 alpha kinase 3 |
| 3837 | 21585 | NM_031620 | j | 3-phosphoglycerate dehydrogenase | 3-phosphoglycerate dehydrogenase |
| 3837 | 21586 | NM_031620 | j, u, dd, oo | 3-phosphoglycerate dehydrogenase | 3-phosphoglycerate dehydrogenase |
| 3837 | 21587 | NM_031620 | k | 3-phosphoglycerate dehydrogenase | 3-phosphoglycerate dehydrogenase |
| 3838 | 1683 | NM_031621 | e, ww | linker of T-cell receptor pathways | linker of T-cell receptor pathways |
| 3839 | 14956 | NM_031622 | l | mitogen-activated protein kinase 6 | mitogen-activated protein kinase 6 |
| 3841 | 1639 | NM_031627 | c, x, General, ss | nuclear receptor subfamily 1, group H, member 3 | nuclear receptor subfamily 1, group H, member 3 |
| 3845 | 1727 | NM_031642 | r, tt | core promoter element binding protein | core promoter element binding protein |
| 3854 | 18403 | NM_031677 | r | four and a half LIM domains 2 | four and a half LIM domains 2 |
| 3856 | 2327 | NM_031683 | ll | SMC (segregation of mitotic chromosomes 1)-like 1 (yeast) | SMC (segregation of mitotic chromosomes 1)-like 1 (yeast) |
| 3857 | 20743 | NM_031684 | dd | solute carrier family 29 (nucleoside transporters), member 1 | solute carrier family 29 (nucleoside transporters), member 1 |
| 3859 | 19727 | NM_031687 | h, ff | ubiquitin A-52 residue ribosomal protein fusion product 1 | ubiquitin A-52 residue ribosomal protein fusion product 1 |
| 3862 | 13706 | NM_031699 | ss | claudin 1 | claudin 1 |
| 3864 | 25652 | NM_031704 | q | syntaxin 5a | syntaxin 5a |
| 3864 | 20718 | NM_031704 | n | syntaxin 5a | syntaxin 5a |
| 3864 | 20719 | NM_031704 | b, q, y, dd | syntaxin 5a | syntaxin 5a |
| 3874 | 17554 | NM_031736 | o, vv | solute carrier family 27 (fatty acid transporter), member 2 | solute carrier family 27 (fatty acid transporter), member 2 |
| 3886 | 15647 | NM_031773 | l, y | RNA polymerase I (127 kDa subunit) | RNA polymerase I (127 kDa subunit) |
| 3896 | 2114 | NM_031798 | u, kk | solute carrier family 12, member 2 | solute carrier family 12, member 2 |
| 3901 | 10676 | NM_031818 | t | intracellular chloride ion channel protein p64H1 | intracellular chloride ion channel protein p64H1 |
| 3902 | 2655 | NM_031821 | l, kk, nn, tt | serum-inducible kinase | serum-inducible kinase |
| 3904 | 4748 | NM_031834 | k, cc, vv | sulfotransferase family 1A, phenol-preferring, member 1 | sulfotransferase family 1A, phenol-preferring, member 1 |
| 3904 | 4749 | NM_031834 | b, k, l, ii | Aryl sulfotransferase cytosolic, 1A, phenol-preferring, member 3, sulfotransferase family 1A, phenol-preferring, member 1 | Aryl sulfotransferase cytosolic, 1A, phenol-preferring, member 3, sulfotransferase family 1A, phenol-preferring, member 1 |
| 3910 | 15069 | NM_031840 | k, s, jj | Farnesyl diphosphate synthase | Farnesyl diphosphate synthase |
| 3910 | 15070 | NM_031840 | ii, jj, rr | Farnesyl diphosphate synthase | Farnesyl diphosphate synthase |
| 3910 | 25460 | NM_031840 | k, jj | Farnesyl diphosphate synthase | Farnesyl diphosphate synthase |
| 3930 | 860 | NM_032063 | mm | delta (*Drosophila*)-like 1 | delta (*Drosophila*)-like 1 |
| 3931 | 18494 | NM_032079 | n, ff, pp | DnaJ (Hsp40) homolog, subfamily A, member 2 | DnaJ (Hsp40) homolog, subfamily A, member 2 |
| 3934 | 12299 | NM_032416 | a, General | aldehyde dehydrogenase 2, mitochondrial | aldehyde dehydrogenase 2, mitochondrial |
| 3940 | 17829 | NM_033234 | v | Hemoglobin, beta | Hemoglobin, beta |
| 3952 | 1311 | NM_053291 | j, s, t | phosphoglycerate kinase 1 | phosphoglycerate kinase 1 |
| 3958 | 1063 | NM_053328 | p, t, ff | basic helix-loop-helix domain containing, class B2 | basic helix-loop-helix domain containing, class B2 |
| 3960 | 14928 | NM_053330 | ff, gg, hh | ribosomal protein L21 | ribosomal protein L21 |
| 3965 | 14042 | NM_053348 | cc | fetuin beta | fetuin beta |
| 4007 | 20831 | NM_053589 | g | GTPase Rab14 | GTPase Rab14 |
| 4020 | 1178 | NM_053620 | ll | Cdc42-binding protein kinase beta | Cdc42-binding protein kinase beta |
| 4072 | 17728 | NM_053867 | n, ee | tumor protein, translationally-controlled 1 | tumor protein, translationally-controlled 1 |
| 4073 | 19781 | NM_053883 | q, tt | dual specificity phosphatase 6 | dual specificity phosphatase 6 |
| 4075 | 14992 | NM_053886 | dd | lectin, mannose-binding, 1 | lectin, mannose-binding, 1 |
| 4107 | 23250 | NM_057097 | m | vesicle-associated membrane protein 3 | vesicle-associated membrane protein 3 |
| 4122 | 2413 | NM_057141 | l, n | heterogeneous nuclear ribonucleoprotein K | heterogeneous nuclear ribonucleoprotein K |
| 4122 | 2416 | NM_057141 | w | heterogeneous nuclear ribonucleoprotein K | heterogeneous nuclear ribonucleoprotein K |
| 4128 | 8641 | NM_057211 | f | Kruppel like factor 9 | Kruppel-likefactor 9 |
| 4130 | 10498 | NM_078617 | w, y | ribosomal protein S23 | ribosomal protein S23 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4168 | 8436 | NM_133299 | b, General, vv | perosisomal 2-enoyl-CoA reductase | perosisomal 2-enoyl-CoA reductase |
| 4175 | 656 | NM_133380 | x | Interleukin 4 receptor | Interleukin 4 receptor |
| 4206 | 17112 | NM_134326 | ee | Albumin, Glutathione peroxidase 1 | Albumin, Glutathione peroxidase 1 |
| 4239 | 15189 | NM_138826 | q, w | Metallothionein 1 A | Metallothionein |
| 4239 | 15190 | NM_138826 | n, w, ii | Metallothionein 1 A | Metallothionein |
| 4245 | 16354 | NM_138843 | v, xx | mercaptopyruvate sulfurtransferase | mercaptopyruvate sulfurtransferase |
| 4250 | 9896 | NM_138878 | p | Neural precursor cell expressed, developmentally down-regulated gene 8 | Neural precursor cell expressed, developmentally down-regulated gene 8 |
| 4260 | 1858 | NM_138907 | o, q, jj, xx | acyl-CoA thioesterase 1, cytosolic, mitochondrial acyl-CoA thioesterase 1 | acyl-CoA thioesterase 1, cytosolic, mitochondrial acyl-CoA thioesterase 1 |
| 4325 | 19429 | R47028 | n | dimethylarginine dimethylaminohydrolase 1 | dimethylarginine dimethylaminohydrolase 1 |
| 4333 | 8210 | S61960 | e | ferritin light chain 1 | ferritin light chain 1 |
| 4361 | 1392 | U10188 | l | Polo-like kinase homolog | Polo-like kinase homolog |
| 4383 | 17078 | U53859 | k, jj | calpain, small subunit 1 | calpain, small subunit 1 |
| 4383 | 17079 | U53859 | jj | calpain, small subunit 1 | calpain, small subunit 1 |
| 4385 | 25608 | U53927 | t, ff | cationic amino acid transporter-2A | cationic amino acid transporter-2A |
| 4422 | 10819 | X51536 | h, k | ribosomal protein S3 | ESTs, Highly similar to RS3_MOUSE 40S ribosomal protein S3 [*R. norvegicus*] |
| 4434 | 1037 | X57523 | a, qq | Transporter 1, ABC (ATP binding cassette) | Transporter 1, ABC (ATP binding cassette) |
| 4437 | 18611 | X58200 | h, l, General, ee | ribosomal protein L29 | ribosomal protein L29 |
| 4445 | 15875 | X62145 | ee, gg, hh | ribosomal protein L8 | ESTs, Highly similar to RL8_HUMAN 60S ribosomal protein L8 [*R. norvegicus*] |
| 4450 | 20821 | X62671 | ll | Finkel-Biskis-Reilly murine sarcoma virus (FBR-MuSV) ubiquitously expressed (fox derived) | ESTs, Highly similar to UBIM_RAT UBIQUITIN-LIKE PROTEIN FUBI [*R. norvegicus*] |
| 4452 | 6376 | X62951 | xx | dimethylarginine dimethylaminohydrolase 1 | dimethylarginine dimethylaminohydrolase 1 |
| 4454 | 16413 | X65036 | oo | alpha 7A integrin | alpha 7A integrin |
| 4454 | 16414 | X65036 | u | alpha 7A integrin | alpha 7A integrin |
| 4463 | 11260 | X77934 | t, mm | Amyloid protein precursor-like protein 2 | Amyloid protein precursor-like protein 2 |
| 80 | 21042 | AA799814 | p | HMm:MAP kinase-activated protein kinase 2 | ESTs, Weakly similar to A34366 Ca2+/calmodulin-dependent protein kinase (EC 2.7.1.123) II delta chain - rat [*R. norvegicus*] |
| 119 | 19020 | AA800291 | e, h, n | HMm:guanylate kinase 1 | ESTs, Weakly similar to discs, large homolog 3 (*Drosophila*) [*Rattus norvegicus*] [*R. norvegicus*] |
| 665 | 22537 | AA892799 | kk | HMm:glyoxylate reductase/hydroxypyruvate reductase | ESTs, Weakly similar to 3-phosphoglycerate dehydrogenase [*Rattus norvegicus*] [*R. norvegicus*] |
| 665 | 22538 | AA892799 | z | HMm:glyoxylate reductase/hydroxypyruvate reductase | ESTs, Weakly similar to 3-phosphoglycerate dehydrogenase [*Rattus norvegicus*] [*R. norvegicus*] |
| 850 | 22540 | AA924630 | ff | HMm:glyoxylate reductase/hydroxypyruvate reductase | ESTs, Weakly similar to 3-phosphoglycerate dehydrogenase [*Rattus norvegicus*] [*R. norvegicus*] |
| 873 | 21010 | AA925306 | o | HMm:carnitine acetyltransferase | ESTs, Weakly similar to 1701410A choline acetyltransferase [*Rattus norvegicus*] [*R. norvegicus*] |
| 1165 | 2915 | AA996782 | ww | HMm:lamin B2 | ESTs, Moderately similar to lamin B1 [*Rattus norvegicus*] [*R. norvegicus*] |
| 1295 | 21563 | AI007750 | gg, hh | HMm:ubiquitin-conjugating enzyme E2L 3 | ESTs, Weakly similar to ubiquitin-conjugating enzyme E2D 2 [*Rattus norvegicus*] [*R. norvegicus*] |
| 1373 | 12310 | AI010362 | gg, hh | HMm:cullin 1 | ESTs, Weakly similar to vasopressin-activated calcium-mobilizing receptor protein [*Rattus norvegicus*] [*R. norvegicus*] |
| 1429 | 20817 | AI012589 | c | glutathione S-transferase, pi 2 | glutathione S-transferase, pi 2 |
| 1894 | 2364 | AI103379 | General | HMm:ubiquitin-activating enzyme E1, Chr X | ESTs, Highly similar to I63168 gene Ube1x protein - rat (fragment) [*R. norvegicus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2084 | 17812 | AI169075 | uu | HMm:glutathione transferase zeta 1 (maleylacetoacetate isomerase) | ESTs, Weakly similar to GTO1_RAT Glutathione transferase omega 1 (GSTO 1-1) (Glutathione-dependent dehydroascorbate reductase) [*R. norvegicus*] |
| 2320 | 14384 | AI177096 | e | HMm:adeninephosphoribosyl transferase | ESTs, Highly similar to APT_RAT ADENINE PHOSPHORIBOSYLTRANSFERASE (APRT) [*R. norvegicus*] |
| 2336 | 8949 | AI177593 | l, General | HMm:ATPase, H+ transporting, lysosomal 21 kDa, V0 subunit B | ESTs, Weakly similar to VATL_MOUSE Vacuolar ATP synthase 16 kDa proteolipid subunit [*R. norvegicus*] |
| 2469 | 21505 | AI228005 | bb | HMm:deoxyguanosine kinase | ESTs, Weakly similar to deoxycytidine kinase [*Rattus norvegicus*] [*R. norvegicus*] |
| 2591 | 22542 | AI232066 | ff | HMm:glyoxylate reductase/hydroxypyruvate reductase | ESTs, Weakly similar to 3-phosphoglycerate dehydrogenase [*Rattus norvegicus*] [*R. norvegicus*] |
| 2793 | 21043 | AI237813 | mm | HMm:MAP kinase-activated protein kinase 2 | ESTs, Weakly similar to A34366 Ca2+/calmodulin-dependent protein kinase (EC 2.7.1.123) II delta chain - rat [*R. norvegicus*] |
| 3389 | 17715 | NM_017274 | ss, xx | glycerol-3-phosphate acyltransferase, mitochondrial | glycerol-3-phosphate acyltransferase, mitochondrial |
| 3389 | 20282 | NM_017274 | y | glycerol-3-phosphate acyltransferase, mitochondrial | glycerol-3-phosphate acyltransferase, mitochondrial |
| 3425 | 14979 | NM_019126 | u, bb, jj | Carcinoembryonic antigen gene family (CGM3) | Carcinoembryonic antigen gene family (CGM3) |
| 3504 | 904 | NM_019620 | d, n, gg, hh, kk, tt | Kruppel associated box (KRAB) zinc finger 1 | Kruppel associated box (KRAB) zinc finger 1 |
| 3602 | 21023 | NM_022599 | h, l, General | synaptojanin 2 binding protein | synaptojanin 2 binding protein |
| 3768 | 21624 | NM_031144 | mm | actin, beta | actin, beta |
| 3768 | 21625 | NM_031144 | z | actin, beta | actin, beta |
| 4242 | 2100 | NM_138829 | ll | golgi reassembly stacking protein 2 | golgi reassembly stacking protein 2 |
| 4260 | 18082 | NM_138907 | nn | mitochondrial acyl-CoA thioesterase 1 | mitochondrial acyl-CoA thioesterase 1 |
| 4260 | 18083 | NM_138907 | m, o, jj, nn, xx | mitochondrial acyl-CoA thioesterase 1 | mitochondrial acyl-CoA thioesterase 1 |
| 4397 | 23926 | U86635 | d, oo | glutathione S-transferase, mu 5 | glutathione S-transferase, mu 5 |
| 33 | 17613 | AA799511 | ww | | ESTs, Weakly similar to DDRT helix-destabilizing protein - rat [*R. norvegicus*] |
| 38 | 17599 | AA799539 | o | | ESTs, Weakly similar to KEAP_RAT Kelch-like ECH-associated protein 1 (Cytosolic inhibitor of Nrf2) (INrf2) [*R. norvegicus*] |
| 45 | 18361 | AA799591 | j, tt | | ESTs, Highly similar to TBB1_RAT TUBULIN BETA CHAIN (T BETA-15) [*R. norvegicus*] |
| 56 | 20982 | AA799657 | x, qq | | ESTs, Weakly similar to S68418 protein phosphatase 1M chain M110 isoform - rat (fragment) [*R. norvegicus*] |
| 77 | 20998 | AA799803 | b, General | | ESTs, Weakly similar to JC6554 complement subcomponent C1s (EC 3.4.21.42) precursor [similarity] - rat [*R. norvegicus*] |
| 97 | 16712 | AA800015 | v | integrin-linked kinase | integrin-linked kinase |
| 117 | 21665 | AA800272 | e, s | | ESTs, Highly similar to RM03_RAT Mitochondrial 60S ribosomal protein L3 [*R. norvegicus*] |
| 124 | 9089 | AA800389 | d | | ESTs, Weakly similar to A48157 renal transcription factor Kid-1- rat [*R. norvegicus*] |
| 126 | 6892 | AA800551 | p | DnaJ-like protein | DnaJ-like protein |
| 140 | 12072 | AA800680 | g | | ESTs, Weakly similar to S68418 protein phosphatase 1M chain M110 isoform - rat (fragment) [*R. norvegicus*] |
| 165 | 21415 | AA800948 | l, mm | | ESTs, Highly similar to 0812252A tubulin alpha [*Rattus norvegicus*] [*R. norvegicus*] |
| 189 | 9840 | AA817964 | g | paraoxonase 1 | paraoxonase 1 |
| 199 | 6526 | AA818118 | gg, hh | | ESTs, Weakly similar to cold inducible RNA-binding protein [*Rattus norvegicus*] [*R. norvegicus*] |
| 201 | 6016 | AA818163 | x | | ESTs, Weakly similar to PON1_RAT Serum paraoxonase/arylesterase 1 (PON 1) (Serum aryldiakylphosphatase 1) (A-esterase 1) (Aromatic esterase 1) [*R. norvegicus*] |
| 202 | 17771 | AA818224 | l | | Rat mRNA for beta-tubulin T beta15 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 269 | 17614 | AA848306 | t, ll, tt | | ESTs, Weakly similar to DDRT helix-destabilizing protein - rat [R. norvegicus] |
| 277 | 23355 | AA848530 | l, bb | | ESTs, Weakly similar to retinoblastoma binding protein 7 [Rattus norvegicus] [R. norvegicus] |
| 297 | 6635 | AA849786 | bb, ll | | ESTs, Weakly similar to CLK3_RAT Protein kinase CLK3 (CDC-like kinase 3) [R. norvegicus] |
| 316 | 14324 | AA850402 | n | | ESTs, Moderately similar to S21348 probable polypolyprotein-related protein 4 - rat [R. norvegicus] |
| 372 | 14987 | AA858640 | o | heat shock protein 60 (liver) | Rattus norvegicus CDK110 mRNA, heat shock protein 60 (liver) |
| 390 | 19105 | AA859230 | v, x | | ESTs, Weakly similar to HG17_RAT NONHISTONE CHROMOSOMAL PROTEIN HMG-17 [R. norvegicus] |
| 410 | 11317 | AA859631 | oo | | ESTs, Weakly similar to ZF37_RAT Zinc finger protein 37 (Zfp-37) [R. norvegicus] |
| 411 | 16318 | AA859648 | c | | ESTs, Weakly similar to DJA1_MOUSE DnaJ homolog subfamily A member 1 (Heat shock 40 kDa protein 4) (DnaJ protein homolog 2) (HSJ-2) [R. norvegicus] |
| 433 | 23301 | AA859975 | w | 2-oxoglutarate carrier | 2-oxoglutarate carrier |
| 439 | 19332 | AA860014 | e | | EST, Moderately similar to 2206405A hemoglobin:SUBUNIT = zeta [Rattus norvegicus] [R. norvegicus] |
| 465 | 16082 | AA874887 | ww | | ESTs, Weakly similar to segregation of mitotic chromosomes b; SMC (segregation of mitotic chromosomes 1)-like 1 (yeast) [Rattus norvegicus] [R. norvegicus] |
| 478 | 14951 | AA875037 | y | | ESTs, Weakly similar to plasminogen activator inhibitor 2 type A [Rattus norvegicus] [R. norvegicus] |
| 482 | 16327 | AA875050 | c, oo | | ESTs, Weakly similar to KICE_RAT Choline/ethanolamine kinase [Includes: Choline kinase (CK); Ethanolamine kinase (EK)] [R. norvegicus] |
| 486 | 20701 | AA875097 | b, m, General | | EST, Highly similar to FIBA_RAT Fibrinogen alpha/alpha-E chain precursor [R. norvegicus] |
| 501 | 15933 | AA875253 | q | ADP-ribosylation factor-like 1 | ADP-ribosylation factor-like 1 |
| 516 | 16516 | AA875563 | x | | ESTs, Weakly similar to I56519 taipoxin-associated calcium binding protein-49 precursor - rat [R. norvegicus] |
| 533 | 9136 | AA891226 | rr, tt | | ESTs, Highly similar to PSB5_RAT Proteasome subunit beta type 5 precursor (Proteasome epsilon chain) (Macropain epsilon chain) (Multicatalytic endopeptidase complex epsilon chain) (Proteasome subunit X) (Proteasome chain 6) [R. norvegicus] |
| 547 | 2753 | AA891589 | e | sarcosine dehydrogenase | ESTs, sarcosine dehydrogenase |
| 562 | 18269 | AA891769 | z | | ESTs, Weakly similar to SC65 synaptonemal complex protein [Rattus norvegicus] [R. norvegicus] |
| 606 | 17350 | AA892240 | k | | ESTs, Weakly similar to 2008109A set gene [Rattus norvegicus] [R. norvegicus] |
| 613 | 4486 | AA892298 | w | | ESTs, Weakly similar to matrin cyclophilin (matrin-cyp) [Rattus norvegicus] [R. norvegicus] |
| 621 | 13647 | AA892367 | z, General, ii, rr | | ESTs, Highly similar to RL3_RAT 60S RIBOSOMAL PROTEIN L3 (L4) [R. norvegicus] |
| 623 | 19226 | AA892394 | a | | ESTs, Weakly similar to ELV4_RAT ELAV-like protein 4 (Paraneoplastic encephalomyelitis antigen HuD) (Hu-antigen D) [R. norvegicus] |
| 623 | 19227 | AA892394 | a, w | | ESTs, Weakly similar to ELV4_RAT ELAV-like protein 4 (Paraneoplastic encephalomyelitis antigen HuD) (Hu-antigen D) [R. norvegicus] |
| 631 | 9254 | AA892470 | j, q, nn, oo | | ESTs, Highly similar to S03644 histone H2A.Z - rat [R. norvegicus] |
| 632 | 11992 | AA892485 | kk | dihydrolipoamide acetyltransferase | dihydrolipoamide acetyltransferase |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 649 | 15876 | AA892582 | l, General | | ESTs, Highly similar to RL8_HUMAN 60S ribosomal protein L8 [R. norvegicus] |
| 658 | 4487 | AA892680 | e, p | | ESTs, Weakly similar to matrin cyclophilin (matrin-cyp) [Rattus norvegicus] [R. norvegicus] |
| 667 | 6951 | AA892820 | bb | | ESTs, Weakly similar to S70642 ubiquitin ligase Nedd4 - rat (fragment) [R. norvegicus] |
| 671 | 7148 | AA892842 | gg, hh | | ESTs, Weakly similar to CAZ3_RAT F-actin capping protein alpha-3 subunit (CAPZ alpha-3) [R. norvegicus] |
| 679 | 3438 | AA892921 | r | | ESTs, Weakly similar to A55143 calpain (EC 3.4.22.17) light chain - rat (fragment) [R. norvegicus] |
| 680 | 16482 | AA892940 | x | | ESTs, Weakly similar to EF2_RAT Elongation factor 2 (EF-2) [R. norvegicus] |
| 691 | 24179 | AA893091 | nn, tt | | ESTs, Weakly similar to TC17_RAT Zinc finger protein 354A (Transcription factor 17) (Renal transcription factor Kid-1) (Kidney, ischemia, and developmentally regulated protein-1) [R. norvegicus] |
| 725 | 17836 | AA893626 | uu | | ESTs, Weakly similar to guanine nucleotide-binding protein, beta-1# subunit [Rattus norvegicus] [R. norvegicus] |
| 743 | 7637 | AA894089 | k, x | rotein carrying the RING-H2 sequence motif | rotein carrying the RING-H2 sequence motif |
| 746 | 18419 | AA894130 | n, General, ww | | ESTs, Weakly similar to 2019243A amyloid precursor-like protein 2 [Rattus norvegicus] [R. norvegicus] |
| 754 | 15274 | AA894258 | General, kk | ubiquitin-conjugating enzyme E2D 3 (homologous to yeast UBC4/5) | ubiquitin-conjugating enzyme E2D 3 (homologous to yeast UBC4/5) |
| 755 | 3908 | AA894259 | j | | ESTs, Weakly similar to hypoxia induced gene 1 [Rattus norvegicus] [R. norvegicus] |
| 795 | 6483 | AA900461 | v | | ESTs, Weakly similar to OBRG_RAT Leptin receptor gene-related protein (OB-R gene related protein) (OB-RGRP) [R. norvegicus] |
| 804 | 18547 | AA900722 | ii | solute carrier family 9 (sodium/hydrogen exchanger), isoform 3 regulator 2 | solute carrier family 9 (sodium/hydrogen exchanger), isoform 3 regulator 2 |
| 824 | 22980 | AA923973 | y | seven in absentia 1A | seven in absentia 1A |
| 855 | 5019 | AA924768 | b | | ESTs, Weakly similar to DnaJ (Hsp40) homolog, subfamily A, member 2 [Rattus norvegicus] [R. norvegicus] |
| 867 | 23261 | AA925145 | b, uu, vv | | ESTs, Weakly similar to betaine-homocysteine methyltransferase [Rattus norvegicus] [R. norvegicus] |
| 868 | 10666 | AA925212 | kk | siah binding protein 1; FBP interacting repressor; pyrimidine tract binding splicing factor; Ro ribonucleoprotein-binding protein 1 | siah binding protein 1; FBP interacting repressor; pyrimidine tract binding splicing factor; Ro ribonucleoprotein-binding protein 1 |
| 964 | 14763 | AA944481 | s, ff, nn | | ESTs, Weakly similar to FCN2_RAT Ficolin 2 precursor (Collagen/fibrinogen domain-containing protein 2) (Ficolin-B) (Ficolin B) (Serum lectin P35) (EBP-37) (Hucolin) [R. norvegicus] |
| 977 | 2893 | AA944833 | kk | | ESTs, Weakly similar to ROD_RAT Heterogeneous nuclear ribonucleoprotein D0 (hnRNP D0) (AU-rich element RNA-binding protein 1) [R. norvegicus] |
| 999 | 22607 | AA945580 | b | | ESTs, Weakly similar to ARG2_RAT Arginase II, mitochondrial precursor (Non-hepatic arginase) (Kidney-type arginase) [R. norvegicus] |
| 1012 | 17721 | AA945762 | General | | ESTs, Weakly similar to 2102279A protein Tyr phosphatase [Rattus norvegicus] [R. norvegicus] |
| 1017 | 22680 | AA945883 | j | | ESTs, Weakly similar to JC5598 mucin - rat [R. norvegicus] |
| 1030 | 22753 | AA946300 | l, General | | Rattus norvegicus cytochrome P450-like protein mRNA, partial cds |
| 1041 | 643 | AA946439 | c, ii, tt | | ESTs, Highly similar to HSRT4 histone H4 - rat [R. norvegicus] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1048 | 23584 | AA955071 | ff | retinoid X receptor gamma ( | retinoid X receptor gamma ( |
| 1052 | 22596 | AA955298 | c | | ESTs, Weakly similar to T46637 transcription factor 1 neural - rat [*R. norvegicus*] |
| 1055 | 23542 | AA955389 | pp | | ESTs, Weakly similar to GRB2__HUMAN Growth factor receptor-bound protein 2 (GRB2 adapter protein) (SH2/SH3 adapter GRB2) (ASH protein) [*R. norvegicus*] |
| 1079 | 11050 | AA956164 | ii | | ESTs, Weakly similar to JQ0866 T-complex protein 1 - rat [*R. norvegicus*] |
| 1082 | 23747 | AA956329 | gg, hh | | ESTs, Moderately similar to delta-6 fatty acid desaturase [*Rattus norvegicus*] [*N. norvegicus*] |
| 1084 | 25112 | AA956437 | d | | ESTs, Weakly similar to TERA__RAT TRANSITIONAL ENDOPLASMIC RETICULUM ATPASE (TER ATPASE) (15S MG(2+)-ATPASE P97 SUBUNIT) (VALOSIN CONTAINING PROTEIN) (VCP) [CONTAINS: VALOSIN] [*R. norvegicus*] |
| 1091 | 6174 | AA957063 | tt | | ESTs, Weakly similar to E2BE__RAT TRANSLATION INITIATION FACTOR EIF-2B EPSILON SUBUNIT (EIF-2B GDP-GTP EXCHANGE FACTOR) [*R. norvegicus*] |
| 1099 | 24050 | AA957449 | v | | ESTs, Weakly similar to SNK__RAT Serine/threonine-protein kinase SNK (Serum inducible kinase) [*N. norvegicus*] |
| 1101 | 12479 | AA957557 | a, vv | | ESTs, Weakly similar to ITH3__RAT Inter-alpha-trypsin inhibitor heavy chain H3 precursor (ITI heavy chain H3) [*R. norvegicus*] |
| 1110 | 23541 | AA957999 | f, l. nn | | ESTs, Weakly similar to TXTP__RAT Tricarboxylate transport protein, mitochondrial precursor (Citrate transport protein) (CTP) (Tricarboxylate carrier protein) [*R. norvegicus*] |
| 1190 | 13330 | AA997716 | ll | Kelch-like ECH-associated protein 1 | Kelch-like ECH-associated protein 1 |
| 1213 | 3746 | AA998268 | b, bb | | ESTs, Weakly similar to SYPH__RAT SYNAPTOPHYSIN (MAJOR SYNAPTIC VESICLE PROTEIN P38) [*R. norvegicus*] |
| 1216 | 14379 | AA998415 | rr | | ESTs, Weakly similar to A40016 matrin 3- rat [*R. norvegicus*] |
| 1244 | 11745 | AB006450 | gg, hh | translocator of inner mitochondrial membrane 17 kDa, a | translocator of inner mitochondrial membrane 17 kDa, a |
| 1255 | 18192 | AF000899 | s, tt | nucleoporin p58 | *Rattus norvegicus* p58/p45 mRNA, alternatively spliced form, clone H6, 3' end, nucleoporin p58 |
| 1260 | 19649 | AF016387 | pp | retinoid X receptor gamma ( | retinoid X receptor gamma ( |
| 1260 | 19650 | AF016387 | s | retinoid X receptor gamma ( | retinoid X receptor gamma ( |
| 1270 | 8008 | AF039584 | xx | decay-accelarating factor | decay-accelarating factor |
| 1274 | 15715 | AF053092 | ii | | *Rattus norvegicus* polo-like kinase isoform mRNA, partial cds |
| 1281 | 3896 | AF077000 | m | protein tyrosine phosphatase TD14 | protein tyrosine phosphatase TD14 |
| 1283 | 20741 | AF084186 | nn | alpha-fodrin | alpha-fodrin |
| 1288 | 2947 | AF099093 | f, kk | ubiquitin-conjugating enzyme UBC7 | ubiquitin-conjugating enzyme UBC7 |
| 1289 | 12932 | AF102552 | x | ankyrin 3(G) | ankyrin 3 (G) |
| 1292 | 11251 | AI007666 | ii | | ESTs, Weakly similar to JC4647 KW8 protein - rat [*R. norvegicus*] |
| 1294 | 22332 | AI007748 | ff | | ESTs, Weakly similar to OZF__RAT Zinc finger protein OZF (POZF-1) [*R. norvegicus*] |
| 1322 | 21838 | AI009131 | ee, kk | laminin, gamma 1 | laminin, gamma 1 |
| 1333 | 10820 | AI009411 | ee | | ESTs, Highly similar to RS3__MOUSE 40S ribosomal protein S3 [*R. norvegicus*] |
| 1339 | 9746 | AI009555 | d, g | | *Rattus norvegicus* dynein light intermediate chain 1 mRNA, complete cds |
| 1350 | 22545 | AI009747 | z | transducer of ERBB2, 1 | transducer of ERBB2, 1 |
| 1365 | 23540 | AI010110 | xx | SH3-domain GRB2-like 1 | SH3-domain GRB2-like 1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1401 | 16112 | AI011706 | tt | | ESTs, Weakly similar to SFR5_RAT Splicing factor, arginine/serine-rich 5 (Pre-mRNA splicing factor SRP40) (Insulin-induced growth response protein CL-4) (Delayed-early protein HRS) [R. norvegicus] |
| 1415 | 21796 | AI012221 | vv | | ESTs, Weakly similar to intracellular chloride ion channel protein p64H1 [Rattus norvegicus] [R. norvegicus] |
| 1422 | 3417 | AI012337 | h, w | | ESTs, Highly similar to NHPX_RAT NHP2-like protein 1 (High mobility group-like nuclear protein 2 homolog 1) ([U4/U6.U5] tri-snRNP 15.5 kDa protein) (OTK27) [R. norvegicus] |
| 1427 | 1263 | AI012567 | bb | | ESTs, Weakly similar to ZF94_RAT Zinc finger protein 94 (Zfp-94) (Zinc finger protein Y1) (RLZF-Y) [R. norvegicus] |
| 1434 | 6489 | AI012636 | d | | ESTs, Weakly similar to RBMA_RAT RNA-binding protein 10 (RNA binding motif protein 10) (S1-1 protein) [N. norvegicus] |
| 1462 | 7258 | AI013475 | h | | ESTs, Moderately similar to SORT_RAT Sortilin (Glycoprotein 110) (Gp110) [R. norvegicus] |
| 1472 | 24239 | AI013781 | d | | ESTs, Weakly similar to S19586 N-methyl-D-aspartate receptor glutamate-binding chain - rat [R. norvegicus] |
| 1548 | 23949 | AI031019 | q | translation initiation factor eIF-2B alpha-subunit | translation initiation factor eIF-2B alpha-subunit |
| 1548 | 23950 | AI031019 | n, q, x, ll | translation initiation factor eIF-2B alpha-subunit | translation initiation factor eIF-2B alpha-subunit |
| 1572 | 5431 | AI044257 | l | | ESTs, Weakly similar to syntenin [Rattus norvegicus] [R. norvegicus] |
| 1591 | 18205 | AI044836 | h | | ESTs, Weakly similar to NUCL_RAT Nucleolin (Protein C23) [R. norvegicus] |
| 1647 | 10533 | AI058430 | qq | | ESTs, Highly similar to HG17_RAT NONHISTONE CHROMOSOMAL PROTEIN HMG-17 [R. norvegicus] |
| 1662 | 8584 | AI058911 | cc, ii, rr | | ESTs, Weakly similar to FIBA_RAT Fibrinogen alpha/alpha-E chain precursor [R. norvegicus] |
| 1670 | 14984 | AI059174 | h | | Rattus norvegicus CDK110 mRNA |
| 1686 | 6370 | AI059568 | g | | ESTs, Highly similar to B48213 syntaxin 1B - rat [R. norvegicus] |
| 1733 | 26184 | AI070784 | m | | ESTs, Weakly similar to OZF_RAT Zinc finger protein OZF (POZF-1) [R. norvegicus] |
| 1741 | 10999 | AI071110 | t | | ESTs, Weakly similar to A44437 regenerating liver inhibitory factor RL/IF-1 - rat [R. norvegicus] |
| 1762 | 21839 | AI071644 | f | laminin, gamma 1 | laminin, gamma 1 |
| 1764 | 7092 | AI071668 | c | | ESTs, Weakly similar to E2BE_RAT TRANSLATION INITIATION FACTOR EIF-2B EPSILON SUBUNIT (EIF-2B GDP-GTP EXCHANGE FACTOR) [R. norvegicus] |
| 1771 | 16376 | AI071866 | a, u | | Rattus norvegicus Nclone10 mRNA |
| 1794 | 21797 | AI072439 | qq | | ESTs, Weakly similar to intracellular chloride ion channel protein p64H1 [Rattus norvegicus] [R. norvegicus] |
| 1802 | 1501 | AI072634 | e, l, t, bb, dd, ww | | Rattus norvegicus cytokeratin-18 mRNA, partial cds |
| 1825 | 11183 | AI100768 | b | | ESTs, Weakly similar to CAH2_RAT Carbonic anhydrase II (Carbonate dehydratase II) (CA-II) [R. norvegicus] |
| 1832 | 6321 | AI101256 | ii, ll | | ESTs, Weakly similar to S09017 heterogeneous ribonuclear particle protein type C - rat (fragment) [R. norvegicus] |
| 1851 | 18649 | AI101926 | q | | ESTs, Weakly similar to HS9B_RAT Heat shock protein HSP 90-beta (HSP 84) [R. norvegicus] |
| 1875 | 23538 | AI102727 | l, n, p | solute carrier family 20 (phosphate transporter), member 1 | solute carrier family 20 (phosphate transporter), member 1 |
| 1885 | 15026 | AI103094 | General | ras-related protein | ras-related protein |
| 1889 | 15981 | AI103150 | nn | | ESTs, Weakly similar to ubiquitin conjugating enzyme [Rattus norvegicus] [R. norvegicus] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1895 | 8919 | AI103388 | dd, kk | | ESTs, Weakly similar to ARF6_HUMAN ADP ribosylation factor 6 [*R. norvegicus*] |
| 1896 | 14981 | AI103396 | ee | | *Rattus norvegicus* CDK110 mRNA |
| 1935 | 18831 | AI104357 | e | | ESTs, Highly similar to ACTB_HUMAN Actin, cytoplasmic 1 (Beta-actin) [*R. norvegicus*] |
| 1944 | 12342 | AI104658 | oo | | ESTs, Weakly similar to A48152 zinc finger protein Gfi-1 - rat [*R. norvegicus*] |
| 1956 | 15065 | AI105050 | p, ii, ll | ATP synthase, H+ transporting, mitochondrial F1 complex, beta polypeptide | ATP synthase, H+ transporting, mitochondrial F1 complex, beta polypeptide |
| 1979 | 11192 | AI111986 | g | | ESTs, Weakly similar to S41067 collagen alpha 1(III) chain - rat [*R. norvegicus*] |
| 2006 | 11735 | AI136540 | j | | ESTs, Highly similar to TRT3_RAT Troponin T, fast skeletal muscle isoforms beta/alpha (Beta/alpha TnTF) [*R. norvegicus*] |
| 2007 | 10780 | AI136555 | j | | *Rattus norvegicus* mRNA for Castration Induced Prostatic Apoptosis Related protein-1 (CIPAR-1) |
| 2023 | 8924 | AI137283 | z | | ESTs, Weakly similar to TC17_RAT Zinc finger protein 354A (Transcription factor 17) (Renal transcription factor Kid-1) (Kidney, ischemia, and developmentally regulated protein-1) [*R. norvegicus*] |
| 2072 | 1358 | AI146154 | mm | phosphatidylinositol 4-kinase | phosphatidylinositol 4-kinase |
| 2085 | 1335 | AI169105 | ss | | ESTs, Weakly similar to PON1_RAT Serum paraoxonase/arylesterase 1 (PON 1) (Serum aryldiakylphosphatase 1) (A-esterase 1) (Aromatic esterase 1) [*R. norvegicus*] |
| 2094 | 18641 | AI169225 | ee | | *Rattus norvegicus* mRNA for ribosomal protein L35 |
| 2096 | 22661 | AI169265 | t, mm | ATPase, H+ transporting, lysosomal (vacuolar proton pump), subunit 1 | ATPase, H+ transporting, lysosomal (vacuolar proton pump), subunit 1 |
| 2131 | 14938 | AI170362 | qq | | ESTs, Weakly similar to I67414 nuclear factor kappa B - rat (fragment) [*R. norvegicus*] |
| 2145 | 15403 | AI170714 | m, dd | | ESTs, Weakly similar to A40389 translation elongation factor eEF-1 alpha chain (clone pS1) - rat [*R. norvegicus*] |
| 2155 | 18535 | AI170979 | dd, oo | | ESTs, Weakly similar to REQN_RAT Zinc-finger protein neuro-d4 [*R. norvegicus*] |
| 2160 | 17783 | AI171206 | vv | | ESTs, Weakly similar to 2118320A neurodegeneration-associated protein 1 [*Rattus norvegicus*] [*R. norvegicus*] |
| 2170 | 11419 | AI171365 | k | | ESTs, Weakly similar to A57514 RNA helicase HEL117 - rat [*R. norvegicus*] |
| 2181 | 6879 | AI171674 | t | Very low density lipoprotein receptor | Very low density lipoprotein receptor |
| 2204 | 6630 | AI172184 | b | | ESTs, Weakly similar to SYPH_RAT SYNAPTOPHYSIN (MAJOR SYNAPTIC VESICLE PROTEIN P38) [*R. norvegicus*] |
| 2216 | 23325 | AI172405 | bb | | ESTs, Highly similar to 2008109A set gene [*Rattus norvegicus*] [*R. norvegicus*] |
| 2247 | 15404 | AI175760 | dd | | ESTs, Weakly similar to A40389 translation elongation factor eEF-1 alpha chain (clone pS1) - rat [*R. norvegicus*] |
| 2271 | 13339 | AI176308 | r | | ESTs, Weakly similar to CO1B_RAT Coronin 1B (Coronin 2) [*R. norvegicus*] |
| 2335 | 17773 | AI177513 | y | | ESTs, Weakly similar to CLK3_RAT Protein kinase CLK3 (CDC-like kinase 3) [*R. norvegicus*] |
| 2355 | 4979 | AI178133 | ss | | ESTs, Weakly similar to LIS1_MOUSE Platelet-activating factor acetylhydrolase IB alpha subunit (PAF acetylhydrolase 45 kDa subunit) (PAF-AH 45 kDa subunit) (PAF-AH alpha) (PAFAH alpha) (Lissencephaly-1 protein) (LIS-1) [*R. norvegicus*] |
| 2384 | 12408 | AI178762 | qq | | ESTs, Moderately similar to delta-6 fatty acid desaturase [*Rattus norvegicus*] [*R. norvegicus*] |
| 2395 | 23043 | AI178968 | nn | | ESTs, Weakly similar to S70642 ubiquitin ligase Nedd4 - rat (fragment) [*R. norvegicus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2403 | 17890 | AI179123 | j, mm | | ESTs, Weakly similar to NF-E2-related factor 2 [Rattus norvegicus] [R. norvegicus] |
| 2429 | 16656 | AI179634 | h | | ESTs, Weakly similar to Gasz [Rattus norvegicus] [R. norvegicus] |
| 2440 | 6455 | AI179984 | vv | | ESTs, Weakly similar to CPI3__RAT CONTRAPSIN-LIKE PROTEASE INHIBITOR 3 PRECURSOR (CPI-23) (SERINE PROTEASE INHIBITOR 1) (SPI-1) [R. norvegicus] |
| 2468 | 12413 | AI227953 | t, mm | | ESTs, Weakly similar to K6A1__RAT Ribosomal protein S6 kinase alpha 1 (S6K-alpha 1) (90 kDa ribosomal protein S6 kinase 1) (p90-RSK 1) (Ribosomal S6 kinase 1) (RSK-1) (pp90RSK1) [R. norvegicus] |
| 2505 | 6604 | AI229192 | xx | | ESTs, Weakly similar to 2209311A coagulation factor X [Rattus norvegicus] [R. norvegicus] |
| 2515 | 23858 | AI229450 | r | | ESTs, Weakly similar to A57514 RNA helicase HEL117 - rat [R. norvegicus] |
| 2530 | 18650 | AI230121 | q, ii, ll | | ESTs, Weakly similar to HS9B__RAT Heat shock protein HSP 90-beta (HSP 84) [R. norvegicus] |
| 2566 | 21816 | AI231217 | ee | | ESTs, Highly similar to S611__HUMAN Protein transport protein Sec61 alpha subunit isoform 1 (Sec61 alpha-1) [R. norvegicus] |
| 2605 | 8390 | AI232288 | ww | | ESTs, Weakly similar to retinoblastoma binding protein 7 [Rattus norvegicus] [R. norvegicus] |
| 2624 | 5602 | AI232611 | o, ff, xx | | ESTs, Weakly similar to MTE1__RAT Acyl coenzyme A thioester hydrolase, mitochondrial precursor (Very-long-chain acyl-CoA thioesterase) (MTE-I) [R. norvegicus] |
| 2636 | 12873 | AI232984 | tt | | ESTs, Weakly similar to OZF__RAT Zinc finger protein OZF (POZF-1) [R. norvegicus] |
| 2641 | 4442 | AI233163 | gg, hh | | ESTs, Highly similar to RL11__HUMAN 60S ribosomal protein L11 [R. norvegicus] |
| 2713 | 22070 | AI235528 | jj | | ESTs, Weakly similar to synuclein, gamma [Rattus norvegicus] [R. norvegicus] |
| 2726 | 7307 | AI235935 | g, oo | | ESTs, Weakly similar to C1TC__RAT C-1-tetrahydrofolate synthase, cytoplasmic (C1-THF synthase) [Includes: Methylenetetrahydrofolate dehydrogenase; Methenyltetrahydrofolate cyclohydrolase; Formyltetrahydrofolate synthetase] [R. norvegicus] |
| 2730 | 7604 | AI236039 | ll | reticulocalbin | reticulocalbin |
| 2740 | 13911 | AI236262 | ww | | Rattus norvegicus epidermal Langerhans cell protein LCP1 mRNA, complete cds |
| 2742 | 10667 | AI236366 | dd | siah binding protein 1; FBP interacting repressor; pyrimidine tract binding splicing factor; Ro ribonucleoprotein-binding protein 1 | siah binding protein 1; FBP interacting repressor; pyrimidine tract binding splicing factor; Ro ribonucleoprotein-binding protein 1 |
| 2755 | 6207 | AI236681 | gg, hh | | ESTs, Weakly similar to SUIS__RAT Sucrase-isomaltase, intestinal [Contains: Sucrase Isomaltase] [R. norvegicus] |
| 2762 | 17618 | AI236786 | p, rr | | ESTs, Weakly similar to FK506 binding protein 2 (13 kDa) [Rattus norvegicus] [R. norvegicus] |
| 2778 | 23076 | AI237388 | q, dd | | ESTs, Weakly similar to IFR1__RAT INTERFERON-RELATED DEVELOPMENTAL REGULATOR 1 (NERVE GROWTH FACTOR-INDUCIBLE PROTEIN PC4) (IRPR) [R. norvegicus] |
| 2851 | 18338 | AI639422 | g | | ESTs, Moderately similar to CAQC__RAT CALSEQUESTRIN, CARDIAC MUSCLE ISOFORM PRECURSOR [R. norvegicus] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2858 | 26012 | AI639478 | pp | | ESTs, Weakly similar to PDI_RAT Protein disulfide isomerase precursor (PDI) (Prolyl 4-hydroxylase beta subunit) (Cellular thyroid hormone binding protein) (Thyroxine deiodinase) (Iodothyronine 5'-monodeiodinase) (5'-MD) [*R. norvegicus*] |
| 2867 | 8107 | AI639534 | pp | | ESTs, Weakly similar to ATS4_RAT ADAMTS-4 precursor (A disintegrin and metalloproteinase with thrombospondin motifs 4) (ADAM-TS 4) (ADAM-TS4) (Aggrecanase 1) [*R. norvegicus*] |
| 2872 | 7602 | AJ001929 | b, q, v, ii, ll, xx | reticulocalbin | reticulocalbin |
| 2876 | 20519 | C06598 | v, w | | ESTs, Weakly similar to FK506 binding protein 2 (13 kDa) [*Rattus norvegicus*] [*R. norvegicus*] |
| 2877 | 5048 | D00092 | oo | dihydrolipoamide acetyltransferase | dihydrolipoamide acetyltransferase |
| 2881 | 5049 | D10655 | m | dihydrolipoamide acetyltransferase | dihydrolipoamide acetyltransferase |
| 2886 | 5082 | D14015 | ii, ww | Cyclin E1 | ESTs, Highly similar to CGE1_RAT G1/S-specific cyclin E1 [*R. norvegicus*] |
| 2898 | 1041 | D78610 | x | Protein tyrosine phosphatase receptor type epsilon polypeptide | Protein tyrosine phosphatase, receptor type, epsilon polypeptide |
| 2899 | 1356 | D83538 | y | phosphatidylinositol 4-kinase | phosphatidylinositol 4-kinase |
| 2900 | 2744 | D87991 | b, e, q, dd | | ESTs, Highly similar to JC5026 UDP-galactose transporter related protein 1 - rat [*N. norvegicus*] |
| 2915 | 4352 | H31692 | x | GERp95 | GERp95 |
| 2919 | 9745 | H31847 | c, h | | *Rattus norvegicus* dynein light intermediate chain 1 mRNA, complete cds |
| 2921 | 3815 | H31907 | u | G protein pathway suppressor 1 | G protein pathway suppressor 1 |
| 2952 | 14968 | K02815 | f | butyrophilin-like 2 (MHC class II associated) | butyrophilin-like 2 (MHC class II associated) |
| 2964 | 107 | L14001 | General, mm | | *Rattus norvegicus* clone 15 polymeric immunoglobulin receptor mRNA, 3'UTR microsatellite repeats |
| 2965 | 108 | L14002 | l, m, u, General, cc, kk, cc | | *Rattus norvegicus* clone 15 polymeric immunoglobulin receptor mRNA, 3'UTR microsatellite repeats |
| 2967 | 109 | L14004 | b, General, vv | | *Rattus norvegicus* clone 15 polymeric immunoglobulin receptor mRNA, 3'UTR microsatellite repeats |
| 2972 | 24518 | L19927 | t, y, mm | ATP synthase, H+ transporting, mitochondrial F1 complex, gamma polypeptide 1 | ATP synthase, H+ transporting, mitochondrial F1 complex, gamma polypeptide 1 |
| 2981 | 18620 | L40364 | gg, hh | | *Rattus norvegicus* MHC class I RT1.O type - 149 processed pseudogene mRNA |
| 2982 | 25389 | L41684 | ll | FAT tumor suppressor (*Drosophila*) homolog | FAT tumor suppressor (*Drosophila*) homolog |
| 2984 | 17883 | M11851 | ss | | Rat heart myosin light chain 2 (MLC2) mRNA, 3' end |
| 2988 | 24554 | M13749 | m | Chorionic somatomammotropin hormone 2; Placental lactogen-2 | Chorionic somatomammotropin hormone 2; Placental lactogen-2 |
| 3015 | 17211 | M34331 | ee, ll | | *Rattus norvegicus* mRNA for ribosomal protein L35 |
| 3015 | 26030 | M34331 | bb, ll | | *Rattus norvegicus* mRNA for ribosomal protein L35 |
| 3040 | 2694 | M92340 | rr | Interleukin 6 signal transducer | Interleukin 6 signal transducer |
| 3099 | 18726 | NM_012645 | b, q, v, General, dd, oo, rr | | *Rattus norvegicus* MHC class Ib RT1.S3 (RT1.S3) mRNA, partial cds |
| 3109 | 7101 | NM_012679 | nn | Clusterin | Clusterin |
| 3132 | 1478 | NM_012744 | kk | Pyruvate carboxylase | Pyruvate carboxylase |
| 3133 | 8829 | NM_012749 | q, xx | Nucleolin | Nucleolin |
| 3133 | 8831 | NM_012749 | g | Nucleolin | Nucleolin |
| 3138 | 721 | NM_012780 | tt | Aryl hydrocarbon receptor nuclear translocator 1 | Aryl hydrocarbon receptor nuclear translocator 1 |
| 3164 | 20945 | NM_012875 | gg, hh | Ribosomal protein L39 | Ribosomal protein L39 |
| 3191 | 19106 | NM_012963 | ss | High mobility group 1 | High mobility group 1 |
| 3191 | 19107 | NM_012963 | cc | High mobility group 1 | High mobility group 1 |
| 3191 | 19108 | NM_012963 | ii | High mobility group 1 | High mobility group 1 |
| 3191 | 19109 | NM_012963 | ee | High mobility group 1 | High mobility group 1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3191 | 19110 | NM_012963 | jj | High mobility group 1 | High mobility group 1 |
| 3231 | 24607 | NM_013075 | n | Homeo box A1 | Homeo box A1 |
| 3236 | 8898 | NM_013087 | q, tt | CD81 antigen (target of antiproliferative antibody 1) | CD81 antigen (target of antiproliferative antibody 1) |
| 3255 | 24867 | NM_013155 | t, mm | Very low density lipoprotein receptor | Very low density lipoprotein receptor |
| 3258 | 3465 | NM_013160 | ww | | ESTs, Moderately similar to MXI1_RAT MAX interacting protein 1 (MXI1 protein) [R. norvegicus] |
| 3270 | 1969 | NM_013194 | k, t, mm | Myosin, heavy polypeptide 9, non-muscle | Myosin, heavy polypeptide 9, non-muscle |
| 3270 | 1970 | NM_013194 | t, mm | Myosin, heavy polypeptide 9, non-muscle | Myosin, heavy polypeptide 9, non-muscle |
| 3278 | 18230 | NM_013221 | r | | ESTs, Moderately similar to I58311 HMG-box containing protein 1 - rat [R. norvegicus] |
| 3278 | 1495 | NM_013221 | f, General, qq, vv | HMG-box containing protein 1 | HMG-box containing protein 1 |
| 3300 | 18139 | NM_017033 | General | | ESTs, Highly similar to PMRT phosphoglucomutase (EC 5.4.2.2) 1 - rat [R. norvegicus] |
| 3417 | 20848 | NM_017343 | x | | Rat mRNA for myosin regulatory light chain (RLC) |
| 3417 | 20849 | NM_017343 | r, ff | | Rat mRNA for myosin regulatory light chain (RLC) |
| 3419 | 537 | NM_017351 | h, ss, uu | pre-alpha-inhibitor, heavy chain 3 | pre-alpha-inhibitor, heavy chain 3 |
| 3421 | 24428 | NM_017356 | nn | neural visinin-like Ca2+-binding protein type 3 | neural visinin-like Ca2+-binding protein type 3 |
| 3426 | 24732 | NM_019130 | g | Insulin 2 | Insulin 2 |
| 3432 | 20351 | NM_019142 | kk | 5'-AMP-activated protein kinase alpha-1 catalytic subunit | 5'-AMP-activated protein kinase alpha-1 catalytic subunit |
| 3449 | 2933 | NM_019204 | e, m | | ESTs, Highly similar to BACE_RAT Beta-secretase precursor (Beta-site APP cleaving enzyme) (Beta-site amyloid precursor protein cleaving enzyme) (Aspartyl protease 2) (Asp 2) (ASP2) (Membrane-associated aspartic protease 2) (Memapsin-2) [R. norvegicus] |
| 3480 | 24883 | NM_019293 | e, k, u | carbonic anhydrase 5 | carbonic anhydrase 5 |
| 3482 | 1099 | NM_019303 | y | Cytochrome P450 subfamily IIF polypeptide 1 | Cytochrome P450, subfamily IIF, polypeptide 1 |
| 3483 | 16330 | NM_019331 | General kk | Paired basic amino acid cleaving enzyme (furin) | Paired basic amino acid cleaving enzyme (furin) |
| 3483 | 16331 | NM_019331 | h, m, General, mm | Paired basic amino acid cleaving enzyme (furin) | Paired basic amino acid cleaving enzyme (furin) |
| 3486 | 16697 | NM_019349 | s | Serine/threonine kinase 2 | Serine/threonine kinase 2 |
| 3486 | 16698 | NM_019349 | u | Serine/threonine kinase 2 | Serine/threonine kinase 2 |
| 3490 | 23226 | NM_019360 | v, y, gg, hh | cytochrome oxidase subunit VIc | cytochrome oxidase subunit VIc |
| 3513 | 20635 | NM_020099 | ee | OB-receptor gene related protein (OB-RGRP) | OB-receptor gene related protein (OB-RGRP) |
| 3518 | 18724 | NM_021585 | b, ss | | Rattus norvegicus MHC class Ib RT1.S3 (RT1.S3) mRNA, partial cds |
| 3521 | 17340 | NM_021594 | General, dd | ERM-binding phosphoprotein | ERM-binding phosphoprotein |
| 3523 | 19173 | NM_021661 | n | regulator of G-protein signalling 19 | regulator of G-protein signalling 19 |
| 3547 | 20248 | NM_022205 | y | Chemokine receptor (LCR1) | Chemokine receptor (LCR1) |
| 3547 | 20249 | NM_022205 | tt | Chemokine receptor (LCR1) | Chemokine receptor (LCR1) |
| 3561 | 15932 | NM_022385 | q, x, dd | ADP-ribosylation factor-like 1 | ADP-ribosylation factor-like 1 |
| 3565 | 22412 | NM_022392 | f, p, s, General, ee, ff | growth response protein (CL-6) | growth response protein (CL-6) |
| 3565 | 22413 | NM_022392 | a, f, p, General, ee, ff, qq | growth response protein (CL-6) | growth response protein (CL-6) |
| 3565 | 22414 | NM_022392 | ff | growth response protein (CL-6) | growth response protein (CL-6) |
| 3565 | 22415 | NM_022392 | p, General, ff | growth response protein (CL-6) | growth response protein (CL-6) |
| 3568 | 1141 | NM_022401 | f, n, r, z | plectin | plectin |
| 3583 | 3902 | NM_022516 | ss | polypyrimidine tract binding protein | polypyrimidine tract binding protein |
| 3591 | 8097 | NM_022536 | j, q, w, x | cyclophilin B | cyclophilin B |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3592 | 8597 | NM_022538 | h, l | phosphatidate phosphohydrolase type 2a | phosphatidate phosphohydrolase type 2a |
| 3592 | 8598 | NM_022538 | d | phosphatidate phosphohydrolase type 2a | phosphatidate phosphohydrolase type 2a |
| 3594 | 12422 | NM_022546 | bb | Death-associated like kinase | Death-associated like kinase |
| 3595 | 12606 | NM_022547 | General, vv | 10-formyltetrahydrofolate dehydrogenase | 10-formyltetrahydrofolate dehydrogenase |
| 3598 | 20820 | NM_022593 | u | elongation factor SIII p15 subunit | elongation factor SIII p15 subunit |
| 3609 | 12542 | NM_022647 | c, d, qq | | ESTs, Highly similar to 0506206A histone H2B [*Rattus norvegicus*] [*R. norvegicus*] |
| 3610 | 24442 | NM_022667 | u, General, rr | Matrin F/G | Matrin F/G |
| 3622 | 24423 | NM_022703 | m, r, gg, hh, pp | small glutamine rich tetratricopeptide repeat (TPR) containing protein (SGT) | small glutamine-rich tetratricopeptide repeat (TPR) containing protein (SGT) |
| 3623 | 24458 | NM_022706 | b | GABA(A) receptor-associated protein like 2 | GABA(A) receptor-associated protein like 2 |
| 3631 | 6891 | NM_022934 | t, gg, hh | DnaJ-like protein | DnaJ-like protein |
| 3640 | 20681 | NM_022952 | u | clathrin-associated protein 17 | clathrin-associated protein 17 |
| 3658 | 15367 | NM_024149 | r | ADP-ribosylation factor 5 | ADP-ribosylation factor 5 |
| 3660 | 21696 | NM_024152 | f, oo | ADP-ribosylation factor 6 | ADP-ribosylation factor 6 |
| 3683 | 23386 | NM_024404 | gg, hh | RNA binding protein p45AUF1 | RNA binding protein p45AUF1 |
| 3683 | 25682 | NM_024404 | c, w | RNA binding protein p45AUF1 | RNA binding protein p45AUF1 |
| 3694 | 1995 | NM_030850 | d, h, uu | betaine-homocysteine methyltransferase | betaine-homocysteine methyltransferase |
| 3696 | 15186 | NM_030861 | g, p, General, rr | N-acetylglucosaminyltransferase I | N-acetylglucosaminyltransferase I |
| 3696 | 15187 | NM_030861 | n, z, General, rr | N-acetylglucosaminyltransferase I | N-acetylglucosaminyltransferase I |
| 3696 | 15188 | NM_030861 | d, s, General | N-acetylglucosaminyltransferase I | N-acetylglucosaminyltransferase I |
| 3698 | 21800 | NM_030987 | r, w, z | Guanine nucleotide-binding protein beta 1 | Guanine nucleotide-binding protein beta 1 |
| 3698 | 21801 | NM_030987 | gg, hh | Guanine nucleotide-binding protein beta 1 | Guanine nucleotide-binding protein beta 1 |
| 3698 | 21806 | NM_030987 | s, u | Guanine nucleotide-binding protein beta 1 | Guanine nucleotide-binding protein beta 1 |
| 3708 | 17302 | NM_031008 | tt | alpha-c large chain of the protein complex AP-2 associated with clathrin | alpha-c large chain of the protein complex AP-2 associated with clathrin |
| 3711 | 1538 | NM_031012 | k, mm | alanyl (membrane) aminopeptidase | alanyl (membrane) aminopeptidase |
| 3711 | 1540 | NM_031012 | n, dd, ee | alanyl (membrane) aminopeptidase | alanyl (membrane) aminopeptidase |
| 3716 | 16560 | NM_031020 | t | p38 mitogen activated protein kinase | p38 mitogen activated protein kinase |
| 3716 | 16562 | NM_031020 | l, p, ss, uu | p38 mitogen activated protein kinase | p38 mitogen activated protein kinase |
| 3716 | 16564 | NM_031020 | k, l | p38 mitogen activated protein kinase | p38 mitogen activated protein kinase |
| 3716 | 16565 | NM_031020 | t | p38 mitogen activated protein kinase | p38 mitogen activated protein kinase |
| 3719 | 16210 | NM_031026 | r, w | LIC-2 dynein light intermediate chain 53/55 | LIC-2 dynein light intermediate chain 53/55 |
| 3729 | 15137 | NM_031051 | w, y, ee, tt | macrophage migration inhibitory factor | macrophage migration inhibitory factor |
| 3730 | 11899 | NM_031052 | rr | mitochondrial intermediate peptidase | mitochondrial intermediate peptidase |
| 3739 | 6348 | NM_031077 | mm | PCTAIRE-1 protein kinase alternatively spliced | PCTAIRE-1 protein kinase, alternatively spliced |
| 3742 | 17173 | NM_031090 | u, cc | ras related protein | ras related protein |
| 3747 | 20812 | NM_031100 | y, ee | ribosomal protein L10 | ribosomal protein L10 |
| 3752 | 20807 | NM_031106 | h | ribosomal protein L37 | ribosomal protein L37 |
| 3755 | 10878 | NM_031110 | j, General | ribosomal protein S11 | ribosomal protein S11 |
| 3760 | 16671 | NM_031125 | tt | syntaxin 4 | syntaxin 4 |
| 3765 | 15487 | NM_031137 | q, ww | tripeptidylpeptidase II | tripeptidylpeptidase II |
| 3765 | 15489 | NM_031137 | bb, ll, ww | tripeptidylpeptidase II | tripeptidylpeptidase II |
| 3766 | 17378 | NM_031138 | q | ubiquitin conjugating enzyme | ubiquitin conjugating enzyme |
| 3766 | 17379 | NM_031138 | General | ubiquitin conjugating enzyme | ubiquitin conjugating enzyme |
| 3769 | 23097 | NM_031145 | h, bb | calcium- and integrin-binding protein | calcium- and integrin-binding protein |
| 3772 | 164 | NM_031151 | v | malate dehydrogenase mitochondrial | malate dehydrogenase mitochondrial |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3773 | 238 | NM_031152 | ee | RAB11a, member RAS oncogene family | RAB11a, member RAS oncogene family |
| 3773 | 240 | NM_031152 | x | RAB11a, member RAS oncogene family | RAB11a, member RAS oncogene family |
| 3777 | 15277 | NM_031237 | n | ubiquitin-conjugating enzyme E2D 3 (homologous to yeast UBC4/5) | ubiquitin-conjugating enzyme E2D 3 (homologous to yeast UBC4/5) |
| 3787 | 15360 | NM_031335 | p, v | polymerase II | EST, Moderately similar to RPB6_RAT DNA-directed RNA polymerase II 14.4 kDa polypeptide (RPB6) (RPB14.4) [*R. norvegicus*], polymerase II |
| 3811 | 1822 | NM_031553 | c, ww | CCAAT binding transcription factor of CBF-B/NFY-B | CCAAT binding transcription factor of CBF-B/NFY-B |
| 3830 | 20840 | NM_031604 | d | ATPase, H+ transporting, lysosomal (vacuolar proton pump) noncatalytic accessory protein 1 (110/160 kDa) | ATPase, H+ transporting, lysosomal (vacuolar proton pump) noncatalytic accessory protein 1 (110/160 kDa) |
| 3830 | 20841 | NM_031604 | bb | ATPase, H+ transporting, lysosomal (vacuolar proton pump) noncatalytic accessory protein 1 (110/160 kDa) | ATPase, H+ transporting, lysosomal (vacuolar proton pump) noncatalytic accessory protein 1 (110/160 kDa) |
| 3885 | 20752 | NM_031763 | ii | platelet-activating factor acetylhydrolase beta subunit (PAF-AH beta) | platelet-activating factor acetylhydrolase beta subunit (PAF-AH beta) |
| 3885 | 20753 | NM_031763 | l, General, dd, pp | platelet-activating factor acetylhydrolase beta subunit (PAF-AH beta) | platelet-activating factor acetylhydrolase beta subunit (PAF-AH beta) |
| 3892 | 16178 | NM_031785 | ii | ATPase, H+ transporting, lysosomal (vacuolar proton pump), subunit 1 | ATPase, H+ transporting, lysosomal (vacuolar proton pump), subunit 1 |
| 3893 | 1169 | NM_031789 | d, w, bb, ll | NF-E2-related factor 2 | NF-E2-related factor 2 |
| 3893 | 1170 | NM_031789 | d, ll | NF-E2-related factor 2 | NF-E2-related factor 2 |
| 3908 | 10267 | NM_031838 | h | ribosomal protein S2 | ribosomal protein S2 |
| 3908 | 10269 | NM_031838 | w | ribosomal protein S2 | ribosomal protein S2 |
| 3909 | 10949 | NM_031839 | rr | arachidonic acid epoxygenase | arachidonic acid epoxygenase |
| 3914 | 22301 | NM_031967 | d | development-related protein | development-related protein |
| 3926 | 19768 | NM_031986 | pp | syntenin | syntenin |
| 3933 | 1573 | NM_032083 | bb, ss | chimerin (chimaerin) 1 | chimerin (chimaerin) 1 |
| 3947 | 1410 | NM_052798 | o | zinc finger protein 354A | zinc finger protein 354A |
| 3978 | 23811 | NM_053436 | ww | staufen (*Drosophila*, RNA-binding protein) | staufen (*Drosophila*, RNA-binding protein) |
| 3980 | 14670 | NM_053439 | ee | RAN, member RAS oncogene family | RAN, member RAS oncogene family |
| 4010 | 20902 | NM_053593 | cc | cyclin-dependent kinase 4 | cyclin-dependent kinase 4 |
| 4026 | 20951 | NM_053651 | nn | NK2 transcription factor related, locus 5 (*Drosophila*) | NK2 transcription factor related, locus 5 (*Drosophila*) |
| 4032 | 15735 | NM_053665 | n, ee | A kinase (PRKA) anchor protein 1 | A kinase (PRKA) anchor protein 1 |
| 4032 | 15738 | NM_053665 | cc | A kinase (PRKA) anchor protein 1 | A kinase (PRKA) anchor protein 1 |
| 4043 | 10909 | NM_053756 | o | ATP synthase, H+ transporting, mitochondrial F0 complex, subunit c (subunit 9) isoform 3 | ATP synthase, H+ transporting, mitochondrial F0 complex, subunit c (subunit 9) isoform 3 |
| 4047 | 14015 | NM_053770 | n, w | Arg/Abl-interacting protein ArgBP2 | Arg/Abl-interacting protein ArgBP2 |
| 4047 | 14016 | NM_053770 | xx | Arg/Abl-interacting protein ArgBP2 | Arg/Abl-interacting protein ArgBP2 |
| 4050 | 6290 | NM_053795 | tt | kinase D-interacting substance of 220 kDa | kinase D-interacting substance of 220 kDa |
| 4055 | 16921 | NM_053806 | gg, hh, jj | | ESTs, Weakly similar to S18140 hypoxanthine phosphoribosyltransferase (EC 2.4.2.8) - rat [*R. norvegicus*] |
| 4055 | 19827 | NM_053806 | oo | | ESTs, Weakly similar to OZF_RAT Zinc finger protein OZF (POZF-1) [*R. norvegicus*] |
| 4059 | 20421 | NM_053821 | a, vv | v-ral simian leukemia viral oncogene homolog B (ras related) | v-ral simian leukemia viral oncogene homolog B (ras related) |
| 4060 | 6110 | NM_053824 | x | casein kinase II, alpha 1 polypeptide | casein kinase II, alpha 1 polypeptide |
| 4061 | 1601 | NM_053826 | t | pyruvate dehydrogenase kinase, isoenzyme 1 | pyruvate dehydrogenase kinase, isoenzyme 1 |
| 4070 | 1570 | NM_053857 | k, l, m, General | eukaryotic translation initiation factor 4E binding protein 1 | eukaryotic translation initiation factor 4E binding protein 1 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4070 | 1571 | NM_053857 | l, m, q, General, dd | eukaryotic translation initiation factor 4E binding protein 1 | eukaryotic translation initiation factor 4E binding protein 1 |
| 4071 | 18358 | NM_053864 | x | valosin-containing protein | valosin-containing protein |
| 4076 | 1453 | NM_053887 | ff | mitogen activated protein kinase kinase kinase 1 | mitogen activated protein kinase kinase kinase 1 |
| 4076 | 1454 | NM_053887 | gg, hh | mitogen activated protein kinase kinase kinase 1 | mitogen activated protein kinase kinase kinase 1 |
| 4077 | 1660 | NM_053891 | bb, ll, ww | cyclin dependent kinase 5, regulatory subunit 1 (p35) | cyclin-dependent kinase 5, regulatory subunit 1 (p35) |
| 4078 | 16147 | NM_053892 | y | phospholipase A2, group VI | phospholipase A2, group VI |
| 4090 | 16190 | NM_053961 | o | | ESTs, Weakly similar to F Chain F, 2-Enoyl-Coa Hydratase, Data Collected At 100 K, Ph 6.5 [*N. norvegicus*] |
| 4091 | 16546 | NM_053965 | o, ii | solute carrier family 25 (carnitine/acylcarnitine translocase), member 20 | solute carrier family 25 (carnitine/acylcarnitine translocase), member 20 |
| 4091 | 16547 | NM_053965 | o | solute carrier family 25 (carnitine/acylcarnitine translocase), member 20 | solute carrier family 25 (carnitine/acylcarnitine translocase), member 20 |
| 4094 | 17279 | NM_053977 | t, mm | cadherin 17 | cadherin 17 |
| 4094 | 17280 | NM_053977 | mm | cadherin 17 | cadherin 17 |
| 4095 | 15325 | NM_053979 | j | ADP-ribosylation factor-like 5 | ADP-ribosylation factor-like 5 |
| 4101 | 17739 | NM_053995 | h, General, qq | 3-hydroxybutyrate dehydrogenase (heart, mitochondrial) | 3-hydroxybutyrate dehydrogenase (heart, mitochondrial) |
| 4109 | 16043 | NM_057100 | jj | | ESTs, Highly similar to growth arrest specific 6 [*Rattus norvegicus*] [*R. norvegicus*] |
| 4110 | 17709 | NM_057101 | y | Tenascin X | Tenascin X |
| 4116 | 23310 | NM_057119 | w | splicing factor, arginine/serine-rich (transformer 2 *Drosophila* homolog) 10 | splicing factor, arginine/serine-rich (transformer 2 *Drosophila* homolog) 10 |
| 4123 | 15839 | NM_057143 | bb, kk | fertility protein SP22 | fertility protein SP22 |
| 4127 | 18122 | NM_057208 | ee | tropomyosin 3, gamma | tropomyosin 3, gamma |
| 4129 | 3831 | NM_057213 | e, General, cc, qq | ATPase, H+ transporting, lysosomal (vacuolar proton pump), beta 56/58 kDa, isoform 2 | ATPase, H+ transporting, lysosomal (vacuolar proton pump), beta 56/58 kDa, isoform 2 |
| 4144 | 9952 | NM_080902 | xx | hypoxia induced gene 1 | hypoxia induced gene 1 |
| 4154 | 18810 | NM_130430 | w, ss | mitochondrial H+-ATP synthase alpha subunit | mitochondrial H+-ATP synthase alpha subunit |
| 4160 | 7864 | NM_130823 | c, gg, hh, oo, qq | ATPase, H+ transporting, lysosomal (vacuolar proton pump) 16 kDa | ATPase, H+ transporting, lysosomal (vacuolar proton pump) 16 kDa |
| 4170 | 505 | NM_133309 | ss | calpain 8 | calpain 8 |
| 4173 | 252 | NM_133323 | d | zinc finger protein 111 | zinc finger protein 111 |
| 4180 | 10660 | NM_133423 | r, w | splicing factor YT521-B | splicing factor YT521-B |
| 4181 | 16736 | NM_133427 | j | flavohemoprotein b5 + b5R | flavohemoprotein b5 + b5R |
| 4182 | 5686 | NM_133428 | dd | histidine-rich glycoprotein | histidine-rich glycoprotein |
| 4186 | 1791 | NM_133541 | ww | general transcription factor III C 1 | general transcription factor III C 1 |
| 4189 | 1558 | NM_133554 | e, pp | solute carrier family 17 vesicular glutamate transporter), member 1 | solute carrier family 17 vesicular glutamate transporter), member 1 |
| 4189 | 1559 | NM_133554 | e | solute carrier family 17 vesicular glutamate transporter) member 1 | solute carrier family 17 vesicular glutamate transporter), member 1 |
| 4191 | 745 | NM_133567 | cc | centaurin, alpha 1 | centaurin, alpha 1 |
| 4193 | 16993 | NM_133583 | a, d, m | N-myc downstream regulated gene 2 | N-myc downstream-regulated gene 2 |
| 4193 | 15029 | NM_133583 | oo | N-myc downstream-regulated gene 2 | N-myc downstream-regulated gene 2 |
| 4194 | 1164 | NM_133584 | g | phosphodiesterase 5A, cGMP-specific | phosphodiesterase 5A, cGMP-specific |
| 4195 | 4312 | NM_133586 | y, rr, ww | carboxylesterase 2 (intestine, liver) | carboxylesterase 2 (intestine, liver) |
| 4196 | 19822 | NM_133590 | x | Ras-related GTP-binding protein Rab29 | Ras-related GTP-binding protein Rab29 |
| 4197 | 1308 | NM_133591 | e | rabphilin 3A-like (without C2 domains) | rabphilin 3A-like (without C2 domains) |
| 4202 | 25200 | NM_133610 | cc | potassium voltage-gated channel, subfamily H (eag-related), member 5 | potassium voltage-gated channel, subfamily H (eag-related), member 5 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4213 | 8692 | NM_134387 | e | diacetyl/L-xylulose reductase | diacetyl/L-xylulose reductase |
| 4215 | 3074 | NM_134399 | kk | Mk1 protein | Mk1 protein |
| 4217 | 23321 | NM_134407 | ss | aldo-keto reductase family 7, member A2 (aflatoxin aldehyde reductase) | aldo-keto reductase family 7, member A2 (aflatoxin aldehyde reductase) |
| 4224 | 1440 | NM_134456 | u | SH2-B PH domain containing signaling mediator 1 | SH2-B PH domain containing signaling mediator 1 |
| 4225 | 1373 | NM_134468 | n | calcium/calmodulin-dependent protein kinase I | calcium/calmodulin-dependent protein kinase I |
| 4229 | 61 | NM_138510 | u | 20 alpha-hydroxysteroid dehydrogenase | 20 alpha-hydroxysteroid dehydrogenase |
| 4235 | 5283 | NM_138535 | xx | glutamate receptor interacting protein 2 | glutamate receptor interacting protein 2 |
| 4237 | 16922 | NM_138549 | x | synaptic glycoprotein SC2 | synaptic glycoprotein SC2 |
| 4237 | 25479 | NM_138549 | e, x | synaptic glycoprotein SC2 | synaptic glycoprotein SC2 |
| 4247 | 891 | NM_138863 | x, bb | dithiolethione-inducible gene-1 | dithiolethione-inducible gene-1 |
| 4254 | 5655 | NM_138885 | f, q, ff | golgi-associated protein GCP360 | golgi-associated protein GCP360 |
| 4254 | 5656 | NM_138885 | d, q | golgi-associated protein GCP360 | golgi-associated protein GCP360 |
| 4255 | 3015 | NM_138895 | h, w | polyubiquitin | polyubiquitin |
| 4256 | 7636 | NM_138896 | s | rotein carrying the RING-H2 sequence motif | rotein carrying the RING-H2 sequence motif |
| 4259 | 17115 | NM_138905 | l, m, General, kk | ER transmembrane protein DRi 42 | ER transmembrane protein Dri 42 |
| 4261 | 21915 | NM_138910 | dd | defender against cell death 1 | defender against cell death 1 |
| 4261 | 21916 | NM_138910 | ll | defender against cell death 1 | defender against cell death 1 |
| 4269 | 734 | NM_139094 | d | CTD-binding SR-like protein rA8 | CTD-binding SR-like protein rA8 |
| 4270 | 17119 | NM_139098 | p | RNA helicase | RNA helicase |
| 4277 | 15023 | NM_139113 | n, z, General, kk, pp | nuclear receptor subfamily 2, group F, member 6 | nuclear receptor subfamily 2, group F, member 6 |
| 4278 | 15239 | NM_139114 | h, l, v, General | ribosomal protein L15 | ribosomal protein L15 |
| 4281 | 22970 | NM_139254 | c, d, u | tubulin, beta 3 | tubulin, beta 3 |
| 4285 | 1962 | NM_139329 | ii | CCA2 protein | CCA2 protein |
| 4287 | 4949 | NM_139338 | s | Na+/Pi-cotransporter type IIc | *Rattus norvegicus* mRNA for Na+/Pi-cotransporter type IIc, complete cds |
| 4290 | 15703 | NM_144750 | f, n, gg, hh, pp | Lysophospholipase | *Rattus norvegicus* mRNA for Lysophospholipase, complete cds |
| 4291 | 11493 | NM_144755 | f, q, z, dd, oo, qq | | ESTs, Weakly similar to A53621 AMP-activated protein kinase - rat [*R. norvegicus*] |
| 4291 | 11494 | NM_144755 | f, l, q, v, z, General, dd, oo | | ESTs, Weakly similar to A53621 AMP-activated protein kinase - rat [*R. norvegicus*] |
| 4292 | 1623 | NM_144757 | s | Cys2/His2 zinc finger protein (rKr1) | *Rattus norvegicus* Cys2/His2 zinc finger protein (rKr1) mRNA, complete cds |
| 4296 | 1949 | NM_145092 | f, l, ii, nn | | *Rattus norvegicus* lamina associated polypeptide 1C (LAP1C) mRNA, complete cds, *Rattus norvegicus* lamina-associated polypeptide 1C (LAP1C) mRNA, complete cds |
| 4298 | 1562 | NM_145097 | j, o, x, uu | | *Rattus norvegicus* kallistatin mRNA, complete cds |
| 4302 | 16343 | NM_145724 | uu | | *Rattus norvegicus* zinc finger protein Y1 (RLZF-Y) mRNA, complete cds |
| 4302 | 16345 | NM_145724 | j, uu | | *Rattus norvegicus* zinc finger protein Y1 (RLZF-Y) mRNA, complete cds |
| 4303 | 22975 | NM_145778 | ii | | *Rattus norvegicus* mRNA for tubulin, complete cds |
| 4338 | 18647 | S69316 | q, dd | | ESTs, Weakly similar to HS9B_RAT Heat shock protein HSP 90-beta (HSP 84) [*R. norvegicus*] |
| 4345 | 1460 | S76054 | t, General, ll, ww | | ESTs, Highly similar to K2C8_RAT Keratin, type II cytoskeletal 8 (Cytokeratin 8) (Cytokeratin endo A) [*R. norvegicus*] |
| 4348 | 17626 | S78556 | qq | | ESTs, Highly similar to I56581 dnaK-type molecular chaperone grp75 precursor - rat [*R. norvegicus*] |
| 4354 | 110 | U01145 | l, General, kk | | *Rattus norvegicus* clone 15 polymeric immunoglobulin receptor mRNA, 3'UTR microsatellite repeats |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4356 | 347 | U01914 | s, tt | A kinase anchor protein 8 | A kinase anchor protein 8 |
| 4357 | 111 | U02506 | b, General, kk, vv | | *Rattus norvegicus* clone 15 polymeric immunoglobulin receptor mRNA, 3'UTR microsatellite repeats |
| 4358 | 2010 | U05675 | y, vv | | *Rattus norvegicus* Sprague-Dawley fibrinogen B beta chain mRNA, complete cds |
| 4370 | 399 | U31668 | ww, xx | E2F transcription factor 5 | E2F transcription factor 5 |
| 4375 | 1357 | U39572 | mm | phosphatidylinositol 4-kinase | phosphatidylinositol 4-kinase |
| 4376 | 18038 | U39943 | x | | *Rattus norvegicus* cytochrome P450 pseudogene (CYP2J3P1) mRNA |
| 4386 | 15516 | U68544 | b | | *Rattus norvegicus* cyclophilin D mRNA, nuclear gene encoding mitochondrial protein, complete cds |
| 4398 | 1153 | U89280 | h, n | | *Rattus norvegicus* oxidative 17 beta hydroxysteroid dehydrogenase type 6 mRNA, complete cds |
| 4400 | 9841 | U94856 | w | paraoxonase 1 | paraoxonase 1 |
| 4400 | 9842 | U94856 | pp | paraoxonase 1 | paraoxonase 1 |
| 4414 | 19584 | X13905 | General, mm | | ESTs, Moderately similar to TVRTYP GTP-binding protein Rab1 - rat [*R. norvegicus*] |
| 4440 | 18924 | X58830 | g | Bone morphogenetic protein 6 | Bone morphogenetic protein 6 |
| 4446 | 4441 | X62146 | ee | | ESTs, Highly similar to RL11_HUMAN 60S ribosomal protein L11 [*R. norvegicus*] |
| 4447 | 13646 | X62166 | l, m, s, z, General, bb, cc, ii, qq, rr | | ESTs, Highly similar to RL3_RAT 60S RIBOSOMAL PROTEIN L3 (L4) [*R. norvegicus*] |
| 4448 | 15387 | X62482 | h, gg, hh | | ESTs, Highly similar to R3RT25 ribosomal protein S25, cytosolic [validated] - rat [*R. norvegicus*] |
| 4455 | 20844 | X65228 | y, ll | | ESTs, Highly similar to R3RT3A ribosomal protein L23a, cytosolic [validated] - rat [*R. norvegicus*] |
| 4464 | 23302 | X78949 | ff, xx | prolyl 4-hydroxylase alpha subunit | prolyl 4-hydroxylase alpha subunit |
| 4473 | 18031 | X94551 | y | laminin, gamma 1 | laminin, gamma 1 |
| 250 | 10157 | AA819527 | rr | HHs:amyloid beta (A4) precursor protein (protease nexin-II, Alzheimer disease) | ESTs, Highly similar to S23094 beta-amyloid protein precursor - rat [*R. norvegicus*] |
| 2352 | 10156 | AI178039 | bb | HHs:amyloid beta (A4) precursor protein (protease nexin-II, Alzheimer disease) | ESTs, Highly similar to S23094 beta-amyloid protein precursor - rat [*R. norvegicus*] |
| 4410 | 10154 | X07648 | m | HHs:amyloid beta (A4) precursor protein (protease nexin-II, Alzheimer disease) | ESTs, Highly similar to S23094 beta-amyloid protein precursor - rat [*R. norvegicus*] |
| 4424 | 20872 | X51707 | h | ribosomal protein S19 | ESTs, Highly similar to R3RT19 ribosomal protein S19, cytosolic [validated] - rat [*R. norvegicus*] |
| 2218 | 18498 | AI172452 | m, ii, ll, uu | | ESTs, Weakly similar to COXJ_RAT Cytochrome c oxidase polypeptide VIIa-liver/heart, mitochondrial precursor (Cytochrome c oxidase subunit VIIa-L) [*R. norvegicus*] |
| 2324 | 16175 | AI177145 | w | | ESTs, Weakly similar to CAG7_RAT ALPHA-N-ACETYLGALACTOSAMINIDE ALPHA-2,6-SIALYLTRANSFERASE (ST6GALNACIII) (STY) [*R. norvegicus*] |
| 2398 | 12033 | AI179066 | ee | | ESTs, Highly similar to SL52_RAT SODIUM/GLUCOSE COTRANSPORTER 2 (NA(+)/GLUCOSE COTRANSPORTER 2) (LOW AFFINITY SODIUM-GLUCOSE COTRANSPORTER) [*R. norvegicus*] |
| 2556 | 20055 | AI230762 | rr | | ESTs, Weakly similar to A53742 calponin, acidic - rat [*R. norvegicus*] |
| 2607 | 18497 | AI232307 | c | | ESTs, Weakly similar to COXJ_RAT Cytochrome c oxidase polypeptide VIIa-liver/heart, mitochondrial precursor (Cytochrome c oxidase subunit VIIa-L) [*R. norvegicus*] |
| 3501 | 22726 | NM_019383 | r | ATP synthase subunit d | ATP synthase subunit d |
| 3608 | 2250 | NM_022643 | c, d, m, cc, kk, qq, vv | | ESTs, Highly similar to 0506206A histone H2B [*Rattus norvegicus*] [*R. norvegicus*] |
| 3756 | 19161 | NM_031111 | j, ee | ribosomal protein S21 | ribosomal protein S21 |
| 4097 | 15468 | NM_053982 | h, gg, hh | ribosomal protein S15a | ribosomal protein S15a |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4097 | 19544 | NM_053982 | h, l, qq | | EST, Moderately similar to JC2234 ribosomal protein S15a, cytosolic [validated] - rat [*N. norvegicus*] |
| 4299 | 9845 | NM_145672 | m | | ESTs, Weakly similar to JN0572 neutrophil chemo-attractant Gro protein precursor - rat [*R. norvegicus*] |
| 4428 | 16716 | X53054 | c | | Rat mRNA for RT1.D beta chain |
| 488 | 4339 | AA875121 | d | CCAAT binding factor of CBF-C/NFY-C | CCAAT binding factor of CBF-C/NFY-C |
| 1304 | 17353 | AI008020 | o | Malic enzyme 1, soluble | Malic enzyme 1, soluble |
| 1681 | 8330 | AI059434 | g | peroxisome proliferative activated receptor, gamma, coactivator 1 | peroxisome proliferative activated receptor, gamma, coactivator 1 |
| 1829 | 18838 | AI101102 | ee | Prosaposin (sulfated glycoprotein, sphingolipid hydrolase activator) | Prosaposin (sulfated glycoprotein, sphingolipid hydrolase activator) |
| 1890 | 11486 | AI103162 | j | Glycoprotein-4-beta-galactosyltransferase 2 | Glycoprotein-4-beta-galactosyltransferase 2 |
| 2112 | 6479 | AI169690 | h, l, q | Fibrinogen, gamma polypeptide | Fibrinogen, gamma polypeptide |
| 2455 | 21296 | AI227641 | j | Myosin, light polypeptide 2, alkali; ventricular, skeletal, slow | Myosin, light polypeptide 2, alkali; ventricular, skeletal, slow |
| 2552 | 13618 | AI230724 | kk, tt | SAC1 (supressor of actin mutations 1, homolog)-like (*S. cerevisiae*) | SAC1 (supressor of actin mutations 1, homolog)-like (*S. cerevisiae*) |
| 2724 | 21414 | AI235842 | x | Superoxide dismutase 2, mitochondrial | Superoxide dismutase 2, mitochondrial |
| 2961 | 790 | L10073 | g | 5-hydroxytryptamine (serotonin) receptor 5B, ERO1-like (*S. cerevisiae*), Lysosomal associated membrane protein 1 (120 kDa), apoptotic protease activating factor 1, ceroid-lipofuscinosis, neuronal 2, cysteine-sulfinate decarboxylase | 5-hydroxytryptamine (serotonin) receptor 5B |
| 2969 | 16119 | L16532 | q | 2',3'-Cyclic nucleotide 3'-phosphodiesterase | 2',3'- Cyclic nucleotide 3'-phosphodiesterase |
| 2992 | 21053 | M15481 | qq | Insulin-like growth factor I | Insulin-like growth factor I |
| 3071 | 6477 | NM_012559 | dd | Fibrinogen, gamma polypeptide | Fibrinogen, gamma polypeptide |
| 3073 | 619 | NM_012565 | h, r, kk | Glucokinase | Glucokinase |
| 3076 | 20744 | NM_012571 | e, ll, oo | Glutamic-oxaloacetic transaminase 1, soluble (aspartate aminotransferase, cytosolic) see also D1Mgh12 | Glutamic-oxaloacetic transaminase 1, soluble (aspartate aminotransferase, cytosolic) see also D1Mgh12 |
| 3087 | 18746 | NM_012600 | gg, hh | Malic enzyme 1, soluble | Malic enzyme 1, soluble |
| 3090 | 9174 | NM_012612 | g | Natriuretic peptide precursor A, (pronatriodilatin, also Anf, Pnd) | Natriuretic peptide precursor A, (pronatriodilatin, also Anf, Pnd) |
| 3102 | 16198 | NM_012663 | kk, tt | Vesicle-associated membrane protein (synaptobrevin 2) | Vesicle-associated membrane protein (synaptobrevin 2) |
| 3102 | 16199 | NM_012663 | bb, kk | Vesicle-associated membrane protein (synaptobrevin 2) | Vesicle-associated membrane protein (synaptobrevin 2) |
| 3102 | 16200 | NM_012663 | ii | Vesicle-associated membrane protein (synaptobrevin 2) | Vesicle-associated membrane protein (synaptobrevin 2) |
| 3119 | 503 | NM_012704 | k | Rat kidney prostaglandin EP3 receptor | Rat kidney prostaglandin EP3 receptor |
| 3121 | 24545 | NM_012713 | s | Protein kinase C beta | Protein kinase C beta |
| 3131 | 1260 | NM_012743 | d | Hepatocyte nuclear factor 3 beta | Hepatocyte nuclear factor 3 beta |
| 3154 | 11138 | NM_012839 | jj | Cytochrome C, expressed in somatic tissues | Cytochrome C, expressed in somatic tissues |
| 3162 | 395 | NM_012864 | v | Matrix metalloproteinase 7 (matrilysin) | Matrix metalloproteinase 7 (matrilysin) |
| 3163 | 4338 | NM_012866 | ll | CCAAT binding factor of CBF-C/NFY-C | CCAAT binding factor of CBF-C/NFY-C |
| 3188 | 1720 | NM_012943 | cc | Distal-less homeobox | Distal-less homeobox |
| 3205 | 19391 | NM_012998 | t, y, mm | Protein disulfide isomerase (Prolyl 4-hydroxylase, beta polypeptide) | Protein disulfide isomerase (Prolyl 4-hydroxylase, beta polypeptide) |
| 3205 | 19392 | NM_012998 | j, gg, hh | Protein disulfide isomerase (Prolyl 4 hydroxylase, beta polypeptide) | Protein disulfide isomerase (Prolyl 4-hydroxylase, beta polypeptide) |
| 3205 | 19393 | NM_012998 | gg, hh, ll | Protein disulfide isomerase (Prolyl 4-hydroxylase, beta polypeptide) | Protein disulfide isomerase (Prolyl 4-hydroxylase, beta polypeptide) |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3209 | 23543 | NM_013013 | w, y | Prosaposin (sulfated glycoprotein, sphingolipid hydrolase activator) | Prosaposin (sulfated glycoprotein, sphingolipid hydrolase activator) |
| 3209 | 23544 | NM_013013 | c | Prosaposin (sulfated glycoprotein, sphingolipid hydrolase activator) | Prosaposin (sulfated glycoprotein, sphingolipid hydrolase activator) |
| 3211 | 208 | NM_013025 | vv | Macrophage inflammatory protein 1 alpha (Small inducible cytokine A3) | Macrophage inflammatory protein 1 alpha (Small inducible cytokine A3) |
| 3233 | 1583 | NM_013079 | a, m, s, General, dd | Asparagine synthetase | Asparagine synthetase |
| 3306 | 910 | NM_017059 | bb, ss | Bcl2-associated X protein | Bcl2-associated X protein |
| 3306 | 911 | NM_017059 | ss | Bcl2-associated X protein | Bcl2-associated X protein |
| 3306 | 912 | NM_017059 | qq | Bcl2-associated X protein | Bcl2-associated X protein |
| 3336 | 20859 | NM_017144 | cc | Troponin I | Troponin I |
| 3357 | 1541 | NM_017193 | ee | kynurenine aminotransferase II | kynurenine aminotransferase II |
| 3364 | 13938 | NM_017212 | g | microtubule-associated protein tau | microtubule-associated protein tau |
| 3398 | 12347 | NM_017290 | jj | ATPase, Ca++ transporting, cardiac muscle, slow twitch 2 | ATPase, Ca++ transporting, cardiac muscle, slow twitch 2 |
| 3398 | 12348 | NM_017290 | ff, pp | ATPase, Ca++ transporting, cardiac muscle, slow twitch 2 | ATPase, Ca++ transporting, cardiac muscle, slow twitch 2 |
| 3398 | 12349 | NM_017290 | l | ATPase, Ca++ transporting, cardiac muscle, slow twitch 2 | ATPase, Ca++ transporting, cardiac muscle, slow twitch 2 |
| 3459 | 5661 | NM_019241 | u | gap junction membrane channel protein beta 5 | gap junction membrane channel protein beta 5 |
| 3492 | 1070 | NM_019368 | f, q, z | blocked early in transport I homolog (S. cerevisiae) - like | blocked early in transport 1 homolog (S. cerevisiae) - like |
| 3497 | 15680 | NM_019376 | ii, ll | 14-3-3 protein gamma-subtype | 14-3-3 protein gamma-subtype |
| 3508 | 15911 | NM_019907 | ww | postsynaptic protein Cript | postsynaptic protein Cript |
| 3516 | 15335 | NM_021264 | General, kk | ribosomal protein L35a | ribosomal protein L35a |
| 3540 | 23151 | NM_022005 | e | FXYD domain-containing ion transport regulator 6 | FXYD domain-containing ion transport regulator 6 |
| 3585 | 25681 | NM_022519 | r | serine (or cysteine) proteinase inhibitor, clade A (alpha-1 antiproteinase, antitrypsin), member 1 | serine (or cysteine) proteinase inhibitor, clade A (alpha-1 antiproteinase, antitrypsin), member 1 |
| 3585 | 4212 | NM_022519 | e | serine (or cysteine) proteinase inhibitor, clade A (alpha-1 antiproteinase, antitrypsin), member 1 | serine (or cysteine) proteinase inhibitor, clade A (alpha-1 antiproteinase, antitrypsin), member 1 |
| 3585 | 4213 | NM_022519 | ee | serine (or cysteine) proteinase inhibitor, clade A (alpha-1 antiproteinase, antitrypsin), member 1 | serine (or cysteine) proteinase inhibitor, clade A (alpha-1 antiproteinase, antitrypsin), member 1 |
| 3590 | 5666 | NM_022529 | r | mitochondrial ribosomal protein L23 | mitochondrial ribosomal protein L23 |
| 3626 | 58 | NM_022715 | nn | major vault protein | major vault protein |
| 3636 | 18098 | NM_022947 | oo | suppressor of K+ transport defect 3 | suppressor of K+ transport defect 3 |
| 3642 | 15755 | NM_022960 | k | neutral solute channel aquaporin 9 | neutral solute channel aquaporin 9 |
| 3703 | 248 | NM_030998 | gg, hh | anti-Mullerian hormone type 2 receptor | anti-Mullerian hormone type 2 receptor |
| 3720 | 15805 | NM_031028 | g | gamma-aminobutyric acid (GABA) B receptor, 1 | gamma-aminobutyric acid (GABA) B receptor, 1 |
| 3720 | 15807 | NM_031028 | s | gamma-aminobutyric acid (GABA) B receptor, 1 | gamma-aminobutyric acid (GABA) B receptor, 1 |
| 3799 | 24710 | NM_031512 | vv | Interleukin 1 beta | Interleukin 1 beta |
| 3807 | 4010 | NM_031543 | e, r | Cytochrome P450, subfamily 2e1 (ethanol-inducible) | Cytochrome P450, subfamily 2e1 (ethanol-inducible) |
| 3807 | 4011 | NM_031543 | j, w | Cytochrome P450, subfamily 2e1 (ethanol-inducible) | Cytochrome P450, subfamily 2e1 (ethanol-inducible) |
| 3807 | 4012 | NM_031543 | e, rr | Cytochrome P450, subfamily 2e1 (ethanol-inducible) | Cytochrome P450, subfamily 2e1 (ethanol-inducible) |
| 3818 | 1920 | NM_031576 | c, cc | P450 (cytochrome) oxidoreductase | P450 (cytochrome) oxidoreductase |
| 3819 | 939 | NM_031577 | z | growth hormone releasing hormone | growth hormone releasing hormone |
| 3827 | 14542 | NM_031596 | u | squamous cell carcinoma antigen recognized by T-cells | squamous cell carcinoma antigen recognized by T-cells |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3827 | 14543 | NM_031596 | jj | squamous cell carcinoma antigen recognized by T-cells | squamous cell carcinoma antigen recognized by T-cells |
| 3843 | 906 | NM_031633 | ss | forkhead box M1 | forkhead box M1 |
| 3848 | 9427 | NM_031656 | c, kk | syntaxin-like protein 3I35 | syntaxin-like protein 3I35 |
| 3848 | 9428 | NM_031656 | p | syntaxin-like protein 3I35 | syntaxin-like protein 3I35 |
| 3850 | 20467 | NM_031662 | r, ee | calcium/calmodulin-dependent protein kinase kinase 1, alpha | calcium/calmodulin-dependent protein kinase kinase 1, alpha |
| 3852 | 23656 | NM_031673 | bb | calpain 10 | calpain 10 |
| 3936 | 17933 | NM_032615 | m, o, z, General, dd, rr | membrane interacting protein of RGS16 | membrane interacting protein of RGS16 |
| 3936 | 17934 | NM_032615 | o, z, General, nn | membrane interacting protein of RGS16 | membrane interacting protein of RGS16 |
| 3936 | 17935 | NM_032615 | o, s | membrane interacting protein of RGS16 | membrane interacting protein of RGS16 |
| 3991 | 14380 | NM_053536 | tt | Kruppel-like factor 15 (kidney) | Kruppel-like factor 15 (kidney) |
| 4022 | 13005 | NM_053623 | a | fatty acid-Coenzyme A ligase, long chain 4 | fatty acid-Coenzyme A ligase, long chain 4 |
| 4052 | 3677 | NM_053798 | x | SAC1 (supressor of actin mutations 1 homolog)-like (*S. cerevisiae*) | SAC1 (supressor of actin mutations 1, homolog)-like (*S. cerevisiae*) |
| 4058 | 16311 | NM_053818 | j | glycine transporter 1 | glycine transporter 1 |
| 4066 | 20868 | NM_053843 | y, xx | Fc receptor IgG, low affinity III | Fc receptor, IgG, low affinity III |
| 4137 | 132 | NM_080782 | ll, tt | cyclin-dependent kinase inhibitor 1A (P21) | cyclin-dependent kinase inhibitor 1A (P21) |
| 4137 | 133 | NM_080782 | p, ll, ss | cyclin-dependent kinase inhibitor 1A (P21) | cyclin-dependent kinase inhibitor 1A (P21) |
| 4164 | 17560 | NM_133283 | e, t, mm | eukaryotic translation elongation factor 2, mitogen activated protein kinase kinase 2 | mitogen activated protein kinase kinase 2 |
| 4164 | 17564 | NM_133283 | ff | mitogen activated protein kinase kinase 2 | mitogen activated protein kinase kinase 2 |
| 4164 | 21848 | NM_133283 | v, y | mitogen activated protein kinase kinase 2 | mitogen activated protein kinase kinase 2 |
| 4164 | 21849 | NM_133283 | ff | mitogen activated protein kinase kinase 2 | mitogen activated protein kinase kinase 2 |
| 4176 | 10195 | NM_133383 | w | retinoid-inducible serine caroboxypetidase | retinoid-inducible serine caroboxypetidase |
| 4324 | 1937 | R46934 | k | amelogenin | amelogenin |
| 4406 | 21054 | X06107 | g, v | Insulin-like growth factor I | Insulin-like growth factor I |
| 60 | 2040 | AA799700 | w | HMm:selenophosphate synthetase 2 | ESTs, Highly similar to SPS2_MOUSE Selenide,water dikinase 2 (Selenophosphate synthetase 2) (Selenium donor protein 2) [*M. musculus*] |
| 209 | 12160 | AA818412 | o, qq | cytochrome P450, 2b19 | cytochrome P450, 2b19 |
| 495 | 10936 | AA875146 | f | HMm:ubiquitin conjugating enzyme 6 | ESTs, Highly similar to ubiquitin conjugating enzyme 6; Ubc6p homolog [*Mus musculus*] [*M. musculus*] |
| 590 | 2107 | AA892006 | e | HMm:ATPase, H+ transporting, lysosomal 70 kD, V1 subunit A, isoform 1 | ESTs, Highly similar to VAA1_MOUSE Vacuolar ATP synthase catalytic subunit A, ubiquitous isoform (V-ATPase A subunit 1) (Vacuolar proton pump alpha subunit 1) (V-ATPase 69 kDa subunit 1) [*M. musculus*] |
| 815 | 3959 | AA901338 | z | HMm:eukaryotic translation initiation factor 2, subunit 2 (beta, 38 kDa) | ESTs, Highly similar to eukaryotic translation initiation factor 2, subunit 2 (beta, 38 kDa) [*Mus musculus*] [*M. musculus*] |
| 1096 | 2702 | AA957307 | l, l, p, z, General, dd, ii, pp, qq, rr | HMm:seryl-aminoacyl-tRNA synthetase 1 | ESTs, Highly similar to A41019 serine--tRNA ligase (EC 6.1.1.11) - mouse (fragment) [*M. musculus*] |
| 1517 | 2108 | AI029960 | ee | HMm:ATPase, H+ transporting, lysosomal 70 kD, V1 subunit A, isoform 1 | ESTs, Highly similar to VAA1_MOUSE Vacuolar ATP synthase catalytic subunit A, ubiquitous isoform (V-ATPase A subunit 1) (Vacuolar proton pump alpha subunit 1) (V-ATPase 69 kDa subunit 1) [*M. musculus*] |
| 2089 | 17914 | AI169159 | ll | HMm:ATPase, H+ transporting, lysosomal 31 kDa, V1 subunit E | ESTs, Moderately similar to VATE_MOUSE Vacuolar ATP synthase subunit E (V-ATPase E subunit) (Vacuolar proton pump E subunit) (V-ATPase 31 kDa subunit) (P31) [*M. musculus*] |
| 2312 | 15588 | AI176916 | dd | HMm:phosphomannomutase 1 | ESTs, Highly similar to PMM1_MOUSE Phosphomannomutase 1 (PMM 1) [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2948 | 12156 | K00996 | o | cytochrome P450, 2b19 | cytochrome P450, 2b19 |
| 2950 | 12157 | K01721 | o | cytochrome P450, 2b19 | cytochrome P450, 2b19 |
| 2968 | 23897 | L15011 | g | cortexin | cortexin |
| 3178 | 6107 | NM_012915 | b, General, gg, hh, uu | ATPase inhibitor (rat mitochondrial IF1 protein) | ATPase inhibitor (rat mitochondrial IF1 protein) |
| 3178 | 6108 | NM_012915 | b, General, uu | ATPase inhibitor (rat mitochondrial IF1 protein) | ATPase inhibitor (rat mitochondrial IF1 protein) |
| 3178 | 6109 | NM_012915 | n | ATPase inhibitor (rat mitochondrial IF1 protein) | ATPase inhibitor (rat mitochondrial IF1 protein) |
| 3196 | 956 | NM_012976 | General | Lectin, galactose binding, soluble 5 (Galectin-5), Lectin, galactose binding, soluble 9 (Galectin-9) | Lectin, galactose binding, soluble 9 (Galectin 9) |
| 3197 | 958 | NM_012977 | b, tt | Lectin, galactose binding, soluble 9 (Galectin-9) | Lectin, galactose binding, soluble 9 (Galectin 9) |
| 3541 | 20309 | NM_022175 | gg, hh | Homeobox gene Pem | Homeobox gene Pem |
| 3655 | 504 | NM_024136 | x | epididymal retinoic acid-binding protein | epididymal retinoic acid-binding protein |
| 3796 | 635 | NM_031509 | vv | Glutathione-S-transferase, alpha type (Ya) | Glutathione-S-transferase, alpha type (Ya) |
| 4312 | 683 | NM_147206 | ii | HMm:cytochrome P450, steroid inducible 3a13 | *Rattus norvegicus* cytochrome P450 3A9 mRNA, complete cds |
| 5 | 4439 | AA685175 | h, m, s, General | | ESTs, Moderately similar to ribosome binding protein 1 isoform mRRp61 [*Mus musculus*] [*M. musculus*] |
| 14 | 19222 | AA799279 | d, f, l, General, pp | | ESTs, Highly similar to mitochondrial carrier homolog 2 [*Mus musculus*] [*M. musculus*] |
| 37 | 15560 | AA799538 | z | | ESTs, Highly similar to SFR2_MOUSE Splicing factor, arginine/serine-rich 2 (Splicing factor SC35) (SC-35) (Splicing component, 35 kDa) (PR264 protein) [*M. musculus*] |
| 85 | 21006 | AA799861 | rr | | ESTs, Highly similar to IRF7_MOUSE Interferon regulatory factor 7 (IRF-7) [*M. musculus*] |
| 85 | 21007 | AA799861 | g | | ESTs, Highly similar to IRF7_MOUSE Interferon regulatory factor 7 (IRF-7) [*M. musculus*] |
| 101 | 15394 | AA800039 | z, ll | | ESTs, Weakly similar to FAF1_MOUSE FAS-associated factor 1 (FAF1 protein) [*M. musculus*] |
| 121 | 24228 | AA800318 | oo | | ESTs, Moderately similar to IC1_MOUSE Plasma protease C1 inhibitor precursor (C1 inh) (C1Inh) [*M. musculus*] |
| 147 | 17648 | AA800735 | l | | ESTs, Weakly similar to VIL1_MOUSE Villin 1 [*M. musculus*] |
| 147 | 17649 | AA800735 | w, gg, hh | | ESTs, Weakly similar to VIL1_MOUSE Villin 1 [*M. musculus*] |
| 174 | 2425 | AA817722 | mm | | ESTs, Highly similar to CTN1_MOUSE Alpha-1 catenin (102 kDa cadherin-associated protein) (CAP102) (Alpha E-catenin) [*M. musculus*] |
| 186 | 11215 | AA817921 | xx | | ESTs, Highly similar to ubiquitin-like 5 [*Mus musculus*] [*M. musculus*] |
| 191 | 10623 | AA817987 | c, f, n, v | Sulfotransferase hydroxysteroid gene 2 | Sulfotransferase hydroxysteroid gene 2 |
| 204 | 6522 | AA818261 | c | | ESTs, Moderately similar to A47318 RNA-binding protein Raly - mouse [*M. musculus*] |
| 222 | 18868 | AA818759 | dd | | ESTs, Moderately similar to S12207 hypothetical protein (B2 element) - mouse [*M. musculus*] |
| 233 | 6132 | AA819055 | v, uu | | ESTs, Weakly similar to G35070 apolipoprotein H-related protein 13G1 - mouse [*M. musculus*] |
| 249 | 9987 | AA819502 | c | | ESTs, Weakly similar to ELL_MOUSE RNA POLYMERASE II ELONGATION FACTOR ELL (ELEVEN-NINETEEN LYSINE-RICH LEUKEMIA PROTEIN) [*M. musculus*] |
| 258 | 6297 | AA819681 | General, uu | | ESTs, Highly similar to RIKEN cDNA 1200014P03 [*Mus musculus*] [*M. musculus*] |
| 283 | 16128 | AA848807 | l, r, nn | | ESTs, Highly similar to RIKEN cDNA 2410017I18 [*Mus musculus*] [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 307 | 12129 | AA849966 | n | | ESTs, Moderately similar to Mpv17 transgene, kidney disease mutant-like [*Mus musculus*] [*M. musculus*] |
| 319 | 19621 | AA850634 | v | | ESTs, Moderately similar to S12207 hypothetical protein (B2 element) - mouse [*M. musculus*] |
| 330 | 8872 | AA851050 | v, qq | glutathione reductase | glutathione reductase |
| 334 | 15561 | AA851202 | ll | | ESTs, Highly similar to SFR2_MOUSE Splicing factor, arginine/serine-rich 2 (Splicing factor SC35) (SC-35) (Splicing component, 35 kDa) (PR264 protein) [*M. musculus*] |
| 337 | 17699 | AA851233 | gg, hh | | ESTs, Highly similar to RIKEN cDNA 4930548G07 [*Mus musculus*] [*M. musculus*] |
| 371 | 1801 | AA858636 | r, rr | | ESTs, Highly similar to mini chromosome maintenance deficient 7 (*S. cerevisiae*) [*Mus musculus*] [*M. musculus*] |
| 386 | 18765 | AA859019 | a | | ESTs, Weakly similar to G35070 apolipoprotein H-related protein 13G1 - mouse [*M. musculus*] |
| 398 | 6464 | AA859401 | ll | | ESTs, Highly similar to JC7321 N-acetylneuraminic acid 9-phosphate synthase (EC 4.1.3.—) - mouse [*M. musculus*] |
| 419 | 22670 | AA859750 | y | | ESTs, Weakly similar to ERF_MOUSE ETS-domain transcription factor ERF [*M. musculus*] |
| 421 | 14213 | AA859827 | bb, dd, jj, oo, pp | | ESTs, Moderately similar to URK1_MOUSE URIDINE KINASE (URIDINE MONOPHOSPHOKINASE) [*M. musculus*] |
| 432 | 19377 | AA859971 | l | | ESTs, Highly similar to RIKEN cDNA 0610010I12 [*Mus musculus*] [*M. musculus*] |
| 459 | 9391 | AA866477 | d | | ESTs, Moderately similar to COXM_MOUSE Cytochrome c oxidase polypeptide VIIb, mitochondrial precursor [*M. musculus*] |
| 476 | 16241 | AA875019 | pp | | ESTs, Highly similar to ZAP3_MOUSE Nuclear protein ZAP3 [*M. musculus*] |
| 487 | 16416 | AA875098 | j, q, dd | | ESTs, Highly similar to RIKEN cDNA 1110002O23 [*Mus musculus*] [*M. musculus*] |
| 509 | 18864 | AA875470 | u | | ESTs, Highly similar to COP9 (constitutive photomorphogenic) homolog, subunit 7a (*Arabidopsis thaliana*); DNA segment, Chr 6, ERATO Doi 35, expressed; COP9 complex S7a; COP9 (constitutive photomorphogenic), subunit 7a (*Arabidopsis*) [*Mus musculus*] [*M. musculus*] |
| 515 | 15558 | AA875537 | tt | | ESTs, Highly similar to SFR2_MOUSE Splicing factor, arginine/serine-rich 2 (Splicing factor SC35) (SC-35) (Splicing component, 35 kDa) (PR264 protein) [*M. musculus*] |
| 524 | 15688 | AA875664 | x | | ESTs, Highly similar to mitochondria associated granulocyte macrophage CSF signaling molecule [*Mus musculus*] [*M. musculus*] |
| 526 | 17057 | AA891049 | General | | ESTs, Highly similar to PFD2_MOUSE Prefoldin subunit 2 [*M. musculus*] |
| 531 | 24814 | AA891209 | m | | ESTs, Highly similar to interleukin 25; lymphocyte antigen 6 complex, locus E ligand [*Mus musculus*] [*M. musculus*] |
| 574 | 16602 | AA891864 | t, mm | | ESTs, Highly similar to RIKEN cDNA 2900054O13 gene; nuclear ATP/GTP-binding protein; Purkinje cell degeneration [*Mus musculus*] [*M. musculus*] |
| 594 | 6362 | AA892053 | q | | ESTs, Highly similar to T42204 chromatin structural protein homolog Supt5hp - mouse [*M. musculus*] |
| 628 | 18150 | AA892422 | e | | ESTs, Moderately similar to RIKEN cDNA 2410001P07; RIKEN cDNA 2410001P07 gene [*Mus musculus*] [*M. musculus*] |
| 633 | 1522 | AA892486 | e, ii, rr, uu | | ESTs, Weakly similar to A36690 sucrose alpha-glucosidase (EC 3.2.1.48) - rat (fragment) [*R. norvegicus*] |
| 648 | 18274 | AA892572 | bb | | ESTs, Highly similar to RIKEN cDNA 1110001J03 [*Mus musculus*] [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 666 | 20359 | AA892817 | f, s | | EST, Weakly similar to S12207 hypothetical protein (B2 element) - mouse [*M. musculus*] |
| 684 | 11189 | AA892960 | ee | | ESTs, Highly similar to RIKEN cDNA 1200011I18 [*Mus musculus*] [*M. musculus*] |
| 696 | 19745 | AA893199 | t | | ESTs, Highly similar to RIKEN cDNA 1500004D14 [*Mus musculus*] [*M. musculus*] |
| 701 | 548 | AA893235 | c, ww, xx | | ESTs, Highly similar to G0S2__MOUSE Putative lymphocyte G0/G1 switch protein 2 (G0S2-like protein) [*M. musculus*] |
| 720 | 17698 | AA893596 | ww | | ESTs, Highly similar to RIKEN cDNA 4930548G07 [*Mus musculus*] [*M. musculus*] |
| 745 | 3217 | AA894101 | jj | | ESTs, Moderately similar to PNAD__MOUSE PROTEIN N-TERMINAL ASPARAGINE AMIDOHYDROLASE (PROTEIN NH2-TERMINAL ASPARAGINE DEAMIDASE) (NTN-AMIDASE) (PNAD) (PROTEIN NH2-TERMINAL ASPARAGINE AMIDOHYDROLASE) (PNAA) [*M. musculus*] |
| 764 | 3910 | AA894345 | b, k, l, cc | | ESTs, Weakly similar to 2021425A MAT1 gene [*Mus musculus*] [*M. musculus*] |
| 765 | 18094 | AA899051 | rr | SH-PTP2 protein tyrosine phosphatase, non-receptor type 11 | SH-PTP2 protein tyrosine phosphatase, non-receptor type 11 |
| 807 | 22666 | AA900974 | r, y, kk | | ESTs, Highly similar to p34SEI-1; PHD zinc finger- and bromodomain-interacting protein 1 [*Mus musculus*] [*M. musculus*] |
| 840 | 18434 | AA924413 | kk, tt | | ESTs, Moderately similar to hypothetical protein MNCb-0169 [*Mus musculus*] [*M. musculus*] |
| 843 | 3631 | AA924460 | m | | ESTs, Weakly similar to PMC1__MOUSE Polymyositis/scleroderma autoantigen 1 (Autoantigen PM/Scl 1) (Polymyositis/scleroderma autoantigen 75 kDa) (PM/Scl-75) (P75 polymyositis-scleroderma overlap syndrome associated autoantigen) [*M. musculus*] |
| 864 | 5073 | M925061 | d | | ESTs, Moderately similar to S20710 hypothetical protein, 16K - mouse [*M. musculus*] |
| 916 | 16909 | AA942704 | bb | | ESTs, Moderately similar to SUR2__MOUSE Surfeit locus protein 2 (Surf-2) [*M. musculus*] |
| 918 | 6039 | AA942716 | nn | | ESTs, Highly similar to hematological and neurological expressed sequence 1 [*Mus musculus*] [*M. musculus*] |
| 976 | 21581 | AA944828 | ff | | ESTs, Highly similar to RIKEN cDNA 2610524G07 [*Mus musculus*] [*M. musculus*] |
| 984 | 22667 | AA945069 | r | | ESTs, Highly similar to p34SEI-1; PHD zinc finger- and bromodomain-interacting protein 1 [*Mus musculus*] [*M. musculus*] |
| 1026 | 12321 | AA946166 | d | | ESTs, Highly similar to RIKEN cDNA 2410003C20 [*Mus musculus*] [*M. musculus*] |
| 1057 | 15329 | AA955427 | k | | ESTs, Highly similar to LMA1__MOUSE Laminin alpha-1 chain precursor (Laminin A chain) [*M. musculus*] |
| 1060 | 9984 | AA955536 | c | | ESTs, Weakly similar to ELL__MOUSE RNA POLYMERASE II ELONGATION FACTOR ELL (ELEVEN-NINETEEN LYSINE-RICH LEUKEMIA PROTEIN) [*M. musculus*] |
| 1060 | 9985 | AA955536 | c | | ESTs, Weakly similar to ELL__MOUSE RNA POLYMERASE II ELONGATION FACTOR ELL (ELEVEN-NINETEEN LYSINE-RICH LEUKEMIA PROTEIN) [*M. musculus*] |
| 1066 | 23662 | AA955640 | jj | | ESTs, Highly similar to RIKEN cDNA 2610002M06 [*Mus musculus*] [*M. musculus*] |
| 1088 | 23805 | AA956558 | jj | | ESTs, Moderately similar to MTG8__MOUSE MTG8 protein [*M. musculus*] |
| 1123 | 16603 | AA964059 | mm | | ESTs, Highly similar to RIKEN cDNA 2900054O13 gene; nuclear ATP/GTP-binding protein; Purkinje cell degeneration [*Mus musculus*] [*M. musculus*] |
| 1129 | 12166 | AA964426 | e | | ESTs, Moderately similar to RIKEN cDNA 2810433K01 [*Mus musculus*] [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1155 | 21008 | AA965186 | ll | | ESTs, Highly similar to IRF7_MOUSE Interferon regulatory factor 7 (IRF-7) [*M. musculus*] |
| 1177 | 2988 | AA997030 | rr | | ESTs, Moderately similar to guanine nucleotide exchange factor (RCC1 related) [*Mus musculus*] [*M. musculus*] |
| 1193 | 3269 | AA997800 | k | | ESTs, Moderately similar to T30249 cell proliferation antigen Ki-67 - mouse [*M. musculus*] |
| 1203 | 3357 | AA998078 | v | | ESTs, Moderately similar to RaIBP1 associated Eps domain containing protein [*Mus musculus*] [*M. musculus*] |
| 1233 | 3069 | AA998910 | ss | | ESTs, Highly similar to endoplasmic reticulum chaperone SIL1 homolog (*S. cerevisiae*) [*Mus musculus*] [*M. musculus*] |
| 1265 | 23044 | AF034218 | s, kk, pp | hyaluronidase 2 | hyaluronidase 2 |
| 1298 | 4740 | AI007847 | k | | ESTs, Weakly similar to S26689 hypothetical protein hc1 - mouse (fragment) [*M. musculus*] |
| 1340 | 3464 | AI009589 | ww | | ESTs, Highly similar to RIKEN cDNA 4921524J17 [*Mus musculus*] [*M. musculus*] |
| 1345 | 994 | AI009693 | bb | | ESTs, Highly similar to RIKEN cDNA 2310050K10 [*Mus musculus*] [*M. musculus*] |
| 1362 | 6874 | AI010057 | g | | EST, Weakly similar to A26621 retrovirus-related endonuclease (EC 3.1.—.—) - mouse (fragment) [*M. musculus*] |
| 1378 | 6943 | AI010637 | ss | | ESTs, Moderately similar to peptide N-glycanase; peptide:N-glycanase [*Mus musculus*] [*M. musculus*] |
| 1510 | 2340 | AI029499 | s, oo | | ESTs, Weakly similar to JC4524 aldehyde dehydrogenase (NAD(P)+) (EC 1.2.1.5) - rat [*R. norvegicus*] |
| 1511 | 22469 | AI029506 | dd | | ESTs, Moderately similar to COG2_MOUSE Coatomer gamma-2 subunit (Gamma-2 coat protein) (Gamma-2 COP) [*M. musculus*] |
| 1561 | 7916 | AI043855 | s, t | sterol-C5-desaturase (fungal ERG3, delta-5-desaturase)-like | sterol-C5-desaturase (fungal ERG3, delta-5-desaturase)-like |
| 1569 | 9829 | AI044063 | x | | ESTs, Weakly similar to carcinoma related gene [*Mus musculus*] [*M. musculus*] |
| 1589 | 24174 | AI044826 | gg, hh | | ESTs, Highly similar to CC45_MOUSE CDC45-related protein (PORC-PI-1) [*M. musculus*] |
| 1610 | 19782 | AI045333 | r | | ESTs, Moderately similar to tumor necrosis factor induced protein 1 [*Mus musculus*] [*M. musculus*] |
| 1635 | 23712 | AI045827 | h | | ESTs, Weakly similar to T00043 BH-protocadherin-a - mouse [*M. musculus*] |
| 1652 | 10084 | AI058674 | s | | ESTs, Highly similar to MTR3_MOUSE Myotubularin-related protein 3 [*M. musculus*] |
| 1682 | 14518 | AI059477 | gg, hh | | ESTs, Moderately similar to POL3_MOUSE Retrovirus-related POL polyprotein (Endonuclease) [*M. musculus*] |
| 1726 | 11821 | AI070350 | mm | | ESTs, Weakly similar to J04667 TB2/DP1 protein homolog - mouse [*M. musculus*] |
| 1747 | 9079 | AI071251 | b, x | | ESTs, Moderately similar to A57050 K-glypican precursor - mouse [*M. musculus*] |
| 1757 | 16788 | AI071557 | ii | Orthodenticle (*Drosophila*) homolog 1 | Orthodenticle (*Drosophila*) homolog 1 |
| 1765 | 6521 | AI071688 | c, w | | ESTs, Moderately similar to A47318 RNA-binding protein Raly - mouse [*M. musculus*] |
| 1788 | 9162 | AI072392 | jj | | ESTs, Highly similar to C2MS classical-complement-pathway C3/C5 convertase (EC 3.4.21.43) C2 component precursor - mouse [*M. musculus*] |
| 1826 | 23124 | AI100785 | y, nn | | ESTs, Highly similar to germ cell-less homolog (*Drosophila*) [*Mus musculus*] [*M. musculus*] |
| 1874 | 19379 | AI102711 | d, j | | ESTs, Highly similar to RIKEN cDNA 0610010I12 [*Mus musculus*] [*M. musculus*] |
| 1936 | 7223 | AI104373 | x | | ESTs, Highly similar to RIKEN cDNA 2810428I15 [*Mus musculus*] [*M. musculus*] |
| 1942 | 5084 | AI104587 | z | | ESTs, Moderately similar to RIKEN cDNA 1810008A14 [*Mus musculus*] [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1977 | 2539 | AI111960 | y | | ESTs, Weakly similar to FKB5_MOUSE 51 kDa FK506-binding protein (FKBP51) (Peptidyl-prolyl cis-trans isomerase) (PPiase) (Rotamase) [*M. musculus*] |
| 1997 | 11180 | AI113003 | oo, vv | | ESTs, Highly similar to gene rich cluster, C9 gene [*Mus musculus*] [*M. musculus*] |
| 2014 | 16187 | AI136838 | gg, hh | | ESTs, Highly similar to A55053 endothelial monocyte-activating protein II precursor - mouse [*M. musculus*] |
| 2015 | 23851 | AI136862 | v | | ESTs, Highly similar to carcinoma related gene [*Mus musculus*] [*M. musculus*] |
| 2027 | 13129 | AI137413 | p | | ESTs, Weakly similar to T14318 ubiquitin-protein ligase E3-alpha - mouse [*M. musculus*] |
| 2034 | 1556 | AI137790 | xx | | *R. norvegicus* mRNA from Leydig cell hypercalcemic tumour H-500 |
| 2041 | 22987 | AI138061 | s | | ESTs, Moderately similar to JC4761 recombination activating gene 1 inducing protein - mouse [*M. musculus*] |
| 2052 | 13190 | AI144981 | c | | ESTs, Weakly similar to Fas-activated serine/threonine kinase [*Mus musculus*] [*M. musculus*] |
| 2053 | 23106 | AI145081 | ww | | ESTs, Highly similar to S56766 replication licensing factor MCM4 - mouse [*M. musculus*] |
| 2068 | 18522 | AI145870 | t, ff | | ESTs, Moderately similar to RIKEN cDNA 1110025H10 [*Mus musculus*] [*M. musculus*] |
| 2070 | 13401 | AI146008 | pp | | ESTs, Moderately similar to S12207 hypothetical protein (B2 element) - mouse [*M. musculus*] |
| 2075 | 14510 | AI68947 | tt | | ESTs, Moderately similar to POL3_MOUSE Retrovirus-related POL polyprotein (Endonuclease) [*M. musculus*] |
| 2083 | 5683 | AI169034 | p | DEAD/H (Asp-Glu-Ala-Asp/His) box polypeptide 20, 103 kD | DEAD/H (Asp-Glu-Ala-Asp/His) box polypeptide 20, 103 kD |
| 2087 | 6392 | AI169154 | q | | ESTs, Weakly similar to SSXT_MOUSE SSXT protein (SYT protein) (Synovial sarcoma associated Ss18-alpha) [*M. musculus*] |
| 2093 | 2607 | AI169211 | c | | ESTs, Highly similar to A47318 RNA-binding protein Raly - mouse [*M. musculus*] |
| 2095 | 806 | AI169231 | r | | ESTs, Highly similar to G33_RAT GENE 33 POLYPEPTIDE [*R. norvegicus*] |
| 2110 | 15665 | AI169611 | l | | ESTs, Moderately similar to steroid receptor RNA activator 1 [*Mus musculus*] [*M. musculus*] |
| 2113 | 20466 | AI169735 | h | | Rat cytochrome P450IIB3 (P450IIB subfamily) mRNA, complete cds |
| 2115 | 804 | AI169756 | n, r, ee | | ESTs, Highly similar to G33_RAT GENE 33 POLYPEPTIDE [*R. norvegicus*] |
| 2125 | 4368 | AI170265 | xx | | ESTs, Highly similar to RIKEN cDNA 1700006C06 [*Mus musculus*] [*M. musculus*] |
| 2176 | 21698 | AI171574 | tt | | ESTs, Highly similar to RNA and export factor binding protein 1; Tcra enhancer-binding factor interacting protein 1 [*Mus musculus*] [*M. musculus*] |
| 2187 | 10087 | AI171803 | w, General, uu | methylmalonate semialdehyde dehydrogenase gene | methylmalonate semialdehyde dehydrogenase gene |
| 2191 | 22239 | AI171982 | qq | | ESTs, Moderately similar to I48672 p8 MTCP-1 - mouse [*M. musculus*] |
| 2201 | 5080 | AI172106 | qq | | ESTs, Highly similar to cDNA sequence AB028863; Mmrp19 [*Mus musculus*] [*M. musculus*] |
| 2214 | 15382 | AI172302 | rr | | ESTs, Weakly similar to S43056 hypothetical protein - mouse [*M. musculus*] |
| 2223 | 5044 | AI172572 | m | | ESTs, Moderately similar to expressed sequence tag mouse EST 12 [*Mus musculus*] [*M. musculus*] |
| 2254 | 22451 | AI175992 | d, t | | ESTs, Highly similar to beta-catenin interacting protein ICAT [*Mus musculus*] [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2329 | 21279 | AI177356 | bb | | ESTs, Highly similar to mitochondnal ribosomal protein 64 [*Mus musculus*] [*M. musculus*] |
| 2332 | 18095 | AI177482 | rr | SH-PTP2 protein tyrosine phosphatase, non-receptor type 11 | SH-PTP2 protein tyrosine phosphatase, non-receptor type 11 |
| 2344 | 22249 | AI177809 | l | zyxin | zyxin |
| 2412 | 12011 | AI179380 | oo | | ESTs, Highly similar to open reading frame 12 [*Mus musculus*] [*M. musculus*] |
| 2413 | 19783 | AI179388 | y | | ESTs, Highly similar to RIKEN cDNA 0610040D20 [*Mus musculus*] [*M. musculus*] |
| 2422 | 23515 | AI179498 | l | | ESTs, Highly similar to SEC23B (*S. cerevisiae*) [*Mus musculus*] [*M. musculus*] |
| 2430 | 17865 | AI179636 | ss | | ESTs, Highly similar to RIKEN cDNA 0610009B22 [*Mus musculus*] [*M. musculus*] |
| 2448 | 17089 | AI180281 | h | | ESTs, Moderately similar to JC4978 oxidative stress protein A170 - mouse [*M. musculus*] |
| 2485 | 21898 | AI228595 | ss | | ESTs, Moderately similar to CNO7_MOUSE CCR4-NOT transcription complex, subunit 7 (CCR4-associated factor 1) (CAF1) [*M. musculus*] |
| 2494 | 15873 | AI228798 | pp | | ESTs, Weakly similar to I52657 seizure-related protein SEZ-6 precursor - mouse [*M. musculus*] |
| 2497 | 23824 | AI229059 | h, q, x, dd | | ESTs, Moderately similar to retinoic acid induced 12; Clone 13u [*Mus musculus*] [*M. musculus*] |
| 2499 | 5143 | AI229087 | s | | ESTs, Highly similar to TPS1_MOUSE Protein-tyrosine sulfotransferase 1 (Tyrosylprotein sulfotransferase-1) (TPST-1) [*M. musculus*] |
| 2501 | 19063 | AI229166 | nn | | ESTs, Highly similar to mitochondrial ribosomal protein S14; 1810032L21Rik [*Mus musculus*] [*M. musculus*] |
| 2514 | 21237 | AI229430 | cc | | *Rattus norvegicus* Tclone4 mRNA |
| 2534 | 18088 | AI230199 | xx | | ESTs, Weakly similar to POL3_MOUSE Retrovirus-related POL polyprotein (Endonuclease) [*M. musculus*] |
| 2550 | 14388 | AI230702 | q, bb | | ESTs, Highly similar to hematological and neurological expressed sequence 1 [*Mus musculus*] [*M. musculus*] |
| 2559 | 19765 | AI230945 | j, bb | | ESTs, Highly similar to synbindin; syndecan binding protein 2 [*Mus musculus*] [*M. musculus*] |
| 2585 | 2339 | AI231798 | x | | ESTs, Highly similar to T-complex expressed gene 2 [*Mus musculus*] [*M. musculus*] |
| 2614 | 14521 | AI232350 | m | | ESTs, Moderately similar to POL3_MOUSE Retrovirus-related POL polyprotein (Endonuclease) [*M. musculus*] |
| 2629 | 21664 | AI232734 | kk | | ESTs, Highly similar to DD15_MOUSE Putative pre-mRNA splicing factor RNA helicase (DEAH box protein 15) [*M. musculus*] |
| 2675 | 15085 | AI233829 | x, ff, ii | P11 protein | P11 protein |
| 2710 | 22805 | AI235403 | v | | ESTs, Highly similar to adaptor-related protein complex AP-3, delta subunit [*Mus musculus*] [*M. musculus*] |
| 2721 | 15200 | AI235736 | e | | ESTs, Moderately similar to CD34_MOUSE Hematopoietic progenitor cell antigen CD34 precursor [*M. musculus*] |
| 2734 | 15467 | AI236106 | jj | | ESTs, Moderately similar to S15785 heat-stable antigen-related hypothetical protein HSA-C - mouse [*M. musculus*] |
| 2756 | 20992 | AI236719 | k | | ESTs, Highly similar to N-acetylglucosamine kinase; GlcNAc kinase [*Mus musculus*] [*M. musculus*] |
| 2758 | 16609 | AI236748 | pp | | ESTs, Moderately similar to CENB_MOUSE MAJOR CENTROMERE AUTOANTIGEN B (CENTROMERE PROTEIN B) (CENP-B) [*M. musculus*] |
| 2776 | 16063 | AI237314 | q | | ESTs, Highly similar to zinc finger like protein 1 [*Mus musculus*] [*M. musculus*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2802 | 20000 | AI638989 | j | | ESTs, Moderately similar to T14273 zinc finger protein 106 - mouse [*M. musculus*] |
| 2815 | 10071 | AI639058 | y, xx | | ESTs, Highly similar to Nedd4 WW binding# protein 4; Nedd4 WW-binding protein 4 [*Mus musculus*] [*M. musculus*] |
| 2819 | 5545 | AI639117 | h, cc, ii, vv | | ESTs, Highly similar to CFAB_MOUSE Complement factor B precursor (C3/C5 convertase) [*M. musculus*] |
| 2912 | 11358 | H31610 | oo, pp | | ESTs, Highly similar to JW0059 mtprd protein - mouse [*M. musculus*] |
| 2936 | 18281 | H33459 | ss | | ESTs, Highly similar to SWI/SNF related, matrix associated, actin dependent regulator of chromatin, subfamily b, member 1; integrase interactor 1 [*Mus musculus*] [*M. musculus*] |
| 2944 | 16256 | J02861 | dd, rr | cytochrome P450 2c13, cytochrome P450, 2c38 | cytochrome P450 2c13, cytochrome P450, 2c38 |
| 2951 | 17270 | K02111 | jj | | Rat embryonic myosin heavy chain gene, partial 5' region, mRNA |
| 2996 | 20464 | M20406 | l, v, vv | | Rat cytochrome P450IIB3 (P450IIB subfamily) mRNA, complete cds |
| 3012 | 16305 | M33312 | o, General | Cytochrome P450 IIA1 (hepatic steroid hydroxylase IIA1) gene | Cytochrome P450 IIA1 (hepatic steroid hydroxylase IIA1) gene |
| 3033 | 16255 | M82855 | g, dd | cytochrome P450 2c13, cytochrome P450, 2c38 | cytochrome P450 2c13, cytochrome P450, 2c38 |
| 3070 | 16895 | NM_012558 | a, cc, gg, hh, ss, uu | Fructose-1,6-biphosphatase | Fructose-1,6-biphosphatase |
| 3107 | 24589 | NM_012674 | d, kk | Serine protease inhibitor, kanzal type 1/Trypsin inhibitor-like protein, pancreatic | Serine protease inhibitor, kanzal type 1/Trypsin inhibitor-like protein, pancreatic |
| 3113 | 16306 | NM_012692 | uu | Cytochrome P450 IIA1 (hepatic steroid hydroxylase IIA1) gene, Cytochrome P450 IIA2 | Cytochrome P450 IIA1 (hepatic steroid hydroxylase IIA1) gene, Cytochrome P450 IIA2 |
| 3114 | 24707 | NM_012693 | c, r, s | Cytochrome P450 IIA2 | Cytochrome P450 IIA2 |
| 3115 | 10622 | NM_012695 | f, n | Sulfotransferase hydroxysteroid gene 2 | Sulfotransferase hydroxysteroid gene 2 |
| 3115 | 10624 | NM_012695 | n, xx | Sulfotransferase hydroxysteroid gene 2 | Sulfotransferase hydroxysteroid gene 2 |
| 3115 | 10625 | NM_012695 | k, n, ii | Sulfotransferase hydroxysteroid gene 2 | Sulfotransferase hydroxysteroid gene 2 |
| 3115 | 10626 | NM_012695 | f | Sulfotransferase hydroxysteroid gene 2 | Sulfotransferase hydroxysteroid gene 2 |
| 3150 | 21350 | NM_012823 | a | Annexin A3 | Annexin A3 |
| 3235 | 357 | NM_013086 | w | CAMP responsive element modulator | CAMP responsive element modulator |
| 3237 | 18096 | NM_013088 | ff | SH-PTP2 protein tyrosine phosphatase, non-receptor type 11 | SH-PTP2 protein tyrosine phosphatase, non-receptor type 11 |
| 3259 | 200 | NM_013161 | k, v | Pancreatic lipase | Pancreatic lipase |
| 3263 | 2012 | NM_013173 | r | Solute carrier family 11 member 2 (natural resistance-associated macrophage protein 2) | Solute carrier family 11 member 2 (natural resistance-associated macrophage protein 2) |
| 3263 | 2013 | NM_013173 | r | Solute carrier family 11 member 2 (natural resistance-associated macrophage protein 2) | Solute carrier family 11 member 2 (natural resistance-associated macrophage protein 2) |
| 3307 | 18973 | NM_017060 | kk | | ESTs, Moderately similar to S14234 hypothetical protein - mouse [*M. musculus*] |
| 3366 | 21903 | NM_017220 | ss | cytochrome P450, 2c37 | cytochrome P450, 2c37 |
| 3388 | 20914 | NM_017272 | j, o, v, vv | aldehyde dehydrogenase family 1, subfamily A4 | aldehyde dehydrogenase family 1, subfamily A4 |
| 3416 | 16148 | NM_017340 | o, y, jj, ss, xx | acyl-coA oxidase | acyl-coA oxidase |
| 3416 | 16150 | NM_017340 | o, jj | acyl-coA oxidase | acyl-coA oxidase |
| 3443 | 1173 | NM_019184 | j, rr | Cytochrome P450, subfamily IIC (mephenytoin 4-hydroxylase) | Cytochrome P450, subfamily IC (mephenytoin 4-hydroxylase) |
| 3443 | 1174 | NM_019184 | rr | Oytochrome P450, subfamily IIC (mephenytoin 4-hydroxylase) | Cytochrome P450, subfamily IIC (mephenytoin 4-hydroxylase) |
| 3480 | 20553 | NM_019293 | l, p | | ESTs, Moderately similar to S12207 hypothetical protein (B2 element) - mouse [*M. musculus*] |
| 3499 | 18032 | NM_019380 | w | stromal cell derived factor receptor 1 | stromal cell derived factor receptor 1 |
| 3554 | 43 | NM_022287 | General, dd, ff, rr | sulfate anion transporter | sulfate anion transporter |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3603 | 21072 | NM_022601 | k | pyridoxine 5'-phosphate oxidase | pyridoxine 5'-phosphate oxidase |
| 3605 | 21203 | NM_022606 | u | protein phosphatase 2C | protein phosphatase 2C |
| 3605 | 21204 | NM_022606 | u | protein phosphatase 2C | protein phosphatase 2C |
| 3607 | 5336 | NM_022631 | v | | ESTs, Highly similar to synembryn [*Mus musculus*] [*M. musculus*] |
| 3629 | 23606 | NM_022867 | ii | microtubule-associated proteins 1A/1B light chain 3 | microtubule-associated proteins 1A/1B light chain 3 |
| 3629 | 23608 | NM_022867 | ll | microtubule-associated proteins 1A/1B light chain 3 | microtubule-associated proteins 1A/1B light chain 3 |
| 3644 | 17486 | NM_023092 | g, cc | unconventional myosin Myr2 I heavy chain | unconventional myosin Myr2 I heavy chain |
| 3644 | 17487 | NM_023092 | mm | unconventional myosin Myr2 I heavy chain | unconventional myosin Myr2 I heavy chain |
| 3677 | 2811 | NM_024386 | jj | 3-hydroxy-3-methylglutaryl CoA lyase | 3-hydroxy-3-methylglutaryl CoA lyase |
| 3677 | 2812 | NM_024386 | rr | 3-hydroxy-3-methylglutaryl CoA lyase | 3-hydroxy-3-methylglutaryl CoA lyase |
| 3677 | 2813 | NM_024386 | o, ii | 3-hydroxy-3-methylglutaryl CoA lyase | 3-hydroxy-3-methylglutaryl CoA lyase |
| 3684 | 16141 | NM_024405 | nn | GSK-3beta interacting protein rAxin | GSK-3beta interacting protein rAxin |
| 3691 | 4057 | NM_030844 | u | islet cell autoantigen 1, 69 kDa | islet cell autoantigen 1, 69 kDa |
| 3714 | 485 | NM_031017 | c | cAMP response element binding protein 1 | cAMP response element binding protein 1 |
| 3732 | 17269 | NM_031057 | General, kk | methylmalonate semialdehyde dehydrogenase gene | methylmalonate semialdehyde dehydrogenase gene |
| 3741 | 1403 | NM_031087 | jj | presenilin-2 | presenilin-2 |
| 3743 | 1175 | NM_031093 | x, xx | Cytochrome P450, subfamily IIC (mephenytoin 4-hydroxylase) | Cytochrome P450, subfamily IIC (mephenytoin 4-hydroxylase) |
| 3774 | 15238 | NM_031153 | l | shank-interacting protein | shank-interactin protein |
| 3778 | 8149 | NM_031242 | ii | CDP-diacylglycerol synthase (phosphatidate cytidylyltransferase) 1 | COP-diacylglycerol synthase (phosphatidate cytidylyltransferase) 1 |
| 3789 | 23358 | NM_031342 | rr | lysophospholipase II | lysophospholipase II |
| 3825 | 15803 | NM_031593 | bb | synaptic vesicle protein 2C | synaptic vesicle protein 2C |
| 3890 | 21646 | NM_031781 | General, ll | amyloid beta (A4) precursor protein-binding, family A, member 3 (X11-like 2) | amyloid beta (A4) precursor protein-binding, family A, member 3 (X11-like 2) |
| 3894 | 15794 | NM_031796 | qq | UDP-GalNAc:polypeptide N-acetylgalactosaminyltransferase T5 | UDP-GalNAc:polypeptide N-acetylgalactosaminyltransferase T5 |
| 3900 | 15759 | NM_031815 | kk | activin beta E | activin beta E |
| 3905 | 7914 | NM_031835 | b, h, l, General, nn | beta-alanine-pyruvate aminotransferase | beta-alanine-pyruvate aminotransferase |
| 3938 | 21102 | NM_033021 | q | vesicle associated protein | vesicle associated protein |
| 3938 | 21103 | NM_033021 | q, x | vesicle associated protein | vesicle associated protein |
| 3975 | 23338 | NM_053416 | n, rr | double-stranded RNA-binding protein p74 | double-stranded RNA-binding protein p74 |
| 3979 | 14621 | NM_053437 | o, ss | diacylglycerol acyltransferase | diacylglycerol acyltransferase |
| 4006 | 21534 | NM_053588 | f | Trif gene | Trif gene |
| 4015 | 1126 | NM_053605 | v, y, oo | sphingomyelin phosphodiesterase 3, neutral | sphingomyelin phosphodiesterase 3, neutral |
| 4023 | 15777 | NM_053630 | v | potassium voltage-gated channel, subfamily H (eag-related), member 4 | potassium voltage-gated channel, subfamily H (eag-related), member 4 |
| 4057 | 15103 | NM_053814 | l, bb | Rho interacting protein 3 | Rho interacting protein 3 |
| 4081 | 17090 | NM_053906 | t, mm | glutathione reductase | glutathione reductase |
| 4081 | 17091 | NM_053906 | qq | glutathione reductase | glutathione reductase |
| 4119 | 968 | NM_057133 | l, v, bb | nuclear receptor subfamily 0, group B, member 2 | nuclear receptor subfamily 0, group B, member 2 |
| 4171 | 4956 | NM_133315 | n | solute carrier family 39 (iron-regulated transporter), member 1 | solute carrier family 39 (iron-regulated transporter), member 1 |
| 4171 | 4957 | NM_133315 | f, n, y, ll | solute carrier family 39 (iron-regulated transporter), member 1 | solute carrier family 39 (iron-regulated transporter), member 1 |
| 4177 | 21576 | NM_133398 | oo | LYRIC | LYRIC |
| 4187 | 11483 | NM_133546 | f, n, General, kk | myeloid differentiation primary response gene 116 | myeloid differentiation primary response gene 116 |
| 4187 | 18043 | NM_133546 | w, z, General, kk, tt | myeloid differentiation primary response gene 116 | myeloid differentiation primary response gene 116 |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4188 | 13968 | NM_133553 | kk | UDP-Gal:betaGlcNAc beta 1,3-galactosyltransferase, polypeptide 4 | UDP-Gal:betaGlcNAc beta 1,3-galactosyltransferase, polypeptide 4 |
| 4188 | 13969 | NM_133553 | e | UDP-Gal:betaGlcNAc beta 1,3-galactosyltransferase, polypeptide 4 | UDP-Gal:betaGlcNAc beta 1,3-galactosyltransferase, polypeptide 4 |
| 4190 | 17886 | NM_133561 | t, gg, hh | brain protein 44-like | brain protein 44-like |
| 41901 | 7887 | NM_133561 | q | brain protein 44-like | brain protein 44-like |
| 4220 | 4849 | NM_134415 | h, y | CDK105 protein | CDK105 protein |
| 4236 | 48 | NM_138547 | b | 3-alpha-hydroxysteroid dehydrogenase | 3-alpha-hydroxysteroid dehydrogenase |
| 4236 | 25475 | NM_138547 | b | 3-alpha-hydroxysteroid dehydrogenase | 3-alpha-hydroxysteroid dehydrogenase |
| 4246 | 9796 | NM_138847 | f, q | *Saccharomyces cerevisiae* Nip7p homolog | *Saccharomyces cerevisiae* Nip7p homolog |
| 4248 | 11435 | NM_138865 | tt | testis specific protein | testis specific protein |
| 4282 | 11502 | NM_139255 | l, p, q, y, ww | RDCR-0918-3 protein | RDCR-0918-3 protein |
| 4314 | 23070 | NM_148891 | m, General, ee, oo | | ESTs, Highly similar to NMT1_MOUSE Glycylpeptide N-tetradecanoyltransferase 1 (Peptide N-myristoyltransferase 1) (Myristoyl-CoA:protein N-myristoyltransferase 1) (NMT 1) (Type I N-myristoyltransferase) [*M. musculus*] |
| 4319 | 17995 | NM_153312 | e, j | | *Rattus norvegicus* Sprague Dawley testosterone 6-beta-hydroxylase, cytochrome P450/6-beta-A, (CYP3A2) mRNA, complete cds |
| 4359 | 15462 | U06230 | ii | protein S | protein S |
| 4362 | 17281 | U10697 | j, x, dd, rr | carboxylesterase 1 | carboxylesterase 1 |
| 4372 | 18302 | U33500 | n, tt | | *Rattus norvegicus* retinol dehydrogenase type II mRNA, complete cds |
| 4374 | 212 | U36895 | cc | | *Rattus norvegicus* putative pheromone receptor VN3 mRNA, complete cds |
| 4435 | 15106 | X57529 | v | | ESTs, Highly similar to RS18_HUMAN 40S ribosomal protein S18 (KE-3) (KE3) [*R. norvegicus*] |
| 4457 | 436 | X67877 | pp | | *R. norvegicus* mRNA for cytosolic resiniferatoxin-binding protein |
| 4479 | 25777 | Y08355 | h, l, General, uu, xx | oxidative stress induced | oxidative stress induced |
| 1940 | 23574 | AI104520 | ll | Cytochrome c oxidase subunit VIa (liver) | Cytochrome c oxidase subunit VIa (liver) |
| 2592 | 573 | AI232087 | h, l, m, qq | hydroxyacid oxidase 3 (medium-chain) | hydroxyacid oxidase 3 (medium-chain) |
| 2926 | 21011 | H32189 | nn | Glutathione-S-transferase, mu type 2 (Yb2) | Glutathione-S-transferase, mu type 2 (Yb2) |
| 2942 | 21012 | J02592 | b, l, General, gg, hh, kk, ll | Glutathione-S-transferase, mu type 2 (Yb2) | Glutathione-S-transferase, mu type 2 (Yb2) |
| 2945 | 21014 | J03914 | b, l, o, x, General, ll, rr | Glutathione-S-transferase, mu type 2 (Yb2) | Glutathione-S-transferase, mu type 2 (Yb2) |
| 3025 | 19823 | M61725 | oo | Transcription factor UBF | Transcription factor UBF |
| 3181 | 2830 | NM_012925 | l, p, nn | CD59 antigen | CD59 antigen |
| 3293 | 21013 | NM_017014 | cc | Glutathione S-transferase, mu type 2 (Yb2) | Glutathione-S-transferase, mu type 2 (Yb2) |
| 3293 | 21015 | NM_017014 | s, cc | Glutathione S-transferase, mu type 2 (Yb2) | Glutathione-S-transferase, mu type 2 (Yb2) |
| 3342 | 21975 | NM_017154 | l | xanthine dehydrogenase | xanthine dehydrogenase |
| 3436 | 24362 | NM_019156 | a | vitronectin | vitronectin |
| 3470 | 21443 | NM_019262 | nn | complement component 1, q subcomponent, beta polypeptide | complement component 1, q subcomponent, beta polypeptide |
| 3515 | 20816 | NM_021261 | e, ii, ll | thymosin, beta 10 | thymosin, beta 10 |
| 3627 | 180 | NM_022853 | s | solute carrier family 30 (zinc transporter), member 1 | solute carrier family 30 (zinc transporter), member 1 |
| 3666 | 844 | NM_024352 | h, l, n, uu | Macrophage stimulating 1 (hepatocyte growth factor-like) | Macrophage stimulating 1 (hepatocyte growth factor-like) |
| 3687 | 862 | NM_024487 | w | GrpE-like 1, mitochondrial | GrpE-like 1, mitochondrial |
| 3872 | 3548 | NM_031723 | u, ww | signal peptidase complex (18 kD) | signal peptidase complex (18 kD) |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3872 | 3549 | NM_031723 | r, tt | signal peptidase complex (18 kD) | signal peptidase complex (18 kD) |
| 3912 | 16535 | NM_031853 | bb | Diazepam binding inhibitor (GABA receptor modulator, acyl-Coenxyme A binding protein) | Diazepam binding inhibitor (GABA receptor modulator, acyl-Coenzyme A binding protein) |
| 4042 | 18174 | NM_053752 | o | succinate-CoA ligase, GDP-forming, alpha subunit | succinate-CoA ligase, GDP-forming, alpha subunit |
| 4264 | 15134 | NM_139081 | c | Ornithine decarboxylase antizyme 1 | ESTs, Highly similar to OAZ_RAT Ornithine decarboxylase antizyme (ODC-Az) [R. norvegicus] |
| 226 | 4877 | AA818887 | nn | | Rattus norvegicus MHC class I mRNA, complete cds |
| 545 | 13307 | AA891576 | d | | ESTs, Weakly similar to S49158 complement protein C1q beta chain precursor - rat [R. norvegicus] |
| 844 | 15577 | AA924557 | p | | ESTs, Highly similar to vesicle-associated calmodulin-binding protein [Rattus norvegicus] [R. norvegicus] |
| 871 | 5110 | AA925274 | ii | | ESTs, Highly similar to OKRT2R protein kinase (EC 2.7.1.37), cAMP-dependent, type II-alpha regulatory chain - rat (fragment) [R. norvegicus] |
| 1559 | 7912 | AI043836 | oo | | ESTs, Weakly similar to S53340 CD59 protein - rat [R. norvegicus] |
| 1852 | 11636 | AI101967 | r | amyotrophic lateral sclerosis 2 (juvenile) chromosome region, candidate 3 | amyotrophic lateral sclerosis 2 (juvenile) chromosome region, candidate 3 |
| 2019 | 13717 | AI137131 | ll | | ESTs, Moderately similar to S21976 probable RNA-directed DNA polymerase (EC 2 7.7.49) (clone MH2C) - rat retrotransposon L1 (fragment) [R. norvegicus] |
| 2082 | 11961 | AI169030 | z | | ESTs, Weakly similar to GrpE-like 1 mitochondrial; stress-inducible chaperone mt GrpE#1 [Rattus norvegicus] [R. norvegicus] |
| 2126 | 3547 | AI170279 | dd | | ESTs, Weakly similar to S54303 zinc transport protein ZnT-1 - rat [R. norvegicus] |
| 2202 | 15673 | AI172107 | ss | sirtuin 2 (silent mating type information regulation 2, homolog) 2 (S. cerevisiae) | sirtuin 2 (silent mating type information regulation 2, homolog) 2 (S. cerevisiae) |
| 2322 | 13310 | AI177119 | j, jj | | ESTs, Weakly similar to S49158 complement protein C1q beta chain precursor - rat [R. norvegicus] |
| 2702 | 14923 | AI235223 | nn | | ESTs, Weakly similar to A60716 somatotropin intron-related protein RDE.25 - rat (fragment) [R. norvegicus] |
| 2859 | 19943 | AI639479 | qq | | ESTs, Highly similar to 2008147A protein RAKb [Rattus norvegicus] [R. norvegicus] |
| 2893 | 15671 | D37934 | uu | sirtuin 2 (silent mating type information regulation 2, homolog) 2 (S. cerevisiae) | sirtuin 2 (silent mating type information regulation 2, homolog) 2 (S. cerevisiae) |
| 3099 | 14924 | NM_012645 | h, ii | RT1 class Ib gene | ESTs, Weakly similar to A60716 somatotropin intron-related protein RDE.25 - rat (fragment) [R. norvegicus], RT1 class Ib gene |
| 3567 | 24536 | NM_022399 | q | calreticulin | calreticulin |
| 3875 | 21853 | NM_031738 | oo | | ESTs, Highly similar to solute carrier family 29 (nucleoside transporters), member 2 [Rattus norvegicus] [R. norvegicus] |
| 4045 | 1868 | NM_053768 | General, dd, vv | urate oxidase | urate oxidase |
| 4045 | 1869 | NM_053768 | q, General, dd, vv | urate oxidase | urate oxidase |
| 4049 | 7211 | NM_053791 | gg, hh | prolactin-like protein M | prolactin-like protein M |
| 4084 | 19942 | NM_053946 | b, q, dd | implantation-associated protein | implantation-associated protein |
| 4172 | 15553 | NM_133320 | p, z | LIS1-interacting protein NUDEL; endooligopeptidase A | LIS1-interacting protein NUDEL; endooligopeptidase A |
| 4283 | 1789 | NM_139257 | cc | | ESTs, Moderately similar to A45835 Ly6 homolog RK10 precursor - rat [R. norvegicus] |
| 4293 | 1045 | NM_144758 | l, s, General, oo, uu, vv, ww | peptide/histidine transporter | Rattus norvegicus mRNA for peptide/histidine transporter, complete cds |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 568 | 17060 | AA891812 | y, gg, hh | | ESTs, Highly similar to S54147 alpha adducin - rat [*R. norvegicus*] |
| 568 | 17061 | AA891812 | s | | ESTs, Highly similar to S54147 alpha adducin - rat [*R. norvegicus*] |
| 1437 | 19591 | AI012747 | r | | ESTs, Highly similar to BLMH_RAT Bleomycin hydrolase (BLM hydrolase) (BMH) (BH) [*R. norvegicus*] |
| 1923 | 16915 | AI104104 | xx | | ESTs, Highly similar to QYRTGP phosphoenolpyruvate carboxykinase (GTP) (EC 4.1.1.32), cytosolic - rat [*R. norvegicus*] |
| 2573 | 18625 | AI231375 | k | RT1 class Ib gene | RT1 class Ib gene |
| 3003 | 18618 | M24026 | i, ss | RT1 class Ib gene | RT1 class Ib gene |
| 3099 | 18617 | NM_012645 | p | RT1 class Ib gene | RT1 class Ib gene |
| 4055 | 18628 | NM_053806 | n, ee, gg, hh, jj | RT1 class Ib gene | RT1 class Ib gene |
| 1246 | 25148 | AB008807 | bb | glutathione S-transferase omega 1 | |
| 1247 | 25149 | AB009246 | gg, hh | stem cell growth factor | |
| 1258 | 15292 | AF012714 | ff | multiple inositol polyphosphate histidine phosphatase 1 | multiple inositol polyphosphate histidine phosphatase 1 |
| 1287 | 18731 | AF093139 | ww | tip associating protein | tip associating protein |
| 1968 | 15291 | AI111401 | t, ff, mm | multiple inositol polyphosphate histidine phosphatase 1 | multiple inositol polyphosphate histidine phosphatase 1 |
| 2869 | 25233 | AJ000556 | p, mm | Janus kinase 1 | |
| 2891 | 25278 | D30734 | k, ii, tt | RAS p21 protein activator 2 | |
| 2894 | 15123 | D38066 | j, t, mm, xx | UDP-glucuronosyltransferase 1 family, member 1 | UDP-glucuronosyltransferase 1 family, member 1 |
| 2896 | 9134 | D45247 | j, y | proteasome beta type subunit 5 | |
| 2971 | 6963 | L18889 | ff | calnexin | |
| 3006 | 25430 | M26247 | p | Coagulation factor IX (plasma thromboplastic component, Christmas disease, hemophilia B) | |
| 3016 | 20699 | M35601 | vv | Fibrinogen, A alpha polypeptide | Fibrinogen, A alpha polypeptide |
| 3016 | 20700 | M35601 | a, r, x, vv | Fibrinogen, A alpha polypeptide | Fibrinogen, A alpha polypeptide |
| 3036 | 21882 | M83740 | a, General, ff | dimerization cofactor of hepatocyte nuclear factor-1-alpha | |
| 3039 | 13488 | M91599 | g, General, uu | Fibroblast growth factor receptor 4 | |
| 3129 | 5317 | NM_012737 | d, p, w, ee, mm | Apolipoprotein A-IV | Apolipoprotein A-IV |
| 3144 | 10248 | NM_012797 | ff | Inhibitor of DNA binding 1, helix-loop-helix protein (splice variation) | Inhibitor of DNA binding 1, helix-loop-helix protein (splice variation) |
| 3170 | 631 | NM_012896 | g, ss | Adenosine receptor A3 | Adenosine receptor A3 |
| 3220 | 2667 | NM_013048 | b, h, uu | Tocopherol transfer protein alpha | |
| 3274 | 397 | NM_013214 | o | brain acyl CoA hydrolase | brain acyl-CoA hydrolase |
| 3274 | 20851 | NM_013214 | jj | brain acyl CoA hydrolase | brain acyl-CoA hydrolase |
| 3286 | 24897 | NM_016993 | pp | B cell lymphoma 2 associated oncogene | B cell lymphoma 2 associated oncogene |
| 3311 | 11152 | NM_017073 | q, z | Glutamine synthetase (glutamate-ammonia ligase) | Glutamine synthetase (glutamate-ammonia ligase) |
| 3311 | 11153 | NM_017073 | q, r, s, z, rr | Glutamine synthetase (glutamate-ammonia ligase) | Glutamine synthetase (glutamate-ammonia ligase) |
| 4264 | 25250 | NM_139081 | c, t | Ornithine decarboxylase antizyme 1 | |
| 4264 | 25251 | NM_139081 | c, m | Ornithine decarboxylase antizyme 1 | |
| 4334 | 25505 | S65091 | g, y | cAMP-regulated phosphoprotein (21 kDa) | |
| 4367 | 25593 | U26310 | k | tensin | |
| 4381 | 11916 | U50842 | qq | Neural precursor cell expressed, developmentally down-regulated gene 4 | |
| 4389 | 25083 | U72632 | nn | amine oxidase, copper containing 3 | |
| 4394 | 25642 | U77697 | gg, hh | platelet/endothelial cell adhesion molecule | |
| 4416 | 15652 | X14210 | h, gg, hh | ribosomal protein S4, X-linked | |
| 4422 | 25686 | X51536 | z, General | ribosomal protein S3 | |
| 4427 | 12859 | X53052 | s, v | Major intrinsic protein of eye lens fiber | |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4437 | 5667 | X58200 | h, l, z, General, ee | ribosomal protein L23 | |
| 4445 | 25718 | X62145 | c, cc | ribosomal protein L8 | |
| 4453 | 25090 | X63594 | ii | Inhibitor of nuclear factor of kappa light chain gene enhancer in B-cells, alpha | |
| 4466 | 25746 | X80778 | t | dihydroorotate dehydrogenase | |
| 4476 | 1620 | X97374 | bb | Prepronociceptin (neuropeptide nociceptin) (N23K) | Prepronociceptin (neuropeptide nociceptin) (N23K) |
| 4482 | 20426 | Z12158 | ff, gg, hh | Pyruvate dehydrogenase (lipoamide) alpha 1 | |
| 4321 | 11755 | NM_153314 | b, l, s, General, cc, vv | UDP-glucuronosyltransferase 2 family, member 5 | |
| 4395 | 25643 | U77829 | l, General, bb, ii, uu | growth arrest specific 5 | |
| 4395 | 4477 | U77829 | ii, rr | growth arrest specific 5 | ESTs |
| 1 | 25120 | A03913 | bb, pp | | |
| 2 | 6857 | AA012807 | gg, hh | | |
| 3 | 25098 | AAI08277 | e | | |
| 4 | 4433 | AA684641 | b, x, General | | ESTs |
| 7 | 2102 | AA685760 | r | | ESTs |
| 8 | 25103 | AA685876 | d | | |
| 9 | 4426 | AA685974 | h, l, v, uu | | ESTs, Weakly similar to Y73E7A.1.p [*Caenorhabditis elegans*] [*C. elegans*] |
| 10 | 16704 | AA686132 | o | | |
| 11 | 14286 | AA686361 | j | | |
| 15 | 18272 | AA799294 | pp | | ESTs |
| 17 | 18396 | AA799330 | f, l, j, General, kk, qq | | ESTs, Weakly similar to T47122 cell division protein pelota [imported] - fruit fly (*Drosophila melanogaster*) [*D. melanogaster*] |
| 19 | 15083 | AA799396 | p | | ESTs |
| 20 | 15084 | AA799397 | k | | ESTs |
| 21 | 26053 | AA799406 | x | | |
| 24 | 18365 | AA799442 | g, rr | | ESTs |
| 24 | 18366 | AA799442 | ss | | ESTs |
| 25 | 18160 | AA799448 | t | | ESTs |
| 26 | 18859 | AA799467 | gg, hh | | ESTs |
| 27 | 4206 | AA799474 | ll | | ESTs, Highly similar to CY1_HUMAN Cytochrome c1, heme protein, mitochondrial precursor *H. sapiens*] |
| 30 | 18561 | AA799481 | l, s, pp | | ESTs, Weakly similar to esc-P1 [*Drosophila melanogaster*] [*D. melanogaster*] |
| 31 | 11350 | AA799488 | c, ee, gg, hh, ss | | ESTs |
| 36 | 18327 | AA799537 | q, bb | | ESTs |
| 39 | 24628 | AA799542 | oo | | ESTs |
| 41 | 22669 | AA799567 | jj | | ESTs |
| 43 | 20971 | AA799576 | a, ii, rr | | ESTs, Highly similar to T46259 hypothetical protein DKFZp761E0323.1 - human (fragment) [*H. sapiens*] |
| 46 | 18331 | AA799594 | b | | ESTs |
| 47 | 17712 | AA799598 | tt | | ESTs |
| 48 | 15844 | AA799600 | d | | ESTs, Highly similar to hypothetical protein DKFZp586I021 [*Homo sapiens*] [*H. sapiens*] |
| 49 | 20977 | AA799609 | ww | | ESTs, Moderately similar to T43443 hypothetical protein DKFZp434A2315.1 - human (fragment) [*H. sapiens*] |
| 54 | 22909 | AA799654 | rr | | ESTs |
| 55 | 11313 | AA799656 | d | | ESTs |
| 55 | 11314 | AA799656 | ss | | ESTs |
| 57 | 20987 | AA799664 | y | | ESTs |
| 58 | 11690 | AA799667 | m | | *Rattus norvegicus* CDK106 mRNA |
| 59 | 23878 | AA799686 | vv | | ESTs |
| 61 | 20994 | AA799717 | q, dd, ll | | ESTs, Highly similar to RPB9_HUMAN DNA-directed RNA polymerase II 14.5 kDa polypeptide (RPB9) (RPB14.5) [*H. sapiens*] |
| 62 | 23084 | AA799721 | y | | ESTs |
| 64 | 8768 | AA799726 | f, l, u, v | | ESTs |
| 67 | 18349 | AA799744 | e, p, z, General, qq | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 68 | 17494 | AA799751 | s, y | | ESTs |
| 70 | 18360 | AA799771 | xx | | ESTs |
| 72 | 6425 | AA799784 | a | | ESTs |
| 75 | 17604 | AA799796 | a, s | | ESTs |
| 78 | 14504 | AA799804 | u | | ESTs |
| 79 | 11423 | AA799812 | oo | | ESTs, Moderately similar to PTN3_HUMAN Protein tyrosine phosphatase, non-receptor type 3 (Protein-tyrosine phosphatase H1) (PTP-H1) [*H. sapiens*] |
| 81 | 21001 | AA799822 | a | | ESTs |
| 81 | 18844 | AA799822 | v | | ESTs |
| 83 | 10543 | AA799847 | ee | | ESTs |
| 84 | 21005 | AA799858 | bb | | EST, Moderately similar to ODPB_RAT Pyruvate dehydrogenase E1 component beta subunit, mitochondrial precursor (POHE1-B) [*R. norvegicus*] |
| 86 | 12788 | AA799871 | q, s, z, dd | | ESTs |
| 88 | 18381 | AA799889 | ff | | ESTs |
| 89 | 18179 | AA799891 | oo | | ESTs |
| 89 | 18180 | AA799891 | d, w | | ESTs |
| 92 | 23202 | AA799971 | ss | | ESTs, Moderately similar to hypothetical protein FLJ10986 [*Homo sapiens*] [*H. sapiens*] |
| 93 | 21029 | AA799981 | xx | | ESTs |
| 94 | 18400 | AA799991 | General | | ESTs |
| 98 | 23343 | AA800016 | a | | ESTs, Weakly similar to Yeast ABD1 protein like [*Caenorhabditis elegans*] [*C. elegans*] |
| 99 | 21034 | AA800025 | g | | ESTs |
| 100 | 23344 | AA800034 | j, dd, ll, ww | | ESTs |
| 102 | 18405 | AA800044 | f | | ESTs |
| 104 | 19177 | AA800062 | a, u | | ESTs |
| 108 | 18430 | AA800197 | b, f, q, General | | ESTs |
| 109 | 16661 | AA800198 | j, ww, xx | | ESTs, Weakly similar to ORM1_YEAST ORM1 PROTEIN [*S. cerevisiae*] |
| 111 | 21069 | AA800200 | f, y | | ESTs |
| 112 | 18433 | AA800218 | jj | | ESTs, Weakly similar to T15476 hypothetical protein C09F5.2 - *Caenorhabditis elegans* [*C. elegans*] |
| 113 | 600 | AA800222 | ss | | ESTs |
| 114 | 7947 | AA800224 | ww | | ESTs, Weakly similar to C27H6.4.p [*Caenorhabditis elegans*] [*C. elegans*] |
| 118 | 21083 | AA800290 | ll, ww | | ESTs |
| 118 | 21084 | AA800290 | ww | | ESTs |
| 122 | 23476 | AA800319 | ii | | ESTs, Weakly similar to apolipoprotein L, 3; TNF-inducible protein CG12-1 [*Homo sapiens*] [*H. sapiens*] |
| 125 | 21099 | AA800503 | u | | ESTs |
| 127 | 16795 | AA800570 | jj | | ESTs |
| 128 | 19073 | AA800576 | l, m, General, gg, hh, jj, uu | | ESTs |
| 129 | 2070 | AA800597 | ff | | ESTs |
| 130 | 13930 | AA800613 | n, tt | | EST |
| 131 | 12070 | AA800622 | s, z, General | | ESTs, Weakly similar to K08H10.9.p [*Caenorhabditis elegans*] [*C. elegans*] |
| 132 | 4843 | AA800651 | r | | ESTs |
| 134 | 18079 | AA800665 | x, y | | ESTs |
| 135 | 19084 | AA800669 | uu | | ESTs, Highly similar to A36180 61K transforming protein - human [*H. sapiens*] |
| 137 | 5257 | AA800673 | j, ww | | ESTs, Highly similar to KIAA0164 gene product [*Homo sapiens*] [*H. sapiens*] |
| 138 | 23368 | AA800678 | n, r, General, kk | | ESTs |
| 139 | 19087 | AA800679 | x,z | | ESTs, Weakly similar to putative nucleotide binding protein, estradiol-induced [*Homo sapiens*] [*H. sapiens*] |
| 141 | 18069 | AA800686 | a, q, dd, oo | | ESTs |
| 142 | 21372 | AA800693 | c, j, o, ww | | ESTs |
| 142 | 21373 | AA800693 | l, p | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 143 | 21375 | AA800699 | f, l | | ESTs, Weakly similar to YN60__YEAST HYPOTHETICAL 32.3 KDA PROTEIN IN KRE1-HXT14 INTERGENIC REGION [*S. cerevisiae*] |
| 144 | 18161 | AA800701 | c | | ESTs |
| 145 | 19091 | AA800717 | l | | ESTs |
| 146 | 21377 | AA800719 | kk | | ESTs |
| 148 | 16385 | AA800737 | p | | ESTs, Weakly similar to T42209 neural plakophilin related arm-repeat protein NPRAP - mouse [*M. musculus*] |
| 150 | 21380 | AA800739 | z, ee | | ESTs, Weakly similar to KT12__YEAST KTI12 PROTEIN [*S. cerevisiae*] |
| 151 | 8137 | AA800749 | h | | ESTs |
| 152 | 6595 | AA800753 | gg, hh, tt | | ESTs |
| 153 | 23213 | AA800786 | r | | ESTs |
| 154 | 19101 | AA800787 | a, qq | | ESTs |
| 156 | 19103 | AA800797 | General, dd, ff | | ESTs |
| 157 | 11662 | AA800803 | bb | | ESTs, Weakly similar to YNP5__CAEEL HYPOTHETICAL 28.3 KDA PROTEIN T05G5.5 IN CHROMOSOME III [*C. elegans*] |
| 159 | 8207 | AA800850 | qq | | ESTs |
| 161 | 21403 | AA800885 | t, nn | | ESTs |
| 162 | 13348 | AA800928 | t, ff, mm | | ESTs |
| 167 | 13919 | AA801070 | m | | ESTs |
| 169 | 22318 | AA801187 | pp | | ESTs |
| 171 | 21442 | AA801244 | g | | ESTs |
| 172 | 10549 | AA801255 | l | | ESTs |
| 173 | 21593 | AA801368 | nn | | ESTs |
| 176 | 5959 | AA817813 | ll | | ESTs |
| 177 | 23725 | AA817816 | xx | | ESTs |
| 178 | 1690 | AA817829 | General, cc, qq | | ESTs |
| 179 | 6306 | AA817831 | z | | ESTs |
| 180 | 1802 | AA817841 | n | | ESTs |
| 181 | 1846 | AA817844 | jj | | ESTs |
| 182 | 1900 | AA817849 | ii | | ESTs |
| 183 | 11639 | AA817860 | mm | | ESTs |
| 185 | 5972 | AA817917 | pp | | EST |
| 187 | 2781 | AA817925 | c, l, z, General, bb, pp, rr | | ESTs |
| 190 | 5977 | AA817969 | r | | ESTs |
| 192 | 5979 | AA817990 | l, General | | ESTs |
| 194 | 2897 | AA818039 | l | | ESTs |
| 195 | 5996 | AA818065 | cc, tt | | ESTs |
| 197 | 6313 | AA818093 | g | | EST |
| 200 | 3476 | AA818142 | cc | | ESTs, Weakly similar to F13B9.8.p [*Caenorhabditis elegans*] [*C. elegans*] |
| 203 | 6027 | AA818244 | s | | ESTs |
| 205 | 6037 | AA818288 | l | | ESTs |
| 206 | 7628 | AA818380 | d | | ESTs |
| 207 | 7714 | AA818394 | xx | | ESTs |
| 210 | 7806 | AA818421 | nn | | ESTs |
| 211 | 6224 | AA818511 | m | | ESTs |
| 212 | 6226 | AA818521 | oo | | ESTs |
| 214 | 6231 | AA818595 | o | | ESTs |
| 215 | 18874 | AA818602 | cc | | ESTs |
| 218 | 4250 | AA818700 | ww | | ESTs |
| 219 | 6060 | AA818702 | b, r | | ESTs |
| 220 | 11610 | AA818725 | m | | ESTs |
| 221 | 4291 | AA818741 | t, ff | | ESTs |
| 223 | 19723 | AA818761 | tt | | ESTs |
| 224 | 6188 | AA818774 | l, General, ff | | ESTs |
| 227 | 6090 | AA818889 | cc | | ESTs |
| 228 | 4952 | AA818907 | q, z, General, dd, ee, kk | | ESTs |
| 229 | 6094 | AA818911 | xx | | ESTs |
| 230 | 5966 | AA818947 | ss | | ESTs |
| 238 | 24721 | AA819306 | h, w | | ESTs |
| 242 | 6252 | AA819381 | ff, vv | | ESTs |
| 243 | 6254 | AA819390 | c, d, ww | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 244 | 12096 | AA819415 | t, ff, mm | | ESTs |
| 245 | 13985 | AA819429 | u | | |
| 246 | 6268 | AA819441 | nn | | ESTs |
| 247 | 19438 | AA819450 | xx | | EST |
| 251 | 6284 | AA819537 | p, General | | ESTs |
| 253 | 6171 | AA819633 | n | | ESTs |
| 254 | 6723 | AA819653 | j | | ESTs, Weakly similar to S44652 f42h10.6 protein - *Caenorhabditis elegans* [*C. elegans*] |
| 255 | 6175 | AA819655 | x | | EST |
| 256 | 6176 | AA819657 | bb | | EST |
| 257 | 6295 | AA819672 | General | | ESTs |
| 259 | 16088 | AA819717 | b, c, p | | ESTs |
| 261 | 7111 | AA819816 | p, w | | ESTs |
| 262 | 11640 | AA819828 | l | | ESTs |
| 263 | 6198 | AA819840 | nn | | ESTs |
| 267 | 7559 | AA819918 | qq | | ESTs |
| 268 | 24629 | AA848238 | z, General | | ESTs |
| 270 | 7436 | AA848354 | dd | | ESTs, Moderately similar to hypothetical protein FLJ23251 [*Homo sapiens*] [*H. sapiens*] |
| 272 | 23521 | AA848407 | h, m, x | | ESTs |
| 273 | 21125 | AA848437 | l, General | | ESTs |
| 274 | 11160 | AA848470 | pp | | ESTs |
| 275 | 23504 | AA848496 | b, l, gg, hh, rr | | ESTs, Moderately similar to IF4B_HUMAN Eukaryotic translation initiation factor 4B (eIF-4B) [*H. sapiens*] |
| 275 | 23505 | AA848496 | l, rr | | ESTs, Moderately similar to IF4B_HUMAN Eukaryotic translation initiation factor 4B (eIF-4B) [*H. sapiens*] |
| 276 | 6872 | AA848508 | x | | ESTs |
| 278 | 18518 | AA848540 | n | | ESTs, Weakly similar to PC326 protein [*Homo sapiens*] [*H. sapiens*] |
| 279 | 19503 | AA848639 | y | | ESTs |
| 280 | 11167 | AA848696 | c | | ESTs, Weakly similar to S30833 hypothetical protein YEL044w - yeast (*Saccharomyces cerevisiae*) [*S. cerevisiae*] |
| 281 | 6165 | AA848780 | j, ff, pp | | ESTs |
| 284 | 21176 | AA849003 | d | | ESTs |
| 285 | 12114 | AA849092 | j | | ESTs |
| 286 | 3487 | AA849132 | ff | | ESTs |
| 288 | 12453 | AA849263 | v | | ESTs |
| 289 | 14211 | AA849391 | f | | ESTs |
| 290 | 18909 | AA849426 | a, v, General, dd, uu | | ESTs, Weakly similar to YLC4_CAEEL Hypothetical 81.0 kDa protein C35D10.4 in chromosome III [*C. elegans*] |
| 291 | 17339 | AA849497 | c, v, dd | | ESTs |
| 292 | 12122 | AA849586 | j | | ESTs |
| 293 | 2841 | AA849714 | o, ii, xx | | ESTs |
| 294 | 18693 | AA849715 | tt | | ESTs |
| 296 | 6634 | AA849777 | xx | | ESTs |
| 298 | 8595 | AA849789 | pp | | ESTs |
| 300 | 21275 | AA849796 | pp, tt | | ESTs |
| 302 | 16678 | AA849827 | General | | ESTs |
| 304 | 16501 | AA849876 | ee | | ESTs |
| 305 | 18446 | AA849939 | d | | ESTs |
| 305 | 18447 | AA849939 | d | | ESTs |
| 308 | 18390 | AA850038 | l, p, General | | ESTs |
| 309 | 26058 | AA850076 | gg, hh | | ESTs |
| 310 | 19009 | AA850164 | x, ss | | ESTs |
| 311 | 21341 | AA850195 | General, ii | | ESTs |
| 312 | 19416 | AA850244 | vv | | ESTs |
| 313 | 21353 | AA850247 | u | | ESTs |
| 314 | 13615 | AA850364 | b | | ESTs, Moderately similar to RB17_MOUSE Ras-related protein Rab-17 [*M. musculus*] |
| 318 | 16568 | AA850582 | ss | | ESTs, Weakly similar to GL004 protein [*Homo sapiens*] [*H. sapiens*] |
| 320 | 7596 | AA850686 | a, oo, tt | | ESTs |
| 321 | 26064 | AA850733 | p | | |
| 322 | 17522 | AA850812 | dd | | ESTs |
| 324 | 21762 | AA850886 | e | | ESTs |
| 325 | 21766 | AA850916 | q | | ESTs |
| 326 | 14734 | AA850917 | w | | ESTs |
| 329 | 12164 | AA851029 | ii, ll | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 339 | 18961 | AA851238 | u, ww | fasting-inducible integral membrane protein TM6P1 | fasting-inducible integral membrane protein TM6P1 |
| 340 | 21457 | AA851253 | General | | ESTs |
| 342 | 17482 | AA851264 | d | | ESTs |
| 343 | 21465 | AA851273 | g | | ESTs, Weakly similar to retinoic acid receptor responder (tazarotene induced) 2 [*Homo sapiens*] [*H. sapiens*] |
| 343 | 21466 | AA851273 | g | | ESTs, Weakly similar to retinoic acid receptor responder (tazarotene induced) 2 [*Homo sapiens*] [*H. sapiens*] |
| 344 | 10714 | AA851279 | bb | | ESTs |
| 345 | 21469 | AA851318 | s, bb | | EST |
| 348 | 21479 | AA851401 | u | | ESTs |
| 350 | 12173 | AA851455 | k | | ESTs |
| 351 | 2639 | AA851456 | q, General | | ESTs |
| 352 | 16404 | AA851466 | t, rr | | ESTs |
| 352 | 16405 | AA851466 | ii, rr | | ESTs |
| 353 | 21510 | AA851620 | ee, pp | | ESTs |
| 354 | 21514 | AA851660 | s | | ESTs |
| 359 | 2091 | AA851873 | tt | | ESTs |
| 360 | 23370 | AA851938 | q | | ESTs |
| 361 | 21561 | AA851951 | d, f, r | | |
| 362 | 21572 | AA852011 | u | | ESTs |
| 364 | 6474 | AA858457 | c | | ESTs |
| 366 | 24161 | AA858588 | c | | ESTs |
| 367 | 24377 | AA858590 | l, z, General, kk, nn, pp | | ESTs |
| 369 | 18085 | AA858603 | t | | EST, Weakly similar to T16084 hypothetical protein F16H11.1 - *Caenorhabditis elegans* [*C. elegans*] |
| 370 | 17382 | AA858607 | c, p, oo | | ESTs |
| 373 | 6347 | AA858660 | l, nn | | ESTs |
| 374 | 18350 | AA858674 | y, General | | ESTs |
| 376 | 13229 | AA858760 | f | | ESTs |
| 377 | 6384 | AA858788 | d, ss | | ESTs |
| 378 | 11615 | AA858816 | j | | ESTs, Weakly similar to F53A3.7.p [*Caenorhabditis elegans*] [*C. elegans*] |
| 380 | 14234 | AA858928 | bb | | ESTs |
| 384 | 6420 | AA859000 | ii | | ESTs |
| 385 | 6830 | AA859010 | ww | | ESTs |
| 387 | 17361 | AA859114 | n | | ESTs |
| 389 | 15081 | AA859218 | b | | ESTs |
| 391 | 6717 | AA859252 | l, m | | ESTs |
| 393 | 21851 | AA859330 | xx | | ESTs |
| 394 | 16314 | AA859348 | a | | ESTs |
| 395 | 13052 | AA859351 | j, pp | | ESTs |
| 397 | 25030 | AA859372 | gg, hh | | |
| 399 | 11827 | AA859468 | ii, ww | | ESTs |
| 400 | 23142 | AA859479 | ii | | ESTs |
| 401 | 13271 | AA859502 | f | | ESTs |
| 402 | 16315 | AA859509 | ee | | ESTs |
| 404 | 14486 | AA859524 | cc | | ESTs |
| 405 | 4178 | AA859536 | s, t | | ESTs |
| 406 | 14353 | AA859585 | c, f, p, ff | | ESTs |
| 407 | 11852 | AA859593 | l, l, n, p, z, General | | ESTs |
| 409 | 13381 | AA859626 | l | | ESTs |
| 412 | 17316 | AA859652 | l, y, z, ee, nn, pp | | ESTs |
| 413 | 19067 | AA859663 | y, General | | ESTs |
| 414 | 19726 | AA859665 | k | | EST |
| 415 | 14261 | AA859693 | y | | ESTs, Weakly similar to YNH2_CAEEL HYPOTHETICAL 31.0 KD PROTEIN R107.2 IN CHROMOSOME III [*C. elegans*] |
| 417 | 21707 | AA859722 | e, p, q, y | | ESTs |
| 418 | 19530 | AA859740 | n | | ESTs |
| 422 | 11079 | AA859829 | d | | ESTs |
| 424 | 22739 | AA859877 | q, dd | | ESTs |
| 425 | 22813 | AA859897 | ff, pp | | ESTs |
| 426 | 22816 | AA859898 | ii | | ESTs |
| 427 | 22889 | AA859909 | j | | ESTs |
| 428 | 22927 | AA859920 | j, m, ii, pp | | ESTs |
| 429 | 22999 | AA859933 | n | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 429 | 23000 | AA859933 | d, n, t | | ESTs |
| 430 | 22408 | AA859952 | s | | ESTs |
| 431 | 18468 | AA859966 | q, ff, oo, qq | | ESTs, Moderately similar to TNP1_HUMAN Tumor necrosis factor, alpha-induced protein 1, endothelial (B12 protein) [*H. sapiens*] |
| 437 | 18469 | AA859990 | q | | ESTs, Moderately similar to TNP1_HUMAN Tumor necrosis factor, alpha-induced protein 1, endothelial (B12 protein) [*H. sapiens*] |
| 438 | 11863 | AA859996 | d | | ESTs |
| 443 | 23716 | AA860044 | r, z, General | | ESTs |
| 444 | 19144 | AA860049 | a | | ESTs |
| 446 | 16322 | AA866240 | h | | EST |
| 447 | 7960 | AA866291 | g | | ESTs |
| 448 | 15898 | AA866293 | k | | EST |
| 450 | 15927 | AA866321 | o, v, ff | | ESTs |
| 451 | 15870 | AA866358 | jj | | ESTs |
| 452 | 16607 | AA866364 | c | | ESTs |
| 453 | 11865 | AA866383 | e, h, gg, hh | | ESTs |
| 454 | 10523 | AA866409 | k | | |
| 456 | 15980 | AA866426 | kk | | ESTs |
| 457 | 16853 | AA866454 | gg, hh | | ESTs |
| 457 | 16854 | AA866454 | gg, hh | | ESTs |
| 458 | 18995 | AA866459 | General | | ESTs, Highly similar to hypothetical protein MGC4175 [*Homo sapiens*] [*H. sapiens*] |
| 466 | 16085 | AA874889 | ff, ii, nn, ss | | ESTs |
| 467 | 16615 | AA874912 | x | | ESTs |
| 468 | 16138 | AA874927 | d | | ESTs |
| 468 | 16139 | AA874927 | qq, ss, vv | | ESTs |
| 472 | 11239 | AA874993 | ii, pp | | ESTs |
| 473 | 16192 | AA874995 | n, y | | ESTs |
| 475 | 16237 | AA875017 | p | | ESTs |
| 477 | 16312 | AA875032 | tt | | ESTs |
| 479 | 6490 | AA875042 | ww | | ESTs, Weakly similar to hypothetical protein FLJ21801 [*Homo sapiens*] [*H. sapiens*] |
| 485 | 4721 | AA875090 | g | | ESTs |
| 489 | 15309 | AA875122 | s, z | | ESTs |
| 490 | 15310 | AA875123 | h | | EST |
| 491 | 15311 | AA875124 | jj | | EST |
| 492 | 15312 | AA875126 | l, v, General, xx | | ESTs |
| 492 | 15313 | AA875126 | f, l, j, nn | | ESTs |
| 494 | 15316 | AA875129 | g, jj | | ESTs |
| 496 | 22349 | AA875148 | General | | ESTs |
| 500 | 15384 | AA875217 | k | | ESTs |
| 502 | 15401 | AA875257 | c, d, gg, hh | | ESTs |
| 503 | 15402 | AA875261 | f, ss | | ESTs |
| 506 | 15420 | AA875286 | jj | | ESTs, Highly similar to prostate tumor over expressed gene 1 [*Homo sapiens*] [*H. sapiens*] |
| 506 | 15421 | AA875286 | n, p, kk, xx | | ESTs, Highly similar to prostate tumor over expressed gene 1 [*Homo sapiens*] [*H. sapiens*] |
| 507 | 15445 | AA875327 | j | | ESTs |
| 507 | 15446 | AA875327 | c, kk | | ESTs |
| 508 | 15510 | AA875428 | k | | ESTs |
| 510 | 7936 | AA875495 | General | | ESTs |
| 511 | 13477 | AA875496 | n | | ESTs |
| 512 | 19381 | AA875506 | p | | ESTs, Weakly similar to 0806162N protein URFA6L [*Mus musculus*] [*M. musculus*] |
| 517 | 15587 | AA875577 | z, General | | ESTs |
| 519 | 15617 | AA875620 | l, General, ii, ll, qq, rr | | ESTs |
| 519 | 15618 | AA875620 | l, General ll, qq, ww | | ESTs |
| 520 | 15629 | AA875629 | pp | | ESTs |
| 527 | 19646 | AA891054 | qq | | ESTs |
| 528 | 11940 | AA891108 | d, t, bb | | ESTs |
| 529 | 21909 | AA891161 | ss | | ESTs |
| 530 | 18582 | AA891207 | w, z, ee, kk | | ESTs |
| 532 | 21917 | AA891220 | ee, xx | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 534 | 15152 | AA891314 | d | | ESTs |
| 535 | 16446 | AA891423 | ii | | ESTs |
| 536 | 11599 | AA891438 | cc | | ESTs, Weakly similar to C42D8.3.p [*Caenorhabditis elegans*] [*C. elegans*] |
| 538 | 16997 | AA891447 | bb | | ESTs |
| 541 | 21905 | AA891546 | r | | ESTs |
| 543 | 21955 | AA891559 | y, ss | | ESTs |
| 544 | 7522 | AA891571 | General | | ESTs, Weakly similar to S67314 regulatory protein RMS1 - yeast (*Saccharomyces cerevisiae*) [*S. cerevisiae*] |
| 546 | 11949 | AA891580 | qq, vv | | ESTs |
| 550 | 18490 | AA891669 | x, nn | | ESTs |
| 551 | 17052 | AA891689 | oo | | ESTs |
| 553 | 17038 | AA891727 | ii | | ESTs |
| 553 | 17039 | AA891727 | a | | ESTs |
| 554 | 3422 | AA891732 | qq | | ESTs |
| 555 | 23058 | AA891733 | p, x, General | | ESTs |
| 556 | 11959 | AA891735 | l | | ESTs |
| 557 | 17693 | AA891737 | qq, vv | | ESTs |
| 558 | 17256 | AA891739 | k | | ESTs, Weakly similar to F52H3.5.p [*Caenorhabditis elegans*] [*C. elegans*] |
| 560 | 13686 | AA891749 | rr | | ESTs |
| 563 | 17289 | AA891785 | kk | | ESTs, Weakly similar to A54756 isocitrate dehydrogenase (NADP+) (EC 1.1.1.42), cytosolic - rat [*R. norvegicus*] |
| 564 | 22124 | AA891790 | z, General, kk | | ESTs |
| 565 | 3717 | AA891796 | j, uu | | ESTs |
| 569 | 4461 | AA891814 | x | | ESTs |
| 570 | 17311 | AA891818 | rr | | ESTs |
| 571 | 22841 | AA891821 | f, General, uu | | ESTs |
| 573 | 14289 | AA891838 | dd | | ESTs, Weakly similar to F10E7.5.p [*Caenorhabditis elegans*] [*C. elegans*] |
| 576 | 2576 | AA891884 | gg, hh | | ESTs |
| 577 | 11973 | AA891891 | ff, ww | | ESTs |
| 578 | 17308 | AA891902 | w | | ESTs |
| 578 | 17309 | AA891902 | u, bb | | ESTs |
| 580 | 23312 | AA891920 | f, General | | ESTs, Highly similar to A Chain A, Structural Basis For The Recognition Of A Nucleoporin Fg- Repeat By The Ntf2-Like Domain Of Tap-P15 Mrna Nuclear Export Factor [*H. sapiens*] |
| 581 | 11975 | AA891928 | z, ee, pp, ww | | ESTs, Moderately similar to PC4189 TATA-binding protein - mouse (fragment) [*M. musculus*] |
| 583 | 19319 | AA891937 | gg, hh | | ESTs, Highly similar to S66254 dolichyl-diphosphooligosaccharide--protein glycotransferase (EC 2.4.1.119) 50K chain - human [*H. sapiens*] |
| 584 | 22862 | AA891944 | x, General | | ESTs |
| 585 | 1159 | AA891949 | n, z, General, dd | | ESTs |
| 586 | 4474 | AA891969 | pp | | ESTs |
| 587 | 17374 | AA891978 | r | | ESTs |
| 591 | 15087 | AA892010 | j, m, q, ll | | ESTs, Weakly similar to T22242 hypothetical protein F45G2.10 - *Caenorhabditis elegans* [*C. elegans*] |
| 593 | 38474 | A892036 | s | | ESTs, Highly similar to T13964 probable histone deacetylase (EC 3.5.1.—) HDA2 - mouse [*M. musculus*] |
| 595 | 9037 | AA892066 | ss | | ESTs |
| 596 | 22865 | AA892083 | k, nn, ww | | ESTs |
| 597 | 15891 | AA892086 | a, qq | | ESTs |
| 598 | 8139 | AA892094 | ww | | ESTs |
| 600 | 16899 | AA892127 | u | | ESTs |
| 601 | 14595 | AA892128 | o, nn, xx | | ESTs |
| 602 | 14330 | AA892146 | t, y | | ESTs |
| 603 | 11384 | AA892149 | c, p | | ESTs |
| 604 | 16527 | AA892154 | o | | ESTs |
| 608 | 15667 | AA892248 | s | | |
| 610 | 9073 | AA892273 | nn | | ESTs |
| 611 | 18190 | AA892280 | bb | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 612 | 11982 | AA892284 | vv | | ESTs |
| 614 | 16479 | AA892303 | d, qq | | ESTs, ESTs, Weakly similar to JC5533 scavenger receptor class B type I precursor - rat [*R. norvegicus*] |
| 615 | 19181 | AA892308 | bb, ll, qq, uu | | ESTs |
| 619 | 11980 | AA892335 | l | | ESTs |
| 620 | 2118 | AA892346 | rr | | ESTs, Moderately similar to anaphase-promoting complex subunit 4 [*Homo sapiens*] [*H. sapiens*] |
| 622 | 15492 | AA892376 | tt | | ESTs |
| 625 | 16368 | AA892396 | bb | | ESTs |
| 626 | 4495 | AA892399 | General | | ESTs |
| 629 | 17439 | AA892446 | k | | ESTs |
| 634 | 6944 | AA892500 | c | | ESTs |
| 635 | 14066 | AA892504 | f, s, pp | | ESTs |
| 636 | 15043 | AA892505 | General | | ESTs, Highly similar to divalent cation tolerant protein CUTA [*Homo sapiens*] [*H. sapiens*] |
| 638 | 8599 | AA892522 | a, l | | ESTs |
| 642 | 16507 | AA892547 | m | | ESTs, Highly similar to hypothetical protein CL25022 [*Homo sapiens*] [*H. sapiens*] |
| 643 | 17469 | AA892549 | m, w, General, ss | | ESTs |
| 644 | 19631 | AA892550 | a | | ESTs |
| 645 | 4507 | AA892551 | gg, hh | | EST |
| 646 | 11202 | AA892554 | z | | ESTs |
| 647 | 13574 | AA892557 | z | | ESTs |
| 650 | 19085 | AA892598 | rr | | ESTs, Weakly similar to putative nucleotide binding protein, estradiol-induced [*Homo sapiens*] [*H. sapiens*] |
| 650 | 19086 | AA892598 | f, l, rr | | ESTs, Weakly similar to putative nucleotide binding protein, estradiol-induced [*Homo sapiens*] [*H. sapiens*] |
| 651 | 16825 | AA892602 | b, d, f, q, r, z, dd, ee | | ESTs |
| 652 | 2119 | AA892607 | d | | ESTs |
| 653 | 2121 | AA892637 | v | | ESTs |
| 654 | 4517 | AA892642 | a, w | | ESTs |
| 657 | 20088 | AA892666 | cc | | ESTs |
| 659 | 4523 | AA892754 | w | | ESTs |
| 661 | 23783 | AA892773 | t | | ESTs |
| 662 | 4527 | AA892774 | y | | ESTs |
| 664 | 17421 | AA892789 | o, bb, ff, ss | | ESTs |
| 669 | 19443 | AA892832 | pp | | ESTs |
| 672 | 17590 | AA892851 | pp | | ESTs |
| 674 | 18887 | AA892860 | ww | | ESTs |
| 675 | 1031 | AA892863 | r | | ESTs |
| 676 | 7756 | AA892864 | o | | ESTs |
| 677 | 16366 | AA892888 | General, rr | | EST |
| 677 | 16367 | AA892888 | m, q, x, General, ll | | EST |
| 678 | 12848 | AA892916 | l | | ESTs, Weakly similar to JC7260 strictosidine synthase (EC 4.3.3.2) homolog 2 - fruit fly (*Drosophila melanogaster*) [*D. melanogaster*] |
| 681 | 15956 | AA892942 | r, u | | ESTs |
| 682 | 14465 | AA892950 | tt | | ESTs, Moderately similar to A Chain A, Crystal Structure Of The Accessory Subunit Of Murine Mitochondrial Polymerase Gamma [*M. musculus*] |
| 683 | 8606 | AA892959 | nn | | ESTs, Weakly similar to 1-aminocyclopropane-1-carboxylate synthase [*Homo sapiens*] [*H. sapiens*] |
| 687 | 3131 | AA893032 | b, h, q | | ESTs |
| 688 | 3858 | AA893040 | p | | ESTs |
| 690 | 17691 | AA893088 | nn, ss | | ESTs |
| 692 | 16372 | AA893160 | c | | ESTs |
| 695 | 7096 | AA893193 | d, q | | ESTs |
| 697 | 13323 | AA893212 | u | | ESTs |
| 698 | 4243 | AA893217 | n, w | | ESTs |
| 700 | 11252 | AA893225 | ww | | ESTs |
| 703 | 10538 | AA893239 | o | 2-hydroxyphytanoyl-CoA lyase | 2-hydroxyphytanoyl-CoA lyase |
| 707 | 3886 | AA893289 | g | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 709 | 9082 | AA893357 | ww | | ESTs |
| 711 | 22890 | AA893406 | g, gg, hh | | ESTs |
| 712 | 17800 | AA893436 | kk | | ESTs |
| 713 | 12312 | AA893453 | General | | ESTs |
| 714 | 21980 | AA893454 | r | | ESTs |
| 716 | 3444 | AA893569 | ww | | ESTs |
| 717 | 8277 | AA893584 | nn | | ESTs |
| 718 | 24350 | AA893590 | dd | | ESTs |
| 719 | 11984 | AA893593 | s | | ESTs |
| 721 | 4539 | AA893602 | y | | ESTs |
| 722 | 4540 | AA893603 | e | | ESTs |
| 723 | 22149 | AA893607 | ww | | ESTs |
| 723 | 22150 | AA893607 | ww | | ESTs |
| 724 | 4541 | AA893612 | j, ff | | ESTs |
| 726 | 14495 | AA893658 | l, ii, qq | | ESTs |
| 727 | 17843 | AA893659 | d | | ESTs |
| 729 | 12028 | AA893670 | gg, hh, rr | | ESTs |
| 730 | 4547 | AA893683 | a | | ESTs |
| 733 | 4656 | AA893793 | u | | ESTs |
| 734 | 4556 | AA893811 | cc | | ESTs |
| 736 | 17891 | AA893885 | l, General, kk, xx | | ESTs |
| 737 | 17896 | AA893905 | j | | ESTs |
| 738 | 4559 | AA893933 | cc | | EST |
| 739 | 3446 | AA893970 | s, ww | | ESTs |
| 740 | 10540 | AA894027 | l, u General | | |
| 741 | 3149 | AA894030 | v | | ESTs |
| 742 | 4577 | AA894084 | d | | ESTs |
| 744 | 17953 | AA894090 | e, ss | | ESTs |
| 747 | 3453 | AA894131 | uu, xx | | ESTs, Weakly similar to T37473 transcription regulation mediator c-MED6 - *Caenorhabditis elegans* [*C. elegans*] |
| 748 | 14751 | AA894168 | z, General, ee | | ESTs |
| 749 | 21989 | AA894188 | f, l, z, General, uu | | ESTs |
| 752 | 2134 | AA894212 | p | | ESTs, Weakly similar to T20899 hypothetical protein F14F3.3 - *Caenorhabditis elegans* [*C. elegans*] |
| 753 | 12041 | AA894234 | l, j, n, p, kk | | ESTs, Weakly similar to YJA4__YEAST HYPOTHETICAL 23.7 KD PROTEIN IN CYR1-OST1 INTERGENIC REGION [*S. cerevisiae*] |
| 757 | 18667 | AA894282 | nn, xx | | ESTs |
| 758 | 17336 | AA894297 | ww | | ESTs |
| 759 | 18583 | AA894312 | y, nn | | ESTs |
| 760 | 26051 | AA894316 | o, ff | | ESTs |
| 761 | 19120 | AA894318 | u | | ESTs |
| 762 | 1578 | AA894338 | pp | | ESTs, Weakly similar to T24832 hypothetical protein T11F9.11 - *Caenorhabditis elegans* [*C. elegans*] |
| 763 | 22009 | AA894340 | d | | ESTs |
| 767 | 4107 | AA899109 | x, ll | | ESTs |
| 768 | 19762 | AA899113 | xx | | ESTs |
| 769 | 18477 | AA899120 | pp | | |
| 770 | 4607 | AA899152 | j | | ESTs |
| 771 | 12203 | AA899256 | mm | | ESTs, Moderately similar to IF4G__HUMAN Eukaryotic translation initiation factor 4 gamma (eIF-4-gamma) (eIF4G) (P220) [*H. sapiens*] |
| 773 | 4618 | AA899301 | g | | ESTs |
| 774 | 4196 | AA899304 | o, rr | | ESTs |
| 776 | 20857 | AA899521 | General, nn | | ESTs, Weakly similar to golgi phosphoprotein 2; golgi membrane protein GP73 [*Homo sapiens*] [*H. sapiens*] |
| 777 | 4641 | AA899546 | pp | | ESTs |
| 779 | 21354 | AA899721 | jj, xx | | ESTs |
| 780 | 4095 | AA899814 | c | | ESTs |
| 781 | 20580 | AA899840 | k | | ESTs |
| 782 | 24555 | AA899865 | u | | ESTs |
| 783 | 22060 | AA899898 | w | | ESTs |
| 784 | 18890 | AA899964 | o | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 787 | 4699 | AA900033 | e | | EST |
| 788 | 4707 | AA900090 | f, y | | ESTs |
| 789 | 19756 | AA900118 | c | | ESTs |
| 790 | 8988 | AA900148 | h | | ESTs |
| 791 | 15007 | AA900236 | f | | ESTs |
| 793 | 16422 | AA900380 | m | | ESTs |
| 794 | 4738 | AA900401 | jj | | EST |
| 796 | 4747 | AA900465 | u, gg, hh | | ESTs |
| 798 | 4751 | AA900481 | g | | ESTs |
| 799 | 14527 | AA900521 | ii, rr | | ESTs |
| 800 | 17368 | AA900548 | e | | ESTs, Weakly similar to T30021 hypothetical protein K08F11.4 - *Caenorhabditis elegans* [*C. elegans*] |
| 801 | 19258 | AA900613 | General | | ESTs |
| 802 | 22994 | AA900649 | c, m | | ESTs |
| 806 | 4797 | AA900967 | s | | ESTs |
| 809 | 4814 | AA901012 | bb | | ESTs |
| 811 | 11467 | AA901069 | s | | |
| 812 | 4806 | AA901179 | ss | | ESTs |
| 814 | 3523 | AA901241 | xx | | ESTs |
| 817 | 22863 | AA901357 | ss | | ESTs |
| 818 | 14892 | AA923842 | ss | | ESTs, Highly similar to JC4676 PoIII transcription factor TFTIID chain TAFII20 - human [*H. sapiens*] |
| 819 | 4881 | AA923865 | c | | ESTs |
| 820 | 17793 | AA923925 | l, General, pp | | ESTs |
| 821 | 4883 | AA923941 | dd | | ESTs |
| 822 | 3963 | AA923955 | ff, ll | | ESTs |
| 825 | 4896 | AA924000 | gg, hh | | ESTs |
| 826 | 4900 | AA924024 | h, l, n | | ESTs |
| 827 | 22883 | AA924028 | a | | ESTs |
| 828 | 4903 | AA924053 | s, ii | | ESTs |
| 829 | 4916 | AA924130 | p | | EST |
| 831 | 4171 | AA924144 | jj | | ESTs, Weakly similar to T28H10.2.p [*Caenorhabditis elegans*] [*C. elegans*] |
| 832 | 22969 | AA924151 | n, w | | ESTs |
| 833 | 24192 | AA924210 | vv | | ESTs |
| 836 | 4936 | AA924316 | k, cc | | ESTs, Highly similar to chromosome 11 open reading frame 10 [*Homo sapiens*] [*H. sapiens*] |
| 837 | 22914 | AA924335 | w | | ESTs |
| 838 | 12344 | AA924336 | l | | ESTs |
| 841 | 20396 | AA924426 | v, rr | | ESTs, Moderately similar to JC5224 methionine--tRNA ligase (EC 6.1.1.10) - human [*H. sapiens*] |
| 842 | 4959 | AA924455 | k | | ESTs |
| 845 | 4978 | AA924575 | ii | | EST |
| 847 | 18891 | AA924598 | o, ss | | ESTs |
| 848 | 16989 | AA924609 | ff | | ESTs, Weakly similar to S54052 DOS1 protein - yeast (*Saccharomyces cerevisiae*) [*S. cerevisiae*] |
| 849 | 4983 | AA924615 | oo | | ESTs |
| 853 | 5013 | AA924756 | h, ss | | ESTs |
| 854 | 23030 | AA924763 | n | | ESTs |
| 856 | 23123 | AA924794 | mm | | ESTs |
| 857 | 12372 | AA924803 | c | | ESTs |
| 858 | 4067 | AA924813 | f, s, z, General | | ESTs |
| 859 | 2888 | AA924902 | o, vv | | ESTs |
| 861 | 22911 | AA924943 | General | | ESTs |
| 862 | 23141 | AA925019 | ww | | ESTs |
| 863 | 21458 | AA925049 | General, kk | | ESTs |
| 865 | 5079 | AA925083 | General, kk | | ESTs |
| 866 | 22998 | AA925123 | s | | ESTs |
| 870 | 18271 | AA925267 | n, p, General | | ESTs |
| 875 | 5131 | AA925341 | f | | ESTs |
| 876 | 5134 | AA925355 | General | | ESTs |
| 877 | 18485 | AA925359 | tt | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 878 | 5141 | AA925393 | ii | | Rat mRNA for acetyl-coenzyme A carboxylase (EC 6.4.1.2.) 3' untranslated region |
| 879 | 5151 | AA925439 | e | | ESTs |
| 880 | 5152 | AA925441 | l | | ESTs |
| 881 | 5157 | AA925469 | q | | ESTs |
| 883 | 5167 | AA925529 | bb | | EST |
| 884 | 3993 | AA925540 | f | | ESTs |
| 887 | 16445 | AA925557 | kk | | ESTs |
| 888 | 4271 | AA925603 | o, jj | | ESTs |
| 889 | 2690 | AA925644 | ss | | ESTs, Weakly similar to T01D3.5.p [Caenorhabditis elegans] [C. elegans] |
| 890 | 5183 | AA925662 | vv | | ESTs |
| 891 | 5193 | AA925693 | n | | EST |
| 892 | 5198 | AA925710 | nn | | ESTs |
| 893 | 5203 | AA925741 | p | | ESTs |
| 894 | 5215 | AA925774 | j | | ESTs |
| 895 | 3791 | AA925854 | l | | ESTs |
| 896 | 23464 | AA925876 | General | | ESTs |
| 897 | 21573 | AA925920 | f | | ESTs |
| 898 | 12196 | AA925983 | k | | ESTs, Highly similar to hypothetical protein FLJ20602 [Homo sapiens] [H. sapiens] |
| 899 | 5242 | AA925994 | y | | ESTs |
| 900 | 23068 | AA926036 | c, kk | | ESTs |
| 901 | 23468 | AA926067 | u | | ESTs |
| 902 | 5255 | AA926085 | y, ee, tt | | ESTs |
| 903 | 5256 | AA926088 | bb | | ESTs |
| 904 | 5258 | AA926089 | h, m General, dd | | ESTs, Highly similar to KIAA0164 gene product [Homo sapiens] [H. sapiens] |
| 905 | 19555 | AA926120 | a, h, uu | | EST |
| 907 | 5277 | AA926171 | v | | EST |
| 909 | 11478 | AA926231 | General | | ESTs |
| 910 | 16380 | AA926303 | c | | ESTs |
| 912 | 21827 | AA933158 | d, f, uu | | ESTs, Highly similar to SKIW_HUMAN Helicase SKI2W (Helicase-like protein) (HLP) [H. sapiens] |
| 917 | 20901 | AA942706 | nn | | ESTs |
| 920 | 8518 | AA942842 | h | | ESTs |
| 922 | 23007 | AA942874 | d | | ESTs |
| 923 | 6615 | AA942889 | q | | ESTs, Weakly similar to Iron-containing alcohol dehydrogenases [Caenorhabditis elegans] [C. elegans] |
| 924 | 21200 | AA942904 | ii, ll | | ESTs |
| 925 | 19015 | AA943015 | z | | ESTs |
| 925 | 19016 | AA943015 | n, General | | ESTs |
| 926 | 22130 | AA943020 | gg, hh | | ESTs |
| 927 | 6692 | AA943039 | ii, rr | | ESTs |
| 928 | 21894 | AA943095 | f, x, General | | ESTs |
| 929 | 15235 | AA943122 | pp | | ESTs |
| 930 | 21982 | AA943129 | h | | ESTs |
| 932 | 22180 | AA943202 | f | | ESTs |
| 933 | 6218 | AA943244 | jj | | ESTs |
| 934 | 22075 | AA943421 | oo | | ESTs |
| 935 | 11695 | AA943536 | c | | ESTs |
| 936 | 22254 | AA943552 | gg, hh | | ESTs, Weakly similar to T02G5.13.p [Caenorhabditis elegans] [C. elegans] |
| 937 | 22257 | AA943558 | j | | ESTs, Highly similar to JC4676 PolII transcription factor TFTIID chain TAFII20 - human [H. sapiens] |
| 938 | 22337 | AA943600 | gg, hh | | ESTs |
| 940 | 23404 | AA943687 | tt | | ESTs |
| 941 | 16253 | AA943693 | q | | ESTs |
| 942 | 21668 | AA943752 | bb | | ESTs |
| 943 | 12713 | AA943866 | f, General | | ESTs |
| 945 | 22368 | AA944157 | t, gg, hh | | ESTs |
| 947 | 22372 | AA944176 | s, oo | | ESTs, Weakly similar to T19334 hypothetical protein R74.1 - Caenorhabditis elegans [C. elegans] |
| 948 | 20903 | AA944180 | tt | | ESTs, Highly similar to CKS2_MOUSE CYCLIN-DEPENDENT KINASES REGULATORY SUBUNIT 2 (CKS-2) [M. musculus] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 950 | 14426 | AA944230 | k | | ESTs |
| 951 | 8321 | AA944233 | ss | | ESTs |
| 952 | 13507 | AA944244 | ee | | ESTs |
| 953 | 23108 | AA944251 | rr | | ESTs |
| 954 | 22395 | AA944289 | d | | ESTs |
| 955 | 9121 | AA944301 | u | | ESTs |
| 956 | 4511 | AA944348 | ii | | ESTs |
| 957 | 17901 | AA944355 | vv | | ESTs |
| 958 | 8870 | AA944361 | d | | ESTs |
| 959 | 22416 | AA944380 | o, p, ff | | ESTs, Weakly similar to T26648 hypothetical protein Y38A8.1 - Caenorhabditis elegans [C. elegans] |
| 960 | 8219 | AA944384 | gg, hh | | ESTs |
| 961 | 22681 | AA944413 | cc | | ESTs |
| 963 | 16096 | AA944469 | ss | | ESTs |
| 966 | 22446 | AA944530 | pp | | ESTs, Highly similar to G01430 PL6 protein - human [H. sapiens] |
| 967 | 11887 | AA944561 | jj | | ESTs, Weakly similar to T31809 hypothetical protein M03F8.2 - Caenorhabditis elegans [C. elegans] |
| 970 | 23177 | AA944628 | pp, ss | | ESTs |
| 971 | 12706 | AA944740 | k | | ESTs |
| 973 | 12140 | AA944752 | k | | ESTs |
| 974 | 22536 | AA944803 | t, mm | | ESTs |
| 975 | 22503 | AA944823 | General | | ESTs |
| 978 | 12306 | AA944898 | uu | | ESTs |
| 979 | 22519 | AA944906 | cc | | ESTs |
| 981 | 26084 | AA944922 | u | | |
| 982 | 23029 | AA944935 | n | | ESTs |
| 983 | 16458 | AA944956 | ii | | ESTs |
| 985 | 22554 | AA945076 | o | | ESTs |
| 986 | 6929 | AA945099 | c, f | | ESTs, Weakly similar to hypothetical protein FLJ11016 [Homo sapiens] [H. sapiens] |
| 987 | 22558 | AA945123 | General, ff, oo | | EST |
| 992 | 14352 | AA945181 | ee | | ESTs |
| 993 | 12309 | AA945193 | General, kk | | ESTs, Weakly similar to C5MS complement C5 precursor - mouse [M. musculus] |
| 994 | 22574 | AA945268 | xx | | ESTs |
| 997 | 22581 | AA945432 | z, ee | | ESTs |
| 998 | 22076 | AA945579 | General | | ESTs, Weakly similar to D64752 dihydrodipicolinate synthase homolog yagE - Escherichia coli [E. coli] |
| 1000 | 3674 | AA945587 | l | | ESTs |
| 1001 | 22050 | AA945604 | l | | ESTs |
| 1002 | 6791 | AA945613 | d, gg, hh | | ESTs |
| 1003 | 19731 | AA945615 | n | | ESTs |
| 1004 | 11870 | AA945679 | pp | | ESTs |
| 1004 | 11871 | AA945679 | qq, vv | | ESTs |
| 1006 | 22625 | AA945704 | c | | ESTs |
| 1008 | 22637 | AA945727 | g | | ESTs |
| 1013 | 22645 | AA945765 | v | | ESTs |
| 1014 | 16489 | AA945784 | l | | ESTs |
| 1015 | 22656 | AA945818 | gg, hh | | ESTs |
| 1016 | 21883 | AA945866 | oo | | ESTs |
| 1018 | 21214 | AA945887 | f | | ESTs |
| 1019 | 11256 | AA945898 | r, ss | | ESTs |
| 1021 | 22689 | AA945962 | f | | ESTs |
| 1022 | 18524 | AA946017 | m, General, uu | | ESTs |
| 1023 | 22701 | AA946022 | u | | ESTs |
| 1024 | 18337 | AA946046 | ll | | ESTs |
| 1025 | 22712 | AA946092 | d | | ESTs |
| 1027 | 22729 | AA946167 | pp | | ESTs |
| 1029 | 23027 | AA946264 | d | | ESTs |
| 1031 | 22755 | AA946323 | e | | ESTs |
| 1033 | 18944 | AA946391 | l | | ESTs |
| 1035 | 22768 | AA946411 | ff | | ESTs |
| 1036 | 22769 | AA946413 | u | | ESTs |
| 1037 | 6730 | AA946417 | c | | ESTs |
| 1039 | 22770 | AA946428 | pp, vv | | ESTs |
| 1040 | 21968 | AA946434 | oo | | ESTs |
| 1042 | 10960 | AA946440 | l, xx | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1043 | 21947 | AA946451 | ii | | ESTs, Moderately similar to CGI-105 protein [Homo sapiens] [H. sapiens] |
| 1044 | 6841 | AA946474 | h, ss | | ESTs |
| 1045 | 22793 | AA946502 | nn | | ESTs |
| 1046 | 23749 | AA946505 | x | | ESTs, Weakly similar to YFBYAM phenylalanine--tRNA ligase (EC 6.1.1.20) alpha chain precursor, mitochondrial - yeast (Saccharomyces cerevisiae) [S. cerevisiae] |
| 1047 | 23750 | AA946530 | gg, hh | | ESTs |
| 1049 | 23471 | AA955162 | rr | | ESTs |
| 1050 | 23320 | AA955164 | q | | ESTs |
| 1051 | 23499 | AA955249 | General, ff | | ESTs |
| 1053 | 23533 | AA955350 | k | | ESTs |
| 1056 | 16216 | AA955392 | z, General, ss, tt | | ESTs |
| 1058 | 23557 | AA955447 | u | | ESTs, Highly similar to Werner helicase interacting protein, isoform 1; putative helicase RUVBL [Homo sapiens] [H. sapiens] |
| 1059 | 23369 | AA955523 | q | | ESTs |
| 1061 | 23629 | AA955552 | o | | ESTs |
| 1063 | 18156 | AA955573 | p | | ESTs, Moderately similar to 1804353A transcription factor RAP74 [Homo sapiens] |
| 1065 | 23657 | AA955630 | r | | ESTs |
| 1067 | 14263 | AA955831 | x | | ESTs, Weakly similar to F28G4.5.p [Caenorhabditis elegans] [C. elegans] |
| 1068 | 23738 | AA955835 | m | | ESTs |
| 1069 | 14509 | AA955871 | qq | | ESTs |
| 1069 | 14510 | AA955871 | bb, qq | | ESTs |
| 1070 | 24251 | AA955887 | g, v | | ESTs |
| 1071 | 24259 | AA955909 | v | | ESTs |
| 1073 | 24288 | AA955970 | p | | EST |
| 1074 | 19938 | AA955980 | p | | ESTs |
| 1077 | 24307 | AA956035 | e | | ESTs |
| 1078 | 22535 | AA956140 | r, z | | ESTs |
| 1081 | 497 | AA956278 | ss | | ESTs |
| 1086 | 23799 | AA956530 | bb | | ESTs, Highly similar to hypothetical protein ET [Homo sapiens] [H. sapiens] |
| 1090 | 23943 | AA956943 | e | | ESTs, Weakly similar to T21344 hypothetical protein F25H2.1 - Caenorhabditis elegans [C. elegans] |
| 1092 | 23963 | AA957139 | n | | ESTs |
| 1097 | 24003 | AA957311 | ww | | ESTs |
| 1100 | 24070 | AA957501 | o, p | | ESTs |
| 1102 | 24119 | AA957683 | b, dd | | ESTs |
| 1103 | 24130 | AA957723 | g | | ESTs |
| 1105 | 24144 | AA957766 | e, s | | ESTs |
| 1107 | 24167 | AA957826 | gg, hh | | ESTs |
| 1108 | 24171 | AA957835 | qq, vv | | ESTs |
| 1109 | 24223 | AA957992 | g | | ESTs |
| 1113 | 23034 | AA963211 | oo, pp | | ESTs |
| 1114 | 12833 | AA963243 | f | | ESTs |
| 1115 | 2049 | AA963369 | kk, tt | | ESTs |
| 1116 | 20927 | AA963449 | jj | | ESTs |
| 1117 | 18790 | AA963716 | o | | ESTs |
| 1118 | 15949 | AA963780 | c | | ESTs |
| 1119 | 9309 | AA963794 | m | | ESTs |
| 1121 | 18138 | AA963815 | g | | ESTs |
| 1124 | 15474 | AA964114 | l | | ESTs |
| 1127 | 2321 | AA964265 | ss | | ESTs |
| 1128 | 2355 | AA964366 | c, gg, hh | | ESTs, Highly similar to hypothetical protein FLJ20727 [Homo sapiens] [H. sapiens] |
| 1130 | 19452 | AA964500 | ee | | EST |
| 1131 | 2382 | AA964513 | m | | ESTs |
| 1132 | 2383 | AA964514 | r | | ESTs |
| 1134 | 11274 | AA964535 | x | | ESTs |
| 1135 | 2423 | AA964611 | ii | | ESTs |
| 1137 | 2433 | AA964653 | dd | | ESTs |
| 1138 | 3107 | AA964687 | dd | | ESTs |
| 1139 | 2454 | AA964740 | ss | | ESTs |
| 1140 | 2459 | AA964755 | t | | ESTs |
| 1141 | 12836 | AA964777 | g | | ESTs |
| 1142 | 11324 | AA964832 | f | | ESTs |
| 1143 | 14622 | AA964868 | w | | ESTs |
| 1144 | 2486 | AA964871 | vv | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1146 | 21390 | AA964988 | f, pp | | ESTs |
| 1147 | 2528 | AA964990 | a, uu | | ESTs, Weakly similar to S46683 hypothetical protein YHR189w - yeast (*Saccharomyces cerevisiae*) [*S. cerevisiae*] |
| 1148 | 2691 | AA965075 | ff | | ESTs |
| 1149 | 12622 | AA965077 | w | | ESTs |
| 1150 | 2563 | AA965113 | f | | ESTs, Weakly similar to Y54E5A.5.p [*Caenorhabditis elegans*] [*C. elegans*] |
| 1151 | 2568 | AA965120 | xx | | ESTs, Weakly similar to S48963 hypothetical protein YHR121w - yeast (*Saccharomyces cerevisiae*) [*S. cerevisiae*] |
| 1152 | 2571 | AA965128 | g | | ESTs |
| 1154 | 12572 | AA965176 | e | | ESTs |
| 1156 | 16680 | AA965190 | vv | | ESTs |
| 1157 | 2603 | AA965213 | w | | ESTs |
| 1158 | 2141 | AA965219 | w, x, dd | | ESTs |
| 1159 | 2610 | AA965251 | w | | ESTs |
| 1160 | 15907 | AA996422 | l | | ESTs |
| 1162 | 2826 | AA996523 | vv | | ESTs |
| 1163 | 2860 | AA996581 | ii | | ESTs |
| 1164 | 2787 | AA996688 | x | | ESTs |
| 1166 | 2921 | AA996814 | k | | ESTs |
| 1168 | 2930 | AA996846 | pp | | ESTs |
| 1171 | 12591 | AA996927 | ii, rr | | ESTs |
| 1172 | 2954 | AA996933 | c, u | | ESTs |
| 1174 | 2964 | AA996954 | s | | ESTs |
| 1175 | 16496 | AA996955 | a | | ESTs |
| 1176 | 2978 | AA996974 | dd | | ESTs, Highly similar to 1802387B transcription factor IIE:SUBUNIT = small 34 kD [*Homo sapiens*] [*H. sapiens*] |
| 1178 | 20694 | AA997048 | bb | | ESTs |
| 1179 | 3087 | AA997062 | ii | | ESTs |
| 1180 | 3477 | AA997096 | pp | | ESTs |
| 1181 | 3145 | AA997237 | jj | | ESTs |
| 1182 | 3163 | AA997297 | uu | | ESTs |
| 1183 | 3005 | AA997338 | c | | ESTs |
| 1184 | 19249 | AA997342 | b, j, x, dd | | *Rattus norvegicus* Ratsg2 mRNA, complete cds |
| 1186 | 14582 | AA997412 | mm | | ESTs |
| 1187 | 3238 | AA997555 | b | | ESTs |
| 1188 | 12616 | AA997599 | p | | ESTs |
| 1189 | 8173 | AA997699 | ss, tt | | ESTs |
| 1192 | 3267 | AA997788 | pp | | ESTs |
| 1195 | 3290 | AA997883 | f, l, pp | | ESTs |
| 1196 | 26114 | AA997904 | ff | | |
| 1197 | 3302 | AA997905 | b, l | | ESTs |
| 1198 | 3307 | AA997928 | f | | EST |
| 1199 | 3317 | AA997958 | bb | | ESTs |
| 1200 | 11941 | AA997980 | n | | ESTs |
| 1201 | 3326 | AA997990 | x | | ESTs |
| 1204 | 26115 | AA998084 | cc | | ESTs |
| 1205 | 3362 | AA998092 | y | | ESTs |
| 1209 | 3375 | AA998132 | r | | EST |
| 1211 | 16533 | AA998174 | g, o | | ESTs |
| 1212 | 3730 | AA998234 | h, General, qq | | ESTs |
| 1214 | 3766 | AA998325 | e | | ESTs |
| 1215 | 3784 | AA998387 | ss | | ESTs |
| 1217 | 19623 | AA998422 | ii, uu | | EST |
| 1217 | 19624 | AA998422 | y | | EST |
| 1220 | 17009 | AA998506 | ll | | ESTs |
| 1222 | 3576 | AA998540 | b | | ESTs |
| 4485 | 26119 | AA998576 | kk, tt | | |
| 1224 | 3586 | AA998579 | pp | | ESTs |
| 1226 | 3411 | AA998638 | b, General | | ESTs |
| 1227 | 3612 | AA998673 | w | | ESTs |
| 1230 | 3641 | AA998771 | r | | ESTs |
| 1232 | 3133 | AA998893 | w | | ESTs |
| 1234 | 3683 | AA998968 | k | | ESTs |
| 1236 | 3690 | AA999006 | e | | ESTs |
| 1237 | 3708 | AA999060 | w | | EST |
| 1239 | 3720 | AA999138 | ee, ww | | ESTs |
| 1240 | 3079 | AA999169 | w, General | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1242 | 12602 | AA999183 | g | | ESTs |
| 1243 | 25137 | AB005540 | ss, ww | | |
| 1253 | 3562 | AB020504 | r, gg, hh | PMF32 protein | PMF32 protein |
| 1261 | 25165 | AF022952 | jj | vascular endothelial growth factor B | |
| 1262 | 20283 | AF029357 | x | | |
| 1263 | 25168 | AF030050 | s, cc | replication factor C | |
| 1264 | 11210 | AF030087 | q, y, z, General, tt | | ESTs |
| 1264 | 25170 | AF030087 | f, z, tt | | |
| 1267 | 4294 | AF034898 | y | | |
| 1268 | 20188 | AF034900 | cc | | |
| 1275 | 19212 | AF055292 | j, mm | | |
| 1277 | 25195 | AF061945 | g | | |
| 1279 | 25196 | AF064856 | g, k | | |
| 1280 | 18615 | AF074608 | n, ee | | |
| 1282 | 25203 | AF079873 | t, ll, mm, rr | zinc finger protein 162 | |
| 1290 | 14313 | AI007626 | h, General, gg, hh | | ESTs |
| 1291 | 2513 | AI007642 | c | | ESTs |
| 1293 | 22746 | AI007672 | a | | ESTs |
| 1296 | 3814 | AI007761 | ii | | ESTs |
| 1297 | 1804 | AI007824 | r | | |
| 1297 | 1805 | AI007824 | r | | |
| 1300 | 6804 | AI007877 | cc | | ESTs |
| 1301 | 14361 | AI007924 | e | | ESTs |
| 1302 | 4039 | AI007963 | x | | ESTs |
| 1306 | 3806 | AI008119 | r | | ESTs |
| 1307 | 4068 | AI008316 | bb | | ESTs |
| 1308 | 13009 | AI008380 | y | | ESTs |
| 1309 | 4077 | AI008384 | gg, hh | | ESTs |
| 1311 | 14737 | AI008416 | ss | | ESTs |
| 1312 | 17820 | AI008698 | oo | | ESTs |
| 1313 | 12438 | AI008736 | ss | | ESTs |
| 1317 | 3365 | AI008919 | ff | | ESTs |
| 1318 | 6818 | AI008931 | f | | ESTs |
| 1319 | 4120 | AI008975 | mm | | ESTs, Weakly similar to S14828 nidogen - rat (fragment) [*R. norvegicus*] |
| 1320 | 4951 | AI009026 | g | | ESTs |
| 1321 | 24665 | AI009098 | q | | ESTs |
| 1323 | 15660 | AI009141 | u | | ESTs |
| 1324 | 23252 | AI009170 | ll | | ESTs |
| 1327 | 2506 | AI009341 | f | | ESTs |
| 1328 | 7524 | AI009350 | b | | ESTs, Weakly similar to C37H5.3.p [*Caenorhabditis elegans*] [*C. elegans*] |
| 1329 | 6382 | AI009362 | y, z, ee | | ESTs |
| 1330 | 2245 | AI009363 | tt | | ESTs |
| 1331 | 3356 | AI009371 | o | | ESTs |
| 1334 | 8164 | AI009444 | s, z, ee | | ESTs, Weakly similar to 2121426A modifier of rudimentary-p1 gene [*Drosophila melanogaster*] [*D. melanogaster*] |
| 1335 | 2267 | AI009450 | m, x, dd, qq | | ESTs, Weakly similar to T24151 hypothetical protein R10H10.1 - *Caenorhabditis elegans* [*C. elegans*] |
| 1342 | 3991 | AI009603 | nn | | ESTs |
| 1343 | 21447 | AI009608 | ww | | ESTs |
| 1344 | 3923 | AI009647 | f | | ESTs |
| 1346 | 6836 | AI009700 | k | | ESTs |
| 1347 | 17568 | AI009703 | gg, hh | | ESTs |
| 1348 | 6838 | AI009709 | bb | | ESTs |
| 1349 | 16490 | AI009710 | pp | | ESTs |
| 1351 | 15089 | AI009752 | tt | | ESTs |
| 1353 | 6843 | AI009768 | k | | ESTs |
| 1355 | 7043 | AI009796 | oo | | ESTs, Weakly similar to F19B6.1b.p [*Caenorhabditis elegans*] [*C. elegans*] |
| 1356 | 22058 | AI009800 | d | | ESTs |
| 1357 | 7224 | AI009820 | p | | ESTs |
| 1358 | 22619 | AI009825 | s | | ESTs |
| 1359 | 26132 | AI009950 | l | | EST |
| 1360 | 18505 | AI010034 | d, n | | ESTs |
| 1361 | 6873 | AI010055 | gg, hh | | ESTs |
| 1364 | 15258 | AI010104 | vv | | ESTs |
| 1366 | 4177 | AI010123 | General | | ESTs |
| 1367 | 12717 | AI010250 | v | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1369 | 6897 | AI010275 | kk, tt | | ESTs |
| 1370 | 14455 | AI010277 | n, kk | | ESTs |
| 1371 | 12095 | AI010339 | o | | ESTs, Weakly similar to C16C10.11.p [*Caenorhabditis elegans*] [*C. elegans*] |
| 1372 | 15180 | AI010354 | l | | ESTs |
| 1374 | 6916 | AI010430 | mm | | ESTs |
| 1377 | 3139 | AI010618 | w | | ESTs |
| 1379 | 6946 | AI010642 | gg, hh, jj | | ESTs |
| 1380 | 11227 | AI010660 | j | | ESTs |
| 1381 | 17761 | AI010662 | z | | ESTs, Highly similar to S37488 gene T10 protein - mouse [*M. musculus*] |
| 1382 | 22884 | AI010755 | uu | | ESTs |
| 1383 | 12726 | AI010758 | ss | | ESTs |
| 1384 | 6972 | AI010763 | gg, hh | | ESTs |
| 1385 | 8966 | AI010944 | f, ww | | ESTs, Weakly similar to R08B4.3.p [*Caenorhabditis elegans*] [*C. elegans*] |
| 1386 | 3597 | AI010951 | d, nn | | ESTs |
| 1389 | 6044 | AI011285 | pp | | ESTs |
| 1390 | 14049 | AI011306 | ll | | ESTs, Weakly similar to hypothetical protein PP1226 [*Homo sapiens*] [*H. sapiens*] |
| 1391 | 3737 | AI011322 | w | | ESTs |
| 1392 | 14393 | AI011367 | ff | | ESTs, Weakly similar to T13387 hypothetical protein 115C2.8 - fruit fly (*Drosophila melanogaster*) [*D. melanogaster*] |
| 1394 | 13386 | AI011456 | bb | | ESTs |
| 1395 | 3934 | AI011510 | General | | ESTs |
| 1396 | 735 | AI011560 | ll | | ESTs, Weakly similar to B Chain B, Solution Structure Of The C-Terminal Negative Regulatory Domain Of P53 In A Complex With Ca2+ Bound S100b(Bb) [*R. norvegicus*] |
| 1397 | 21861 | AI011571 | n, ss | | ESTs |
| 1399 | 14375 | AI011606 | pp | | ESTs |
| 1403 | 16234 | AI011716 | f | | ESTs |
| 1405 | 2388 | AI011806 | ee | | ESTs, Weakly similar to T31718 hypothetical protein F44E7.9 - *Caenorhabditis elegans* [*C. elegans*] |
| 1407 | 8675 | AI011835 | ii | | ESTs |
| 1408 | 16528 | AI011878 | u | | ESTs |
| 1409 | 18154 | AI011879 | j | | ESTs |
| 1411 | 4205 | AI011982 | f | | ESTs |
| 1412 | 24021 | AI012027 | f | | ESTs, Moderately similar to CA16_MOUSE Collagen alpha 1(VI) chain precursor *M. musculus*] |
| 1414 | 17407 | AI012145 | xx | | ESTs |
| 1416 | 22688 | AI012222 | d, w, General, nn | | ESTs |
| 1417 | 3436 | AI012226 | cc, qq | | ESTs |
| 1418 | 3981 | AI012235 | x, rr | | ESTs |
| 1419 | 23808 | AI012242 | a | | ESTs, Moderately similar to hypothetical protein FLJ14981 [*Homo sapiens*] [*H. sapiens*] |
| 1420 | 17738 | AI012244 | u | | ESTs, Weakly similar to DY3.6.p [*Caenorhabditis elegans*] [*C. elegans*] |
| 1421 | 24190 | AI012246 | d | | ESTs |
| 1423 | 24200 | AI012356 | y | | ESTs |
| 1424 | 17592 | AI012382 | x | | ESTs |
| 1425 | 7123 | AI012448 | o | | ESTs |
| 1430 | 3493 | AI012590 | General, kk | | ESTs |
| 1431 | 19032 | AI012612 | ll | | ESTs |
| 1435 | 21409 | AI012637 | f, pp | | ESTs |
| 1436 | 7142 | AI012689 | ee | | ESTs |
| 1438 | 7171 | AI012761 | pp | | ESTs |
| 1440 | 7178 | AI012812 | jj | | ESTs |
| 1441 | 7179 | AI012822 | v | | EST |
| 1442 | 23990 | AI012945 | gg, hh | | ESTs |
| 1444 | 14033 | AI012979 | l | | ESTs |
| 1445 | 17555 | AI012991 | k | | ESTs |
| 1446 | 10641 | AI012995 | p, x | | ESTs |
| 1447 | 17054 | AI013031 | k | | ESTs, Moderately similar to N4AM_HUMAN NADH-ubiquinone oxidoreductase subunit B14.5a (Complex I-B14.5a) (CI-B14.5a) [*H. sapiens*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1448 | 7199 | AI013044 | ff | | ESTs |
| 1449 | 3191 | AI013075 | z, dd | | ESTs, Moderately similar to hypothetical protein FLJ14621 [*Homo sapiens*] [*H. sapiens*] |
| 1450 | 14500 | AI013083 | kk, qq | | ESTs |
| 1451 | 11554 | AI013110 | t | | ESTs |
| 1452 | 3613 | AI013120 | gg, hh | | ESTs |
| 1453 | 15129 | AI013204 | t | | ESTs |
| 1457 | 7240 | AI013305 | cc | | ESTs |
| 1458 | 3088 | AI013369 | l | | ESTs |
| 1459 | 7256 | AI013440 | ii | | ESTs |
| 1466 | 9551 | AI013558 | kk | | ESTs |
| 1467 | 2101 | AI013667 | t | | ESTs |
| 1468 | 7281 | AI013755 | c | | ESTs, Weakly similar to Human mRNA KIAA0066 predicted protein like [*Caenorhabditis elegans*] [*C. elegans*] |
| 1469 | 21667 | AI013773 | oo | | ESTs |
| 1470 | 26151 | AI013774 | j | | ESTs |
| 1471 | 6786 | AI013775 | v | | ESTs |
| 1473 | 7289 | AI013801 | t, ee | | ESTs |
| 1475 | 23176 | AI013847 | e | | ESTs |
| 1477 | 12802 | AI013865 | w, General | | ESTs |
| 1478 | 3260 | AI013875 | o, ee | | ESTs |
| 1479 | 2708 | AI013882 | t, mm, xx | | ESTs, Highly similar to S53612 gene MSSP-2 protein - human [*H. sapiens*] |
| 1481 | 21454 | AI013888 | l | | ESTs |
| 1482 | 21074 | AI013890 | ll | | ESTs |
| 1483 | 6508 | AI013900 | ii | | ESTs, Highly similar to muscle specific gene [*Homo sapiens*] [*H. sapiens*] |
| 1484 | 18962 | AI013918 | o | fasting-inducible integral membrane protein TM6P1 | fasting-inducible integral membrane protein TM6P1 |
| 1485 | 18977 | AI013937 | d | endoplasmic retuclum protein 29 | ESTs |
| 1487 | 15936 | AI013993 | c | | ESTs |
| 1488 | 7288 | AI014022 | t, General | | ESTs |
| 1489 | 11178 | AI014076 | n | | ESTs, Weakly similar to nitrophenylphosphatase [*Caenorhabditis elegans*] [*C. elegans*] |
| 1490 | 15495 | AI014094 | j | | ESTs, Weakly similar to DPSD_CAEEL Putative phosphatidylserine decarboxylase proenzyme [*C. elegans*] |
| 1491 | 8136 | AI014116 | ww | | ESTs |
| 1492 | 24315 | AI014132 | z, General | | ESTs |
| 1495 | 14406 | AI028849 | ee | | ESTs |
| 1497 | 18574 | AI028997 | p, gg, hh | | ESTs, Weakly similar to T20120 hypothetical protein C50F4.14 - *Caenorhabditis elegans* [*C. elegans*] |
| 1498 | 7357 | AI029007 | ii | | ESTs, Weakly similar to F10B5.8.p [*Caenorhabditis elegans*] [*C. elegans*] |
| 1499 | 21933 | AI029057 | ss | | ESTs |
| 1500 | 7374 | AI029096 | qq | | ESTs |
| 1501 | 3311 | AI029116 | r | | ESTs |
| 1502 | 22185 | AI029229 | k | | ESTs, Highly similar to 2024339A cleavage stimulation factor [*Homo sapiens*] [*H. sapiens*] |
| 1503 | 7415 | AI029274 | ii | | ESTs |
| 1506 | 19296 | AI029415 | k | | EST |
| 1507 | 13573 | AI029443 | v | | ESTs |
| 1509 | 2668 | AI029455 | uu | | ESTs |
| 1512 | 7503 | AI029649 | l, r, kk | | EST |
| 1513 | 13674 | AI029675 | gg, hh | | ESTs |
| 1514 | 7521 | AI029713 | d | | ESTs |
| 1516 | 16705 | AI029858 | xx | | ESTs |
| 1518 | 7582 | AI029996 | ss | | ESTs |
| 1519 | 7583 | AI030001 | oo | | EST |
| 1520 | 7586 | AI030024 | uu | | ESTs |
| 1521 | 10665 | AI030067 | h, nn | | ESTs |
| 1522 | 17955 | AI030069 | gg, hh | | ESTs |
| 1523 | 14492 | AI030091 | y | | ESTs |
| 1524 | 7597 | AI030118 | s | | ESTs |
| 1525 | 7618 | AI030172 | qq | | ESTs |
| 1526 | 7003 | AI030259 | General | | ESTs, Moderately similar to hypothetical protein MGC12904 [*Homo sapiens*] [*H. sapiens*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1527 | 7658 | AI030348 | ss | | ESTs |
| 1528 | 7664 | AI030376 | gg, hh | | ESTs |
| 1529 | 7685 | AI030465 | qq | | ESTs |
| 1530 | 17419 | AI030524 | p | | ESTs |
| 1531 | 7724 | AI030643 | p | | ESTs |
| 1532 | 7741 | AI030695 | nn | | ESTs |
| 1533 | 7745 | AI030706 | p, ff | | ESTs |
| 1534 | 7748 | AI030731 | gg, hh | | ESTs |
| 1535 | 7751 | AI030750 | d, kk | | ESTs |
| 1536 | 7755 | AI030771 | n | | ESTs |
| 1537 | 13286 | AI030790 | x, General, kk | | ESTs |
| 1538 | 21172 | AI030799 | ll | | ESTs |
| 1539 | 17552 | AI030833 | cc | | ESTs |
| 1540 | 2911 | AI030835 | m, General, ff | | ESTs |
| 1541 | 10750 | AI030845 | f | | ESTs |
| 1542 | 7781 | AI030869 | x | | EST |
| 1543 | 20101 | AI030877 | rr | | ESTs |
| 1544 | 7793 | AI030907 | oo | | ESTs, Weakly similar to short-chain alcohol dehydrogenase [Caenorhabditis elegans] [C. elegans] |
| 1545 | 19561 | AI030921 | u, y | | EST |
| 1547 | 10767 | AI030989 | r | | EST |
| 1549 | 7831 | AI031035 | j | | ESTs |
| 1551 | 5350 | AI043611 | f | | ESTs |
| 1552 | 4335 | AI043630 | w | | ESTs, Moderately similar to hypothetical protein FLJ23251 [Homo sapiens] [H. sapiens] |
| 1554 | 9180 | AI043694 | ii, xx | | ESTs, Weakly similar to T27134 hypothetical protein Y53C12B.2 - Caenorhabditis elegans [C. elegans] |
| 1555 | 7873 | AI043709 | u | | ESTs |
| 1556 | 7584 | AI043724 | n, q | | ESTs |
| 1557 | 20102 | AI043753 | ii, rr | | ESTs |
| 1558 | 7904 | AI043806 | cc | | ESTs |
| 1562 | 7917 | AI043877 | gg, hh | | ESTs |
| 1563 | 3598 | AI043901 | r | | ESTs |
| 1564 | 7926 | AI043913 | m | | ESTs |
| 1567 | 7963 | AI044045 | qq | | ESTs |
| 1568 | 9828 | AI044061 | k | | EST |
| 1570 | 19563 | AI044064 | j | | EST |
| 1573 | 5781 | AI044263 | f, tt | | ESTs |
| 1574 | 5433 | AI044271 | gg, hh | | ESTs |
| 1575 | 16389 | AI044323 | c, ff | | ESTs |
| 1576 | 5453 | AI044328 | u | | ESTs |
| 1577 | 16027 | AI044416 | s, oo | | ESTs |
| 1578 | 5494 | AI044425 | p, ff | | ESTs |
| 1579 | 9859 | AI044429 | ii | | EST |
| 1580 | 10829 | AI044467 | e | | EST |
| 1581 | 5495 | AI044476 | j | | ESTs |
| 1582 | 9871 | AI044530 | b | | ESTs |
| 1584 | 9889 | AI044621 | uu | | ESTs |
| 1586 | 3827 | AI044721 | oo | | ESTs |
| 1587 | 9906 | AI044759 | u | | ESTs |
| 1588 | 5476 | AI044791 | cc | | ESTs |
| 1592 | 5615 | AI044861 | m, oo | | ESTs |
| 1593 | 6492 | AI044862 | u | | ESTs |
| 1594 | 5630 | AI044869 | f | | ESTs |
| 1595 | 6496 | AI044887 | gg, hh | | ESTs |
| 1597 | 9927 | AI044932 | rr | | ESTs |
| 1598 | 4047 | AI044947 | General | | ESTs |
| 1599 | 5692 | AI045092 | e | | ESTs |
| 1600 | 19569 | AI045120 | s | | EST |
| 1601 | 5709 | AI045148 | k | | EST |
| 1604 | 9968 | AI045182 | e | | ESTs |
| 1606 | 20524 | AI045201 | y | | ESTs |
| 1607 | 9977 | AI045253 | bb | | EST |
| 1609 | 5759 | AI045330 | e | | ESTs |
| 1611 | 9983 | AI045337 | p | | ESTs |
| 1612 | 18932 | AI045451 | p, General | | ESTs |
| 1614 | 16752 | AI045475 | h, vv | | ESTs |
| 1615 | 5809 | AI045488 | x | | EST |
| 1616 | 5810 | AI045492 | gg, hh | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1617 | 7994 | AI045521 | pp | | ESTs |
| 1618 | 21971 | AI045545 | ll | | ESTs |
| 1619 | 11767 | AI045556 | g | | ESTs |
| 1620 | 19535 | AI045572 | j | | EST |
| 1621 | 5834 | AI045577 | v | | ESTs |
| 1622 | 5836 | AI045584 | jj | | ESTs |
| 1624 | 10535 | AI045602 | ii | | ESTs |
| 1625 | 17755 | AI045608 | w, General | | ESTs |
| 4486 | 26173 | AI045626 | x | | |
| 1627 | 10020 | AI045632 | f | | ESTs |
| 1628 | 12825 | AI045672 | h | | ESTs, Weakly similar to T25443 hypothetical protein B0261.4 - *Caenorhabditis elegans* [*C. elegans*] |
| 1629 | 10024 | AI045704 | y | | ESTs |
| 1630 | 5859 | AI045712 | qq | | ESTs |
| 1632 | 5870 | AI045762 | ii | | ESTs |
| 1634 | 5878 | AI045774 | j | | ESTs |
| 1636 | 5895 | AI045850 | jj | | ESTs |
| 1637 | 5902 | AI045871 | General | | ESTs |
| 1638 | 23650 | AI045908 | r | | ESTs |
| 1639 | 5327 | AI045965 | c | | ESTs |
| 1640 | 11774 | AI058340 | e | | ESTs |
| 1641 | 8020 | AI058348 | c, f | | ESTs |
| 1642 | 6828 | AI058359 | l, General, qq | | ESTs, Weakly similar to T46465 hypothetical protein DKFZp434A0530.1 - human [*H. sapiens*] |
| 1643 | 8025 | AI058365 | j, ee, qq | | ESTs, Moderately similar to uncharacterized bone marrow protein BM033 [*Homo sapiens*] [*H. sapiens*] |
| 1645 | 10063 | AI058399 | qq | | EST |
| 1646 | 10065 | AI058416 | mm | | EST |
| 1648 | 10068 | AI058492 | f | | ESTs |
| 1649 | 8177 | AI058603 | s | | ESTs |
| 1651 | 8110 | AI058665 | ll | | ESTs |
| 1653 | 10090 | AI058715 | p | | EST |
| 1654 | 10093 | AI058746 | qq | | ESTs |
| 1655 | 8143 | AI058759 | y, tt | | ESTs |
| 1656 | 18659 | AI058762 | ff, gg, hh | | ESTs |
| 1657 | 10096 | AI058772 | e | | EST |
| 1658 | 10100 | AI058796 | j | | ESTs |
| 1659 | 10106 | AI058851 | oo | | EST |
| 1660 | 4427 | AI058859 | bb | | ESTs |
| 1661 | 10110 | AI058863 | oo | | EST |
| 1663 | 8577 | AI058913 | bb | | ESTs, Highly similar to PYR1_HUMAN CAD protein [Includes: Glutamine-dependent carbamoyl-phosphate synthase; Aspartate carbamoyltransferase; Dihydroorotase] [H. sapiens] |
| 1664 | 10123 | AI058933 | v | | ESTs |
| 1665 | 8191 | AI058960 | u | | ESTs |
| 1668 | 8224 | AI059095 | r | | ESTs |
| 1669 | 8227 | AI059103 | rr | | ESTs |
| 1671 | 10319 | AI059234 | h | | ESTs |
| 1672 | 8265 | AI059246 | pp | | EST |
| 1673 | 26178 | AI059258 | ss | | |
| 1674 | 8274 | AI059270 | y | | ESTs |
| 1675 | 8275 | AI059277 | j | | ESTs |
| 1676 | 11798 | AI059337 | e | | ESTs |
| 1678 | 8312 | AI059378 | cc | | ESTs |
| 1679 | 8314 | AI059386 | General, nn | | ESTs |
| 1680 | 8322 | AI059408 | w | | ESTs, Weakly similar to F09G2.4.p [*Caenorhabditis elegans*] [*C. elegans*] |
| 1683 | 8344 | AI059511 | jj | | EST |
| 1685 | 7970 | AI059549 | n | | ESTs |
| 1687 | 8365 | AI059574 | bb | | ESTs |
| 1688 | 19230 | AI059604 | t | | ESTs |
| 1689 | 3345 | AI059622 | s | | ESTs |
| 1690 | 8395 | AI059662 | m | | ESTs |
| 1691 | 10233 | AI059664 | d | | ESTs |
| 1692 | 5272 | AI059681 | e | | ESTs |
| 1693 | 8707 | AI059707 | y | | ESTs |
| 1694 | 10246 | AI059709 | cc | | ESTs |
| 1695 | 16779 | AI059883 | g | | EST |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1696 | 8472 | AI059885 | n | | ESTs |
| 1697 | 10281 | AI059947 | General, ee | | ESTs |
| 1699 | 8616 | AI059964 | gg, hh | | ESTs |
| 1701 | 8500 | AI059983 | b, General | | ESTs |
| 1702 | 8512 | AI060028 | r | | ESTs |
| 1704 | 8522 | AI060071 | r | | ESTs |
| 1705 | 21142 | AI060130 | ss | | ESTs, Highly similar to hypothetical protein FLJ22357 similar to epidermal growth factor receptor-related protein [Homo sapiens] [H. sapiens] |
| 1707 | 10315 | AI060178 | j, r, s | | ESTs |
| 1708 | 10318 | AI060198 | gg, hh | | ESTs |
| 1711 | 8580 | AI060314 | g | | EST |
| 1712 | 8715 | AI069920 | y, General | | ESTs |
| 1713 | 5440 | AI069922 | s | | ESTs |
| 1714 | 10367 | AI070033 | r, v | | ESTs |
| 1716 | 6343 | AI070108 | m | | ESTs |
| 1717 | 17767 | AI070128 | pp | | ESTs |
| 1719 | 7743 | AI070233 | v | | ESTs |
| 1720 | 11819 | AI070270 | ff | | ESTs |
| 1721 | 10393 | AI070274 | cc | | EST |
| 1722 | 16905 | AI070275 | q | | ESTs |
| 1723 | 10396 | AI070294 | dd | | ESTs |
| 1724 | 16492 | AI070315 | ss | | ESTs, Weakly similar to NFC2_MOUSE Nuclear factor of activated T-cells, cytoplasmic 2 (T cell transcription factor NFAT1) (NEAT pre-existing subunit) (NF-ATp) [M. musculus] |
| 1725 | 8874 | AI070336 | t, mm | | ESTs |
| 1727 | 14424 | AI070421 | w | | ESTs |
| 1728 | 8926 | AI070516 | a | | ESTs |
| 1730 | 10446 | AI070638 | q | | ESTs |
| 1731 | 13454 | AI070712 | uu | | ESTs |
| 1732 | 10459 | AI070724 | j | | EST |
| 1734 | 21208 | AI070806 | dd, oo | | ESTs, Weakly similar to Y53C12A.3.p [Caenorhabditis elegans] [C. elegans] |
| 1735 | 9004 | AI070850 | cc | | ESTs |
| 1736 | 11834 | AI070973 | gg, hh | | ESTs |
| 1737 | 9039 | AI070982 | k | | ESTs |
| 1738 | 9040 | AI070986 | ll | | ESTs |
| 1739 | 8720 | AI071023 | gg, hh | | ESTs, Weakly similar to YG5L_YEAST Hypothetical 29.9 kDa protein in APL6-MES1 intergenic region [S. cerevisiae] |
| 1740 | 10998 | AI071109 | ee | | EST |
| 1743 | 21085 | AI071206 | u, ww | | ESTs |
| 1744 | 9605 | AI071243 | d | | ESTs |
| 1745 | 18191 | AI071244 | ww | | ESTs |
| 1746 | 9607 | AI071247 | ww | | ESTs, Weakly similar to T27095 hypothetical protein Y51H1A.4 - Caenorhabditis elegans [C. elegans] |
| 1748 | 8049 | AI071278 | y | | ESTs |
| 1750 | 11028 | AI071317 | d, nn | | ESTs |
| 1751 | 11031 | AI071371 | gg, hh | | ESTs |
| 1752 | 22676 | AI071458 | dd | | ESTs |
| 1754 | 11052 | AI071492 | cc | | ESTs |
| 1755 | 3867 | AI071504 | k | | ESTs |
| 1756 | 8086 | AI071526 | u | | ESTs |
| 1758 | 5695 | AI071566 | s | | ESTs, Weakly similar to SYBSR threonine synthase (EC 4.2.99.2) - yeast (Saccharomyces cerevisiae) [S. cerevisiae] |
| 1759 | 16802 | AI071570 | vv | | EST, Moderately similar to BBMS complement factor B precursor - mouse [M. musculus] |
| 1760 | 11066 | AI071602 | bb | | ESTs |
| 1763 | 9702 | AI071666 | v | | ESTs |
| 1766 | 26187 | AI071696 | gg, hh | | |
| 1767 | 17387 | AI071702 | f | | ESTs |
| 1768 | 11088 | AI071703 | n, gg, hh | | ESTs |
| 1769 | 9721 | AI071736 | e | | ESTs |
| 1770 | 9747 | AI071794 | k | | ESTs |
| 1772 | 11127 | AI071868 | v, x, ll | | EST |
| 1774 | 11135 | AI071911 | d | | ESTs |
| 1776 | 13916 | AI071972 | l, bb | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1777 | 9800 | AI072014 | qq | | ESTs, Weakly similar to U2af50-P1 [*Drosophila melanogaster*] [*D. melanogaster*] |
| 1778 | 9806 | AI072036 | ww, xx | | ESTs |
| 1779 | 9808 | AI072050 | z, ee | | ESTs |
| 1780 | 13426 | AI072081 | v, gg, hh | | ESTs |
| 1781 | 9196 | AI072121 | o | | ESTs, Weakly similar to 2118405G hexaprenyl pyrophosphate synthetase [*Saccharomyces cerevisiae*] [*S. cerevisiae*] |
| 1782 | 9211 | AI072164 | uu | | ESTs |
| 1783 | 10842 | AI072166 | gg, hh | | EST |
| 1784 | 7516 | AI072183 | tt | | ESTs |
| 1785 | 3801 | AI072257 | k, mm | | ESTs, Weakly similar to T18297 zinc-finger protein FOG-2 - mouse [*M. musculus*] |
| 1786 | 8081 | AI072294 | pp | | ESTs |
| 1787 | 9168 | AI072299 | f, General | | ESTs |
| 1790 | 17680 | AI072403 | p | | ESTs, Highly similar to S43484 heterogeneous nuclear ribonucleoprotein F - human [*H. sapiens*] |
| 1791 | 9271 | AI072405 | y | | ESTs |
| 1792 | 9277 | AI072424 | h, p | | ESTs |
| 1793 | 10869 | AI072425 | y | | ESTs |
| 1796 | 10879 | AI072476 | General | | ESTs |
| 1797 | 9312 | AI072550 | x, General | | ESTs |
| 1798 | 23953 | AI072558 | gg, hh | | ESTs |
| 1799 | 26190 | AI072578 | s | | |
| 1800 | 10902 | AI072603 | x | | ESTs |
| 1801 | 9325 | AI072617 | u | | ESTs |
| 1803 | 10920 | AI072748 | m, General | | ESTs |
| 1804 | 9384 | AI072751 | gg, hh | | ESTs |
| 1805 | 10923 | AI072793 | nn | | ESTs |
| 1807 | 9419 | AI072877 | y | | ESTs |
| 1808 | 10929 | AI072881 | pp | | ESTs |
| 1810 | 21885 | AI072886 | a | | ESTs |
| 1812 | 9432 | AI072914 | w | | EST |
| 1813 | 10934 | AI072950 | l | | ESTs |
| 1814 | 3986 | AI072957 | c, bb | | ESTs |
| 1815 | 10921 | AI073003 | kk | | ESTs |
| 1816 | 10941 | AI073004 | x | | EST |
| 1818 | 9475 | AI073059 | h, p, ss | | ESTs |
| 1819 | 7074 | AI073086 | General, ll | | ESTs |
| 1820 | 9490 | AI073118 | ss | | ESTs |
| 1821 | 22532 | AI073178 | v | | ESTs |
| 1822 | 17190 | AI073193 | ee | | ESTs |
| 1823 | 9510 | AI073208 | bb | | ESTs |
| 1824 | 6996 | AI073210 | m | | ESTs |
| 1827 | 19371 | AI100841 | m | | ESTs |
| 1828 | 13657 | AI101026 | v | | ESTs, Highly similar to JE0326 peroxin Pex11p isoform, Pex11pbeta - human [*H. sapiens*] |
| 1830 | 22098 | AI101116 | cc | | ESTs |
| 1831 | 21913 | AI101181 | d | | ESTs |
| 1833 | 2220 | AI101258 | k | | ESTs |
| 1834 | 5491 | AI101331 | cc, qq | | ESTs |
| 1835 | 6799 | AI101380 | u, nn | | ESTs |
| 1836 | 4401 | AI101381 | x, pp, ss | | ESTs |
| 1837 | 7365 | AI101395 | j | | ESTs |
| 1838 | 2188 | AI101401 | tt | | ESTs |
| 1839 | 20473 | AI101441 | ss | | ESTs |
| 1841 | 21747 | AI101492 | c, m, z, ee | | ESTs |
| 1842 | 18212 | AI101494 | g | | ESTs |
| 1843 | 13382 | AI101527 | s | | ESTs, Highly similar to S01700 signal recognition particle 19K protein - human [*H. sapiens*] |
| 1844 | 4650 | AI101582 | m | | ESTs, Weakly similar to W06D4.4.p [*Caenorhabditis elegans*] [*C. elegans*] |
| 1845 | 5074 | AI101695 | c, ww | | ESTs |
| 1846 | 13265 | AI101708 | f | | ESTs |
| 1847 | 13661 | AI101763 | jj | | ESTs |
| 1848 | 4847 | AI101818 | v | | ESTs |
| 1849 | 23104 | AI101874 | p, gg, hh | | ESTs |
| 1850 | 4119 | AI101901 | oo | | ESTs |
| 1853 | 11719 | AI102042 | ff, mm | | ESTs |
| 1855 | 21592 | AI102065 | u | | ESTs |
| 1856 | 4001 | AI102070 | w | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1857 | 18565 | AI102073 | q, r | | ESTs |
| 1858 | 2093 | AI102097 | f, j, y | | ESTs |
| 1859 | 6223 | AI102152 | ee | | ESTs |
| 1860 | 14902 | AI102191 | nn | | ESTs |
| 1861 | 22310 | AI102194 | m | | ESTs |
| 1862 | 14284 | AI102286 | j | | ESTs |
| 1863 | 8501 | AI102429 | y | | ESTs |
| 1865 | 17632 | AI102472 | p, bb | | ESTs |
| 1867 | 21056 | AI102574 | General | | ESTs |
| 1868 | 24386 | AI102588 | ff | | ESTs, Weakly similar to T21325 hypothetical protein F25B3.6 - *Caenorhabditis elegans* [*C. elegans*] |
| 1870 | 17335 | AI102634 | oo, tt | | ESTs, Weakly similar to W06B4.2.p [*Caenorhabditis elegans*] [*C. elegans*] |
| 1872 | 24338 | AI102670 | q, z, General | | ESTs |
| 1876 | 22171 | AI102734 | y | | ESTs, Moderately similar to JC4965 elk1 protein - mouse [*M. musculus*] |
| 1877 | 6796 | AI102753 | l, y | | ESTs |
| 1878 | 22857 | AI102768 | j | | ESTs |
| 1879 | 18777 | AI102788 | m, oo | | ESTs |
| 1880 | 11228 | AI102871 | e, ll, pp | | ESTs |
| 1881 | 22628 | AI102955 | qq | | ESTs |
| 1882 | 24229 | AI102972 | b, g, vv | | ESTs |
| 1883 | 4744 | AI103008 | ww | | ESTs |
| 1884 | 10659 | AI103059 | ii | | ESTs |
| 1887 | 3584 | AI103106 | v, bb, ww | | ESTs |
| 1888 | 13298 | AI103143 | e | | ESTs |
| 1891 | 3475 | AI103245 | a | | ESTs, Weakly similar to F13B9.8.p [*Caenorhabditis elegans*] [*C. elegans*] |
| 1892 | 23619 | AI103314 | f | | ESTs |
| 1893 | 12394 | AI103377 | tt | | ESTs |
| 1897 | 4355 | AI103410 | qq, vv | | ESTs |
| 1898 | 15280 | AI103428 | d, ll | | ESTs |
| 1899 | 17168 | AI103441 | j, t, ll | | ESTs |
| 1900 | 6476 | AI103456 | y | | ESTs |
| 1901 | 11659 | AI103480 | gg, hh | | ESTs |
| 1903 | 5309 | AI103521 | g | | ESTs, Weakly similar to BEM-1/BUD5 suppressor-like [*Caenorhabditis elegans*] [*C. elegans*] |
| 1904 | 20918 | AI103552 | y | | ESTs |
| 1905 | 21579 | AI103572 | kk, tt | | ESTs |
| 1906 | 6699 | AI103589 | g | | ESTs |
| 1910 | 2752 | AI103641 | General, kk | | ESTs |
| 1911 | 4856 | AI103708 | d | | ESTs |
| 1914 | 22885 | AI103828 | t, w, nn, tt | | ESTs |
| 1915 | 15946 | AI103834 | j | | ESTs, Moderately similar to CGI-118 protein [*Homo sapiens*] [*H. sapiens*] |
| 1916 | 22587 | AI103848 | h | | ESTs |
| 1917 | 23067 | AI103851 | mm | | ESTs, Highly similar to 13 kDa differentiation associated protein; NADH: ubiquinone oxidoreductase [*Homo sapiens*] [*H. sapiens*] |
| 1920 | 7434 | AI103954 | pp | | ESTs |
| 1921 | 16079 | AI103960 | e | | ESTs, Highly similar to JE0092 NADH dehydrogenase (ubiquinone) (EC 1.6.5.3) flavoprotein 1 precursor- human [*H. sapiens*] |
| 1924 | 3413 | AI104127 | l | | ESTs |
| 1925 | 9294 | AI104152 | ww | | ESTs |
| 1926 | 17440 | AI104231 | v | | ESTs, Weakly similar to BWMSV4 Mov-34 protein - mouse [*M. musculus*] |
| 1927 | 16569 | AI104253 | w | | ESTs, Weakly similar to GL004 protein [*Homo sapiens*] [*H. sapiens*] |
| 1929 | 22833 | AI104258 | l, pp | | ESTs |
| 1930 | 5907 | AI104261 | ll | | ESTs |
| 1932 | 15416 | AI104340 | General | | ESTs |
| 1933 | 10991 | AI104342 | u | | ESTs |
| 1934 | 3291 | AI104355 | j | | ESTs |
| 1939 | 3729 | AI104488 | j | | ESTs |
| 1941 | 18235 | AI104523 | d, p | | ESTs |
| 1943 | 16673 | AI104608 | d, ww | | ESTs |
| 1945 | 2484 | AI104675 | f | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 1947 | 17528 | AI104753 | u | | ESTs, Moderately similar to hypothetical protein FLJ20758 [Homo sapiens] [H. sapiens] |
| 1948 | 12798 | AI104773 | gg, hh | | ESTs, Highly similar to hypothetical protein KIAA1695; hypothetical protein FLJ22297; KIAA1695 protein [Homo sapiens] [H. sapiens] |
| 1949 | 15377 | AI104821 | n, gg, hh | | ESTs |
| 1950 | 12731 | AI104846 | p, y | | ESTs |
| 1951 | 11233 | AI104864 | ff | | ESTs, Moderately similar to hypothetical protein MGC3037 [Homo sapiens] [H. sapiens] |
| 1952 | 6528 | AI104878 | ww | | ESTs |
| 1954 | 6205 | AI104907 | c | TEMO | TEMO |
| 1962 | 18756 | AI105153 | pp, rr | | ESTs |
| 1963 | 17768 | AI105196 | q, dd, oo | | ESTs |
| 1964 | 22600 | AI105309 | v, w | | ESTs |
| 1965 | 7049 | AI105371 | t | | ESTs |
| 1966 | 17221 | AI105429 | ii | | ESTs |
| 1969 | 11179 | AI111559 | ss | | ESTs |
| 1970 | 4478 | AI111599 | d, ii, kk | | ESTs |
| 1970 | 4479 | AI111599 | General, ii | | ESTs |
| 1971 | 7359 | AI111683 | a | | ESTs |
| 1972 | 8305 | AI111695 | f, pp | | ESTs |
| 1973 | 3309 | AI111725 | j | | ESTs |
| 1974 | 9500 | AI111798 | m | | ESTs |
| 1978 | 12926 | AI111975 | tt | | ESTs |
| 1980 | 12908 | AI112043 | a | | ESTs |
| 1981 | 22522 | AI112092 | y | | ESTs |
| 1982 | 8775 | AI112098 | q | | ESTs |
| 1983 | 14560 | AI112111 | pp, tt | | ESTs |
| 1984 | 12916 | AI112171 | a, x | | ESTs |
| 1985 | 7382 | AI112208 | s | | ESTs |
| 1988 | 8048 | AI112338 | l, pp | | ESTs |
| 1991 | 22744 | AI112512 | x | | ESTs |
| 1992 | 24131 | AI112888 | ww | | ESTs |
| 1993 | 12965 | AI112926 | l | | ESTs, Moderately similar to ALKB_HUMAN Alkylated DNA repair protein alkB homolog [H. sapiens] |
| 1994 | 14512 | AI112964 | qq | | ESTs |
| 1996 | 18105 | AI112992 | ww | | ESTs |
| 1998 | 6555 | AI113020 | ss | | ESTs |
| 1999 | 8672 | AI113029 | h | | ESTs |
| 2000 | 11698 | AI113244 | xx | | ESTs |
| 2001 | 11574 | AI113288 | l | | ESTs |
| 2002 | 6446 | AI136157 | gg, hh | | ESTs |
| 2003 | 13020 | AI136338 | ii | | ESTs, Weakly similar to S36152 MHC class III histocompatibility antigen HLA-B-associated protein 2 [similarity] - human [H. sapiens] |
| 2005 | 17253 | AI136523 | d | | ESTs |
| 2009 | 13044 | AI136694 | u | | ESTs |
| 2010 | 11301 | AI136709 | j | | ESTs |
| 2011 | 13046 | AI136711 | k | | ESTs |
| 2012 | 17668 | AI136744 | nn | | ESTs, Weakly similar to S44904 ZK652.9 protein - Caenorhabditis elegans [C. elegans] |
| 2018 | 14243 | AI137123 | ee | | ESTs |
| 2021 | 9404 | AI137259 | jj | | ESTs |
| 2022 | 3542 | AI137275 | r | | ESTs |
| 2024 | 23526 | AI137337 | l | | ESTs, Weakly similar to T28052 hypothetical protein ZK858.7 - Caenorhabditis elegans [C. elegans] |
| 2025 | 9192 | AI137345 | s, vv | | ESTs |
| 2026 | 17451 | AI137356 | gg, hh | | ESTs, Highly similar to S68692 deoxyhypusine synthase (EC 1.1.1.249) [validated] - human [H. sapiens] |
| 2029 | 21164 | AI137488 | o, y | | ESTs |
| 2035 | 17483 | AI137897 | d | | ESTs |
| 2036 | 14459 | AI137930 | ii | | ESTs |
| 2037 | 12356 | AI137931 | mm | | ESTs |
| 2038 | 13153 | AI137935 | s, u | | ESTs |
| 2039 | 21504 | AI137941 | c, d, y | | ESTs |
| 2040 | 23447 | AI137991 | nn | | ESTs |
| 2043 | 2264 | AI144741 | tt | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2044 | 13173 | AI144770 | v | | ESTs |
| 2045 | 6291 | AI144797 | h, l, m, w | | ESTs |
| 2046 | 7887 | AI144832 | l | | ESTs, Highly similar to SYR_HUMAN ARGINYL-TRNA SYNTHETASE (ARGININE--TRNA LIGASE) (ARGRS) [*H. sapiens*] |
| 2047 | 11367 | AI144858 | r | | ESTs |
| 2048 | 6506 | AI144919 | c | | ESTs |
| 2049 | 8880 | AI144936 | l | | ESTs |
| 2050 | 8027 | AI144958 | u | | ESTs |
| 2054 | 14458 | AI145095 | General, ii, ll | | ESTs |
| 2055 | 11391 | AI145238 | ss | | ESTs |
| 2056 | 13397 | AI145332 | ll | | ESTs |
| 2057 | 23553 | AI145343 | nn | | ESTs |
| 2058 | 13374 | AI145368 | b | | ESTs |
| 2059 | 17545 | AI145384 | v | | ESTs |
| 2060 | 17479 | AI145385 | w | | ESTs |
| 2062 | 13006 | AI145455 | oo | | ESTs |
| 2063 | 11331 | AI145556 | ww | | ESTs |
| 2064 | 21216 | AI145586 | ww | | ESTs |
| 2066 | 5874 | AI145801 | General | | ESTs |
| 2067 | 13262 | AI145853 | d, kk | | ESTs |
| 2069 | 12733 | AI145892 | n | | ESTs |
| 2073 | 11354 | AI146215 | xx | | ESTs |
| 2074 | 18411 | AI146259 | k | | ESTs |
| 2076 | 11575 | AI168950 | tt | | ESTs |
| 2078 | 3284 | AI168965 | ii | | ESTs |
| 2079 | 5469 | AI168986 | tt | | ESTs, Highly similar to hypothetical protein FLJ11021 similar to splicing factor, argini [*Homo sapiens*] [*H. sapiens*] |
| 2081 | 22559 | AI169007 | d | | ESTs |
| 2086 | 16484 | AI169116 | gg, hh | | ESTs |
| 2088 | 10984 | AI169156 | s, rr, vv | | ESTs |
| 2091 | 8205 | AI169176 | z, General | | ESTs |
| 2092 | 12979 | AI169177 | d | | ESTs, Highly similar to S33363 gly96 protein - mouse [*M. musculus*] |
| 2098 | 149 | AI169272 | ww | | ESTs |
| 2102 | 7497 | AI169302 | k, mm | | ESTs, Highly similar to S27393 sphingomyelin phosphodiesterase (EC 3.1.4.12), acidic, splice form 1 precursor - mouse [*M. musculus*] |
| 2103 | 22276 | AI169345 | r | | ESTs, Highly similar to FBX8_HUMAN F-box only protein 8 (F-box/SEC7 protein FBS) (DC10) [*H. sapiens*] |
| 2104 | 16338 | AI169374 | p | | ESTs |
| 2106 | 24163 | AI169430 | r | | ESTs, Weakly similar to T29315 hypothetical protein F36D4.5 - *Caenorhabditis elegans* [*C. elegans*] |
| 2108 | 8903 | AI169596 | ww | | ESTs |
| 2109 | 13346 | AI169599 | m | | ESTs |
| 2111 | 12768 | AI169643 | cc | | ESTs |
| 2117 | 10724 | AI169921 | nn | | ESTs |
| 2118 | 5954 | AI169984 | b, uu | | ESTs |
| 2119 | 5899 | AI170038 | m | | ESTs |
| 2120 | 18222 | AI170046 | r | | EST |
| 2121 | 21254 | AI170059 | b | | ESTs |
| 2123 | 22014 | AI170117 | h | | ESTs |
| 2124 | 7113 | AI170260 | e | | ESTs |
| 2127 | 17861 | AI170289 | nn, ww | | ESTs |
| 2128 | 21395 | AI170308 | r | | ESTs |
| 2129 | 16688 | AI170327 | b, z, General, tt | | ESTs |
| 2130 | 13865 | AI170357 | ll, ss | | ESTs |
| 2132 | 2729 | AI170363 | General, xx | | ESTs |
| 2133 | 5297 | AI170379 | ff | | ESTs |
| 2135 | 17229 | AI170530 | General | | ESTs |
| 2137 | 23589 | AI170593 | s | | ESTs |
| 2138 | 6930 | AI170628 | c | | ESTs, Weakly similar to hypothetical protein FLJ11016 [*Homo sapiens*] [*H. sapiens*] |
| 2139 | 7054 | AI170653 | r | | ESTs |
| 2140 | 11542 | AI170664 | y | | ESTs |
| 2141 | 12698 | AI170665 | l, r, z | | ESTs |
| 2144 | 9757 | AI170693 | General | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2147 | 13617 | AI170762 | kk, oo | | ESTs |
| 2148 | 13370 | AI170768 | r | | ESTs |
| 2149 | 3104 | AI170769 | u | | ESTs |
| 2150 | 23630 | AI170780 | m | | ESTs |
| 2151 | 3023 | AI170795 | dd | | ESTs |
| 2152 | 22204 | AI170820 | ww | | ESTs |
| 2153 | 3501 | AI170825 | b, m | | ESTs |
| 2156 | 13702 | AI171064 | d, ll | | ESTs |
| 2157 | 2131 | AI171091 | ii | | ESTs, Weakly similar to T19999 hypothetical protein C47D12.2 - *Caenorhabditis elegans* [*C. elegans*] |
| 2158 | 23009 | AI171147 | v | | ESTs, Weakly similar to S67312 probable membrane protein YDR255c - yeast (*Saccharomyces cerevisiae*) [*S. cerevisiae*] |
| 2161 | 13704 | AI171230 | d | | ESTs |
| 2163 | 3990 | AI171242 | General | | ESTs |
| 2165 | 18660 | AI171262 | s, ww | | ESTs |
| 2169 | 11446 | AI171338 | n, p, w | | ESTs |
| 2172 | 11813 | AI171487 | ww | | ESTs |
| 2173 | 13718 | AI171512 | h | | ESTs |
| 2174 | 8398 | AI171530 | c | | ESTs |
| 2177 | 5833 | AI171601 | h, j, l, uu | | ESTs |
| 2179 | 24073 | AI171632 | e | | ESTs |
| 2180 | 6667 | AI171646 | u | | ESTs |
| 2182 | 21183 | AI171676 | mm | | ESTs |
| 2184 | 10550 | AI171782 | s | | ESTs |
| 2185 | 6669 | AI171798 | ll | | ESTs |
| 2186 | 2625 | AI171800 | j | | ESTs |
| 2188 | 6335 | AI171866 | h | | ESTs |
| 2189 | 5446 | AI171876 | uu | | ESTs |
| 2190 | 21956 | AI171980 | c | | ESTs |
| 2193 | 8057 | AI172015 | a, vv | | ESTs |
| 2195 | 1506 | AI172051 | q | | ESTs, Highly similar to A29440 signal recognition particle receptor - human [*H. sapiens*] |
| 2198 | 3153 | AI172099 | s, rr | | ESTs |
| 2203 | 9569 | AI172157 | n, v | | ESTs |
| 2206 | 18681 | AI172206 | g | | ESTs |
| 2208 | 6974 | AI172263 | tt, ww | | ESTs |
| 2209 | 18833 | AI172266 | j | | ESTs, Moderately similar to protein kinase NYD-SP15 [*Homo sapiens*] [*H. sapiens*] |
| 2212 | 15016 | AI172285 | nn | | ESTs |
| 2215 | 21020 | AI172313 | General | | ESTs |
| 2217 | 17049 | AI172417 | l | | ESTs, Weakly similar to *B. subtilis* YQJC protein like [*Caenorhabditis elegans*] [*C. elegans*] |
| 2220 | 13058 | AI172519 | v | | ESTs |
| 2221 | 13064 | AI172540 | k | | EST |
| 2222 | 19127 | AI172542 | gg, hh | | ESTs |
| 2224 | 13097 | AI172600 | r | | ESTs |
| 2226 | 8795 | AI172618 | General | | ESTs |
| 2227 | 13169 | AI175001 | m | | ESTs |
| 2228 | 11173 | AI175005 | a | | ESTs |
| 2230 | 8053 | AI175033 | l, pp | | ESTs |
| 2232 | 2331 | AI175045 | nn, xx | | ESTs |
| 2233 | 7134 | AI175063 | h | | ESTs |
| 2234 | 8604 | AI175288 | u | | ESTs, Weakly similar to K08H10.9.p [*Caenorhabditis elegans*] [*C. elegans*] |
| 2237 | 3759 | AI175366 | r, kk, tt | | ESTs |
| 2238 | 5637 | AI175459 | w | | ESTs |
| 2239 | 14717 | AI175477 | nn | | ESTs |
| 2240 | 13461 | AI175501 | q | | ESTs, Weakly similar to T27753 hypothetical protein ZK1320.7 - *Caenorhabditis elegans* [*C. elegans*] |
| 2241 | 13353 | AI175508 | xx | | ESTs |
| 2244 | 15229 | AI175575 | p | | ESTs |
| 2245 | 22084 | AI175578 | p, z, General, ee | | ESTs |
| 2246 | 15113 | AI175590 | s, tt | | ESTs, Weakly similar to T15628 hypothetical protein C25H3.9 - *Caenorhabditis elegans* [*C. elegans*] |
| 2248 | 15984 | AI175777 | d | | ESTs |
| 2249 | 14501 | AI175778 | ff | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2250 | 5037 | AI175791 | l | | ESTs |
| 2255 | 2046 | AI176004 | k | | ESTs |
| 2256 | 22311 | AI176007 | c | | ESTs, Highly similar to PM5P_HUMAN Protein pM5 precursor [*H. sapiens*] |
| 2260 | 4585 | AI176121 | h, v | | ESTs |
| 2262 | 21742 | AI176172 | jj | | ESTs |
| 2263 | 6805 | AI176182 | o | | ESTs |
| 2265 | 22011 | AI176212 | ss | | ESTs, Weakly similar to T23D8.3.p [*Caenorhabditis elegans*] [*C. elegans*] |
| 2266 | 22765 | AI176265 | h | | ESTs |
| 2267 | 21869 | AI176273 | k | | ESTs |
| 2269 | 13501 | AI176284 | General, ww | | ESTs |
| 2270 | 21130 | AI176298 | d | | ESTs |
| 2272 | 13502 | AI176320 | x | | ESTs |
| 2273 | 22934 | AI176323 | bb | | ESTs |
| 2274 | 3014 | AI176362 | qq | | ESTs |
| 2275 | 15015 | AI176363 | jj | | ESTs |
| 2279 | 13175 | AI176465 | s | | ESTs |
| 2280 | 24236 | AI176473 | b, General | | ESTs |
| 2284 | 9492 | AI176502 | w, oo | | ESTs |
| 2285 | 15959 | AI176540 | General | | ESTs |
| 2286 | 23184 | AI176554 | ff | | ESTs |
| 2287 | 4882 | AI176569 | s | | ESTs |
| 2288 | 2679 | AI176581 | c | | ESTs |
| 2289 | 2704 | AI176583 | y | | ESTs |
| 2291 | 2161 | AI176592 | e | | ESTs |
| 2292 | 23587 | AI176598 | y, ss | | ESTs |
| 2293 | 4197 | AI176607 | n | | ESTs |
| 2295 | 2536 | AI176616 | General, ll | | ESTs |
| 2296 | 17647 | AI176646 | q | | ESTs |
| 2297 | 15179 | AI176675 | w | | ESTs |
| 2298 | 22517 | AI176698 | f, l | | ESTs |
| 2301 | 26245 | AI176758 | s | | ESTs |
| 2302 | 11952 | AI176775 | k | | ESTs |
| 2303 | 23797 | AI176804 | kk | | ESTs |
| 2304 | 14328 | AI176806 | w | | ESTs |
| 2305 | 21740 | AI176810 | h, w, General, qq | | ESTs |
| 2307 | 23449 | AI176828 | j | | ESTs |
| 2308 | 9712 | AI176836 | p, ff | | ESTs, Weakly similar to T21364 hypothetical protein F25H5.6 - *Caenorhabditis elegans* [*C. elegans*] |
| 2309 | 23299 | AI176839 | General, kk, ll, tt | | ESTs |
| 2310 | 6821 | AI176841 | o | | ESTs |
| 2311 | 5436 | AI176850 | jj | | ESTs |
| 2313 | 13000 | AI176933 | n | | ESTs |
| 2315 | 10825 | AI177022 | x | | ESTs, Weakly similar to T13609 hypothetical protein 87B1 6 - fruit fly (*Drosophila melanogaster*) [*D. melanogaster*] |
| 2316 | 2596 | AI177031 | l, General | | ESTs |
| 2318 | 3969 | AI177055 | l | | ESTs |
| 2319 | 6473 | AI177091 | o, xx | | ESTs |
| 2321 | 14335 | AI177115 | tt | | ESTs |
| 2323 | 3457 | AI177128 | y | | ESTs |
| 2326 | 21870 | AI177281 | pp | | ESTs |
| 2327 | 7519 | AI177285 | ss | | ESTs |
| 2331 | 4987 | AI177428 | ww | | ESTs |
| 2333 | 18823 | AI177484 | t | | ESTs |
| 2334 | 17722 | AI177491 | r, z | | ESTs |
| 2339 | 9521 | AI177706 | n | | ESTs |
| 2340 | 14275 | AI177748 | ww | | ESTs |
| 2341 | 6334 | AI177765 | General | | ESTs, Weakly similar to T20254 hypothetical protein C55A6.1 - *Caenorhabditis elegans* [*C. elegans*] |
| 2342 | 10611 | AI177790 | General | | ESTs |
| 2343 | 22037 | AI177797 | e | | ESTs |
| 2345 | 16111 | AI177866 | w | | ESTs, Moderately similar to splicing factor, arginine/serine-rich 6 [*Homo sapiens*] [*H. sapiens*] |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2346 | 5275 | AI177898 | jj | | ESTs, Weakly similar to T25144 hypothetical protein T22H6.6 - *Caenorhabditis elegans* [*C. elegans*] |
| 2350 | 4828 | AI177965 | f, General | | ESTs |
| 2353 | 17320 | AI178069 | s | | ESTs |
| 2356 | 9440 | AI178142 | b, pp, ww | | ESTs |
| 2358 | 22751 | AI178159 | l | | ESTs |
| 2359 | 19014 | AI178241 | s | | ESTs |
| 2361 | 13141 | AI178321 | g | | ESTs |
| 2362 | 18996 | AI178326 | q | | ESTs, Highly similar to hypothetical protein MGC4175 [*Homo sapiens*] [*H. sapiens*] |
| 2363 | 16045 | AI178386 | dd | | ESTs |
| 2364 | 18658 | AI178475 | d, n | | ESTs |
| 2365 | 8730 | AI178483 | General | | ESTs, Highly similar to HEM6_MOUSE Coproporphyrinogen III oxidase, mitochondrial precursor (Coproporphyrinogenase) (Coprogen oxidase) (COX) [*M. musculus*] |
| 2366 | 21256 | AI178491 | jj | | ESTs |
| 2367 | 14561 | AI178503 | r, rr | | ESTs |
| 2368 | 18800 | AI178504 | a, s, ff | | ESTs |
| 2369 | 3246 | AI178516 | l, m General cc, dd, oo | | ESTs, Weakly similar to S64571 probable membrane protein YGR245c - yeast (*Saccharomyces cerevisiae*) [*S. cerevisiae*] |
| 2370 | 7192 | AI178530 | f, v | | ESTs |
| 2372 | 15282 | AI178573 | l | | ESTs |
| 2373 | 4097 | AI178635 | c | | ESTs |
| 2376 | 8072 | AI178687 | k | | ESTs |
| 2377 | 21311 | AI178688 | tt | | ESTs |
| 2378 | 22174 | AI178689 | u | | ESTs, Moderately similar to hypothetical protein MGC3121 [*Homo sapiens*] [*H. sapiens*] |
| 2379 | 20570 | AI178731 | s | | ESTs |
| 2380 | 5381 | AI178734 | f, ww | | ESTs |
| 2382 | 23567 | AI178746 | n | | ESTs |
| 2385 | 12047 | AI178768 | y | | ESTs |
| 2386 | 3850 | AI178804 | b | | ESTs |
| 2388 | 3138 | AI178850 | dd | | ESTs |
| 2389 | 13591 | AI178884 | ww | | ESTs |
| 2390 | 22361 | AI178901 | v | | ESTs |
| 2392 | 6608 | AI178912 | bb | | ESTs |
| 2393 | 22268 | AI178929 | nn | | ESTs |
| 2394 | 15427 | AI178951 | vv | | ESTs |
| 2396 | 18805 | AI179039 | gg, hh | | ESTs |
| 2399 | 9596 | AI179089 | bb | | ESTs |
| 2405 | 2818 | AI179144 | a | | ESTs |
| 2407 | 8477 | AI179167 | h, w | | ESTs |
| 2408 | 21568 | AI179185 | ii | | ESTs |
| 2409 | 10489 | AI179269 | ww | | ESTs |
| 2414 | 13029 | AI179391 | q | | ESTs |
| 2415 | 19927 | AI179397 | ee | | |
| 2416 | 13614 | AI179407 | b, m, z | | ESTs, Moderately similar to RB17_MOUSE Ras-related protein Rab-17 [*M. musculus*] |
| 2417 | 15042 | AI179422 | f | | ESTs |
| 2418 | 15648 | AI179445 | s | | ESTs |
| 2419 | 20687 | AI179458 | p | | ESTs |
| 2420 | 13619 | AI179464 | n | | ESTs |
| 2421 | 2768 | AI179481 | l, General, ff | | ESTs |
| 2423 | 22724 | AI179506 | pp | | ESTs |
| 2425 | 13054 | AI179560 | kk | | ESTs |
| 2426 | 23270 | AI179601 | General, ii | | ESTs |
| 2428 | 19383 | AI179620 | r | | ESTs, Weakly similar to 0806162N protein URFA6L [*Mus musculus*] [*M. musculus*] |
| 2431 | 12412 | AI179697 | e | | ESTs, Weakly similar to putative cytochrome oxidase [*Escherichia coli* K12] [*E. coli*] |
| 2432 | 21528 | AI179711 | gg, hh | | ESTs |
| 2433 | 7918 | AI179750 | c | | ESTs |
| 2435 | 6251 | AI179854 | l | | ESTs |
| 2437 | 18895 | AI179916 | c, h, j | | ESTs, Highly similar to HSPC038 protein [*Homo sapiens*] [*H. sapiens*] |
| 2439 | 12899 | AI179967 | ss | | ESTs |
| 2442 | 2246 | AI180113 | w | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2444 | 18465 | AI180187 | gg, hh | | ESTs |
| 2445 | 24028 | AI180239 | dd, qq | | ESTs |
| 2447 | 4089 | AI180251 | v | | ESTs |
| 2449 | 13990 | AI180283 | j | | ESTs, Weakly similar to T25574 hypothetical protein C30H7.2 - *Caenorhabditis elegans* [*C. elegans*] |
| 2450 | 17859 | AI180300 | ww | | ESTs |
| 2451 | 2249 | AI180327 | y | | ESTs |
| 2452 | 6631 | AI180336 | ww | | ESTs |
| 2454 | 7117 | AI227612 | ww | | ESTs |
| 2456 | 14130 | AI227670 | u | | ESTs |
| 2457 | 5471 | AI227672 | d | | ESTs |
| 2458 | 12241 | AI227689 | p, y | | ESTs |
| 2459 | 13666 | AI227694 | r | | ESTs |
| 2460 | 23944 | AI227705 | pp | | ESTs, Weakly similar to T21344 hypothetical protein F25H2.1 - *Caenorhabditis elegans* [*C. elegans*] |
| 2461 | 23015 | AI227724 | q | | ESTs |
| 2463 | 6765 | AI227761 | l | | ESTs, Highly similar to EFER_HUMAN Eferin [*H. sapiens*] |
| 2464 | 23023 | AI227856 | oo | | ESTs |
| 2466 | 2374 | AI227925 | ff | | ESTs |
| 2467 | 2226 | AI227941 | z, General | | ESTs |
| 2471 | 20341 | AI228103 | xx | | EST |
| 2473 | 11630 | AI228165 | g, h | | ESTs |
| 2474 | 14241 | AI228180 | h | | EST |
| 2475 | 18491 | AI228195 | g | | ESTs |
| 2476 | 16140 | AI228230 | v | | ESTs |
| 2477 | 4719 | AI228265 | x, General | | ESTs |
| 2478 | 12946 | AI228291 | General | | ESTs |
| 2480 | 8917 | AI228301 | z, ee, nn, rr | | ESTs |
| 2481 | 6102 | AI228335 | l | | ESTs |
| 2482 | 13740 | AI228455 | c | | ESTs, Moderately similar to KIAA0943 protein [*Homo sapiens*] [*H. sapiens*] |
| 2484 | 13753 | AI228589 | g | | ESTs |
| 2486 | 16053 | AI228596 | p, kk | | ESTs, Weakly similar to T16757 hypothetical protein R144.3 - *Caenorhabditis elegans* [*C. elegans*] |
| 2488 | 22106 | AI228628 | ll, ww | | ESTs |
| 2490 | 3557 | AI228672 | nn | | ESTs |
| 2491 | 13757 | AI228676 | z, General | | ESTs, Weakly similar to C32D5.6.p [*Caenorhabditis elegans*] [*C. elegans*] |
| 2492 | 2669 | AI228695 | ww | | ESTs |
| 2493 | 24685 | AI228696 | n | | ESTs |
| 2496 | 13776 | AI228915 | bb | | ESTs |
| 2498 | 22148 | AI229071 | gg, hh | | ESTs |
| 2500 | 18404 | AI229104 | v | | ESTs, Moderately similar to C Chain C, Human Glyoxalase I Complexed With S-P-Nitrobenzyloxycarbonylglutathione [*H. sapiens*] |
| 2503 | 2748 | AI229179 | vv | | ESTs |
| 2504 | 22644 | AI229183 | General | | ESTs |
| 2506 | 15490 | AI229253 | ii | | *Rattus norvegicus* zinc finger protein (pMLZ-4) mRNA, 3' untranslated region |
| 2507 | 5107 | AI229291 | w | | ESTs |
| 2509 | 15500 | AI229337 | a, r | | ESTs |
| 2510 | 7323 | AI229405 | ss | | ESTs, Weakly similar to H32C10.1.p [*Caenorhabditis elegans*] [*C. elegans*] |
| 2512 | 13838 | AI229416 | v | | ESTs |
| 2516 | 15426 | AI229497 | c, u | | ESTs, Moderately similar to JE0381 NADH dehydrogenase (ubiquinone) (EC 1.6.5.3) chain NDUFB10 - human [*H. sapiens*] |
| 2517 | 23435 | AI229502 | oo | | ESTs |
| 2518 | 13690 | AI229660 | k | | ESTs |
| 2519 | 2231 | AI229664 | y, ll | | ESTs |
| 2520 | 21879 | AI229695 | h | | ESTs |
| 2522 | 23983 | AI229708 | General | | ESTs, Moderately similar to T46864 nicotinate-nucleotide pyrophosphorylase (carboxylating) (EC 2.4.2.19) [validated] - human [*H. sapiens*] |
| 2524 | 13035 | AI229844 | l | | ESTs |
| 2525 | 14258 | AI229902 | y | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2526 | 11934 | AI229905 | c, General | | ESTs, Weakly similar to T26088 hypothetical protein W02B12.7 - *Caenorhabditis elegans* [*C. elegans*] |
| 2529 | 22111 | AI230110 | y | | ESTs |
| 2531 | 12554 | AI230125 | bb | | ESTs |
| 2533 | 18417 | AI230166 | q | | ESTs |
| 2538 | 18528 | AI230284 | b | | ESTs |
| 2539 | 14298 | AI230360 | y | | ESTs |
| 2540 | 24137 | AI230370 | ll | | ESTs |
| 2541 | 20620 | AI230428 | p | | ESTs, Weakly similar to GEM4_HUMAN Component of gems 4 (Gemin4) (p97) [*H. sapiens*] |
| 2542 | 4179 | AI230431 | q, ww | | ESTs |
| 2543 | 6820 | AI230439 | ll | | ESTs, Weakly similar to S69697 hypothetical protein YDR412w - yeast (*Saccharomyces cerevisiae*) [*S. cerevisiae*] |
| 2544 | 15938 | AI230503 | p | | ESTs |
| 2547 | 18393 | AI230632 | c, f, kk | | ESTs |
| 2548 | 11347 | AI230660 | ss | | ESTs, Weakly similar to T13618 hypothetical protein 8D8.4 - fruit fly (*Drosophila melanogaster*) [*D. melanogaster*] |
| 2549 | 20764 | AI230668 | General | | ESTs |
| 2551 | 18529 | AI230716 | b | | ESTs |
| 2553 | 4046 | AI230737 | b, c | | ESTs |
| 2558 | 13928 | AI230939 | x | | ESTs |
| 2562 | 19082 | AI231038 | h, z, dd | | ESTs |
| 2564 | 633 | AI231127 | k, l, cc, dd | | ESTs |
| 2567 | 6743 | AI231219 | c | | ESTs |
| 2568 | 20397 | AI231226 | z | | ESTs, Moderately similar to JC5224 methionine--tRNA ligase (EC 6.1.1.10) - human [*H. sapiens*] |
| 2569 | 2619 | AI231290 | k | | ESTs, Highly similar to N-acetyltransferase, homolog of *S. cerevisiae* ARD1; N-acetyltransferase ARD1, human homolog of [*Homo sapiens*] [*H. sapiens*] |
| 2572 | 13958 | AI231356 | g | | ESTs |
| 2574 | 19595 | AI231379 | ww | | ESTs |
| 2577 | 11489 | AI231567 | ff | | ESTs, Highly similar to 2016304A motor protein [*Homo sapiens*] [*H. sapiens*] |
| 2579 | 2422 | AI231615 | d | | ESTs |
| 2580 | 14000 | AI231716 | k | | ESTs |
| 2581 | 8062 | AI231773 | q, r | | ESTs |
| 2582 | 18454 | AI231776 | ll | | ESTs, Moderately similar to F43G9.5.p [*Caenorhabditis elegans*] [*C. elegans*] |
| 2584 | 7055 | AI231789 | h | | ESTs, Weakly similar to T24720 hypothetical protein T09A5.6 - *Caenorhabditis elegans* [*C. elegans*] |
| 2586 | 14007 | AI231808 | vv | | ESTs |
| 2587 | 17077 | AI231834 | kk | | ESTs |
| 2589 | 22995 | AI232047 | n, r, kk | | ESTs |
| 2590 | 6682 | AI232065 | dd | | ESTs |
| 2593 | 2587 | AI232103 | General | | ESTs |
| 2594 | 8959 | AI232128 | ww | | ESTs |
| 2597 | 6726 | AI232157 | v | | ESTs |
| 2598 | 5012 | AI232163 | tt | | ESTs |
| 2599 | 11549 | AI232174 | dd | | ESTs |
| 2600 | 21242 | AI232230 | z | | ESTs, Weakly similar to T27032 hypothetical protein Y49A3A.1 - *Caenorhabditis elegans* [*C. elegans*] |
| 2601 | 23125 | AI232266 | vv, xx | | ESTs |
| 2603 | 23379 | AI232274 | d | | ESTs, Weakly similar to T29933 hypothetical protein F29B9.10 - *Caenorhabditis elegans* [*C. elegans*] |
| 2604 | 13237 | AI232280 | v | | ESTs |
| 2609 | 14034 | AI232321 | a | | ESTs, Highly similar to CGI-150 protein [*Homo sapiens*] [*H. sapiens*] |
| 2610 | 11873 | AI232326 | qq, vv | | ESTs |
| 2611 | 15246 | AI232332 | w | | ESTs |
| 2612 | 16172 | AI232341 | General, kk | | ESTs, Weakly similar to C13B9.2.p [*Caenorhabditis elegans*] [*C. elegans*] |
| 2613 | 11411 | AI232346 | l, General, ee | | ESTs |
| 2615 | 24007 | AI232397 | k | | ESTs |
| 2616 | 3143 | AI232408 | l, l | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2617 | 18910 | AI232419 | g, General | | ESTs, Weakly similar to YLC4__CAEEL Hypothetical 81.0 kDa protein C35D10.4 in chromosome III [*C. elegans*] |
| 2621 | 10405 | AI232524 | uu | | ESTs |
| 2623 | 20350 | AI232552 | General, kk | | EST |
| 2625 | 15088 | AI232613 | rr, ss, uu | | ESTs, Weakly similar to T22242 hypothetical protein F45G2.10 - *Caenorhabditis elegans* [*C. elegans*] |
| 2626 | 4440 | AI232643 | General | | ESTs |
| 2627 | 12177 | AI232666 | c | | ESTs, Weakly similar to NADE__DROME Putative glutamine-dependent NAD(+) synthetase (NAD(+) synthase [glutamine-hydrolyzing]) [*D. melanogaster*] |
| 2630 | 20566 | AI232793 | d | | ESTs |
| 2631 | 10173 | AI232815 | gg, hh | | ESTs |
| 2632 | 4521 | AI232903 | a, r, y | | ESTs, Moderately similar to JC5824 NADH dehydrogenase (ubiquinone) (EC 1.6.5.3) CI-88 chain - human [*H. sapiens*] |
| 2633 | 12467 | AI232924 | mm | | ESTs |
| 2634 | 7147 | AI232948 | a, ff | | ESTs, Weakly similar to T27038 hypothetical protein Y49E10.2 - *Caenorhabditis elegans* [*C. elegans*] |
| 2635 | 3917 | AI232970 | a, o, ff, uu | | ESTs |
| 2637 | 5355 | AI233031 | a, b, General, uu | | ESTs |
| 2639 | 6033 | AI233081 | m | | ESTs |
| 2642 | 14081 | AI233164 | xx | | ESTs |
| 2643 | 11561 | AI233182 | bb | | ESTs |
| 2644 | 13598 | AI233194 | h | | ESTs |
| 2645 | 17790 | AI233204 | j | | ESTs, Moderately similar to ESTD__HUMAN Esterase D [*H. sapiens*] |
| 2648 | 14108 | AI233226 | cc | | ESTs |
| 2649 | 2025 | AI233232 | g | | ESTs |
| 2651 | 15900 | AI233262 | g | | ESTs |
| 2653 | 22263 | AI233308 | tt | | ESTs |
| 2655 | 4475 | AI233374 | t, ww | | ESTs |
| 2656 | 5377 | AI233383 | a | | ESTs |
| 2657 | 7161 | AI233407 | l, tt | | ESTs, Weakly similar to S44853 K12H4.3 protein - *Caenorhabditis elegans* [*C. elegans*] |
| 2658 | 23010 | AI233446 | z | | ESTs, Weakly similar to S67312 probable membrane protein YDR255c - yeast (*Saccharomyces cerevisiae*) [*S. cerevisiae*] |
| 2659 | 14095 | AI233468 | z | | ESTs |
| 2660 | 5794 | AI233480 | pp | | ESTs |
| 2662 | 12588 | AI233576 | d | | ESTs, Highly similar to T46486 chromosomal protein CAPC homolog DKFZp434F205.1 [similarity] - human [*H. sapiens*] |
| 2664 | 7837 | AI233688 | s | | ESTs |
| 2665 | 21765 | AI233696 | vv | | ESTs |
| 2666 | 2044 | AI233698 | gg, hh | | ESTs |
| 2667 | 18254 | AI233704 | oo | | ESTs |
| 2668 | 4670 | AI233714 | cc | | ESTs |
| 2671 | 2772 | AI233750 | f | | ESTs |
| 2672 | 22686 | AI233753 | d | | ESTs |
| 2673 | 7469 | AI233767 | uu | | ESTs, Highly similar to T00744 KIAA0154 protein homolog A-735G6.4 - human [*H. sapiens*] |
| 2674 | 21197 | AI233769 | bb | | ESTs |
| 2677 | 21260 | AI233885 | gg, hh | | ESTs |
| 2678 | 16616 | AI234079 | x | | ESTs |
| 2679 | 17791 | AI234091 | uu | | ESTs |
| 2680 | 14181 | AI234107 | b, h, General | | ESTs |
| 2681 | 22233 | AI234128 | nn | | ESTs |
| 2682 | 14187 | AI234147 | nn | | ESTs |
| 2683 | 14449 | AI234152 | p | | ESTs |
| 2684 | 7071 | AI234162 | ll | | ESTs |
| 2685 | 14192 | AI234219 | cc | | EST |
| 2686 | 12583 | AI234251 | ss | | ESTs |
| 2687 | 14197 | AI234292 | cc | | ESTs |
| 2688 | 17664 | AI234496 | ee | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2690 | 14677 | AI234620 | t, General | | ESTs |
| 2691 | 22453 | AI234678 | p, z | | ESTs |
| 2692 | 23583 | AI234819 | bb | | ESTs |
| 2693 | 14693 | AI234830 | l | | ESTs, Weakly similar to S38159 hypothetical protein YKR081c - yeast (*Saccharomyces cerevisiae*) [*S. cerevisiae*] |
| 2694 | 22213 | AI234858 | tt | | ESTs, Highly similar to splicing factor 3b, subunit 3, 130 kD; spliceosome-associated protein 130 [*Homo sapiens*] [*H. sapiens*] |
| 2696 | 14705 | AI234943 | ss | | ESTs |
| 2697 | 17484 | AI234956 | d | | ESTs |
| 2699 | 19146 | AI235049 | cc, qq | | ESTs |
| 2701 | 8850 | AI235059 | l, y | | ESTs |
| 2704 | 23535 | AI235232 | g | | ESTs |
| 2705 | 6632 | AI235277 | General, dd | | ESTs |
| 2707 | 17646 | AI235338 | g | | ESTs |
| 2708 | 8153 | AI235359 | r | | ESTs |
| 2709 | 9588 | AI235365 | p | | ESTs |
| 2714 | 9547 | AI235559 | General | | ESTs, Highly similar to HEM6_MOUSE Coproporphyrinogen III oxidase, mitochondrial precursor (Coproporphyrinogenase) (Coprogen oxidase) (COX) [*M. musculus*] |
| 2715 | 14743 | AI235560 | nn | | ESTs |
| 2716 | 2850 | AI235563 | d | | ESTs |
| 2718 | 11729 | AI235630 | l, kk, nn | | ESTs |
| 2719 | 19052 | AI235675 | ww | | ESTs |
| 2720 | 5698 | AI235692 | t, mm | | ESTs, Moderately similar to I Chain I, Beta-Galactosidase (Chains I-P) [*E. coli*] |
| 2723 | 14760 | AI235806 | tt | | EST |
| 2727 | 14776 | AI235950 | v | | ESTs |
| 2729 | 19418 | AI236030 | oo | | EST |
| 2735 | 23230 | AI236146 | tt | | ESTs |
| 2737 | 18406 | AI236168 | y, pp | | ESTs |
| 2739 | 14880 | AI236203 | k | | ESTs |
| 2741 | 14596 | AI236342 | oo | | ESTs, Weakly similar to T20417 hypothetical protein E02H1.1 - *Caenorhabditis elegans* [*C. elegans*] |
| 2743 | 9407 | AI236402 | e, dd | | ESTs |
| 2744 | 19075 | AI236473 | l, y | | ESTs |
| 2745 | 9546 | AI236520 | q | | ESTs |
| 2749 | 3103 | AI236603 | bb | | ESTs |
| 2750 | 6567 | AI236608 | s, z | | ESTs |
| 2751 | 6890 | AI236610 | g | | ESTs |
| 2753 | 17248 | AI236635 | gg, hh, vv | | ESTs, Highly similar to 2120310B RNA polymerase II elongation factor [*Mus musculus*] [*M. musculus*] |
| 2754 | 7983 | AI236664 | x | | ESTs |
| 2757 | 6558 | AI236741 | u | | ESTs |
| 2759 | 22443 | AI236761 | p | | ESTs |
| 2760 | 24388 | AI236772 | ss | | ESTs |
| 2761 | 23081 | AI236778 | u | | ESTs |
| 2763 | 14233 | AI236794 | qq | | ESTs |
| 2765 | 23595 | AI236834 | y | | ESTs |
| 2766 | 14800 | AI236856 | ww | | ESTs |
| 2768 | 11818 | AI236937 | ss | | ESTs |
| 2770 | 6240 | AI237132 | General, rr | | ESTs |
| 2771 | 14937 | AI237159 | r | | ESTs, Weakly similar to T23655 hypothetical protein M01F1.3 - *Caenorhabditis elegans* [*C. elegans*] |
| 2772 | 3798 | AI237193 | ee. mm | | ESTs, Weakly similar to T24155 hypothetical protein R10H10.6 - *Caenorhabditis elegans* [*C. elegans*] |
| 2773 | 9289 | AI237251 | g | | ESTs |
| 2774 | 3201 | AI237286 | p | | ESTs |
| 2775 | 350 | AI237311 | ee | | ESTs, Weakly similar to T22416 hypothetical protein F49C12.12 - *Caenorhabditis elegans* [*C. elegans*] |
| 2779 | 14919 | AI237399 | l | | ESTs |
| 2780 | 14911 | AI237403 | s, nn | | ESTs |
| 2782 | 14834 | AI237543 | o | | ESTs |
| 2783 | 23659 | AI237585 | oo | | ESTs |
| 2784 | 9680 | AI237606 | b | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2788 | 8759 | AI237646 | l, s, nn, uu | | ESTs |
| 2790 | 19248 | AI237683 | tt | | ESTs |
| 2791 | 23860 | AI237684 | m | | ESTs |
| 2792 | 3347 | AI237691 | u | | ESTs |
| 2794 | 14656 | AI237820 | a | | ESTs |
| 2795 | 13062 | AI237822 | u | | ESTs |
| 2796 | 9501 | AI638949 | c | | ESTs, Moderately similar to chromosome 20 open reading frame 116 [*Homo sapiens*] [*H. sapiens*] |
| 2797 | 15475 | AI638950 | oo | | ESTs |
| 2798 | 6127 | AI638960 | pp | | ESTs |
| 2798 | 6128 | AI638960 | h, pp | | ESTs |
| 2799 | 19786 | AI638973 | g | | EST |
| 2800 | 25841 | AI638977 | tt | | |
| 2801 | 25845 | AI638987 | k | | |
| 2803 | 25848 | AI638991 | cc | | |
| 2804 | 25855 | AI639002 | f | | |
| 2805 | 17214 | AI639008 | f, z, General | | ESTs |
| 2806 | 23781 | AI639012 | c | | ESTs, Weakly similar to hypothetical protein MGC2601 [*Homo sapiens*] [*H. sapiens*] |
| 2808 | 4035 | AI639023 | cc | | ESTs |
| 2809 | 7176 | AI639029 | n, ii, qq, ss, vv | | ESTs |
| 2810 | 19790 | AI639036 | kk | | EST |
| 2811 | 18495 | AI639042 | ww | | ESTs |
| 2812 | 19997 | AI639043 | bb, jj | | ESTs |
| 2814 | 24205 | AI639045 | c, g, r, kk | | ESTs |
| 2816 | 16514 | AI639093 | oo | | ESTs |
| 2817 | 7170 | AI639102 | d, pp | | ESTs |
| 2818 | 19952 | AI639108 | z, ee, kk | | ESTs |
| 2820 | 17367 | AI639123 | oo | | ESTs |
| 2821 | 25899 | AI639136 | d | | |
| 2822 | 20014 | AI639137 | g | | EST |
| 2824 | 20016 | AI639158 | m | | ESTs, Weakly similar to IF3Y_YEAST EUKARYOTIC TRANSLATION INITIATION FACTOR 3 62 KDA SUBUNIT (EIF3 P62) (TRANSLATION INITIATION FACTOR EIF3, P62 SUBUNIT) (GCD10 PROTEIN) [*S. cerevisiae*] |
| 2825 | 19744 | AI639161 | oo | | EST |
| 2826 | 25907 | AI639167 | General, bb, oo, uu, ww | | ESTs |
| 2827 | 19934 | AI639170 | mm | | ESTs |
| 2828 | 20018 | AI639186 | tt | | EST |
| 2829 | 20075 | AI639187 | gg, hh | | ESTs, Weakly similar to T23273 hypothetical protein Y63D3A.8 - *Caenorhabditis elegans* [*C. elegans*] |
| 2830 | 19795 | AI639197 | k | | EST |
| 2831 | 25921 | AI639209 | v | | |
| 2833 | 19945 | AI639238 | c | | ESTs |
| 2834 | 19962 | AI639248 | f, s | | |
| 2835 | 17082 | AI639255 | w | | ESTs |
| 2836 | 19013 | AI639256 | ww | | ESTs |
| 2837 | 25934 | AI639257 | pp | | |
| 2838 | 25936 | AI639264 | g | | |
| 2840 | 25949 | AI639304 | e | | EST |
| 2841 | 16759 | AI639312 | nn | | ESTs |
| 2842 | 3787 | AI639324 | tt | | ESTs |
| 2844 | 25962 | AI639347 | x | | |
| 2845 | 25964 | AI639352 | v | | |
| 2846 | 20026 | AI639354 | p, bb, qq | | EST |
| 2847 | 25966 | AI639356 | cc | | |
| 2849 | 19967 | AI639409 | cc | | ESTs |
| 2850 | 20029 | AI639417 | k | | ESTs |
| 2852 | 10098 | AI639425 | p | | ESTs |
| 2853 | 15937 | AI639447 | f | | ESTs |
| 2854 | 26000 | AI639455 | mm, xx | | |
| 2855 | 26001 | AI639456 | g | | |
| 2856 | 26004 | AI639461 | tt | | |
| 2857 | 19870 | AI639462 | x | | ESTs |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2862 | 20056 | AI639504 | l, ll | | ESTs, Weakly similar to T13607 hypothetical protein 87B1.3 - fruit fly (*Drosophila melanogaster*) [*D. melanogaster*] |
| 2863 | 15545 | AI639506 | ff, nn | | ESTs |
| 2864 | 19864 | AI639510 | u, jj | | ESTs |
| 2866 | 3240 | AI639524 | d, k | | ESTs |
| 2871 | 25235 | AJ001290 | jj | solute carrier family 5 (inositol transporters), member 3 | |
| 2874 | 25244 | AJ011115 | g, cc | | |
| 2875 | 25247 | AJ011608 | bb | | |
| 2882 | 25254 | D10770 | k, mm | | |
| 2884 | 20487 | D13556 | gg, hh | | |
| 2885 | 25257 | D13623 | dd | | |
| 2885 | 15281 | D13623 | b, l, q, x, General, dd | | ESTs |
| 2886 | 25042 | D14015 | e | Cyclin E1 | |
| 2887 | 20384 | D17349 | o | | |
| 2888 | 25260 | D17521 | q, dd, oo | | |
| 2892 | 25047 | D31838 | ff | | |
| 2895 | 25292 | D45240 | v | | |
| 2900 | 25313 | D87991 | q, dd | | |
| 2902 | 25808 | E00593 | u, ee | | |
| 2903 | 25801 | E12286 | e | | |
| 2904 | 11892 | H31078 | k, gg, hh | | ESTs |
| 2905 | 22543 | H31117 | General | | |
| 2906 | 18517 | H31118 | mm | | ESTs, Weakly similar to PC326 protein [*Homo sapiens*] [*H. sapiens*] |
| 2908 | 11895 | H31367 | z | | ESTs |
| 2909 | 26371 | H31373 | t | | |
| 2910 | 12360 | H31456 | v | | ESTs |
| 2911 | 20514 | H31489 | p | | ESTs |
| 2913 | 6499 | H31625 | r | | ESTs |
| 2914 | 4349 | H31648 | d, ss | | EST |
| 2916 | 4354 | H31695 | nn | | ESTs |
| 2920 | 4364 | H31887 | bb | | ESTs |
| 2922 | 4366 | H31955 | tt | | ESTs |
| 2923 | 4367 | H31976 | gg, hh | | ESTs, Weakly similar to T24597 hypothetical protein T06E6.1 - *Caenorhabditis elegans* [*C. elegans*] |
| 2924 | 11907 | H31990 | gg, hh | | ESTs |
| 2925 | 10531 | H32109 | v, ss | | ESTs |
| 2927 | 17307 | H32747 | rr | | ESTs |
| 2929 | 6980 | H33001 | f, j, m, n, kk | | ESTs |
| 2931 | 4385 | H33086 | t | | ESTs |
| 2932 | 24033 | H33101 | General, oo, uu | | ESTs |
| 2933 | 4395 | H33149 | p | | ESTs, Weakly similar to F38A5.1.p [*Caenorhabditis elegans*] [*C. elegans*] |
| 2934 | 16524 | H33219 | a, n, w | | ESTs |
| 2935 | 10184 | H33426 | jj, rr | | ESTs |
| 2935 | 10185 | H33426 | w, jj | | ESTs |
| 2937 | 4407 | H33528 | l, ff, oo, pp | | ESTs |
| 2938 | 4418 | H33656 | tt | | ESTs |
| 2940 | 12155 | J00728 | o, bb, qq | | |
| 2941 | 25050 | J01435 | n | | |
| 2941 | 25319 | J01435 | n | | |
| 2954 | 25325 | K03045 | a, v, vv, xx | | |
| 2954 | 25326 | K03045 | a, vv | | |
| 2955 | 20149 | K03243 | qq, xx | | |
| 2958 | 12158 | L00320 | o | | |
| 2962 | 1806 | L10336 | d | | |
| 2963 | 25363 | L13235 | General, ll | | |
| 2966 | 25366 | L14003 | General | | |
| 2970 | 25370 | L16995 | o, General, kk | | |
| 2973 | 25052 | L22190 | xx | | |
| 2977 | 25382 | L28114 | cc | | |
| 2979 | 13681 | L38482 | u | | |
| 2983 | 25055 | M11251 | o | | |
| 2986 | 20626 | M13100 | ii | | |
| 2986 | 20627 | M13100 | gg, hh | | |
| 2986 | 20628 | M13100 | w | | |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 2987 | 25056 | M13234 | cc | | |
| 2990 | 25400 | M14776 | w, rr | | |
| 2993 | 25403 | M15528 | g | | |
| 2998 | 25416 | M20721 | g | | |
| 2999 | 20481 | M22631 | tt | Propionyl Coenzyme A carboxylase, alpha polypeptide | |
| 3000 | 805 | M23572 | General | | |
| 3001 | 25425 | M23888 | bb | | |
| 3002 | 24831 | M23889 | ii | | Rat T-cell receptor unproductive beta-chain mRNA V-region (V-D-J-C), clone CRTB320 |
| 3021 | 25057 | M58495 | e | | |
| 3026 | 17130 | M62992 | d, l | | |
| 3026 | 17131 | M62992 | d | | |
| 3032 | 19730 | M81183 | f | | ESTs |
| 3037 | 20664 | M91234 | m, t, mm | | Rat VL30 element mRNA |
| 3038 | 1905 | M91235 | mm | | Rat VL30 element mRNA |
| 3055 | 25540 | NM_012513 | h | | |
| 3086 | 25204 | NM_012599 | a, h, v, x, oo, uu | | |
| 3092 | 23524 | NM_012615 | c, l, m, y, General | | |
| 3094 | 25433 | NM_012621 | cc | | |
| 3099 | 18725 | NM_012645 | a, cc, dd, ll, rr | | |
| 3115 | 18719 | NM_012695 | n, dd, ii, uu | Rat senescence marker protein 2A gene, exons 1 and 2 | Rat senescence marker protein 2A gene, exons 1 and 2 |
| 3118 | 26032 | NM_012703 | a, dd, pp, uu | | |
| 3128 | 25649 | NM_012736 | bb | | |
| 3150 | 20577 | NM_012823 | k, oo | Annexin A3 | ESTs |
| 3159 | 25336 | NM_012850 | g | | |
| 3160 | 18960 | NM_012851 | uu | | ESTs |
| 3182 | 19302 | NM_012930 | o | | EST, Moderately similar to CPT2_RAT CARNITINE O-PALMITOYLTRANSFERASE II, MITOCHONDRIAL PRECURSOR (CPT II) [*R. norvegicus*] |
| 3185 | 19398 | NM_012939 | b | | EST |
| 3187 | 20930 | NM_012941 | k, n, r, jj | | |
| 3199 | 26359 | NM_012984 | cc | | |
| 3225 | 14996 | NM_013059 | x | Tissue-nonspecific ALP alkaline phosphatase | Tissue-nonspecific ALP alkaline phosphatase |
| 3225 | 14997 | NM_013059 | f, ff, kk | Tissue-nonspecific ALP alkaline phosphatase | Tissue-nonspecific ALP alkaline phosphatase |
| 3230 | 25676 | NM_013069 | t | | |
| 3238 | 26047 | NM_013096 | k, tt | | |
| 3238 | 26149 | NM_013096 | r | | |
| 3256 | 25567 | NM_013156 | j, oo, uu | | |
| 3265 | 25312 | NM_013178 | ss | | |
| 3281 | 18305 | NM_013226 | h, bb | ribosomal protein L32 | |
| 3298 | 25546 | NM_017023 | cc | | |
| 3314 | 1261 | NM_017077 | xx | | |
| 3366 | 20052 | NM_017220 | h | | ESTs |
| 3366 | 26043 | NM_017220 | cc | | |
| 3367 | 11989 | NM_017222 | k | | ESTs |
| 3367 | 18967 | NM_017222 | f | | ESTs |
| 3403 | 26109 | NM_017306 | o, jj | | EST |
| 3408 | 19718 | NM_017315 | nn | | ESTs |
| 3423 | 1569 | NM_017361 | oo, pp | nucleoporin p54 | nucleoporin p54 |
| 3506 | 20633 | NM_019630 | g | | ESTs |
| 3537 | 20182 | NM_021840 | c, d | | |
| 3555 | 13758 | NM_022289 | f, u | | ESTs |
| 3620 | 19495 | NM_022700 | d | | EST |
| 3633 | 19924 | NM_022937 | f | Doc2A | |
| 3648 | 8656 | NM_023979 | ii | enoyl-Coenzyme A, hydratase/3-hydroxyacyl Coenzyme A dehydrogenase | ESTs |
| 3675 | 8296 | NM_024384 | tt | PDRP protein | PDRP protein |
| 3732 | 5999 | NM_031057 | bb, pp | | ESTs |
| 3764 | 19359 | NM_031136 | b, s | | EST |
| 3768 | 21623 | NM_031144 | pp | | |
| 3794 | 26327 | NM_031357 | w | | ESTs |
| 3794 | 25862 | NM_031357 | d | | |
| 3796 | 25069 | NM_031509 | vv | | |
| 3804 | 25058 | NM_031533 | h, kk | | |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 3819 | 25793 | NM_031577 | pp | | |
| 3906 | 8384 | NM_031836 | t, mm, xx | vascular endothelial growth factor | vascular endothelial growth factor |
| 3906 | 8385 | NM_031836 | mm | vascular endothelial growth factor | vascular endothelial growth factor |
| 3906 | 8386 | NM_031836 | t, mm, xx | vascular endothelial growth factor | vascular endothelial growth factor |
| 3916 | 8663 | NM_031971 | nn | Heat shock protein 70-1 | Heat shock protein 70-1 |
| 3939 | 25528 | NM_033096 | c, ss | | |
| 3945 | 11714 | NM_033352 | f, l, n, General, kk | | ESTs |
| 3982 | 19367 | NM_053469 | n, y | | EST |
| 3989 | 5937 | NM_053523 | ee, tt | | ESTs |
| 4014 | 19403 | NM_053604 | f | | EST |
| 4055 | 20645 | NM_053806 | j | | |
| 4162 | 23350 | NM_130894 | p | mitofusin 2 | mitofusin 2 |
| 4163 | 17426 | NM_131910 | j | dynein-associated protein RKM23 | dynein-associated protein RKM23 |
| 4174 | 23200 | NM_133324 | a | corneal wound healing related protein | corneal wound healing related protein |
| 4201 | 797 | NM_133609 | m, dd, oo, pp | eukaryotic translation initiation factor 2B, subunit 3 (gamma, 58 kD) | eukaryotic translation initiation factor 2B, subunit 3 (gamma, 58 kD) |
| 4201 | 798 | NM_133609 | f, m, n, dd, ee, ll, oo, pp | eukaryotic translation initiation factor 2B, subunit 3 (gamma, 58 kD) | eukaryotic translation initiation factor 2B, subunit 3 (gamma, 58 kD) |
| 4206 | 19384 | NM_134326 | pp | | EST |
| 4219 | 2367 | NM_134410 | b, q, x | Mg87 protein | Mg87 protein |
| 4219 | 2368 | NM_134410 | b, ss | Mg87 protein | Mg87 protein |
| 4233 | 7620 | NM_138523 | t | potassium channel regulatory factor | ESTs |
| 4241 | 16401 | NM_138828 | ee | | |
| 4273 | 17657 | NM_139101 | l, q, z, pp | potassium channel regulator 1 | potassium channel regulator 1 |
| 4288 | 10458 | NM_144741 | u | | EST |
| 4295 | 26218 | NM_145084 | r | | *Rattus norvegicus* hypothetical protein RMT-7 mRNA, complete cds |
| 4295 | 23756 | NM_145084 | g, cc | | *Rattus norvegicus* hypothetical protein RMT-7 mRNA, complete cds |
| 4300 | 6988 | NM_145677 | ww | | ESTs |
| 4306 | 20515 | NM_145784 | d, qq | | ESTs |
| 4306 | 21355 | NM_145784 | o, v | | ESTs |
| 4306 | 20698 | NM_145784 | a, x, vv | | |
| 4306 | 13642 | NM_145784 | jj | | ESTs |
| 4307 | 14664 | NM_145790 | General, ii, kk, ss | | ESTs |
| 4309 | 25644 | NM_147136 | u | | |
| 4317 | 8018 | NM_153306 | oo | | ESTs |
| 4318 | 25498 | NM_153308 | mm | | |
| 4321 | 11756 | NM_153314 | e, General, rr | | |
| 4323 | 14128 | NM_153740 | e | | ESTs |
| 4327 | 25064 | S45392 | v | | |
| 4328 | 25481 | S46798 | n | | |
| 4329 | 25483 | S48190 | ff, ww | | |
| 4330 | 25491 | S58528 | t, mm | | |
| 4331 | 25495 | S59892 | c | | |
| 4332 | 25496 | S59893 | d, v | | |
| 4336 | 25511 | S68944 | ee | | |
| 4336 | 25512 | S68944 | u | | |
| 4337 | 25513 | S69315 | k, q | | |
| 4339 | 25518 | S70011 | y | | |
| 4341 | 1575 | S74801 | g, cc | | |
| 4342 | 25531 | S74907 | l, y, ff, pp | | |
| 4344 | 17128 | S75997 | d | | |
| 4346 | 25538 | S76466 | u | | |
| 4349 | 25550 | S79213 | j, General, kk, qq | protein phosphatase 1, regulatory (inhibitor) subunit 2 | |
| 4350 | 25559 | S81025 | l, m, General, dd | | |
| 4352 | 25071 | S83436 | l, oo | | |
| 4353 | 25568 | S87522 | k, n | | |
| 4355 | 25075 | U01347 | z | | |

TABLE 1-continued

| SEQ ID NO. | GLGC ID NO. | GenBank Acc. or RefSeq ID No. | Model Code | Known Gene Name | Unigene Sequence Cluster Title |
|---|---|---|---|---|---|
| 4360 | 25576 | U09361 | h | tenascin C | |
| 4364 | 25586 | U17837 | General | | |
| 4369 | 17480 | U31598 | e, pp | | *R. norvegicus* mRNA for RT1.Ma |
| 4371 | 25598 | U32575 | c | | |
| 4373 | 1483 | U34843 | General | D123 gene product | D123 gene product |
| 4379 | 24008 | U47316 | jj | | ESTs, Weakly similar to S40928 hypothetical protein ZK1098.5 - *Caenorhabditis elegans* [*C. elegans*] |
| 4380 | 25604 | U50185 | xx | myosin phosphatase, target subunit 1 | |
| 4380 | 25605 | U50185 | t, ff, mm | myosin phosphatase, target subunit 1 | |
| 4384 | 25607 | U53873 | k | | |
| 4388 | 25628 | U70268 | ii | | |
| 4392 | 25636 | U75921 | cc | | |
| 4393 | 25639 | U75925 | pp | | |
| 4401 | 18663 | U95052 | u | eukaryotic translation initiation factor 4 gamma, 2 | ESTs, Weakly similar to S49172 translation initiation factor eIF-4 gamma - human (fragment) [*H. sapiens*] |
| 4402 | 26033 | X00722 | q | | |
| 4403 | 819 | X02284 | b, e, General, uu | | |
| 4405 | 25664 | X05472 | v | | |
| 4407 | 25666 | X06801 | t, mm | | |
| 4409 | 803 | X07266 | r | | |
| 4411 | 1113 | X07729 | y | | |
| 4418 | 25678 | X14848 | b | | |
| 4419 | 25679 | X15013 | c | | |
| 4420 | 25680 | X15551 | m, x, tt | | |
| 4423 | 25087 | X51615 | j, t | | |
| 4425 | 17129 | X52583 | d | | |
| 4426 | 25689 | X52815 | t, y | | |
| 4430 | 25691 | X53504 | l, q, General | | |
| 4431 | 25694 | X54250 | a | | |
| 4432 | 25088 | X54419 | h, v | | |
| 4436 | 25700 | X57986 | pp | Protein kinase, cAMP-dependent, catalytic, alpha | |
| 4436 | 25701 | X57986 | f, p, r, z, General | Protein kinase, cAMP-dependent, catalytic, alpha | |
| 4441 | 25705 | X59375 | h, j, jj | | |
| 4442 | 25706 | X59608 | w | | |
| 4443 | 25713 | X60659 | e, u | | |
| 4446 | 25719 | X62146 | l, ff | | |
| 4449 | 25725 | X62660 | qq, vv | | |
| 4451 | 25729 | X62950 | t | | |
| 4461 | 16272 | X76456 | e | | |
| 4462 | 25741 | X76489 | mm | CD9 antigen (p24) | |
| 4465 | 25743 | X80130 | t, mm | | |
| 4467 | 25747 | X81448 | t, General, bb, mm, ss | keratin complex 1, acidic, gene 18 | |
| 4469 | 25753 | X89695 | g, cc | | |
| 4470 | 25756 | X89698 | f | | |
| 4471 | 25758 | X89700 | pp | | |
| 4472 | 25761 | X89702 | h | | |
| 4474 | 25769 | X95850 | k | | |
| 4475 | 12978 | X96437 | d | | ESTs, Highly similar to S33363 gly96 protein - mouse [*M. musculus*] |
| 4477 | 25774 | X99723 | ee, mm | SWI/SNF related, matrix associated, actin dependent regulator of chromatin, subfamily a, member 4 | |

TABLE 2

| SEQ ID NO. | GLGC ID NO. | GenBank Acc. or RefSeq ID No. | Model Code | Human Homologous Gene Name | Human Homologous Cluster Title |
|---|---|---|---|---|---|
| 2969 | 16119 | L16532 | q | 2',3'-cyclic nucleotide 3' phosphodiesterase, cyclic nucleotide phosphodiesterase 1 | |
| 4126 | 15408 | NM_057197 | rr | 2,4-dienoyl CoA reductase 1, mitochondrial | 2,4-dienoyl CoA reductase 1, mitochondrial |
| 4126 | 15409 | NM_057197 | ff, ii, jj | 2,4-dienoyl CoA reductase 1, mitochondrial | 2,4-dienoyl CoA reductase 1, mitochondrial |
| 1271 | 22602 | AF044574 | o | 2,4-dienoyl CoA reductase 2, peroxisomal, 2,4-dienoyl-Coenzyme A reductase 2, peroxisomal | 2,4-dienoyl CoA reductase 1, mitochondrial, 2,4-dienoyl CoA reductase 2, peroxisomal, 2 2,4-dienoyl-Coenzyme A reductase 2, peroxisomal, *Mus musculus*, Similar to hypothetical protein MGC4172, clone MGC:18716 IMAGE:4219994, mRNA, complete cds, carbonyl reductase 2, peroxisomal trans 2-enoyl CoA reductase; putative short chain alcohol dehydrogenase, peroxisomal trans-2-enoyl-CoA reductase |
| 1271 | 22603 | AF044574 | o, kk | 2,4-dienoyl CoA reductase 2, peroxisomal, 2,4-dienoyl-Coenzyme A reductase 2, peroxisomal | 2,4-dienoyl CoA reductase 1, mitochondrial, 2,4-dienoyl CoA reductase 2, peroxisomal, 2 4-dienoyl-Coenzyme A reductase 2, peroxisomal, *Mus musculus*, Similar to hypothetical protein MGC4172, clone MGC:18716 IMAGE:4219994, mRNA, complete cds, carbonyl reductase 2, peroxisomal trans 2-enoyl CoA reductase; putative short chain alcohol dehydrogenase, peroxisomal trans-2-enoyl-CoA reductase |
| 3248 | 650 | NM_013134 | vv | 3-hydroxy-3-methylglutaryl-Coenzyme A reductase | 3-hydroxy-3-methylglutaryl-Coenzyme A reductase, *Mus musculus*, Similar to 3-hydroxy-3-methylglutaryl-Coenzyme A reductase, clone MGC:25828 IMAGE:4166540, mRNA, complete cds, SREBP CLEAVAGE-ACTIVATING PROTEIN |
| 3248 | 651 | NM_013134 | t | 3-hydroxy-3-methylglutaryl-Coenzyme A reductase | 3-hydroxy-3-methylglutaryl-Coenzyme A reductase, *Mus musculus*, Similar to 3-hydroxy-3-methylglutaryl-Coenzyme A reductase, clone MGC:25828 IMAGE:4166540, mRNA, complete cds, SREBP CLEAVAGE-ACTIVATING PROTEIN |
| 3248 | 652 | NM_013134 | n, t | 3-hydroxy-3-methylglutaryl-Coenzyme A reductase | 3-hydroxy-3-methylglutaryl-Coenzyme A reductase, *Mus musculus*, Similar to 3-hydroxy-3-methylglutaryl-Coenzyme A reductase, clone MGC:25828 IMAGE:4166540, mRNA, complete cds, SREBP CLEAVAGE-ACTIVATING PROTEIN |
| 3386 | 20600 | NM_017268 | q, w, jj | 3-hydroxy-3-methylglutaryl-Coenzyme A synthase 1, 3-hydroxy-3-methylglutaryl-Coenzyme A synthase 1 (soluble) | 3-hydroxy-3-methylglutaryl-Coenzyme A synthase 1 (soluble), 3-hydroxy-3-methylglutaryl-Coenzyme A synthase 2, pre B-cell leukemia transcription factor 1 |
| 3386 | 20601 | NM_017268 | q, w, jj | 3-hydroxy-3-methylglutaryl-Coenzyme A synthase 1, 3-hydroxy-3-methylglutaryl-Coenzyme A synthase 1 (soluble) | 3-hydroxy-3-methylglutaryl-Coenzyme A synthase 1 (soluble), 3-hydroxy-3-methylglutaryl-Coenzyme A synthase 2, pre B-cell leukemia transcription factor 1 |
| 3510 | 20493 | NM_020076 | b, k, l, General, bb, ff, qq, tt, uu | 3-hydroxyanthranilate 3,4-dioxygenase | 3-hydroxyanthranilate 3,4-dioxygenase |
| 3510 | 20494 | NM_020076 | cc, ii, ss | 3-hydroxyanthranilate 3,4-dioxygenase | 3-hydroxyanthranilate 3,4-dioxygenase |
| 3497 | 15680 | NM_019376 | ii, ll | 3-monooxgenase/tryptophan 5-monooxgenase activation protein, gamma polypeptide, tyrosine 3-monooxygenase/tryptophan 5-monooxygenase activation protein, gamma polypeptide | |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1957 | 18278 | AI105080 | m | 3-oxoacid CoA transferase | 3-oxoacid CoA transferase, 3-oxoacid CoA transferase 2, ESTs, Highly similar to SCOT_HUMAN SUCCINYL-COA:3-KETOACID-COENZYME A TRANSFERASE PRECURSOR [*H. sapiens*] |
| 3837 | 21585 | NM_031620 | j | 3-phosphoglycerate dehydrogenase, phosphoglycerate dehydrogenase | 3-phosphoglycerate dehydrogenase, EST, Moderately similar to SERA MOUSE D-3-PHOSPHOGLYCERATE DEHYDROGENASE [*M. musculus*], ESTs, Weakly similar to 3-phosphoglycerate dehydrogenase [*Rattus norvegicus*] [*R. norvegicus*], *Mus musculus* adult male testis cDNA, RIKEN full-length enriched library, clone:4930404C15:3-phosphoglycerate dehydrogenase, full insert sequence, glyoxylate reductase/hydroxypyruvate reductase, phosphoglycerate dehydrogenase |
| 3837 | 21586 | NM_031620 | j, u, dd, oo | 3-phosphoglycerate dehydrogenase, phosphoglycerate dehydrogenase | 3-phosphoglycerate dehydrogenase, EST, Moderately similar to SERA MOUSE D-3-PHOSPHOGLYCERATE DEHYDROGENASE [*M. musculus*], ESTs, Weakly similar to 3-phosphoglycerate dehydrogenase [*Rattus norvegicus*] [*R. norvegicus*], *Mus musculus* adult male testis cDNA, RIKEN full-length enriched library, clone:4930404C15:3-phosphoglycerate dehydrogenase, full insert sequence, glyoxylate reductase/hydroxypyruvate reductase, phosphoglycerate dehydrogenase |
| 3837 | 21587 | NM_031620 | k | 3-phosphoglycerate dehydrogenase, phosphoglycerate dehydrogenase | 3-phosphoglycerate dehydrogenase, EST, Moderately similar to SERA MOUSE D-3-PHOSPHOGLYCERATE DEHYDROGENASE [*M. musculus*], ESTs, Weakly similar to 3-phosphoglycerate dehydrogenase [*Rattus norvegicus*] [*R. norvegicus*], *Mus musculus* adult male testis cDNA, RIKEN full-length enriched library, clone:4930404C15:3-phosphoglycerate dehydrogenase, full insert sequence, glyoxylate reductase/hydroxypyruvate reductase, phosphoglycerate dehydrogenase |
| 449 | 17742 | AA866302 | ss | 4-hydroxyphenylpyruvate dioxygenase, 4-hydroxyphenylpyruvic acid dioxygenase | 4-hydroxyphenylpyruvate dioxygenase, 4-hydroxyphenylpyruvic acid dioxygenase |
| 3371 | 17740 | NM_017233 | ss | 4-hydroxyphenylpyruvate dioxygenase, 4-hydroxyphenylpyruvic acid dioxygenase | 4-hydroxyphenylpyruvate dioxygenase, 4-hydroxyphenylpyruvic acid dioxygenase |
| 3081 | 20313 | NM_012585 | k | 5-hydroxytryptamine (serotonin) receptor 1A | 5-hydroxytryptamine (serotonin) receptor 1A |
| 3680 | 22282 | NM_024394 | h, m, General, uu | 5-hydroxytryptamine (serotonin) receptor 3A | 5-hydroxytryptamine (serotonin) receptor 3A |
| 3036 | 21882 | M83740 | a, General, ff | 6-pyruvoyl-tetrahydropterin synthase/dimerization cofactor of hepatocyte nuclear factor 1 alpha (TCF1) | |
| 4483 | 19694 | Z48444 | ee | a disintegrin and metalloprotease domain 10, a disintegrin and metalloproteinase domain 10 | ESTs, Moderately similar to PC4265 disintegrin and metalloproteinase 10 [*H. sapiens*], Homo sapiens cDNA FLJ13398 fis, clone PLACE1001377, highly similar to *Homo sapiens* ADAM10 (ADAM10) mRNA, RIKEN cDNA 1700031C13 gene, a disintegrin and metalloprotease domain 10, a disintegrin and metalloproteinase domain 10 |
| 3312 | 18957 | NM_017075 | o, xx | acetyl-Coenzyme A acetyltransferase 1, acetyl-Coenzyme A acetyltransferase 1 (acetoacetyl Coenzyme A thiolase) | *Homo sapiens*, Similar to acetyl-Coenzyme A acetyltransferase 1 (acetoacetyl Coenzyme A thiolase), clone MGC:13582 IMAGE:4278329, mRNA, complete cds, *Mus musculus*, Similar to Acetyl-Co A |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3312 | 18958 | NM_017075 | o, jj | acetyl-Coenzyme A acetyltransferase 1, acetyl-Coenzyme A acetyltransferase 1 (acetoacetyl Coenzyme A thiolase) | acetyltransferase 1, mitochondrial, clone MGC:39067 IMAGE:5365469, mRNA, complete cds, acetyl-Coenzyme A acetyltransferase 1 (acetoacetyl Coenzyme A thiolase), acetyl-Coenzyme A acyltransferase (peroxisomal 3-oxoacyl-Coenzyme A thiolase) *Homo sapiens*, Similar to acetyl-Coenzyme A acetyltransferase 1 (acetoacetyl Coenzyme A thiolase), clone MGC:13582 IMAGE:4278329, mRNA, complete cds, *Mus musculus*, Similar to Acetyl-Co A acetyltransferase 1, mitochondrial, clone MGC:39067 IMAGE:5365469, mRNA, complete cds, acetyl-Coenzyme A acetyltransferase 1 (acetoacetyl Coenzyme A thiolase), acetyl-Coenzyme A acyltransferase (peroxisomal 3-oxoacyl-Coenzyme A thiolase) |
| 1083 | 23700 | AA956382 | ff | acetyl-Coenzyme A acyltransferase (peroxisomal 3-oxoacyl-Coenzyme A thiolase), acetyl-Coenzyme A acyltransferase 1 (peroxisomal 3-oxoacyl-Coenzyme A thiolase) | *Mus musculus*, Similar to Acetyl-Co A acetyltransferase 1, mitochondrial, clone MGC:39067 IMAGE:5365469, mRNA, complete cds, acetyl-Coenzyme A acyltransferase 1 (peroxisomal 3-oxoacyl-Coenzyme A thiolase), acetyl-Coenzyme A acyltransferase 1 (peroxisomal 3-oxoacyl-Coenzyme A thiolase) |
| 3046 | 23698 | NM_012489 | o, xx | acetyl-Coenzyme A acyltransferase (peroxisomal 3-oxoacyl-Coenzyme A thiolase), acetyl-Coenzyme A acyltransferase I (peroxisomal 3-oxoacyl-Coenzyme A thiolase) | *Mus musculus*, Similar to Acetyl-Co A acetyltransferase 1, mitochondrial, clone MGC:39067 IMAGE:5365469, mRNA, complete cds, acetyl-Coenzyme A acyltransferase (peroxisomal 3-oxoacyl-Coenzyme A thiolase), acetyl-Coenzyme A acyltransferase 1 (peroxisomal 3-oxoacyl-Coenzyme A thiolase) |
| 3046 | 23699 | NM_012489 | o, u, v, ss | acetyl-Coenzyme A acyltransferase (peroxisomal 3-oxoacyl-Coenzyme A thiolase), acetyl-Coenzyme A acyltransferase 1 (peroxisomal 3-oxoacyl-Coenzyme A thiolase) | *Mus musculus*, Similar to Acetyl-Co A acetyltransferase 1, mitochondrial, clone MGC:39067 IMAGE:5365469, mRNA, complete cds, acetyl-Coenzyme A acyltransferase (peroxisomal 3-oxoacyl-Coenzyme A thiolase), acetyl-Coenzyme A acyltransferase 1 (peroxisomal 3-oxoacyl-Coenzyme A thiolase) |
| 3149 | 6780 | NM_012819 | n | acetyl-Coenzyme A dehydrogenase, long-chain, acyl-Coenzyme A dehydrogenase, long chain | acetyl-Coenzyme A dehydrogenase, long-chain, acyl-Coenzyme A dehydrogenase, long chain |
| 3282 | 21078 | NM_016986 | l, o, ss | acetyl-Coenzyme A dehydrogenase, medium chain, acyl-Coenzyme A dehydrogenase, C-4 to C-12 straight chain | ESTs, Highly similar to ACYL-COA DEHYDROGENASE, MEDIUM-CHAIN SPECIFIC PRECURSOR [*M. musculus*], acetyl-Coenzyme A dehydrogenase, medium chain, acyl-Coenzyme A dehydrogenase, C-4 to C-12 straight chain |
| 3284 | 24649 | NM_016988 | b, e, l, w, General | acid phosphatase 2, lysosomal | ESTs, Weakly similar to A33395 acid phosphatase (EC 3.1.3.2) precursor - rat [*R. norvegicus*], acid phosphatase 2, lysosomal, acid phosphatase. testicular |
| 2706 | 19995 | AI235320 | p, t | aconitase 2, mitochondrial | aconitase 2, mitochondrial |
| 3681 | 19993 | NM_024398 | o, xx | aconitase 2, mitochondrial | aconitase 2, mitochondrial |
| 4090 | 19991 | NM_053961 | cc | aconitase 2, mitochondrial | aconitase 2, mitochondrial |
| 3705 | 21165 | NM_031005 | mm | actinin, alpha 1 | ESTs, Weakly similar to alpha actinin 4 [*Mus musculus*] [*musculus*], RIKEN cDNA 31 10023F10 gene, actinin alpha 2, actinin alpha 3, actinin, alpha 1, actinin, alpha 2, actinin, alpha 3, alpha actinin 4 |
| 3705 | 21166 | NM_031005 | t, mm | actinin, alpha 1 | ESTs, Weakly similar to alpha actinin 4 [*Mus musculus*] [*M. musculus*], RIKEN cDNA 3110023F10 gene, actinin alpha 2, actinin alpha 3, actinin, alpha 1, actinin, alpha 2, actinin, alpha 3, alpha actinin 4 |
| 3853 | 5358 | NM_031675 | t, ee, mm | actinin, alpha 4, alpha actinin 4 | ESTs, Weakly similar to alpha actinin 4 [*Mus musculus*] [*M. musculus*], RIKEN cDNA 3110023F10 gene, actinin, alpha 4, alpha actinin 4 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3175 | 24431 | NM_012912 | c, n, General, kk, tt | activating transcription factor 3 | ESTs, Weakly similar to A39382 liver regeneration factor LRF1 - rat [*R. norvegicus*], ESTs, Weakly similar to A54025 transcription factor ATF3 [*H.sapiens*], activating transcriotion factor 3 |
| 3168 | 16721 | NM_012891 | o, General, cc, kk, uu | acyl-Coenzyme A dehydrogenase, very long chain | EST, Moderately similar to ACYL-COA DEHYDROGENASE, VERY-LONG-CHAIN SPECIFIC [*M. musculus*], EST, Weakly similar to ACDV_RAT Acyl-CoA dehydrogenase, very-long-chain specific, mitochondrial precursor (VLCAD) [*R. norvegicus*], EST, Weakly similar to S54183 acyl-CoA dehydrogenase [*H. sapiens*], ESTs, Weakly similar to ACDV_RAT Acyl-CoA dehydrogenase, very-long-chain specific, mitochondrial precursor (VLCAD) [*R. norvegicus*], RIKEN cDNA 2600017P15 gene, acyl-Coenzyme A dehydrogenase, very long chain |
| 1496 | 17957 | AI028975 | d | adaptor protein complex AP-1, beta 1 subunit, adaptor-related protein complex 1, beta 1 subunit | adaptor protein complex AP-1, beta 1 subunit, adaptor-related protein complex 1, beta 1 subunit |
| 3390 | 17959 | NM_017277 | w | adaptor protein complex AP-1, beta 1 subunit, adaptor-related protein complex 1, beta 1 subunit | adaptor protein complex AP-1, beta 1 subunit, adaptor-related protein complex 1, beta 1 subunit |
| 4133 | 17956 | NM_080583 | m, vv | adaptor-related protein complex 2, beta 1 subunit | adaptor protein complex AP-1, beta 1 subunit, adaptor-related protein complex 2, beta 1 subunit |
| 4133 | 17958 | NM_080583 | ff, xx | adaptor-related protein complex 2, beta 1 subunit | adaptor protein complex AP-1, beta 1 subunit, adaptor-related protein complex 2, beta 1 subunit |
| 3346 | 595 | NM_017161 | bb, mm | adenosine A2b receptor | EST, Weakly similar to JC1229 adenosine receptor A2b [*H. sapiens*], adenosine A2b receptor |
| 3170 | 631 | NM_012896 | g, ss | adenosine A3 receptor | |
| 3706 | 91 | NM_031006 | ll | adenosine deaminase, RNA-specific | adenosine deaminase, RNA-specific, expressed sequence AV242451 |
| 3169 | 16708 | NM_012895 | a, b, h, w | adenosine kinase | adenosine kinase, expressed sequence AI987814 |
| 3707 | 997 | NM_031007 | u | adenylate cyclase 2 adenylate cyclase 2 (brain) | EST Moderately similar to B Chain B, Complex Of Gs-Alpha With The Catalytic Domains Of Mammalian Adenylyl Cyclase: Complex With Beta-L-2',3'-Dideoxyatp And Mg [*R. norvegicus*], ESTs, Highly similar to ADENYLATE CYCLASE, TYPE VII [*M. musculus*], ESTs, Weakly similar to ADENYLATE CYCLASE, TYPE VII [*M. musculus*], adenylate cyclase 2 (brain), adenylate cyclase 4, adenylate cyclase 7 |
| 3444 | 24019 | NM_019186 | ss, tt | ADP-ribosylation factor-like 4, ADP-ribosylation-like 4 | ADP-ribosylation factor 4-like, ADP-ribosylation factor-like 7, ADP-ribosylation-like 4, ESTs, Weakly similar to ADP-ribosylation-like 4 [*Mus musculus*] [*M. musculus*], *Mus musculus*, Similar to ADP-ribosylation-like 4, clone MGC:5774 IMAGE:3599701, mRNA, complete cds, RIKEN cDNA 1110036H21 gene, epithelial protein lost in neoplasm beta |
| 3137 | 1348 | NM_012776 | m | adrenergic receptor kinase, beta 1, adrenergic, beta, receptor kinase 1 | ESTs, Weakly similar to GRK6 MOUSE G PROTEIN-COUPLED RECEPTOR KINASE GRK6 [*M. musculus*], G protein-coupled receptor kinase 6, adrenergic receptor kinase, beta 1, adrenergic, beta, receptor kinase 1 |
| 3137 | 1349 | NM_012776 | ii, rr | adrenergic receptor kinase, beta 1, adrenergic, beta, receptor kinase 1 | ESTs, Weakly similar to GRK6 MOUSE G PROTEIN-COUPLED RECEPTOR KINASE GRK6 [*M. musculus*], G protein-coupled receptor kinase 6, adrenergic receptor kinase, beta 1, adrenergic, beta, receptor kinase 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3685 | 1835 | NM_024483 | e | adrenergic receptor, alpha 1d, adrenergic, alpha-1D-, receptor | *Mus musculus* histamine H4 receptor mRNA, complete cds, adrenergic, alpha-1D-, receptor |
| 2347 | 13558 | AI177901 | k | adrenergic receptor, beta 1, adrenergic, beta-1-, receptor | G protein-coupled receptor 45, adrenergic receptor, beta 1, adrenergic, beta-1-, receptor |
| 3122 | 322 | NM_012715 | p, t, ff, ii, pp, xx | adrenomedullin | adrenomedullin |
| 3028 | 10743 | M64780 | l, p, z, General | agrin | ESTs, Weakly similar to A38096 perlecan precursor [*H. sapiens*], ESTs, Weakly similar to AGRT agrin - rat [*R. norvegicus*], ESTs, Weakly similar to BASEMENT MEMBRANE-SPECIFIC HEPARAN SULFATE PROTEOGLYCAN CORE PROTEIN PRECURSOR [*M. musculus*], ESTs, Weakly similar to PGBM_HUMAN BASEMENT MEMBRANE-SPECIFIC HEPARAN SULFATE PROTEOGLYCAN CORE PROTEIN PRECURSOR [*H. sapiens*], *Mus musculus*, clone IMAGE:3494258, mRNA, partial cds, heparan sulfate proteoglycan 2 (perlecan), perlecan (heparan sulfate proteoglycan 2), serine protease inhibitor, Kazal type, 5, sialoadhesin, transmembrane protein with EGF-like and two follistatin-like domains 1 |
| 3028 | 10744 | M64780 | l, p, z, General, ii, nn, rr | agrin | ESTs, Weakly similar to A38096 perlecan precursor [*H. sapiens*], ESTs, Weakly similar to AGRT agrin - rat [*R. norvegicus*], ESTs, Weakly similar to BASEMENT MEMBRANE-SPECIFIC HEPARAN SULFATE PROTEOGLYCAN CORE PROTEIN PRECURSOR [*M. musculus*], ESTs, Weakly similar to PGBM_HUMAN BASEMENT MEMBRANE-SPECIFIC HEPARAN SULFATE PROTEOGLYCAN CORE PROTEIN PRECURSOR [*H. sapiens*], *Mus musculus*, clone IMAGE:3494258, mRNA, partial cds, heparan sulfate proteoglycan 2 (perlecan), perlecan (heparan sulfate proteoglycan 2), serine protease inhibitor, Kazal type, 5, sialoadhesin, transmembrane protein with EGF-like and two follistatin-like domains 1 |
| 3524 | 23424 | NM_021680 | x, z | alanyl-tRNA synthetase | alanyl-tRNA synthetase |
| 445 | 17111 | AA860062 | ee | albumin, albumin 1 | ESTs, Moderately similar to ALBU_RAT Serum albumin precursor [Contains: Neurotensin-related peptide (NRP)] [*R. norvepicus*], albumin, albumin 1 |
| 4206 | 17112 | NM_134326 | ee | albumin albumin 1 glutathione peroxidase 1 | ESTs, Moderately similar to ALBU_RAT Serum albumin precursor [Contains: Neurotensin-related peptide (NRP)] [*R. norvegicus*], ESTs, Weakly similar to GSHC_RAT Glutathione peroxidase (GSHPX-1) (Cellular glutathione peroxidase) [*R. norvegicus*], albumin, albumin 1, glutathione peroxidase 1, glutathione peroxidase 2, glutathione peroxidase 2 (gastrointestinal) |
| 3477 | 22219 | NM_019286 | c, vv | alcohol dehydrogenase 1, complex, alcohol dehydrogenase 1A (class I), alpha polypeptide | ESTs, Weakly similar to ADHA MOUSE ALCOHOL DEHYDROGENASE A CHAIN [*M. musculus*], alcohol dehydrogenase 1, complex, alcohol dehydrogenase 1A (class I), alpha polypeptide, alcohol dehydrogenase 1B (class I), beta polypeptide |
| 4159 | 22220 | NM_130780 | vv | alcohol dehydrogenase 1, complex, alcohol dehydrogenase 1A (class I), alpha polypeptide | ESTs, Weakly similar to ADHA MOUSE ALCOHOL DEHYDROGENASE A CHAIN [*M. musculus*], alcohol dehydrogenase 1, complex, alcohol dehydrogenase 1A (class I), alpha polypeptide, alcohol dehydrogenase 1B (class I), beta polypeptide |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3570 | 20915 | NM_022407 | b, ff | aldehyde dehydrogenase 1 family, member A1, aldehyde dehydrogenase family 1, subfamily A1 | *Mus musculus*, Similar to aldehyde dehydrogenase 8 family, member A1, clone IMAGE:4234742, mRNA, partial cds, aldehyde dehydrogenase 1 family, member A1, aldehyde dehydrogenase family 1, subfamily A1 |
| 3934 | 12299 | NM_032416 | a, General | aldehyde dehydrogenase 2 family (mitochondrial), aldehyde dehydrogenase 2, mitochondrial | ESTs, Moderately similar to DHAM_RAT ALDEHYDE DEHYDROGENASE, MITOCHONDRIAL PRECURSOR (ALDH CLASS 2) (ALDH1) (ALDH-E2) [*R. norvegicus*], RIKEN cDNA 241 0004H02 gene, aldehyde dehydrogenase 1 family, member B1, aldehyde dehydrogenase 2 family (mitochondrial), aldehyde dehydrogenase 2, mitochondrial |
| 3873 | 23883 | NM_031731 | n, General, ee | aldehyde dehydrogenase 3 family, member A2, aldehyde dehydrogenase family 3, subfamily A2 | RIKEN cDNA 1700001N19 gene, RIKEN cDNA 1700055N04 gene, aldehyde dehydrogenase 3 family, member A2, aldehyde dehydrogenase family 3, subfamily A2, expressed sequence AI848594 |
| 3873 | 23884 | NM_031731 | ii | aldehyde dehydrogenase 3 family, member A2, aldehyde dehydrogenase family 3, subfamily A2 | RIKEN cDNA 1700001N19 gene, RIKEN cDNA 1700055N04 gene, aldehyde dehydrogenase 3 family, member A2, aldehyde dehydrogenase family 3, subfamily A2, expressed sequence AI848594 |
| 166 | 11901 | AA801058 | l, nn | aldehyde dehydrogenase 9 family, member A1, aldehyde dehydrogenase 9, subfamily A1 | *Mus musculus*, Similar to aldehyde dehydrogenase 4 family, member A1, clone IMAGE:5102023, mRNA, partial cds, RIKEN cDNA 1110038I05 gene, aldehyde dehydrogenase 4 family, member A1, aldehyde dehydrogenase 9 family, member A1, aldehyde dehydrogenase 9, subfamily A1 |
| 3048 | 7062 | NM_012495 | t, bb, mm | aldolase 1, A isoform, aldolase A, fructose-bisphosphate | EST, Moderately similar to ADHUA fructose-bisphosphate aldolase [*H. sapiens*], EST, Weakly similar to ADHUA fructose-bisphosphate aldolase [*H. sapiens*], ESTs, Highly similar to 139435 fructose-bisphosphate aldolase [*H. sapiens*], ESTs, Moderately similar to aldolase A [*M. musculus*], ESTs, Weakly similar to ALFA_HUMAN FRUCTOSE-BISPHOSPHATE ALDOLASE A [*H. sapiens*], *Mus musculus*, clone MGC:25455 IMAGE:4241 025, mRNA, complete cds, RIKEN cDNA 4933425L11 gene, aldolase 1, A isoform, aldolase 3, C isoform, aldolase A, fructose bisphosphate |
| 3048 | 7064 | NM_012495 | s | aldolase 1, A isoform, aldolase A, fructose-bisphosphate | EST, Moderately similar to ADHUA fructose-bisphosphate aldolase [*H. sapiens*], EST, Weakly similar to ADHUA fructose-bisphosphate aldolase [*H. sapiens*], ESTs, Highly similar to 139435 fructose-bisphosphate aldolase [*H. sapiens*], ESTs, Moderately similar to aldolase A [*M. musculus*], ESTs, Weakly similar to ALFA_HUMAN FRUCTOSE-BISPHOSPHATE ALDOLASE A [*H. sapiens*], *Mus musculus*, clone MGC:25455 IMAGE:4241025, mRNA, complete cds, RIKEN cDNA 4933425L11 gene, aldolase 1, A isoform, aldolase 3, C isoform, aldolase A, fructose-bisphosphate |
| 624 | 820 | AA892395 | a, s, ss, uu | aldolase 2, B isoform, aldolase B, fructose-bisphosphate | *Mus musculus*, clone MGC:25455 IMAGE:4241025, mRNA, complete cds, aldolase 1, A isoform, aldolase 3, C isoform, aldolase B, fructose-bisphosphate |
| 4404 | 818 | X02291 | a, s, ff, qq, tt, uu | aldolase 2, B isoform aldolase B, fructose bisphosphate | *Mus musculus*, clone MGC:25455 IMAGE:4241025, mRNA, complete cds, aldolase 1, A isoform, aldolase 3, C isoform, aldolase B, fructose-bisphosphate |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3049 | 1655 | NM_012497 | n | aldolase 3, C isoform aldolase C, fructose-bisphosphate | Mus musculus, clone MGC:25455 IMAGE:4241025, mRNA, complete cds, aldolase 1, A isoform, aldolase 3, C isoform, aldolase C, fructose-bisphosphate |
| 1202 | 16625 | M998062 | j | Alg5, S. cerevisiae, homolog of | Alg5, S. cerevisiae, homolog of |
| 3173 | 7897 | NM_012901 | u | alpha 1 microglobulin/bikunin, alpha-1-microglobulin/bikunin precursor | RIKEN cDNA 1700013L23 gene, WAP, FS, Ig, KU, and NTR-containing protein, alpha 1 microglobulin/bikunin, alpha-1-microglobulin/bikunin precursor, complement component 8, gamma polypeptide, serine protease inhibitor, Kunitz type 2 |
| 3173 | 7898 | NM_012901 | e, r | alpha 1 microglobulin/bikunin, alpha-1-microglobulin/bikunin precursor | RIKEN cDNA 1700013L23 gene, WAP, FS, Ig, KU, and NTR-containing protein, alpha 1 microglobulin/bikunin, alpha-1-microglobulin/bikunin precursor, complement component 8, gamma polypeptide, serine protease inhibitor, Kunitz type 2 |
| 3173 | 7899 | NM_012901 | e | alpha 1 microglobulin/bikunin, alpha-1-microglobulin/bikunin precursor | RIKEN cDNA 1700013L23 gene, WAP, FS, Ig, KU, and NTR-containing protein, alpha 1 microglobulin/bikunin, alpha-1-microglobulin/bikunin precursor, complement component 8, gamma polypeptide, serine protease inhibitor, Kunitz type 2 |
| 3151 | 20586 | NM_012826 | a, m, vv | alpha-2-glycoprotein 1, zinc | UL16 binding protein 1, UL16 binding protein 2, alpha-2-glycoprotein 1, zinc |
| 3151 | 20587 | NM_012826 | v, vv | alpha-2-glycoprotein 1, zinc | UL16 binding protein 1, UL16 binding protein 2, alpha-2-glycoprotein 1, zinc |
| 3171 | 16273 | NM_012898 | k | alpha-2-HS-glycoprotein | alpha-2-HS-glycoprotein |
| 3171 | 16274 | NM_012898 | r | alpha-2-HS-glycoprotein | alpha-2-HS-glycoprotein |
| 3171 | 16275 | NM_012898 | r, ee | alpha-2-HS-glycoprotein | alpha-2-HS-glycoprotein |
| 3045 | 22513 | NM_012488 | nn | alpha-2-macroglobulin | ESTs, Highly similar to A2MG_RAT ALPHA-2-MACROGLOBULIN PRECURSOR (ALPHA-2-M) [R. norvegicus], ESTs, Weakly similar to A2MG MOUSE ALPHA-2-MACROGLOBULIN PRECURSOR [M. musculus], alpha-2-macroglobulin, murinoglobulin 1, pregnancy-zone protein |
| 3147 | 15032 | NM_012816 | t | alpha-methylacyl CoA racemase | alpha-methylacyl-CoA racemase, cDNA sequence AF397014, chromosome 7 open reading frame 10 |
| 4324 | 1937 | R46934 | k | amelogenin amelogenin (X chromosome, amelogenesis imperfecta 1) | |
| 4389 | 25083 | U72632 | nn | amine oxidase, copper containing 3, amine oxidase, copper containing 3 (vascular adhesion protein 1) | |
| 3172 | 18564 | NM_012899 | k, w | aminolevulinate, delta-, dehydratase | aminolevulinate, delta-, dehydratase |
| 3686 | 21039 | NM_024484 | ii | aminolevulinate, delta-, synthase 1, aminolevulinic acid synthase 1 | aminolevulinate, delta-, synthase 1, aminolevulinic acid synthase 1, aminolevulinic acid synthase 2, erythroid, serine palmitoyltransferase, long chain base subunit 1, serine palmitoyltransferase, long chain base subunit 2 |
| 3452 | 2078 | NM_019220 | p, s, pp | amino-terminal enhancer of split | amino-terminal enhancer of split |
| 3452 | 2079 | NM_019220 | z | amino-terminal enhancer of split | amino-terminal enhancer of split |
| 3808 | 1504 | NM_031544 | a, l, General, uu | AMP deaminase 3, adenosine monophosphate deaminase (isoform E) | AMP deaminase 3, RIKEN cDNA 1200014F01 gene, adenosine monophosphate deaminase (isoform E), expressed sequence AI553520 |
| 3795 | 24645 | NM_031502 | a, d, k, l, dd, uu | amylase 1, salivary, amylase, alpha 1A; salivary | ESTs, Moderately similar to AMYP_HUMAN ALPHA-AMYLASE, PANCREATIC PRECURSOR [H. sapiens], amylase 1, salivary, amylase 2, pancreatic, amylase, alpha 1A; salivary, amylase, alpha 2A; pancreatic |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 250 | 10157 | AA819527 | rr | amyloid beta (A4) precursor protein (protease nexin-II, Alzheimer disease) | ESTs, Highly similar to I39451 amyloid-beta protein [*H. sapiens*], ESTs, Weakly similar to S23094 beta-amyloid protein precursor - rat [*R. norvegicus*], amyloid beta (A4) precursor protein (protease nexin-II, Alzheimer disease) |
| 2352 | 10156 | AI178039 | bb | amyloid beta (A4) precursor protein (protease nexin-II, Alzheimer disease) | ESTs, Highly similar to I39451 amyloid-beta protein [*H. sapiens*], ESTs, Weakly similar to S23094 beta-amyloid protein precursor - rat [*R. norvegicus*], amyloid beta (A4) precursor protein (protease nexin-II, Alzheimer disease) |
| 4410 | 10154 | X07648 | m | amyloid beta (A4) precursor protein (protease nexin-II, Alzheimer disease) | ESTs, Highly similar to I39451 amyloid-beta protein [*H. sapiens*], ESTs, Weakly similar to S23094 beta-amyloid protein precursor - rat [*R. norvegicus*], amyloid beta (A4) precursor protein (protease nexin-II, Alzheimer disease) |
| 4387 | 11 | U70210 | g | amyloid beta (A4) precursor protein-binding, family B, member 2 (Fe65-like) | *Homo sapiens* cDNA: FLJ21218 fis, clone COL00537, *Mus musculus*, Similar to amyloid beta (A4) precursor protein-binding, family B, member 3, clone MGC:38710 IMAGE:5357681, mRNA, complete cds, amyloid beta (A4) precursor protein-binding, family B, member 1, amyloid beta (A4) precursor protein-binding, family B, member 1 (Fe65), amyloid beta (A4) precursor protein-binding, family B, member 2 (Fe65-like), amyloid beta (A4) precursor protein-binding, family B, member 3 |
| 4463 | 11260 | X77934 | t, mm | amyloid beta (A4) precursor-like protein 2 | ESTs, Weakly similar to 2019243A amyloid precursor-like protein 2 [*Rattus norvegicus*] [*R. norvegicus*], ESTs, Weakly similar to EPPI_MOUSE Eppin precursor [*M. musculus*], amyloid beta (A4) precursor-like protein 1, amyloid beta (A4) precursor-like protein 2 |
| 3349 | 8182 | NM_017170 | a, bb | amyloid P component, serum, serum amyloid P-component | EST, Weakly similar to S11473 serum amyloid P-component - rat [*R. norvegicus*], EST, Weakly similar to SAMP MOUSE SERUM AMYLOID P-COMPONENT PRECURSOR [*M. musculus*], ESTs, Weakly similar to SAMP_HUMAN SERUM AMYLOID P-COMPONENT PRECURSOR [*H. sapiens*], amyloid P component, serum |
| 3066 | 225 | NM_012544 | j | angiotensin I converting enzyme (peptidyl-dipeptidase A) 1, angiotensin converting enzyme | ESTs, Highly similar to A31759 peptidyl-dipeptidase A [*H. sapiens*], RIKEN cDNA 2010305L05 gene, angiotensin I converting enzyme (peptidyl-dipeptidase A) 1, angiotensin converting enzyme |
| 3047 | 265 | NM_012494 | gg, hh, jj | angiotensin II receptor, type 2, angiotensin receptor 2 | angiotensin II receptor, type 2, angiotensin receptor 2 |
| 2985 | 21097 | M12112 | s | angiotensinogen, angiotensinogen (serine (or cysteine) proteinase inhibitor, clade A (alpha-1 antiproteinase, antitrypsin), member 8) | angiotensinogen, angiotensinogen (serine (or cysteine) proteinase inhibitor, clade A (alpha-1 antiproteinase, antitrypsin), member 8) |
| 4222 | 21098 | NM_134432 | qq | angiotensinogen, angiotensinogen (serine (or cysteine) proteinase inhibitor, clade A (alpha-1 antiproteinase, antitrypsin), member 8) | angiotensinogen, angiotensinogen (serine (or cysteine) proteinase inhibitor, clade A (alpha-1 antiproteinase, antitrypsin), member 8) |
| 2348 | 15315 | AI177911 | x | annexin A2 | annexin A2, annexin A9 |
| 3507 | 574 | NM_019905 | m | annexin A2, hydroxyacid oxidase (glycolate oxidase) 3, hydroxyacid oxidase 3 (medium-chain) | EST, Moderately similar to 0806162C protein COI [*M. musculus*], EST, Moderately similar to 810024C cytochrome oxidase I [*H. sapiens*], EST, Weakly similar to 0806162C protein COI [*M. musculus*], ESTs, Highly similar to hydroxyacid oxidase 3 (medium-chain) [*Rattus norvegicus*] [*R. norvegicus*], ESTs, Moderately similar to 0806162C protein COI [*M. musculus*], ESTs, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | Moderately similar to 810024C cytochrome oxidase I [*H. sapiens*], ESTs, Weakly similar to 08061620 protein COI [*M. musculus*], annexin A2, annexin A9, hydroxyacid oxidase (glycolate oxidase) 3, hydroxyacid oxidase 1, liver |
| 3661 | 561 | NM_024156 | nn | annexin A6 | annexin A6 |
| 3703 | 248 | NM_030998 | gg, hh | anti-Mullerian hormone receptor, type II, anti-Mullerian hormone type 2 receptor | |
| 4002 | 19252 | NM_053576 | x | anti-oxidant protein 2 (non-selenium glutathione peroxidase, acidic calcium-independent phospholipase A2), peroxiredoxin 5 | ESTs, Moderately similar to AOP2 MOUSE ANTIOXIDANT PROTEIN 2 [*M. musculus*], ESTs, Moderately similar to AOP2_HUMAN ANTIOXIDANT PROTEIN 2 [*H. sapiens*], anti oxidant protein 2 (non-selenium glutathione peroxidase, acidic calcium-independent phospholipase A2), peroxiredoxin 5 |
| 3834 | 12132 | NM_031612 | ss | apelin, apelin; peptide ligand for APJ receptor | apelin, apelin; peptide ligand for APJ receptor |
| 3657 | 20801 | NM_024148 | m, cc, oo, uu, ww | APEX nuclease (multifunctional DNA repair enzyme), apurinic/apyrimidinic endonuclease | APEX nuclease (multifunctional DNA repair enzyme), *Mus musculus* ape2 mRNA for AP endonuclease 2, complete cds, apurinic/apyrimidinic endonuclease |
| 3130 | 426 | NM_012738 | l, General, cc, nn, vv | apolipoprotein A-I | ESTs, Weakly similar to apolipoprotein A-I [*Rattus norvegicus*] [*R. norvegicus*], apolipoprotein A-I |
| 3130 | 427 | NM_012738 | f, l, x, General, nn, vv | apolipoprotein A-I | ESTs, Weakly similar to apolipoprotein A-I [*Rattus norvegicus*] [*R. norvegicus*], apolipoprotein A-I |
| 3129 | 5317 | NM_012737 | d, p, w, ee, mm | apolipoprotein A-IV | |
| 3174 | 23 | NM_012907 | ii | apolipoprotein B editing complex 1, apolipoprotein B mRNA editing enzyme catalytic polypeptide 1 | ESTs, Weakly similar to 159577 apolipoprotein B mRNA editing enzyme, catalytic chain 1 (EC 3.5.4.-) - rat [*R. norvegicus*], activation-induced cytidine deaminase, apolipoprotein B editing complex 1, apolipoprotein B editing complex 2, apolipoprotein B mRNA editing enzyme, catalytic polypeptide 1, hypothetical protein, MGC:7002, phorbolin (similar to apolipoprotein B mRNA editing protein) |
| 3007 | 16930 | M27440 | h, o, ss, vv | apolipoprotein B, apolipoprotein B (including Ag(x) antigen) | ESTs, Highly similar to 1207169A lipoprotein B [*H. sapiens*], apolipoprotein B (including Ag(x) antigen), expressed sequence AI315052 |
| 3051 | 17787 | NM_012501 | ee | apolipoprotein C-III | apolipoprotein C-III, apolipoprotein CIII |
| 4241 | 16400 | NM_138828 | m, x | apolipoprotein E | apolipoprotein E |
| 3437 | 21090 | NM_019158 | General, dd, ff, nn | aquaporin 8 | aquaporin 8 |
| 3642 | 15755 | NM_022960 | k | aquaporin 9 | |
| 3330 | 24693 | NM_017134 | a, b, l, General, cc | arginase 1, liver, arginase, liver | arginase 1, liver, arginase, liver |
| 3285 | 24868 | NM_016992 | nn | arginine vasopressin, arginine vasopressin (neurophysin II, antidiuretic hormone, diabetes insipidus, neurohypophyseal) | arginine vasopressin, arginine vasopressin (neurophysin II, antidiuretic hormone, diabetes insipidus, neurohypophyseal) |
| 3285 | 24869 | NM_016992 | g | arginine vasopressin, arginine vasopressin (neurophysin II, antidiuretic hormone, diabetes diabetes insipidus, neurohypophyseal) | arginine vasopressin, arginine vasopressin (neurophysin II, antidiuretic hormone, diabetes insipidus, neurohypophyseal) |
| 4412 | 20597 | X12459 | b, ff | argininosuccinate synthetase, argininosuccinate synthetase 1 | argininosuccinate synthetase, argininosuccinate synthetase 1, expressed sequence AA408052 |
| 1251 | 4307 | AB012600 | s | aryl hydrocarbon receptor nuclear translocator-like | Aryl hydrocarbon receptor nuclear translocator 1, Aryl hydrocarbon receptor nuclear translocator 2, ESTs, Highly similar to aryl hydrocarbon receptor nuclear translocator-like [*Mus musculus*] [*M. musculus*], *Mus musculus* brain-muscle-ARNT-like protein 2b mRNA, complete cds; alternatively spliced, aryl hydrocarbon receptor nuclear translocator, aryl |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1259 | 4308 | AF015953 | ww | aryl hydrocarbon receptor nuclear translocator-like | hydrocarbon receptor nuclear translocator 2, aryl hydrocarbon receptor nuclear translocator-like Aryl hydrocarbon receptor nuclear translocator 1, Aryl hydrocarbon receptor nuclear translocator 2, ESTs, Highly similar to aryl hydrocarbon receptor nuclear translocator-like [*Mus musculus*] [*M. musculus*], *Mus musculus* brain-muscle-ARNT-like protein 2b mRNA, complete cds; alternatively spliced, aryl hydrocarbon receptor nuclear translocator, aryl hydrocarbon receptor nuclear translocator 2, aryl hydrocarbon receptor nuclear |
| 3148 | 326 | NM_012818 | ss | arylalkylamine N-acetyltransferase | arylalkylamine N-acetyltransferase |
| 2897 | 935 | D49434 | bb, ww | arylsulfatase B | ESTs, Highly similar to [Segment 2 of 2] ARYLSULFATASE B [*M. musculus*], ESTs, Weakly similar to ARSB RAT ARYLSULFATASE B [*R. norvegicus*], *Mus musculus*, clone IMAGE:3991175, mRNA, partial cds, RIKEN cDNA 1110007C02 gene, arylsulfatase B, hypothetical protein FLJ23548 |
| 3052 | 20153 | NM_012503 | b, g, v | asialoglycoprotein receptor 1 | C-type (calcium dependent, carbohydrate recognition domain) lectin, superfamily member 9, C-type (calcium dependent, carbohydrate-recognition domain) lectin, superfamily member 11, ESTs, Weakly similar to LECH_RAT ASIALOGLYCOPROTEIN RECEPTOR 1 (HEPATIC LECTIN 1) (RHL-1) (ASGP-R) (ASGPR) [*R. norvegicus*], asialoglycoprotein receptor 1, macrophage lectin 2 (calcium dependent) |
| 3356 | 24670 | NM_017189 | a, n | asialoglycoprotein receptor 2 | C-type (calcium dependent, carbohydrate-recognition domain) lectin, superfamily member 6, C-type (calcium dependent, carbohydrate-recognition domain) lectin, superfamily member 7, C-type lectin related f, RIKEN cDNA 1810029C22 gene, asialoglycoprotein receptor 2 |
| 3233 | 1583 | NM_013079 | a, m, s, General, dd | asparagine synthetase | |
| 3283 | 15612 | NM_016987 | ee | ATP citrate lyase | ATP citrate lyase, EST, Moderately similar to SUCA_MOUSE SUCCINYL-COA LIGASE [GDP-FORMING] ALPHA-CHAIN, MITOCHONDRIAL PRECURSOR (SUCCINYL-COA SYNTHETASE, ALPHA CHAIN) (SCS-ALPHA) [*M. musculus*], expressed sequence AW538652, succinate-CoA ligase, GDP-forming, alpha subunit |
| 3283 | 15613 | NM_016987 | ii, ll, ww | ATP citrate lyase | ATP citrate lyase, EST, Moderately similar to SUCA_MOUSE SUCCINYL-COA LIGASE [GDP-FORMING] ALPHA-CHAIN, MITOCHONDRIAL PRECURSOR (SUCCINYL-COA SYNTHETASE, ALPHA CHAIN) (SCS-ALPHA) [*M. musculus*], expressed sequence AW538652, succinate-CoA ligase, GDP-forming, alpha subunit |
| 3406 | 16844 | NM_017311 | r | ATP synthase, H+ transporting, mitochondrial F0 complex, subunit c (subunit 9), isoform 1 | ATP synthase, H+ transporting, mitochondrial F0 complex, subunit c (subunit 9), isoform 1, ESTs, Highly similar to AT91_HUMAN ATP SYNTHASE LIPID-BINDING PROTEIN P1 PRECURSOR [*H. sapiens*], *Homo sapiens* cDNA: FLJ23586 fis, clone LNG14376 |
| 4271 | 17203 | NM_139099 | pp | ATP synthase, H+ transporting, mitochondrial F1 complex, epsilon subunit | ATP synthase, H+ transporting, mitochondrial F1 complex, epsilon subunit, RIKEN cDNA 2410043G19 gene, expressed sequence AV000645 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4271 | 17204 | NM_139099 | p, x, mm | ATP synthase, H+ transporting, mitochondrial F1 complex, epsilon subunit | ATP synthase, H+ transporting, mitochondrial F1 complex, epsilon subunit, RIKEN cDNA 2410043G19 gene, expressed sequence AV000645 |
| 3398 | 12347 | NM_017290 | jj | ATPase, Ca++ transporting, cardiac muscle, slow twitch 2 | |
| 3398 | 12348 | NM_017290 | ff, pp | ATPase, Ca++ transporting, cardiac muscle, slow twitch 2 | |
| 3398 | 12349 | NM_017290 | l | ATPase, Ca++ transporting, cardiac muscle, slow twitch 2 | |
| 3043 | 17991 | M96626 | g | ATPase, Ca++ transporting, plasma membrane 3 | ATPase, Ca++ transporting, plasma membrane 2, ATPase, Class V, type 10C, ATPase, class V, type 10A, ESTs, Highly similar to A34308 Ca2+-transporting ATPase [*R. norvegicus*], ESTs, Weakly similar to I49143 gastric H(+)-K(+)-ATPase alpha subunit - mouse [*M. musculus*], RIKEN cDNA 1110019I14 gene, RIKEN cDNA 2810442I22 gene |
| 3177 | 24783 | NM_012914 | p | ATPase, Ca++ transporting, ubiquitous | ATPase, Ca++ transporting, ubiquitous |
| 4396 | 1359 | U78977 | mm | ATPase, Class II, type 9A, ATPase, class II, type 9A | ATPase, Class II, type 9A, EST, Highly similar to AT2A_HUMAN POTENTIAL PHOSPHOLIPID-TRANSPORTING ATPASE IIA [*H. sapiens*], ESTs, Moderately similar to AT2A_HUMAN POTENTIAL PHOSPHOLIPID-TRANSPORTING ATPASE IIA [*H. sapiens*], ESTs, Weakly similar to AT2A_HUMAN POTENTIAL PHOSPHOLIPID-TRANSPORTING ATPASE IIA [*H. sapiens*], *Homo sapiens* mRNA; cDNA DKFZp586I0624 (from clone DKFZp586I0624) |
| 82 | 16346 | AA799824 | a, e, f, s, General, kk, oo | ATPase, H+ transporting, lysosomal 42 kD, V1 subunit C, isoform 1 | ATPase, H+ transporting, lysosomal 42 kD, V1 subunit C, isoform 1, RIKEN cDNA 1110038G14 gene |
| 913 | 10569 | AA942681 | n, z, General | ATPase, H+ transporting, lysosomal 50/57 kD V1 subunit H | ATPase, H+ transporting, lysosomal 50/57 kD V1 subunit H |
| 3053 | 15675 | NM_012504 | General | ATPase, Na+/K+ transporting, alpha 1 polypeptide | ATPase, Na+/K+ transporting, alpha 1 polypeptide, ATPase, Na+/K+ transporting, alpha 4 polypeptide, *Mus musculus*, Similar to ATPase, Na+/K+ transporting, alpha 1a.1 polypeptide, clone IMAGE:3599053, mRNA, partial cds |
| 3053 | 15677 | NM_012504 | General, mm | ATPase, Na+/K+ transporting, alpha 1 polypeptide | ATPase, Na+/K+ transporting, alpha 1 polypeptide, ATPase, Na+/K+ transporting, alpha 4 polypeptide, *Mus musculus*, Similar to ATPase, Na+/K+ transporting, alpha 1a.1 polypeptide, clone IMAGE:3599053, mRNA, partial cds |
| 3054 | 855 | NM_012507 | ll | ATPase, Na+/K+ transporting, beta 2 polypeptide | ATPase, Na+/K+ transporting, beta 2 polypeptide |
| 3176 | 20590 | NM_012913 | n, kk | ATPase, Na+/K+ transporting, beta 3 polypeptide | ATPase, Na+/K+ transporting, beta 3 polypeptide, ESTs, Highly similar to ATND_HUMAN SODIUM/POTASSIUM-TRANSPORTING ATPASE BETA-3 CHAIN [*H. sapiens*], expressed sequence AI664000 |
| 3112 | 24453 | NM_012690 | a, s | ATP-binding cassette, sub-family B (MDR/TAP), member 1A, ATP-binding cassette, sub-family B (MDR1TAP), member 4 | ATP-binding cassette, sub-family B (MDR/TAP), member 4, ESTs, Highly similar to MDR3_HUMAN MULTIDRUG RESISTANCE PROTEIN 3 [*H. sapiens*], ESTs, Weakly similar to 854774 ATP binding cassette transporter ABC2 - human [*M. musculus*], *Mus musculus* 10,11 days embryo whole body cDNA, RIKEN full-length enriched library, clone:2810428N17:ATP-binding cassette, sub-family B (MDR/TAP), member 10, full insert sequence |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4434 | 1037 | X57523 | a, qq | ATP-binding cassette, sub-family B (MDR/TAP), member 2, transporter 1, ATP-binding cassette, sub-family B (MDR/TAP) | ATP-binding cassette, sub-family B (MDR/TAP), member 2, ESTs, Highly similar to S13426 multidrug resistance protein homolog - rat [*R. norvegicus*], transporter 1, ATP-binding cassette, sub-family B (MDR/TAP) |
| 3712 | 15700 | NM_031013 | k | ATP-binding cassette, sub-family C (CFTR/MRP), member 6 | ATP-binding cassette, sub-family C (CFTR/MRP), member 6 |
| 3219 | 730 | NM_013040 | cc | ATP-binding cassette, sub-family C (CFTR/MRP), member 9 | ATP-binding cassette, sub-family C (CFTR/MRP), member 9, ESTs, Weakly similar to T42751 sulfonylurea receptor 2 - rat [*R. norvegicus*], *Homo sapiens* cDNA FLJ31957 fis, clone NT2RP7007381, highly similar to Sulfonylurea receptor 2A, *Mus musculus* adult male pituitary gland cDNA, RIKEN full-length enriched library, clone:5330439B14:ATP-binding cassette, sub-family C (CFTR/MRP), member 9, full insert sequence |
| 3146 | 21729 | NM_012804 | o, ff | ATP-binding cassette, sub-family D (ALD), member 3 | ATP-binding cassette, sub-family D (ALD), member 3, ATP-binding cassette, sub-family D (ALD), member 4, ESTs, Weakly similar to A35723 70K peroxisomal membrane protein - rat [*R. norvegicus*] |
| 3146 | 21730 | NM_012804 | o, v | ATP-binding cassette, sub-family D (ALD), member 3 | ATP-binding cassette, sub-family D (ALD), member 3, ATP-binding cassette, sub-family D (ALD), member 4, ESTs, Weakly similar to A35723 70K peroxisomal membrane protein - rat [*R. norvegicus*] |
| 252 | 6288 | AA819554 | ww | BAl1-associated protein 2, brain-specific angiogenesis inhibitor 1-associated protein 2 | BAl1-associated protein 2, ESTs, Weakly similar to brain-specific angiogenesis inhibitor 1-associated protein 2 [*Mus musculus*] [*M. musculus*], *Mus musculus*, Similar to K1AA0429 gene product, clone IMAGE:2811240, mRNA, partial cds, RIKEN cDNA 1300006M19 gene, brain-specific angiogenesis inhibitor 1-associated protein 2, hypothetical protein FLJ22582, insulin receptor tyrosine kinase substrate |
| 3958 | 1063 | NM_053328 | p, t, ff | basic helix-loop-helix domain containing, class B, 2, basic helix-loop-helix domain containing, class B2 | basic helix-loop-helix domain containing, class B, 2, basic helix-loop-helix domain containing, class B, 3, basic helix-loop-helix domain containing, class B2, basic helix-loop-helix domain containing, class B3 |
| 3139 | 11938 | NM_012783 | x | basigin, basigin (OK blood group) | ESTs, Weakly similar to A46506 leukocyte activation antigen M6 [*H. sapiens*], *Mus musculus*, Similar to spindle pole body protein, clone IMAGE:5324982, mRNA, partial cds, basigin, basigin (OK blood group), spindle pole body protein |
| 3286 | 24897 | NM_016993 | pp | B-cell CLL/lymphoma 2, B-cell leukemia/lymphoma 2 | |
| 3383 | 19 | NM_017258 | s, ss, tt | B-cell translocation gene 1, anti-proliferative | B-cell translocation gene 1, anti-proliferative, *Homo sapiens* cDNA FLJ30547 fis, clone BRAWH2001439, transducer of ERBB2, 1, transducer of ERBB2, 2, transducer of ErbB-2.1 |
| 3384 | 15300 | NM_017259 | n, p, rr | B-cell translocation gene 2, anti-proliferative, BTG family, member 2 | B-cell translocation gene 2, anti-proliferative, B-cell translocation gene 4, BTG family, member 2, ESTs, Highly similar to BTG2_HUMAN BTG2 PROTEIN PRECURSOR [*H. sapiens*] |
| 3384 | 15301 | NM_017259 | n, p, ss, tt | B-cell translocation gene 2, anti-proliferative, BTG family, member 2 | B-cell translocation gene 2, anti-proliferative, B-cell translocation gene 4, BTG family, member 2, ESTs, Highly similar to BTG2_HUMAN BTG2 PROTEIN PRECURSOR [*H. sapiens*] |
| 3384 | 15299 | NM_017259 | p | B-cell translocation gene 2, anti-proliferative, BTG family, member 2 | B-cell translocation gene 2, anti-proliferative, B-cell translocation gene 4, BTG family, member 2, ESTs, Highly similar to BTG2_HUMAN BTG2 PROTEIN PRECURSOR [*H. sapiens*] |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3306 | 910 | NM_017059 | bb, ss | BCL2-associated X protein, Bcl2-associated X protein | |
| 3306 | 911 | NM_017059 | ss | BCL2-associated X protein, Bcl2-associated X protein | |
| 3306 | 912 | NM_017059 | qq | BCL2-associated X protein, Bcl2-associated X protein | |
| 3056 | 7427 | NM_012515 | ll | benzodiazapine receptor (peripheral) benzodiazepine receptor, peripheral | ESTs, Weakly similar to 138724 mitochondrial benzodiazepine receptor [*H. sapiens*], benzodiazapine receptor (peripheral), benzodiazepine receptor, peripheral |
| 3465 | 1450 | NM_019251 | x | BET1 homolog (*S. cerevisiae*), blocked early in transport 1 homolog (*S. cerevisiae*) | BET1 homolog (*S. cerevisiae*), blocked early in transport 1 homolog (*S. cerevisiae*) |
| 3294 | 17815 | NM_017015 | p, r, w, z | beta-glucuronidase, glucuronidase, beta | ESTs, Highly similar to A26581 beta-glucuronidase [*H. sapiens*], SMA3, beta-glucuronidase structural, glucuronidase, beta |
| 3401 | 1531 | NM_017300 | General, ff, rr, uu | bile acid Coenzyme A: amino acid N-acyltransferase (glycine N-choloyltransferase), bile acid Coenzyme A: amino acid N-acyltransferase | ESTs, Weakly similar to YZ28_HUMAN HYPOTHETICAL PROTEIN ZAP128 [*H. sapiens*], *Mus musculus*, Similar to bile acid Coenzyme A: amino acid N-acyltransferase (glycine N-choloyltransferase), clone MGC: 19156 IMAGE:4220620, mRNA, complete cds, bile acid Coenzyme A: amino acid N-acyltransferase (glycine N-choloyltransferase), bile acid-Coenzyme A: amino acid N-acyltransferase, expressed sequence AI118337 |
| 3353 | 3174 | NM_017178 | qq | bone morphogenetic protein 2 | ESTs, Highly similar to BMP2_RAT Bone morphogenetic protein 2 precursor (BMP-2) (BMP-2A) [*R. norvegicus*], ESTs, Weakly similar to GDF3 MOUSE GROWTH/DIFFERENTIATION FACTOR 3 PRECURSOR [*M. musculus*], bone morphogenetic protein 2, growth differentiation factor 5 (cartilage-derived morphogenetic protein-1), nodal |
| 3274 | 397 | NM_013214 | o | brain acyl-CoA hydrolase | |
| 3274 | 20851 | NM_013214 | jj | brain acyl-CoA hydrolase | |
| 805 | 23038 | AA900881 | t, mm | branched chain aminotransferase 1, cytosolic | branched chain aminotransferase 1, cytosolic |
| 3381 | 23037 | NM_017253 | t, mm | branched chain aminotransferase 1, cytosolic | branched chain aminotransferase 1, cytosolic |
| 3786 | 3519 | NM_031334 | h, o, dd | cadherin 1, cadherin 1, type 1 E-cadherin (epithelial) | ESTs, Moderately similar to CAD1_RAT Epithelial-cadherin precursor (E-cadherin) (Uvomorulin) (Cadherin-1) [*R. norvegicus*], cadherin 1, cadherin 1 type 1, E-cadherin (epithelial), cadherin 3, cadherin 3, type 1, P-cadherin (placental), desmoglein 3 (*pemphigus vulgaris* antigen) |
| 2889 | 536 | D25290 | g | cadherin 6, cadherin 6, type 2, K-cadherin (fetal kidney) | ESTs, Weakly similar to CAD6 MOUSE CADHERIN-6 PRECURSOR [*M. musculus*], ESTs, Weakly similar to CAD8 MOUSE CADHERIN-8 PRECURSOR [*M. musculus*], ESTs, Weakly similar to CADB MOUSE CADHERIN-11 PRECURSOR [*M. musculus*], cadherin 10, cadherin 10, type 2 (T2-cadherin), cadherin 12, type 2 (N-cadherin 2), cadherin 6, cadherin 6, type 2, K-cadherin (fetal kidney), cadherin 7, cadherin 9 |
| 3924 | 18501 | NM_031984 | s, v, mm, xx | calbindin 1, (28 kD), calbindin-28K | *Mus musculus*, Similar to secretagogin, clone MGC:27615 IMAGE:4504330, mRNA, complete cds, calbindin 1, (28 kD), calbindin-28K |
| 3060 | 24865 | NM_012521 | ss | calbindin 3, (vitamin D-dependent calcium binding protein), calbindin-D9K | calbindin 3, (vitamin D-dependent calcium binding protein), calbindin-D9K |
| 3123 | 1632 | NM_012717 | d, y | calcitonin receptor-like | calcitonin receptor-like |
| 3467 | 13450 | NM_019255 | k | calcium channel, voltage-dependent, gamma subunit 1 | calcium channel, voltage-dependent, gamma subunit 1, calcium channel, voltage-dependent, gamma subunit 5, calcium |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3400 | 15819 | NM_017298 | u | calcium channel, voltage-dependent, L type, alpha 1D subunit | channel, voltage-dependent, gamma subunit 6, voltage-dependent calcium channel gamma-6 subunit<br>EST, Moderately similar to CCAD MOUSE VOLTAGE-DEPENDENT L-TYPE CALCIUM CHANNEL ALPHA-1D SUBUNIT [*M. musculus*], ESTs, Weakly similar to CCAD MOUSE VOLTAGE-DEPENDENT L-TYPE CALCIUM CHANNEL ALPHA-1D SUBUNIT [*M. musculus*], Mus musculus sperm ion channel mRNA, complete cds, RIKEN cDNA 8430418G19 gene, calcium channel, voltage-dependent, L type, alpha 1D subunit |
| 3850 | 20467 | NM_031662 | r, ee | calcium/calmodulin-dependent protein kinase kinase 1, alpha | |
| 3915 | 19190 | NM_031969 | s | calmodulin 1 calmodulin 1 (phosphorylase kinase delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| 3915 | 19193 | NM_031969 | l, dd | calmodulin 1, calmodulin 1 (phosphorylase kinase, delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| 3915 | 19195 | NM_031969 | c | calmodulin 1, calmodulin 1 (phosphorylase kinase, delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| 3915 | 19196 | NM_031969 | rr | calmodulin 1, calmodulin 1 (phosphorylase kinase, delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| 3915 | 25802 | NM_031969 | c, x | calmodulin 1, calmodulin 1 (phosphorylase kinase, delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| No. 3058 | 20518 | NM_012518 | e, nn | calmodulin 3 calmodulin 3 (phosphorylase kinase delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1 expressed sequence AI327027, expressed sequence AL024000, troponin C, fast skeletal |
| 2971 | 6963 | L18889 | ff | calnexin | |
| 3435 | 20863 | NM_019152 | g | calpain 1, calpain 1, (mu/I) large subunit | ESTs, Weakly similar to CAN1_MOUSE CALPAIN 1, LARGE [CATALYTIC] SUBUNIT (CALCIUM-ACTIVATED NEUTRAL PROTEINASE) (CANP) (MU-TYPE) [*M. musculus*], calpain 1, calpain 11, small optic lobes homolog (*Drosophila*) |
| 3852 | 23656 | NM_031673 | bb | calpain 10 | |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3325 | 21538 | NM_017116 | gg, hh | calpain 2, calpain 2, (m/II) large subunit | RIKEN cDNA 2600002E23 gene, calpain 12, calpain 2, calpain 2, (m/II) large subunit |
| 4383 | 17078 | U53859 | k, jj | calpain, small subunit 1 | EST, Moderately similar to CAN3 MOUSE CALPAIN P94, LARGE [*M. musculus*], ESTs, Weakly similar to A55143 calpain (EC 3.4.22.17) light chain - rat (fragment) [*R. norvegicus*], *Mus musculus*, Similar to grancalcin, EF-hand calcium binding protein, clone MGC:29240 IMAGE:5044040, mRNA, complete cds, RIKEN cDNA 2310005G05 gene, calpain 3, calpain, small subunit 1, expressed sequence AI323605, sorcin |
| 4383 | 17079 | U53859 | jj | calpain, small subunit 1 | EST, Moderately similar to CAN3 MOUSE CALPAIN P94, LARGE [*M. musculus*], ESTs, Weakly similar to A55143 calpain (EC 3.4.22.17) light chain - rat (fragment) [*R. norvegicus*], *Mus musculus*, Similar to grancalcin, EF-hand calcium binding protein, clone MGC:29240 IMAGE:5044040, mRNA, complete cds, RIKEN cDNA 2310005G05 gene, calpain 3, calpain, small subunit 1, expressed sequence AI323605, sorcin |
| 484 | 1190 | AA875089 | ll | calpastatin | ESTs, Moderately similar to CAL_HUMAN CALPAIN INHIBITOR [*H. sapiens*], calpastatin |
| 3954 | 1187 | NM_053295 | t | calpastatin | ESTs, Moderately similar to ICAL_HUMAN CALPAIN INHIBITOR [*H. sapiens*], calpastatin |
| 3489 | 23491 | NM_019359 | k, v | calponin 3, acidic | ESTs, Moderately similar to CALPONIN H1, SMOOTH MUSCLE [*M. musculus*], calponin 1, calponin 2, calponin 3, acidic |
| 3329 | 169 | NM_017131 | f | calsequestrin 2, calsequestrin 2 (cardiac muscle) | ESTs, Highly similar to CAQS MOUSE CALSEQUESTRIN, SKELETAL MUSCLE ISOFORM PRECURSOR [*M. musculus*], ESTs, Moderately similar to CAQC_RAT CALSEQUESTRIN, CARDIAC MUSCLE ISOFORM PRECURSOR [*R. norvegicus*], calsequestrin 1, calsequestrin 1 (fast-twitch, skeletal muscle), calsequestrin 2, calsequestrin 2 (cardiac muscle |
| 3310 | 20649 | NM_017072 | b, General, kk, vv | carbamoyl-phosphate synthetase 1, carbamoyl-phosphate synthetase 1, mitochondrial | DNA segment, Chr 1, University of California at Los Angeles 3, ESTs, Moderately similar to JQ1348 carbamoyl-phosphate synthase [*H. sapiens*], ESTs, Weakly similar to CPSM RAT CARBAMOYL-PHOSPHATE SYNTHASE [*R. norvegicus*], *Mus musculus*, Similar to Propionyl Coenzyme A carboxylase, alpha polypeptide, clone MGC:11973 IMAGE:3601148, mRNA, complete cds, carbamoyl-phosphate synthetase 1, mitochondrial, carbamoyl-phosphate synthetase 2, aspartate transcarbamylase, and dihydroorotase, pyruvate decarboxylase |
| 3310 | 20650 | NM_017072 | b, c, General, cc, kk, uu, vv | carbamoyl-phosphate synthetase 1, carbamoyl-phosphate synthetase 1, mitochondrial | DNA segment, Chr 1, University of California at Los Angeles 3, ESTs, Moderately similar to JQ1348 carbamoyl-phosphate synthase [*H. sapiens*], ESTs, Weakly similar to CPSM RAT CARBAMOYL-PHOSPHATE SYNTHASE [*R. norvegicus*], *Mus musculus*, Similar to Propionyl Coenzyme A carboxylase, alpha polypeptide, clone MGC:11973 IMAGE:3601148, mRNA, complete cds, carbamoyl-phosphate synthetase 1, mitochondrial, carbamoyl-phosphate synthetase 2, aspartate transcarbamylase, and dihydroorotase, pyruvate decarboxylase |
| 236 | 6018 | AA819140 | x | carbonic anhydrase 3, carbonic anhydrase III muscle specific | ESTs, Moderately similar to 1205233A anhydrase,carbonic [*H. sapiens*], *Mus musculus* adult male xiphoid cartilage cDNA, RIKEN full-length enriched library, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | clone:5230400J22:carbonic anhydrase 3, full insert sequence, carbonic anhydrase 1 carbonic anhydrase 3, carbonic anhydrase III, muscle specific |
| 1465 | 17065 | AI013531 | qq | carbonyl reductase 1 | ESTs, Weakly similar to S52349 carbonyl reductase (NADPH) (EC 1.1.1.184) - rat [*R. norvegicus*], RIKEN cDNA 1110001J05 gene, RIKEN cDNA A930033N07 gene, carbonyl reductase 1, carbonyl reductase 3 |
| 3441 | 17064 | NM_019170 | uu | carbonyl reductase 1 | ESTs, Weakly similar to S52349 carbonyl reductase (NADPH) (EC 1.1.1.184) - rat [*R. norvegicus*], RIKEN cDNA 1110001J05 gene, RIKEN cDNA A930033N07 gene, carbonyl reductase 1, carbonyl reductase 3 |
| 74 | 1680 | AA799792 | gg, hh | carboxyl ester lipase, carboxyl ester lipase (bile salt-stimulated lipase) | ESTs, Weakly similar to BILE-SALT-ACTIVATED LIPASE PRECURSOR [*M. musculus*], ESTs, Weakly similar to S13586 triacylglycerol lipase [*H. sapiens*], KIAA0951 protein, carboxyl ester lipase, carboxyl ester lipase (bile salt-stimulated lipase), carboxyl ester lipase-like (bile salt |
| 4166 | 20879 | NM_133295 | j | carboxylesterase 3, carboxylesterase 3 (brain) | ESTs, Weakly similar to A41010 carboxylesterase [*H. sapiens*], *Mus musculus*, Similar to carboxylesterase 2 (intestine, liver), clone MGC:18908 IMAGE:4241028, mRNA, complete cds, *Mus musculus*, clone MGC:18894 IMAGE:4239756, mRNA, complete cds, RIKEN cDNA 2310039D24 gene, T-complex expressed gene 5, carboxylesterase 1, carboxylesterase 1 (monocyte/macrophage serine esterase 1), carboxylesterase 3, carboxylesterase 3 (brain), carboxylesterase related protein, esterase 22 |
| 4018 | 3062 | NM_053617 | a, cc | carboxypeptidase B2 (plasma), carboxypeptidase B2 (plasma, carboxypeptidase U) | carboxypeptidase B2 (plasma), carboxypeptidase B2 (plasma, carboxypeptidase U) |
| 3152 | 15035 | NM_012836 | nn | carboxypeptidase D | carboxypeptidase D, carboxypeptidase M |
| 3927 | 20554 | NM_031987 | o | carnitine O-octanoyltransferase | carnitine O-octanoyltransferase |
| 3927 | 20555 | NM_031987 | o | carnitine O-octanoyltransferase | carnitine O-octanoyltransferase |
| 3813 | 15411 | NM_031559 | o, y, ff | carnitine palmitoyltransferase 1, liver, carnitine palmitoyltransferase I, liver | ESTs, Weakly similar to CPT1i MOUSE CARNITINE O-PALMITOYLTRANSFERASE I, MITOCHONDRIAL LIVER ISOFORM [*M. musculus*], carnitine palmitoyltransferase 1, liver, carnitine palmitoyltransferase I, liver |
| 327 | 320854 | NM_013200 | j, nn | carnitine palmitoyltransferase 1, muscle, carnitine palmitoyltransferase I, muscle | carnitine palmitoyltransferase 1, muscle, carnitine palmitoyltransferase I, muscle |
| 3273 | 20856 | NM_013200 | o, jj | carnitine palmitoyltransferase 1, muscle, carnitine palmitoyltransferase I, muscle | carnitine palmitoyltransferase 1, muscle, carnitine palmitoyltransferase I, muscle |
| 3182 | 1977 | NM_012930 | o, p, y, ff, xx | carnitine palmitoyltransferase 2, carnitine palmitoyltransferase II | carnitine palmitoyltransferase 2, carnitine palmitoyltransferase II |
| 4017 | 20243 | NM_053615 | ff | casein kinase 1, alpha 1 | ESTs, Weakly similar to casein kinase [*M. musculus*], RIKEN cDNA 2610208K14 gene, RIKEN cDNA 3300002K07 gene, casein kinase 1, alpha 1, casein kinase 1, delta |
| 3179 | 776 | NM_012922 | u | caspase 3, apoptosis related cysteine protease, caspase 3, apoptosis-related cysteine protease | *Mus musculus* 13 days embryo head cDNA, RIKEN full-length enriched library, clone:3110059O17:caspase 3, apoptosis related cysteine protease, full insert sequence, caspase 3, apoptosis related cysteine protease, caspase 3, apoptosis-related cysteine protease. caspase 8 |
| 3179 | 777 | NM_012922 | z | caspase 3, apoptosis related cysteine protease, caspase 3, apoptosis-related cysteine protease | *Mus musculus* 13 days embryo head cDNA, RIKEN full-length enriched library, clone:3110059O17:caspase 3, apoptosis related cysteine protease, full insert sequence, caspase 3, apoptosis related |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | cysteine protease, caspase 3, apoptosis-related cysteine protease, caspase 8 |
| 3887 | 16115 | NM_031775 | bb | caspase 6, caspase 6, apoptosis-related cysteine protease | caspase 6, caspase 6, apoptosis-related cysteine protease |
| 3059 | 15740 | NM_012520 | p | catalase, catalase 1 | catalase, catalase 1 |
| 3059 | 15741 | NM_012520 | o, General, bb | catalase, catalase 1 | catalase, catalase 1 |
| 3061 | 11115 | NM_012531 | l, nn | catechol-O-methyltransferase | RIKEN cDNA 6330414C15 gene, catechol-O-methyltransferase |
| 3061 | 11116 | NM_012531 | nn | catechol-O-methyltransferase | RIKEN cDNA 6330414C15 gene, catechol-O-methyltransferase |
| 3185 | 9109 | NM_012939 | l, General | cathepsin H | ESTs, Weakly similar to CATH_RAT CATHEPSIN H PRECURSOR (CATHEPSIN B3) (CATHEPSIN BA) [*R. norvegicus*], cathepsin H, cathepsin W, cathepsin W (lymphopain), expressed sequence AI118514 |
| 3256 | 3430 | NM_013156 | g, General, oo, pp, uu | cathepsin L | ESTs, Weakly similar to CATL MOUSE CATHEPSIN L PRECURSOR [*M. musculus*], RIKEN cDNA 4930486L24 gene, cathepsin L, expressed sequence AA408230 |
| 3256 | 3431 | NM_013156 | z, cc | cathepsin L | ESTs, Weakly similar to CATL MOUSE CATHEPSIN L PRECURSOR [*M. musculus*], RIKEN cDNA 4930486L24 gene, cathepsin L, expressed sequence AA408230 |
| 3649 | 21238 | NM_024125 | t, ff | CCAAT/enhancer binding protein (C/EBP), beta beta | CCAAT/enhancer binding protein (C/EBP), |
| 3649 | 21239 | NM_024125 | d, l, z | CCAAT/enhancer binding protein (C/EBP), beta beta | CCAAT/enhancer binding protein (C/EBP), |
| 3254 | 21683 | NM_013154 | d, g | CCAAT/enhancer binding protein (C/EBP), delta | CCAAT/enhancer binding protein (C/EBP), delta |
| 3806 | 16047 | NM_031541 | j, General, ll | CD36 antigen (collagen type I receptor, thrombospondin receptor)-like 1, scavenger receptor class B1 | CD36 antigen (collagen type I receptor, thrombospondin receptor)-like 1, scavenger receptor class B1 |
| 3814 | 18315 | NM_031561 | o | CD36 antigen, CD36 antigen (collagen type I receptor, thrombospondin receptor) | CD36 antigen, CD36 antigen (collagen type I receptor, thrombospondin receptor) |
| 3814 | 18316 | NM_031561 | o | CD36 antigen, CD36 antigen (collagen type I receptor, thrombospondin receptor) | CD36 antigen, CD36 antigen (collagen type I receptor, thrombospondin receptor) |
| 3814 | 18317 | NM_031561 | o | CD36 antigen, CD36 antigen (collagen type I receptor, thrombospondin receptor) | CD36 antigen, CD36 antigen (collagen type I receptor, thrombospondin receptor) |
| 3814 | 18318 | NM_031561 | j | CD36 antigen, CD36 antigen (collagen type I receptor, thrombospondin receptor) | CD36 antigen, CD36 antigen (collagen type I receptor, thrombospondin receptor) |
| 3814 | 18319 | NM_031561 | o | CD36 antigen, CD36 antigen (collagen type I receptor, thrombospondin receptor) | CD36 antigen, CD36 antigen (collagen type I receptor, thrombospondin receptor) |
| 3814 | 25139 | NM_031561 | o | CD36 antigen, CD36 antigen (collagen type I receptor, thrombospondin receptor) | CD36 antigen, CD36 antigen (collagen type I receptor, thrombospondin receptor) |
| 3447 | 22065 | NM_019195 | bb, nn | CD47 antigen (Rh-related antigen, integrin-associated signal transducer), integrin-associated protein | CD47 antigen (Rh-related antigen, integrin-associated signal transducer), RIKEN cDNA 1700026J12 gene, integrin-associated protein |
| 3181 | 2830 | NM_012925 | l, p, nn | CD59 antigen p18-20 (antigen identified by monoclonal antibodies 16.3A5 EJ16, EJ30, EL32 and G344), CD59a antigen | |
| 3326 | 1435 | NM_017125 | l, cc, rr | CD63 antigen (melanoma 1 antigen), Cd63 antigen | CD63 antigen (melanoma 1 antigen), Cd63 antigen, EST, Weakly similar to CD63 MOUSE CD63 ANTIGEN [*M. musculus*], ESTs, Weakly similar to CD63_RAT CD63 antigen (AD1 antigen) [*R. norvegicus*], *Mus musculus*, clone MGC:36554 IMAGE:4954874, mRNA, complete cds, RIKEN cDNA 1300010A20 gene, expressed sequence 075951, expressed sequence C80071, transmembrane 4 superfamily member 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4039 | 10512 | NM_053743 | k, mm | CDC37 cell division cycle 37 homolog (*S. cerevisiae*), cell division cycle 37 homolog (*S. cerevisiae*) | CDC37 cell division cycle 37 homolog (*S. cerevisaie*), cell division cycle 37 homolog (*S. cerevisiae*), cell division cycle 37 homolog (*S. cerevisiae*)-like |
| 4020 | 1178 | NM_053620 | ll | CDC42 binding protein kinase beta (DMPK-like), Cdc42 binding protein kinase beta | CDC42 binding protein kinase beta (DMPK-like), DNA segment, Chr X, Immunex 40, expressed, ESTs, Highly similar to Cdc42-binding protein kinase beta [*Rattus norvegicus*] [*R. norvegicus*], ESTs, Weakly similar to Cdc42-binding protein kinase beta [*Rattus norvegicus*] [*R. norvegicus*], RIKEN cDNA 1190006F07 gene, dystrophia myotonica kinase, B15 |
| 3990 | 2016 | NM_053527 | d | CDC5 cell division cycle 5-like (*S. pombe*), cell division cycle 5-like (*S. pombe*) | cell division cycle 5-like (*S. pombe*), myeloblastosis oncogene-like 1, myeloblastosis oncogene-like 2, v-myb myeloblastosis viral oncogene homolog (avian), v-myb myeloblastosis viral oncogene homolog (avian)-like 2 |
| 3880 | 13186 | NM_031755 | n | CEA-related cell adhesion molecule 1, carcinoembryonic antigen-related cell adhesion molecule 1 (biliary glycoprotein) | carcinoembryonic antigen-related cell adhesion molecule 1 (biliary glycoprotein), carcinoembryonic antigen-related cell adhesion molecule 5, carcinoembryonic antigen-related cell adhesion molecule 6 (non-specific cross reacting antigen), carcinoembryonic antigen-related cell adhesion molecule 8, pregnancy specific beta-1-glycoprotein 2, pregnancy specific beta-1-glycoprotein 4 |
| 73 | 13683 | AA799788 | s | cell division cycle 34 | ESTs, Highly similar to A41222 ubiquitin--protein ligase [*H. sapiens*], ESTs, Weakly similar to UBC2_HUMAN UBIQUITIN-CONJUGATING ENZYME E2-17 KD [*M. musculus*], RIKEN cDNA 2610301N02 gene, cell division cycle 34, expressed sequence AI327276, ubiquitin-conjugating enzyme E2B, RAD6 homology (*S. cerevisaie*), ubiquitin-conjugating enzyme E2C |
| 2979 | 13682 | L38482 | p | cell division cycle 34 | ESTs, Highly similar to A41222 ubiquitin--protein ligase [*H. sapiens*], ESTs, Weakly similar to UBC2_HUMAN UBIQUITIN-CONJUGATING ENZYME E2-17 KD [*M. musculus*], RIKEN cDNA 2610301N02 gene, cell division cycle 34, expressed sequence AI327276, ubiquitin-conjugating enzyme E2B, RAD6 homology (*S. cerevisaie*), ubiquitin-conjugating enzyme E2C |
| 2465 | 22845 | AI227887 | t | cell division cycle 42 (GTP binding protein, 25 kD), cell division cycle 42 homolog (*S. cerevisiae*) | RIKEN cDNA 4930544G11 gene, RIKEN cDNA 5830400A04 gene, cell division cycle 42 (GTP binding protein, 25 kD), plysia ras-related homolog A2, ras homolog 9 (RhoC), ras homolog A2, ras homolog gene family, member C |
| 3062 | 16520 | NM_012532 | b, u | ceruloplasmin, ceruloplasmin (ferroxidase) | DNA segment, Chr 3, ERATO Doi 555, expressed, EST, Highly similar to FA8_HUMAN COAGULATION FACTOR VIII PRECURSOR [*H. sapiens*], ESTs, Weakly similar to CERU MOUSE CERULOPLASMIN PRECURSOR [*M. musculus*], ESTs, Weakly similar to CERU_RAT CERULOPLASMIN PRECURSOR (FERROXIDASE) [*R. norvegicus*], ESTs, Weakly similar to KUHU ferroxidase [*H. sapiens*], ceruloplasmin, ceruloplasmin (ferroxidase), coagulation factor VIII, procoagulant component (hemophilia A) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3362 | 5005 | NM_017209 | n | CGI-63 protein, nuclear receptor binding factor 1 | *Mus musculus*, Similar to vesicle amine transport protein 1, clone MGC:38107 IMAGE:5320239, mRNA, complete cds, dithiolethione-inducible gene-1, nuclear receptor binding factor 1, vesicle amine transport protein 1 |
| 3871 | 19049 | NM_031719 | e | chloride channel, nucleotide-sensitive, 1A | chloride channel, nucleotide-sensitive, 1A |
| 3871 | 19050 | NM_031719 | e, p | chloride channel nucleotide sensitive, 1A | chloride channel, nucleotide-sensitive, 1A |
| 3901 | 10676 | NM_031818 | t | chloride intracellular channel 4, chloride intracellular channel 4 (mitochondrial) | EST X83352, ESTs, Weakly similar to intracellular chloride ion channel protein p64H1 [*Rattus norvegicus*] [*R. norvegicus*], RIKEN cDNA 5730531E12 gene, chloride intracellular channel 1, chloride intracellular channel 4 (mitochondrial) |
| 3260 | 447 | NM_013165 | tt | cholecystokinin B receptor | cholecystokinin B receptor |
| 3328 | 1305 | NM_017127 | oo | choline kinase | *Mus musculus* 13 days embryo head cDNA, RIKEN full-length enriched library, clone:3110043M12:choline kinase, full insert sequence, choline kinase, hypothetical protein FLJ10761 |
| 3328 | 1306 | NM_017127 | f, l, General, kk, qq, vv | choline kinase | *Mus musculus* 13 days embryo head cDNA, RIKEN full-length enriched library, clone:3110043M12:choline kinase, full insert sequence, choline kinase, hypothetical protein FLJ10761 |
| 3352 | 3512 | NM_017177 | d, o, q, v, dd | choline kinase-like | EST, Weakly similar to KICE MOUSE CHOLINE/ETHANOLAMINE KINASE [*M. musculus*], ESTs, Weakly similar to KICE_RAT Choline/ethanolamine kinase [Includes: Choline kinase (CK); Ethanolamine kinase (EK)] [*R. norvegicus*], *Homo sapiens,* Similar to hypothetical protein FLJ10761, clone MGC:19512 IMAGE:4329734, mRNA, complete cds, RIKEN cDNA 4930555L11 gene, choline kinase-like, ethanolamine kinase, expressed sequence AI97444 |
| 3352 | 3513 | NM_017177 | d, n, dd | choline kinase-like | EST, Weakly similar to KICE MOUSE CHOLINE/ETHANOLAMINE KINASE [*M. musculus*], ESTs, Weakly similar to KICE_RAT Choline/ethanolamine kinase [Includes: Choline kinase (CK); Ethanolamine kinase (EK)] [*R. norvegicus*], *Homo sapiens,* Similar to hypothetical protein FLJ10761, clone MGC:19512 IMAGE:4329734, mRNA, complete cds, RIKEN cDNA 4930555L11 gene, choline kinase-like, ethanolamine kinase, expressed sequence AI97444 |
| 3821 | 1444 | NM_031583 | ww | chondroitin sulfate proteoglycan 6, chondroitin sulfate proteoglycan 6 (bamacan) | SMC2 structural maintenance of chromosomes 2-like 1 (yeast), chondroitin sulfate proteoglycan 6, chondroitin sulfate proteoglycan 6 (bamacan), fibroblast growth factor inducible 16 |
| 3918 | 17075 | NM_031974 | l, General, kk, ll, ss | clathrin, light polypeptide (Lca) | *H. sapiens* clathrin light chain a gene, clathrin, light polypeptide (Lca), clathrin, light polypeptide (Lcb), expressed sequence AV026556 |
| 3862 | 13706 | NM_031699 | ss | claudin 1 | ESTs, Weakly similar to claudin 1 [*Rattus norvegicus*] [*R. norvegicus*], *Homo sapiens,* clone MGC:23949 IMAGE:4243903, mRNA, complete cds, *Mus musculus* claudin 19 mRNA, complete cds, claudin 1, claudin 18 |
| 3863 | 20404 | NM_031700 | General | claudin 3 | claudin 3 |
| 3863 | 20405 | NM_031700 | a, l, General, cc, ss | claudin 3 | claudin 3 |
| 3630 | 24838 | NM_022924 | tt | coagulation factor II, coagulation factor II (thrombin) | coagulation factor II, coagulation factor II (thrombin) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3006 | 25430 | M26247 | p | coagulation factor IX, coagulation factor IX (plasma thromboplastic component, Christmas disease, hemophilia B) | |
| 3335 | 10503 | NM_017143 | a, x, dd | coagulation factor X | ESTs, Weakly similar to 2209311A coagulation factor X [*Rattus norvegicus*] [*R. norvegicus*], ESTs, Weakly similar to FA7 MOUSE COAGULATION FACTOR VII PRECURSOR [*M. musculus*], coagulation factor X, proline-rich Gla (G-carboxyglutamic acid) polypeptide 1, proline rich Gla (G-carboxyglutamic acid) polypeptide 2 |
| 3335 | 10504 | NM_017143 | d, dd | coagulation factor X | ESTs, Weakly similar to 2209311A coagulation factor X [*Rattus norvegicus*] [*R. norvegicus*], ESTs, Weakly similar to FA7 MOUSE COAGULATION FACTOR VII PRECURSOR [*M. musculus*], coagulation factor X, proline-rich Gla (G-carboxyglutamic acid) polypeptide 1, proline rich Gla (G-carboxyglutamic acid) polypeptide 2 |
| 4136 | 19831 | NM_080781 | b, q, x, dd | coatomer protein complex, subunit beta, coatomer protein complex, subunit beta 1 | coatomer protein complex, subunit beta, coatomer protein complex, subunit beta 1 |
| 2712 | 2241 | AI235500 | ss | cofilin 1 (non-muscle), cofilin 1, non-muscle | cofilin 1, (non-muscle), cofilin 1, non-muscle, cofilin 2 (muscle), cofilin 2, muscle, expressed sequence AW987265 |
| 3337 | 15364 | NM_017147 | j | cofilin 1 (non muscle), cofilin 1, non-muscle | cofilin 1 (non-muscle), cofilin 1, non muscle, cofilin 2 (muscle), cofilin 2, muscle expressed sequence AW987265 |
| 2890 | 16610 | D28557 | n, General, oo, rr | cold shock domain protein A | *Mus musculus* 10 days embryo whole body cDNA, RIKEN full-length enriched library clone:2610205119:Y box protein 1, full insert sequence, *Mus musculus* Y-box binding protein (oxyR) mRNA, partial cds, cold shock domain protein A |
| 4484 | 15569 | Z78279 | bb | collagen, type I, alpha 1, procollagen, type I, alpha 1 | EST, Weakly similar to CA11_HUMAN COLLAGEN ALPHA 1(I) CHAIN PRECURSOR [*H. sapiens*], EST, Weakly similar to PROCOLLAGEN ALPHA 1(I) CHAIN PRECURSOR [*M. musculus*], ESTs, Weakly similar to CA11_HUMAN COLLAGEN ALPHA 1(I) CHAIN PRECURSOR [*H. sapiens*], ESTs, Weakly similar to PROCOLLAGEN ALPHA 1(I) CHAIN PRECURSOR [*M. musculus*], F-box only protein 29, *Mus musculus*, Similar to RIKEN cDNA 17CDC51112 gene, clone MGC:28741 IMAGE:4481590, mRNA, complete cds, collagen, type IV, alpha 3 (Goodpasture antigen), expressed sequence AW742721, procollagen, type I, alpha 1, procollagen, type IV, alpha 1, procollagen, type IV, alpha 4, procollagen, type IV, alpha 5, procollagen, type VI, alpha 1 putative emu1 |
| 5722 | 1674 | AA891828 | jj | collagen, type I, alpha 2, procollagen, type I, alpha 2 | F-box only protein 29, *Mus musculus*, clone IMAGE:5323568, mRNA, partial cds, collagen, type VI, alpha 3, procollagen, type I, alpha 2, prostate tumor over expressed gene 1, retinoblastoma binding protein 1 |
| 420 | 2263 | AA859757 | e | collagen, type V, alpha 1, procollagen, type V, alpha 1 | EST, Weakly similar to CGHU1V collagen alpha 1(V) chain precursor [*H. sapiens*], *Homo sapiens* cDNA FLJ30442 fis, clone BRACE2009212, *Homo sapiens* proline-rich acidic protein mRNA, complete cds, *Mus musculus*, clone IMAGE:3490511, mRNA, partial cds, collagen, type V, alpha 1, collagen, type XI, alpha 1, endoplasmic reticulum chaperone SIL1, homolog of yeast, hypothetical protein MGC2705, procollagen, type V, alpha 1, procollagen, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | type V, alpha 3, procollagen, type XI, alpha 1 |
| 3474 | 1129 | NM_019274 | nn | collagen-like tail subunit (single strand of homotrimer) of asymmetric acetylcholinesterase | CSR1 protein, EST, Weakly similar to CA1B MOUSE COLLAGEN ALPHA 1 (XI) CHAIN PRECURSOR [*M. musculus*], ESTs, Weakly similar to CA17_HUMAN COLLAGEN ALPHA 1(VII) CHAIN PRECURSOR [*H. sapiens*], collagen-like tail subunit (single strand of homotrimer) of asymmetric acetylcholinesterase |
| 3469 | 15259 | NM_019259 | rr | complement component 1, q subcomponent binding protein | complement component 1, q subcomponent binding protein |
| 3470 | 21443 | NM_019262 | nn | complement component 1, q subcomponent, beta polypeptide | |
| 3287 | 1958 | NM_016994 | b, General, uu, vv | complement component 3 | EST, Weakly similar to CO3_RAT COMPLEMENT C3 PRECURSOR [CONTAINS: C3A ANAPHYLATOXIN] [*R. norvegicus*], complement component 3, complement component 4 (within H-25), complement component 4A, complement component 4B, expressed sequence 416R3842 hemolytic complement |
| 3287 | 1959 | NM_016994 | f, u, uu | complement component 3 | EST, Weakly similar to CO3_RAT COMPLEMENT C3 PRECURSOR [CONTAINS: C3A ANAPHYLATOXIN] [*R. norvegicus*], complement component 3, complement component 4 (within H-25), complement component 4A, complement component 4B, expressed sequence AI663842 hemolytic complement |
| 1631 | 5852 | M800942 | gg, hh | complement component 4 (within H-2S), complement component 4B | complement component 4 (within H-25), complement component 4A |
| 4377 | 15851 | U42719 | w | complement component 4 (within H-25), complement component 4B | complement component 4 (within H-25), complement component 4A |
| 3288 | 1561 | NM_016995 | d, v, uu | complement component 4 binding protein, beta, complement component 4 binding protein, pseudogene 1 | complement component 4 binding protein, beta |
| 3057 | 563 | NM_012516 | i, vv | complement component 4 binding protein, complement component 4 binding protein, alpha | ESTs, Moderately similar to NBHUC4 C4b-binding protein alpha chain precursor [*H. sapiens*], complement component (3d/Epstein Barr virus) receptor 2, complement component 4 binding protein, complement component 4 binding protein, alpha, complement receptor 2, decay-accelerating factor, expressed sequence AI195242, zona pellucida 3 receptor |
| 4019 | 926 | NM_053619 | g | complement component 5 receptor I (C5a ligand), complement component 5, receptor 1 | ESTs, Weakly similar to GPRY_MOUSE PROBABLE G PROTEIN-COUPLED RECEPTOR GPR34 [*M. musculus*], complement component S receptor 1 (C5a ligand), complement component 5, receptor 1 |
| 3845 | 1727 | NM_031642 | r, tt | core promoter element binding protein | DNA segment, Chr 12, ERATO Doi 427, expressed, EST, Moderately similar to core promoter element binding protein [*Rattus norvegicus*] [*R. norvegicus*], ESTs, Weakly similar to core promoter element binding protein [*Rattus norvegicus*] [*R. norvegicus*], Kruppel-like factor 7 (ubiquitous), core promoter element binding protein |
| 3453 | 15348 | NM_019222 | k, m | coronin, actin binding protein 1B, coronin, actin-binding protein, 1B | ESTs, Moderately similar to CO1B_RAT Coronin 1B (Coronin 2) [*R. norvegicus*], coronin 6, coronin, actin binding protein 1B, coronin, actin binding protein 1C, coronin, actin binding protein, 1C, hypothetical protein DKFZp762I166 |
| 3320 | 6013 | NM_017096 | e, w, rr, vv | C-reactive protein, pentraxin-related, C-reactive protein, petaxin related | C-reactive protein, petaxin related, *Homo sapiens*, Similar to C-reactive protein, pentraxin-related, clone MGC:22631 IMAGE:4766715, mRNA, complete cds |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3063 | 20357 | NM_012534 | p, bb | crystallin, alpha A | crystallin, alpha A, expressed sequence AI323437 |
| 3184 | 13723 | NM_012935 | u | crystallin, alpha B | ESTs, Moderately similar to T46637 transcription factor 1, neural - rat [*R. norvegicus*], ESTs, Weakly similar to A35804 nucleolin [*H. sapiens*], ESTs, Weakly similar to alpha-crystallin chain B [*M. musculus*], *Homo sapiens* mRNA; cDNA DKFZp434E0922 (from clone DKFZp434E0922), *Mus musculus* 10, 11 days embryo whole body cDNA, RIKEN full-length enriched library, clone:2810003I18:myelin transcription factor 1-like, full insert sequence, crystallin, alpha B, myelin transcription factor 1-like, nucleolin |
| 3448 | 18572 | NM_019201 | pp, tt | C-terminal binding protein 1 | C-terminal binding protein 1, *Homo sapiens* mRNA; cDNA DKFZp434B0914 (from clone DKFZp434B0914); partial cds |
| 1094 | 24230 | AA957218 | ii | cyclin D1, cyclin D1 (PRAD1: parathyroid adenomatosis 1) | EST, Moderately similar to JC2342 cyclin D1 - rat [*R. norvegicus*], cyclin D1, cyclin D1 (PRAD1: parathyroid adenomatosis 1) |
| 3180 | 20755 | NM_012923 | m, u | cyclin G, cyclin G1 | ESTs, Weakly similar to CGG1_RAT Cyclin G1 (Cyclin G) [*R. norvegicus*], cyclin G, cyclin G2, cyclin 1 |
| 4137 | 132 | NM_080782 | ll, tt | cyclin-dependent kinase inhibitor 1A (P21), cyclin-dependent kinase inhibitor 1A (p21, Cip1) | |
| 4137 | 133 | NM_080782 | p, ll, ss | cyclin-dependent kinase inhibitor 1A (P21), cyclin-dependent kinase inhibitor 1A (p21, Cip1) | |
| 3468 | 7693 | NM_019258 | g | cystatin 8 (cystatin-related epididymal specific), cystatin 8 (cystatin-related epididymal spermatogenic) | RIKEN cDNA 1700006C19 gene, cystatin 8 (cystatin-related epididymal specific), cystatin 8 (cystatin-related epididymal spermatogenic) |
| 3153 | 2853 | NM_012838 | j, l, qq | cystatin B, cystatin B (stefin B) | cystatin B, cystatin B (stefin B) |
| 3153 | 2854 | NM_012838 | j, l, General, cc, rr | cystatin B, cystatin B (stefin B) | cystatin B, cystatin B (stefin B) |
| 3153 | 2855 | NM_012838 | l, cc | cystatin B, cystatin B (stefin B) | cystatin B, cystatin B (stefin B) |
| 2570 | 24326 | AI231292 | a, l, General, cc, qq | cystatin C, cystatin C (amyloid angiopathy and cerebral hemorrhage) | ESTs, Moderately similar to CYTC MOUSE CYSTATIN C PRECURSOR [*M. musculus*], ESTs, Weakly similar to CYTC MOUSE CYSTATIN C PRECURSOR [*M. musculus*], RIKEN cDNA 1110017E11 gene, RIKEN cDNA 9230101F08 gene, cystatin C, cystatin C (amyloid angiopathy and cerebral hemorrhage), cystatin D, cystatin S, cystatin SA, cystatin SN |
| 2570 | 24327 | AI231292 | h, l, rr | cystatin C, cystatin C (amyloid angiopathy and cerebral hemorrhage) | ESTs, Moderately similar to CYTC MOUSE CYSTATIN C PRECURSOR [*M. musculus*], ESTs, Weakly similar to CYTC MOUSE CYSTATIN C PRECURSOR [*M. musculus*], RIKEN cDNA 1110017E11 gene, RIKEN cDNA 9230101F08 gene, cystatin C, cystatin C (amyloid angiopathy and cerebral hemorrhage), cystatin D, cystatin S, cystatin SA, cystatin SN |
| 3574 | 2515 | NM_022501 | ww | cysteine and glycine-rich protein 2, cysteine-rich protein 2 | RIKEN cDNA 0610010I23 gene, cysteine-rich protein 2, thymus LIM protein |
| 4378 | 19543 | U44948 | ww | cysteine and glycine-rich protein 2, cysteine-rich protein 2 | RIKEN cDNA 0610010I23 gene, cysteine-rich protein 2, thymus LIM protein |
| 3950 | 25024 | NM_052809 | b, o, vv | cysteine dioxygenase 1, cytosolic, cysteine dioxygenase, type I | cysteine dioxygenase 1, cytosolic, cysteine dioxygenase, type I |
| 3950 | 15028 | NM_052809 | b, qq, w | cysteine dioxygenase 1, cytosolic, cysteine dioxygenase, type I | cysteine dioxygenase 1, cytosolic, cysteine dioxygenase, type I |
| 3360 | 14694 | NM_017202 | ff | cytochrome c oxidase subunit IV isoform 1, cytochrome c oxidase, subunit Va | EST, Weakly similar to COX4_HUMAN CYTOCHROME C OXIDASE POLYPEPTIDE IV PRECURSO [*H. sapiens*], |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | ESTs, Moderately similar to COX4_HUMAN CYTOCHROME C OXIDASE POLYPEPTIDE IV PRECURSO [*H. sapiens*], cytochrome c oxidase subunit IV isoform 1, cytochrome c oxidase, subunit IVa |
| 3983 | 21866 | NM_053472 | s | cytochrome c oxidase subunit IV isoform 2, cytochrome c oxidase, subunit IVb | cytochrome c oxidase subunit IV isoform 2, cytochrome c oxidase, subunit IVb |
| 1940 | 23574 | AI104520 | ll | cytochrome c oxidase subunit VIa polypeptide 1, cytochrome c oxidase, subunit VI a, polypeptide 1 | |
| 3154 | 11138 | NM_012839 | jj | cytochrome c, cytochrome C, somatic | |
| 3064 | 488 | NM_012540 | j, w | cytochrome P450, 1a1, aromatic compound inducible, cytochrome P450, subfamily I (aromatic compound-inducible), polypeptide 1 | cytochrome P450, 1a1, aromatic compound inducible, cytochrome P450, subfamily I (aromatic compound-inducible), polypeptide 1 |
| 3064 | 489 | NM_012540 | e, tt | cytochrome P450, 1a1, aromatic compound inducible, cytochrome P450, subfamily I (aromatic compound- | cytochrome P450, 1a1, aromatic compound inducible, cytochrome P450, subfamily I (aromatic compound-inducible), polypeptide 1 |
| 3064 | 20705 | NM_012540 | j | cytochrome P450, 1a2, aromatic compound inducible, cytochrome P450, subfamily I (aromatic compound-inducible), polypeptide 2 | cytochrome P450, 1a2, aromatic compound inducible, cytochrome P450, subfamily I (aromatic compound-inducible), polypeptide 2 |
| 3065 | 20703 | NM_012541 | xx | cytochrome P450, 1a2, aromatic compound inducible, cytochrome P450, subfamily I (aromatic compound-inducible), polypeptide 2 | cytochrome P450, 1a2, aromatic compound inducible, cytochrome P450, subfamily I (aromatic compound-inducible), polypeptide 2 |
| 3186 | 190 | NM_012940 | e | cytochrome P450, 1b1, benz[a]anthracene inducible, cytochrome P450, subfamily I (dioxin-inducible), polypeptide 1 (glaucoma 3, primary infantile) | cytochrome P450, 1b1, benz[a]anthracene inducible, cytochrome P450, subfamily I (dioxin-inducible), polypeptide 1 (glaucoma 3, primary infantile) |
| 3186 | 191 | NM_012940 | e | cytochrome P450, 1b1, benz[a]anthracene inducible, cytochrome P450, subfamily I (dioxin-inducible), polypeptide 3, 1 (glaucoma 3, primary infantile) | cytochrome P450, 1b1, benz[a]anthracene inducible, cytochrome P450, subfamily I (dioxin-inducible), polypeptide 1 (glaucoma primary infantile) |
| 3186 | 192 | NM_012940 | e | cytochrome P450, 1b1, benz[a]anthracene inducible, cytochrome P450, subfamily I (dioxin-inducible), polypeptide 1 (glaucoma 3, primary infantile) | cytochrome P450, 1b1, benz[a]anthracene inducible, cytochrome P450, subfamily I (dioxin-inducible), polypeptide 1 (glaucoma 3, primary infantile) |
| 3186 | 193 | NM_012940 | e, v | cytochrome P450, 1b1, benz[a]anthracene inducible, cytochrome P450, subfamily I (dioxin-inducible), polypeptide 1 (glaucoma 3, primary infantile) | cytochrome P450, 1b1, benz[a]anthracene inducible, cytochrome P450, subfamily I (dioxin-inducible), polypeptide 1 (glaucoma 3, primary infantile) |
| 3807 | 4010 | NM_031543 | e, r | cytochrome P450, 2e1, ethanol inducible, cytochrome P450, subfamily IIE (ethanol-inducible) | |
| 3807 | 4011 | NM_031543 | j, w | cytochrome P450, 2e1, ethanol inducible, cytochrome P450, subfamily IIE (ethanol-inducible) | |
| 3807 | 4012 | NM_031543 | e,rr | cytochrome P450,2e1, ethanol inducible, cytochrome P450, subfamily IIE (ethanol-inducible) | |
| 3187 | 20928 | NM_012941 | ee | cytochrome P450, 51, cytochrome P450, 51 (lanosterol 14-alpha-demethylase) | cytochrome P450, 51, cytochrome P450, 51 (lanosterol 14-alpha-demethylase) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3187 | 20929 | NM_012941 | jj | cytochrome P450, 51, cytochrome P450, 51 (lanosterol 14-alpha-demethylase) | cytochrome P450, 51, cytochrome P450, 51 (lanosterol 14-alpha-demethylase) |
| 3187 | 20931 | NM_012941 | uu | cytochrome P450, 51, cytochrome P450, 51 (lanosterol 14-alpha-demethylase) | cytochrome P450, 51, cytochrome P450, 51 (lanosterol 14-alpha-demethylase) |
| 8352 | 0711 | AA924267 | o | cytochrome P450, subfamily IV B, polypeptide 1, cytochrome P450, subfamily IVB, polypeptide 1 | EST, Moderately similar to I65981 fatty acid omega-hydroxylase [*H. sapiens*], *Mus musculus*, Similar to cytochrome P450, 4a10, clone MGC:18880 IMAGE:4237837, mRNA, complete cds, *Mus musculus*, Similar to cytochrome P450, 4a10, clone MGC:25972 IMAGE:4240359, mRNA, complete cds, RIKEN cDNA A230105L22 gene, cytochrome P450, 4a10, cytochrome P450, subfamily IVA, polypeptide 11, expressed sequence AI314743 |
| 1194 | 20712 | AA997806 | b, uu | cytochrome P450, subfamily IV B, polypeptide 1, cytochrome P450, subfamily IVB, polypeptide 1 | EST, Moderately similar to I65981 fatty acid omega-hydroxylase [*H. sapiens*], *Mus musculus*, Similar to cytochrome P450, 4a10, clone MGC:18880 IMAGE:4237837, mRNA, complete cds, *Mus musculus*, Similar to cytochrome P450, 4a10, clone MGC:25972 IMAGE:4240359, mRNA, complete cds, RIKEN cDNA A230105L22 gene, cytochrome P450, 4a10, cytochrome P450, subfamily VA, polypeptide 11, expressed sequence AI314743 |
| 2991 | 20714 | M14972 | o, r | cytochrome P450, subfamily IV B, polypeptide 1, cytochrome P450, subfamily IVB, polypeptide 1 | EST, Moderately similar to I65981 fatty acid omega-hydroxylase [*H. sapiens*], *Mus musculus*, Similar to cytochrome P450, 4a10, clone MGC:18880 IMAGE:4237837, mRNA, complete cds, *Mus musculus*, Similar to cytochrome P450, 4a10, clone MGC:25972 IMAGE:4240359, mRNA, complete cds, RIKEN cDNA A230105L22 gene, cytochrome P450, 4a10, cytochrome P450, subfamily IVA, polypeptide 11, expressed sequence AI314743 |
| 3019 | 20713 | M57718 | o, r, xx | cytochrome P450, subfamily IV B, polypeptide 1, cytochrome P450, subfamily IVB, polypeptide 1 | EST, Moderately similar to I65981 fatty acid omega-hydroxylase [*H. sapiens*], *Mus musculus*, Similar to cytochrome P450, 4a10, clone MGC:18880 IMAGE:4237837, mRNA, complete cds, *Mus musculus*, Similar to cytochrome P450, 4a10, clone MGC:25972 IMAGE:4240359, mRNA, complete cds, RIKEN cDNA A230105L22 gene, cytochrome P450, 4a10, cytochrome P450, subfamily VA, polypeptide 11, expressed sequence AI314743 |
| 4408 | 20715 | X07259 | o, xx | cytochrome P450, subfamily IV B, polypeptide 1, cytochrome P450, subfamily IVB, polypeptide 1 | EST, Moderately similar to I65981 fatty acid omega-hydroxylase [*H. sapiens*], *Mus musculus*, Similar to cytochrome P450, 4a10, clone MGC:18880 IMAGE:4237837, mRNA, complete cds, *Mus musculus*, Similar to cytochrome P450, 4a10, clone MGC:25972 IMAGE:4240359, mRNA, complete cds, RIKEN cDNAA230105L22 gene, cytochrome P450, 4a10, cytochrome P450, subfamily VA, polypeptide 11, expressed sequence AI314743 |
| 4260 | 1858 | NM_138907 | o, q, jj, xx | cytosolic acyl-CoA thioesterase 1, mitochondrial acyl-CoA thioesterase 1, peroxisomal long-chain acyl-coA thioesterase | EST, Moderately similar to PTE2_HUMAN PEROXISOMAL ACYL-COENZYME A THIOESTER HYDROLASE 2 (PEROXISOMAL LONG-CHAIN ACYL-COA THIOESTERASE 2) (ZAP128) [*H. sapiens*], ESTs, Weakly similar to MTEt3AT Acyl coenzyme A thioester hydrolase, mitochondrial precursor (Very-long-chain acyl-CoA thioesterase) (MTE-I) [*R. norvegicus*], ESTs, Weakly similar to PTE2_HUMAN PEROXISOMAL ACYL- |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | COENZYME A THIOESTER HYDROLASE 2 (PEROXISOMAL LONG-CHAIN ACYL-COA THIOESTERASE 2) (ZAP128) [*H. sapiens*], *Homo sapiens* cDNA FLJ31235 fis, clone KIDNE2004681, moderately similar to *Mus musculus* peroxisomal long chain acyl-CoA thioesterase 1b (Pte 1b) gene, *Mus musculus*, Similar to bile acid Coenzyme A: amino acid N-acyltransferase (glycine N-choloyltransferase), clone MGC:19156 IMAGE:4220620, mRNA, complete cds, cytosolic acyl-CoA thioesterase 1, mitochondrial acyl-CoA thioesterase 1, peroxisomal long-chain acyl-coA thioesterase |
| 3779 | 1857 | NM_031315 | o, xx | cytosolic acyl-CoA thioesterase 1, peroxisomal long-chain acyl-coA thioesterase | EST, Moderately similar to PTE2_HUMAN PEROXISOMAL ACYL-COENZYME A THIOESTER HYDROLASE 2 (PEROXISOMAL LONG-CHAIN ACYL-COA THIOESTERASE 2) (ZAP128) [*H. sapiens*], ESTs, Weakly similar to PTE2HUMAN PEROXISOMAL ACYL-COENZYME A THIOESTER HYDROLASE 2 (PEROXISOMAL LONG-CHAIN ACYL-COA THIOESTERASE 2) (ZAP128) [*H. sapiens*], *Homo sapiens* cDNA FLJ31235 fis, clone K1DNE2004681, moderately similar to *Mus musculus* peroxisomal long chain acyl-CoA thioesterase 1b (Pte 1b) gene, cytosolic acyl-CoA thioesterase 1, peroxisomal long-chain acyl-coA thioesterase |
| 3652 | 17226 | NM_024131 | b, if, vv | D-dopachrome tautomerase | D-dopachrome tautomerase, EST, Moderately similar to DOPD_HUMAN D-DOPACHROME TAUTOMERASE [*H. sapiens*] |
| 3652 | 17227 | NM_024131 | b, f, if, vv | D-dopachrome tautomerase | D-dopachrome tautomerase, EST, Moderately similar to DOPDHUMAN D-DOPACHROME TAUTOMERASE [*H. sapiens*] |
| 3363 | 1703 | NM_017210 | mm | deiodinase, iodothyronine type III, deiodinase, iodothyronine, type III | deiodinase, iodothyronine, type I, deiodinase, odothyronine, type III |
| 3363 | 1704 | NM_017210 | mm, xx | deiodinase, iodothyronine type III, deiodinase, iodothyronine, type III | deiodinase, odothyronune, type I, deiodinase, iodothyronine, type III |
| 3522 | 19679 | NM_021653 | a, d, ii | deiodinase, lodothyronine, type I | ESTs, Moderately similar to 1001_RAT TYPE I IODOTHYRONINE DEIODINASE (TYPE-I 5'DEIODINASE) (DIOI) (TYPE 1 DI) (5DI) [*R. norvegicus*], deiodinase, iodothyronine, type I |
| 3930 | 860 | NM_032063 | mm | delta-like 1 (*Drosophila*) | EST, Highly similar to delta (*Drosophila*)-like 1 [*Rattus norvegicus*] [*R. norvegicus*], ESTs, Highly similar to DLL1_HUMAN DELTA-LIKE PROTEIN 1 PRECURSOR [*H. sapiens*], delta-like 1 (*Drosophila*), delta-like 4 (*Drosophila*), hypothetical protein MGC2487 |
| 3912 | 16535 | NM_031853 | bb | diazepam binding inhibitor, diazepam binding inhibitor (GABA receptor modulator, acyl-Coenzyme A binding protein) | |
| 4466 | 25746 | X80778 | t | dihydroorotate dehydrogenase | |
| 3865 | 811 | NM_031705 | c, s, General, ll | dihydropyrimidinase | ESTs, Weakly similar to DPYI MOUSE DIHYDROPYRIMIDINASE RELATED PROTEIN-1 [*M. musculus*], dihydropyrimidinase |
| 3865 | 812 | NM_031705 | s, oo | dihydropyrimidinase | ESTs, Weakly similar to DPY1 MOUSE DIHYDROPYRIMIDINASE RELATED PROTEIN-i [*M. musculus*], dihydropyrimidinase |
| 756 | 6377 | AA894273 | t, qq | dimethylarginine dimethylaminohydrolase 1 | ESTs, Highly similar to DDH1_HUMAN NG,NG-DIMETHYLARGININE DIMETHYLAMINOHYDROLASE 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | [*H. sapiens*], ESTs, Weakly similar to dimethylarginine dimethylaminohydrolase 1; NG,NG dimethylarginine dimethylaminohydrolase [*Rattus norvegicus*] [*R. norvegicus*], dimethylarginine dimethylaminohydrolase 1, dimethylarginine dimethylaminohydrolase 2 |
| 989 | 19421 | AA945152 | n, ee | dimethylarginine dimethylaminohydrolase 1 | ESTs, Highly similar to DDH1_HUMAN NG,NG-DIMETHYLARGININE DIMETHYLAMINOHYDROLASE 1 [*H. sapiens*], ESTs, Weakly similar to dimethylarginine dimethylaminohydrolase 1; NG,NG dimethylarginine dimethylaminohydrolase [*Rattus norvegicus*] [*R. norvegicus*], dimethylarginine dimethylaminohydrolase 1, dimethylarginine dimethylaminohydrolase 2 |
| 2424 | 19427 | AI179510 | pp | dimethylarginine dimethylaminohydrolase 1 | ESTs, Highly similar to DDH1_HUMAN NG,NG-DIMETHYLARGININE DIMETHYLAMINOHYDROLASE 1 [*H. sapiens*], ESTs, Weakly similar to dimethylarginine dimethylaminohydrolase 1; NG,NG dimethylarginine dimethylaminohydrolase [*Rattus norvegicus*] [*R. norvegicus*], dimethylarginine dimethylaminohydrolase 1, dimethylarginine dimethylaminohydrolase 2 |
| 3556 | 19422 | NM_022297 | j, z | dimethylarginine dimethylaminohydrolase 1 | ESTs, Highly similar to DDH1_HUMAN NG,NG-DIMETHYLARGININE DIMETHYLAMINOHYDROLASE 1 [*H. sapiens*], ESTs, Weakly similar to dimethylarginine dimethylaminohydrolase 1; NG,NG dimethylarginine dimethylaminohydrolase [*Rattus norvegicus*] [*R. norvegicus*], dimethylarginine dimethylaminohydrolase 1, dimethylarginine dimethylaminohydrolase 2 |
| 3556 | 19423 | NM_022297 | l | dimethylarginine dimethylaminohydrolase 1 | ESTs, Highly similar to DDH1_HUMAN NG,NG-DIMETHYLARGININE DIMETHYLAMINOHYDROLASE 1 [*H. sapiens*], ESTs, Weakly similar to dimethylarginine dimethylaminohydrolase 1; NG,NG dimethylarginine dimethylaminohydrolase [*Rattus norvegicus*] [*R. norvegicus*], dimethylarginine dimethylaminohydrolase 1, dimethylarginine dimethylaminohydrolase 2 |
| 4325 | 19429 | R47028 | n | dimethylarginine dimethylaminohydrolase 1 | ESTs, Highly similar to DDH1_HUMAN NG,NG-DIMETHYLARGININE DIMETHYLAMINOHYDROLASE 1 [*H. sapiens*], ESTs, Weakly similar to dimethylarginine dimethylaminohydrolase 1; NG,NG dimethylarginine dimethylaminohydrolase [*Rattus norvegicus*] [*R. norvegicus*], dimethylarginine dimethylaminohydrolase 1, dimethylarginine dimethylaminohydrolase 2 |
| 4452 | 6376 | X62951 | xx | dimethylarginine dimethylaminohydrolase 1 | ESTs, Highly similar to DDH1_HUMAN NG,NG-DIMETHYLARGININE DIMETHYLAMINOHYDROLASE 1 [*H. sapiens*], ESTs, Weakly similar to dimethylarginine dimethylaminohydrolase 1; NG,NG dimethylarginine dimethylaminohydrolase [*Rattus norvegicus*] [*R. norvegicus*], dimethylarginine dimethylaminohydrolase 1, dimethylarginine dimethylaminohydrolase 2 |
| 3917 | 16865 | NM_031973 | a, cc, uu | dipeptidyl peptidase 7, dipeptidylpeptidase 7 | RIKEN cDNA 2510048K03 gene, dipeptidyl peptidase 7, dipeptidylpeptidase 7, prolylcarboxypeptidase (angiotensinase C), protease, serine, 16 (thymus) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1314 | 7785 | AI008758 | vv | dipeptidylpeptidase 4, dipeptidylpeptidase IV (CD26, adenosine deaminase complexing protein 2) | ESTs, Weakly similar to DPP4 MOUSE DIPEPTIDYL PEPTIDASE IV [*M. musculus*], ESTs, Weakly similar to DPP4_RAT Dipeptidyl peptidase IV (DPP IV) (GP110 glycoprotein) (Bile canaliculus domain-specific membrane glycoprotein) [*R. norvegicus*], dipeptidylpeptidase 4, dipeptidylpeptidase 8, fibroblast activation protein, fibroblast activation protein alpha |
| 3140 | 7783 | NM_012789 | qq | dipeptidylpeptidase 4, dipeptidylpeptidase IV (CD26, adenosine deaminase complexing protein 2) | ESTs, Weakly similar to DPP4 MOUSE DIPEPTIDYL PEPTIDASE IV [*M. musculus*], ESTs, Weakly similar to DPP4_RAT Dipeptidyl peptidase IV (DPP IV) (GP110 glycoprotein) (Bile canaliculus domain-specific membrane glycoprotein) [*R. norvegicus*], dipeptidylpeptidase 4, dipeptidylpeptidase 8, fibroblast activation protein, fibroblast activation protein, alpha |
| 3140 | 7784 | NM_012789 | General, kk | dipeptidylpeptidase 4, dipeptidylpeptidase IV (CD26, adenosine deaminase complexing protein 2) | ESTs, Weakly similar to DPP4 MOUSE DIPEPTIDYL PEPTIDASE IV [*M. musculus*], ESTs, Weakly similar to DPP4_RAT Dipeptidyl peptidase IV (DPP IV) (GP110 glycoprotein) (Bile canaliculus domain-specific membrane glycoprotein) [*R. norvegicus*], dipeptidylpeptidase 4, dipeptidylpeptidase 8, fibroblast activation protein, fibroblast activation protein, alpha |
| 216 | 6054 | M818658 | ww | diphtheria toxin receptor (heparin-binding epidermal growth factor-like growth factor), heparin binding epidermal growth factor-like growth factor | diphtheria toxin receptor (heparin-binding epidermal growth factor-like growth factor), heparin binding epidermal growth factor-like growth factor |
| 3188 | 1720 | NM_012943 | cc | distal-less homeo box 5, distal-less homeobox 5 | |
| 3334 | 24105 | NM_017141 | a | DNA polymerase beta, polymerase (DNA directed), beta | *Mus musculus*, Similar to DNA polymerase beta, clone MGC:6386 IMAGE:3581916, mRNA, complete cds, polymerase (DNA directed), beta |
| 3334 | 24107 | NM_017141 | d, g | DNA polymerase beta, polymerase (DNA directed), beta | *Mus musculus*, Similar to DNA polymerase beta, clone MGC:6386 IMAGE:3581916, mRNA, complete cds, polymerase (DNA directed), beta |
| 13 | 1599 | AA686470 | General | DNA-damage inducible transcript 3, DNA-damage-inducible transcript 3 | DNA-damage-inducible transcript 3, ESTs, Highly similar to GROWTH ARREST AND DNA-DAMAGE-INDUCIBLE PROTEIN GADD153 [*M. musculus*], ESTs, Weakly similar to 1916411A TLS-CHOP protein [*H. sapiens*] |
| 131 | 600 | AA686470 | pp | DNA-damage inducible transcript 3, DNA-damage-inducible transcript 3 | DNA-damage inducible transcript 3, DNA-damage-inducible transcript 3, ESTs, Highly similar to GROWTH ARREST AND DNA-DAMAGE-INDUCIBLE PROTEIN GADD153 [*M. musculus*], ESTs, Weakly similar to 1916411A TLS-CHOP protein [*H. sapiens*] |
| 3654 | 1598 | NM_024134 | f, l, o, p, q, General, cc, dd, kk, ll, qq | DNA-damage inducible transcript 3, DNA-damage-inducible transcript 3 | DNA-damage inducible transcript 3, DNA-damage-inducible transcript 3, ESTs, Highly similar to GROWTH ARREST AND DNA-DAMAGE-INDUCIBLE PROTEIN GADD153 [*M. musculus*], ESTs, Weakly similar to 1916411A TLS-CHOP protein [*H. sapiens*] |
| 3931 | 18494 | NM_032079 | n, ff, pp | DnaJ (Hsp40) homolog, subfamily A, member 2 | DnaJ (Hsp40) homolog, subfamily A, member 2, DnaJ (Hsp40) homolog, subfamily B, member 11, DnaJ (Hsp40) homolog, subfamily B, member 1, ESTs, Weakly similar to DnaJ (Hsp40) homolog, subfamily A, member 2 [*Rattus norvegicus*] [*R. norvegicus*], RIKEN cDNA 2810451A06 gene, RIKEN cDNA 5730496F10 gene, expressed sequence AI506245 |
| 2880 | 18686 | D00729 | o, ff, jj | dodecenoyl-Coenzyme A delta isomerase (3,2 trans-enoyl-Coenyme A isomerase), dodecenoyl-Coenzyme A delta | dodecenoyl-Coenzyme A delta isomerase (3,2 trans-enoyl-Coenyme A isomerase), dodecenoyl-Coenzyme A delta isomerase (3,2 trans-enoyl-Coenyme A isomerase) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3403 | 18685 | NM_017306 | o | isomerase (3,2 trans-enoyl-Coenzyme A isomerase) dodecenoyl-Coenzyme A delta isomerase (3,2 trans-enoyl-Coenyme A isomerase), dodecenoyl-Coenzyme A delta isomerase (3,2 trans-enoyl-Coenzyme A isomerase) | dodecenoyl-Coenzyme A delta isomerase (3,2 trans-enoyl-Coenyme A isomerase), dodecenoyl-Coenzyme A delta isomerase (3,2 trans-enoyl-Coenzyme A isomerase) |
| 3403 | 18687 | NM_017306 | o, ff, rr | dodecenoyl-Coenzyme A delta isomerase (3,2 trans-enoyl-Coenyme A isomerase), dodecenoyl-Coenzyme A delta isomerase (3,2 trans-enoyl-Coenzyme A isomerase) | dodecenoyl-Coenzyme A delta isomerase (3,2 trans-enoyl-Coenyme A isomerase), dodecenoyl-Coenzyme A delta isomerase (3,2 trans-enoyl-Coenzyme A isomerase) |
| 3466 | 10340 | NM_019252 | d, j, tt | dolichol-phosphate (beta-D) mannosyltransferase 2, dolichyl-phosphate mannosyltransferase polypeptide 2, regulatory subunit | dolichol-phosphate (beta-D) mannosyltransferase 2, dolichyl-phosphate mannosyltransferase polypeptide 2, regulatory subunit |
| 3333 | 492 | NM_017140 | l | dopamine receptor 3, dopamine receptor D3 | dopamine receptor 3, dopamine receptor 03 |
| 4046 | 15995 | NM_053769 | r, ff | dual specificity phosphatase 1, protein tyrosine phosphatase, non-receptor type 16 | Mus musculus, clone MGC:11703 IMAGE:3964527, mRNA, complete cds, RIKEN cDNA 2310076O10 gene, RIKEN cDNA 4930527G07 gene, dual specificity phosphatase 1, expressed sequence BB104621, protein tyrosine phosphatase, non-receptor type 16 |
| 4046 | 15996 | NM_053769 | n, ff, kk | dual specificity phosphatase 1, protein tyrosine phosphatase, non-receptor type 16 | Mus musculus, clone MGC:11703 IMAGE:3964527, mRNA, complete cds, RIKEN cDNA 2310076D10 gene, RIKEN cDNA 4930527G07 gene, dual specificity phosphatase 1, expressed sequence BB104621, protein tyrosine phosphatase, non-receptor type 16 |
| 4046 | 15997 | NM_053769 | d, n, r, w, y | dual specificity phosphatase 1, protein tyrosine phosphatase, non-receptor type 16 | Mus musculus, clone MGC:11703 IMAGE:3964527, mRNA, complete cds, RIKEN cDNA 2310076O10 gene, RIKEN cDNA 4930527G07 gene, dual specificity phosphatase 1, expressed sequence BB104621, protein tyrosine phosphatase, non-receptor type 16 |
| 4073 | 19781 | NM_053883 | q, tt | dual specificity phosphatase 6 | ESTs, Moderately similar to 2208380A protein Tyr phosphatase MKP-3 [Rattus norvegicus] [R. norvegicus], ESTs, Weakly similar to 2208380A protein Tyr phosphatase MKP-3 [Rattus norvegicus] [R. norvegicus], RIKEN cDNA 1110028K04 gene, RIKEN cDNA 2310076O10 gene, dual specificity phosphatase 6, dual specificity phosphatase 9 |
| 3141 | 24113 | NM_012791 | r | dual-specificity tyrosine-(Y)-phosphorylation regulated kinase 1A, dual-specificity tyrosine-(Y)-phosphorylation regulated kinase 1a | ESTs, Moderately similar to DYRA_RAT Dual-specificity tyrosine-phosphorylation regulated kinase 1A (Protein kinase minibrain homolog) (MNBH) (RP86) (Dual specificity YAK1-related kinase) [R. norvegicus], ESTs, Weakly similar to DYRK MOUSE DUAL-SPECIFICITY TYROSINE-(Y)-PHOSPHORYLATION REGULATED KINASE [M. musculus], Mus musculus, clone MGC:6699 IMAGE:3584001, mRNA, complete cds, dual-specificity tyrosine-(Y)-phosphorylation regulated kinase 1A, dual-specificity tyrosine (Y)-phosphorylation regulated kinase 1a |
| 3651 | 1785 | NM_024130 | x, oo | dynactin 1, dynactin 1 (p150, glued homolog, Drosophila) | ESTs, Weakly similar to dynactin 1 [Rattus norvegicus] [R. norvegicus], Mus musculus, similar to supported by EST AAI21608 (NID:g1679223) and Genscan, clone IMAGE:5361390, mRNA, partial cds, RIKEN cDNA 2410007D12 gene, RIKEN cDNA 4933405K21 gene, dynactin 1, dynactin 1 (p150, glued homolog, Drosophila) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4029 | 1120 | NM_053655 | g, n | dynamin 1-like | ESTs, Moderately similar to dynamin 2 [*Mus musculus*] [*M. musculus*], *Mus musculus*, Similar to K1AA0820 protein, clone MGC:37713 IMAGE:5066120, mRNA, complete cds, *Mus musculus*, Similar to dynamin 1-like, clone MGC:41233 IMAGE:1395338, mRNA, complete cds, dynamin 1-like, dynamin 2 |
| 3272 | 1693 | NM_013199 | e | dynamin 2 | ESTs, Highly similar to A53165 dynamin II isoform aa - rat [*R. norvegicus*], ESTs, Moderately similar to dynamin 2 [*Mus musculus*] [*M. musculus*], *Mus musculus*, Similar to K1AA0820 protein, clone MGC:37713 IMAGE:5066120, mRNA, complete cds, *Mus musculus*, Similar to dynamin 1-like, clone MGC:41233 IMAGE:1395338, mRNA, complete cds, RIKEN cDNA 1200011N24 gene, dynamin 2 |
| 3957 | 17473 | NM_053319 | pp, tt | dynein, cytoplasmic, light chain 1, dynein, cytoplasmic, light polypeptide | ESTs, Moderately similar to protein inhibitor of nitric oxide synthase [*M. musculus*], dynein, axon, light chain 4, dynein, axonemal, light polypeptide 4, dynein, cytoplasmic, light chain 1, dynein, cytoplasmic, light polypeptide |
| 3068 | 21834 | NM_012555 | x | E26 avian leukemia oncogene 1, 5' domain, v-ets erythroblastosis virus E26 oncogene homolog 1 (avian) | E26 avian leukemia oncogene 1,5'domain, ESTs, Moderately similar to A53988 transcription factor ets-1, splice form a - rat [*R. norvegicus*], *Mus musculus* ETS-domain transcription factor mRNA, complete cds, *Rattus norvegicus* ETS domain transcription factor Pet-i mRNA, complete cds, v-ets erythroblastosis virus E26 oncogene homolog 1 (avian), v-ets erythroblastosis virus E26 oncogene like (avian) |
| 3068 | 21835 | NM_012555 | y | E26 avian leukemia oncogene 1, 5'domain, v-ets erythroblastosis virus E26 oncogene homolog 1 (avian) | E26 avian leukemia oncogene 1, 5'domain, ESTs, Moderately similar to A53988 transcription factor ets-1, splice form a - rat [*R. norvegicus*], *Mus musculus* ETS-domain transcription factor mRNA, complete cds, *Rattus norvegicus* ETS domain transcription factor Pet-i mRNA, complete cds, v-ets erythroblastosis virus E26 oncogene homolog 1 (avian), v-ets erythroblastosis virus E26 oncogene like (avian) |
| 3067 | 23868 | NM_012551 | dd, oo, tt | early growth response 1 | early growth response 1, expressed sequence AI835008 |
| 3067 | 23869 | NM_012551 | oo, tt | early growth response 1 | early growth response 1, expressed sequence AI835008 |
| 3067 | 23871 | NM_012551 | tt, vv | early growth response 1 | early growth response 1, expressed sequence AI835008 |
| 3067 | 23872 | NM_012551 | dd, tt | early growth response 1 | early growth response 1, expressed sequence AI835008 |
| 3429 | 16227 | NM_019137 | gg, hh | early growth response 4 | RIKEN cDNA 4930563M09 gene, early growth response 4 |
| 2532 | 23041 | AI230130 | e | ectonucleoside triphosphate diphosphohydrolase 2 | ESTs, Weakly similar to CD39 MOUSE VASCULAR ATP-DIPHOSPHOHYDROLASE [*M. musculus*], RIKEN cDNA 201 0320H07 gene, ecto-apyrase, ectonucleoside triphosphate diphosphohydrolase 1, ectonucleoside triphosphate diphosphohydrolase 3, lysosomal apyrase-like 1 |
| 4111 | 9527 | NM_057104 | c, q, General, jj | ectonucleotide pyrophosphatase/phosphodiesterase 2, ectonucleotide pyrophosphatase/phosphodiesterase 2 (autotaxin) | ectonucleotide pyrophosphatase/phosphodiesterase 2, ectonucleotide pyrophosphatase/phosphodiesterase 2 (autotaxin) |
| 3495 | 1323 | NM_019371 | t, mm | EGL nine homolog 3 (*C. elegans*), egl nine homolog 3 (*C. elegans*) | EGL nine homolog 3 (*C. elegans*), ESTs, Moderately similar to A53770 growth factor-responsive protein, vascular smooth muscle - rat [*R. norvegicus*], ESTs, Weakly similar to A53770 growth factor-responsive protein, vascular smooth muscle - rat |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3495 | 1324 | NM_019371 | t, mm | EGL nine homolog 3 (*C. elegans*), egl nine homolog 3 (*C. elegans*) | [*R. norvegicus*], *Mus musculus*, Similar to EGL nine homolog 3 (*C. elegans*), clone MGC:36685 IMAGE:5371854, mRNA, complete cds, egl nine homolog 1 (*C. elegans*) egl nine homolog 3 (*C. elegans*) EGL nine homolog 3 (*C. elegans*), ESTs, Moderately similar to A53770 growth factor-responsive protein, vascular smooth muscle - rat [*R. norvegicus*], ESTs, Weakly similar to A53770 growth factor-responsive protein, vascular smooth muscle - rat [*R. norvegicus*], *Mus musculus*, Similar to EGL nine homolog 3 (*C. elegans*), clone MGC:36685 IMAGE:5371854, mRNA, complete cds, egl nine homolog 1 (C. elegans) |
| 2956 | 20865 | L00117 | g, w, rr | elastase 1, pancreatic | elastase 1, pancreatic |
| 3189 | 1285 | NM_012948 | r, x | emerin, emerin (Emery-Dreifuss muscular dystrophy) | emerin, emerin (Emery-Dreifuss muscular dystrophy) |
| 3599 | 20925 | NM_022594 | o | enoyl Coenzyme A hydratase 1, peroxisomal, enoyl coenzyme A hydratase 1 peroxisomal | EST Moderately similar to Peroxisomal enoyl hydratase like protein; enoyl hydratase like protein, peroxisomal [*Rattus norvegicus*] [*R. norvegicus*], enoyl Coenzyme A hydratase 1, peroxisomal, enoyl coenzyme A hydratase 1, peroxisomal |
| 2561 | 18778 | AI230982 | ww | Eph receptor B2, EphB2 | EST, Highly similar to putative protein-tyrosine kinase [*Homo sapiens*] [*H. sapiens*], Eph receptor B1, Eph receptor B2, Eph receptor B3, EphB1, expressed sequence AW456895, expressed sequence AW488255 |
| 3022 | 2465 | M59814 | ee, ww | Eph receptor B2, EphB2 | EST, Highly similar to putative protein-tyrosine kinase [*Homo sapiens*] [*H. sapiens*], Eph receptor D1, Eph receptor B2, Eph receptor B3, EphB1, expressed sequence AW456895, expressed sequence AW488255 |
| 2647 | 17907 | AI233224 | t | epidermal growth factor receptor, epidermal growth factor receptor (erythroblastic leukemia viral (v-erb-b) oncogene homolog, avian) | EST, Moderately similar to EGFR_HUMAN EPIDERMAL GROWTH FACTOR RECEPTOR PRECURSOR [*H. sapiens*], *Homo sapiens* truncated epidermal growth factor receptor (EGFR) mRNA, partial cds; alternatively spliced, epidermal growth factor receptor |
| 3155 | 338 | NM_012843 | t, ff, mm | epithelial membrane protein 1 | epithelial membrane protein 1 |
| 3156 | 17541 | NM_012844 | l, s, General, ff, ll, ww | epoxide hydrolase 1, microsomal, epoxide hydrolase 1, microsomal (xenobiotic) | epoxide hydrolase 1, microsomal, epoxide hydrolase 1, microsomal (xenobiotic) |
| 2164 | 23465 | AI171243 | ww | erythrocyte membrane protein band 4.1-like 3, erythrocyte protein band 4.1-like 3 | FERM, RhoGEF (ARHGEF) and pleckstrin domain protein 1 (chondrocyte-derived), *Homo sapiens*, Similar to erythrocyte membrane protein band 4.1-like 3, clone MGC:12343 IMAGE:4044866, mRNA, complete cds, K1AA0793 gene product, erythrocyte membrane protein band 4.1-like 3, erythrocyte protein band 4.1-like 3, erythrocyte protein band 4.1-like 4b, myosin regulatory light chain interacting protein, protein tyrosine phosphatase, non-receptor type 3 |
| 3377 | 17561 | NM_017245 | mm | eukaryotic translation elongation factor 2 | ESTs, Highly similar to EF2_RAT Elongation factor 2 (EF-2) [*R. norvegicus*], ESTs, Weakly similar to EF2_MOUSE Elongation factor 2 (EF-2) [*M. musculus*], ESTs, Weakly similar to EF2_RAT Elongation factor 2 (EF-2) [*R. norvegicus*], G elongation factor, *Mus musculus*, Similar to elongation factor G2, clone MGC:28160 IMAGE:3984129, mRNA, complete cds, U5 small nuclear ribonucleoprotein 116 kDa, U5 snRNP-specific protein, 116 kD, eukaryotic translation elongation factor 2, expressed sequence AI451340 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3377 | 17563 | NM_017245 | gg, hh | eukaryotic translation elongation factor 2 | ESTs, Highly similar to EF2_RAT Elongation factor 2 (EF-2) [R. norvegicus], ESTs, Weakly similar to EF2_MOUSE Elongation factor 2 (EF-2) [M. musculus], ESTs, Weakly similar to EF2_RAT Elongation factor 2 (EF-2) [R. norvegicus], G elongation factor, Mus musculus, Similar to elongation factor G2, clone MGC:28160 IMAGE:3984129, mRNA, complete cds, U5 small nuclear ribonucleoprotein 116 kDa, U5 snRNP-specific protein, 116 kD, eukaryotic translation elongation factor 2, expressed sequence AI451340 |
| 3377 | 17562 | NM_017245 | h, t, mt | eukaryotic translation elongation factor 2, mitogen activated protein kinase kinase 2, mitogen-activated protein kinase kinase 2 | ESTs, Highly similar to EF2_RAT Elongation factor 2 (EF-2) [R. norvegicus], ESTs, Weakly similar to EF2_MOUSE Elongation factor 2 (EF-2) [M. musculus], ESTs, Weakly similar to EF2_RAT Elongation factor 2 (EF-2) [R. norvegicus], G elongation factor, Mus musculus, Similar to elongation factor G2, clone MGC:28160 IMAGE:3984129, mRNA, complete cds, U5 small nuclear ribonucleoprotein 116 kDa, U5 snRNP-specific protein, 116 kD, eukaryotic translation elongation factor 2, expressed protein kinase kinase 2 |
| 4164 | 17560 | NM_133283 | e, t, mm | eukaryotic translation elongation factor 2, mitogen activated protein kinase kinase 2, mitogen-activated protein kinase kinase 2 | |
| 3828 | 14295 | NM_031599 | f, l, pp | eukaryotic translation initiation factor 2 alpha kinase 3 eukaryotic translation initiation factor 2-alpha kinase 3 | EST Weakly similar to eukaryotic translation initiation factor 2 alpha kinase 3 [Rattus norvegicus] [R. norvegicus], eukaryotic translation initiation factor 2 alpha kinase 3, eukaryotic translation initiation factor 2 alpha kinase 4, eukaryotic translation initiation factor 2-alpha kinase 3 |
| 2090 | 23152 | AI169170 | xx | eukaryotic translation initiation factor 4A, isoform 2 | ESTs, Weakly similar to EUKARYOTIC INITIATION FACTOR 4A-II [M. musculus], eukaryotic translation initiation factor 4A, isoform 2 |
| 3509 | 18714 | NM_020075 | y | eukaryotic translation initiation factor 5 | DNA segment, Chr 1, ERATO Doi 692, expressed, ESTs, Highly similar to EUKARYOTIC TRANSLATION INITIATION FACTOR 5 [R. norvegicus], KIAA1856 protein, eukaryotic translation initiation factor 5 |
| 3509 | 18715 | NM_020075 | l | eukaryotic translation initiation factor 5 | DNA segment, Chr 1, ERATO Doi 692, expressed, ESTs, Highly similar to EUKARYOTIC TRANSLATION INITIATION FACTOR 5 [R. norvegicus], KIAA1856 protein, eukaryotic translation initiation factor 5 |
| 3509 | 18716 | NM_020075 | p, gg, hh | eukaryotic translation initiation factor 5 | DNA segment, Chr 1, ERATO Doi 692, expressed, ESTs, Highly similar to EUKARYOTIC TRANSLATION INITIATION FACTOR 5 [R. norvegicus], KIAA1856 protein, eukaryotic translation initiation factor 5 |
| 3458 | 16449 | NM_019238 | jj | farnesyl diphosphate farnesyl transferase 1, farnesyl-diphosphate farnesyltransferase 1 | farnesyl diphosphate farnesyl transferase 1, farnesyl-diphosphate farnesyltransferase 1 |
| 3458 | 16450 | NM_019238 | jj, oo, ss | farnesyl diphosphate farnesyl transferase 1, farnesyl-diphosphate farnesyltransferase 1 | farnesyl diphosphate farnesyl transferase 1, farnesyl-diphosphate farnesyltransferase 1 |
| 3458 | 16451 | NM_019238 | bb, jj | farnesyl diphosphate farnesyl transferase 1, farnesyl-diphosphate farnesyltransferase 1 | farnesyl diphosphate farnesyl transferase 1, farnesyl-diphosphate farnesyltransferase 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3458 | 16452 | NM_019238 | jj | farnesyl diphosphate farnesyl transferase 1, farnesyl-diphosphate farnesyltransferase 1 | farnesyl diphosphate farnesyl transferase 1, farnesyl-diphosphate farnesyltransferase 1 |
| 3910 | 15069 | NM_031840 | k, s, jj | farnesyl diphosphate synthase (farnesyl pyrophosphate synthetase, dimethylallyltranstransferase geranyltranstransferase) farnesyl diphosphate synthetase | ESTs, Moderately similar to A34713 farnesyl pyrophosphate synthetase, testis - rat [*R. norvegicus*], ESTs, Weakly similar to A34713 farnesyl-pyrophosphate synthetase, testis - rat [*R. norvegicus*], farnesyl diphosphate synthase (farnesyl pyrophosphate synthetase, dimethylallyltranstransferase, |
| 3910 | 15070 | NM_031840 | ii, jj, rr | farnesyl diphosphate synthase (farnesyl pyrophosphate synthetase, dimethylallyltranstransferase, geranyltranstransferase), farnesyl diphosphate synthetase | ESTs, Moderately similar to A34713 farnesyl pyrophosphate synthetase, testis - rat [*R. norvegicus*], ESTs, Weakly similar to A34713 farnesyl-pyrophosphate synthetase, testis - rat [*R. norvegicus*], farnesyl diphosphate synthase (farnesyl pyrophosphate synthetase, dimethylallyltranstransferase, geranyltranstransferase) |
| 3910 | 25460 | NM_031840 | k, jj | farnesyl diphosphate synthase (farnesyl pyrophosphate synthetase, dimethylallyltranstransferase, geranyltranstransferase), farnesyl diphosphate synthetase | ESTs, Moderately similar to A34713 farnesyl pyrophosphate synthetase, testis - rat [*R. norvegicus*], ESTs, Weakly similar to A34713 farnesyl-pyrophosphate synthetase, testis - rat [*R. norvegicus*], farnesyl diphosphate synthase (farnesyl pyrophosphate synthetase, dimethylallyltranstransferase, geranyltranstransferase) |
| 3158 | 20819 | NM_012847 | vv | farnesyltransferase, CAAX box, alpha | farnesyltransferase, CAAX box, alpha |
| 4148 | 8167 | NM_130406 | q, ll | Fas (TNFRSF6) associated factor 1, Fas-associated factor 1 | DNA segment, Human S2298E, Fas (TNFRSF6) associated factor 1, Fas-associated factor 1, RIKEN cDNA 1300013G12 gene, RIKEN cDNA 4930455J02 gene, expressed sequence AI196514, reproduction 8 |
| 3653 | 851 | NM_024132 | c, kk | fatty acid amide hydrolase, fatty acid hydroxylase | RIKEN cDNA 2700038P16 gene, fatty acid amide hydrolase |
| 3069 | 17676 | NM_012556 | g, j | fatty acid binding protein 1, liver | fatty acid binding protein 1, liver |
| 2299 | 16477 | AI176701 | jj | fatty acid binding protein 3, muscle and heart, fatty acid binding protein 3, muscle and heart (mammary-derived growth inhibitor) | EST, Moderately similar to FABH MOUSE FATTY ACID-BINDING PROTEIN, HEART [*M. musculus*], fatty acid binding protein 3, muscle and heart, fatty acid binding protein 3, muscle and heart (mammary-derived growth inhibitor) |
| 704 | 20986 | M893242 | o | fatty acid Coenzyme A ligase, long chain 2, fatty-acid-Coenzyme A ligase, long-chain 2 | ESTs, Weakly similar to fatty acid Coenzyme A ligase, long chain 2; acetyl-Coenzyme A synthetase; acetate-CoA ligase; acetyl-Coenzyme A synthetase I (ADP forming); acetyl-CoA synthetase [*Mus musculus*] [*M. musculus*], *Mus musculus*, Similar to fatty-acid-Coenzyme A ligase, long-chain 6, clone MGC:28744 IMAGE:4481949, mRNA, complete cds, *Mus musculus*, Similar to hypothetical protein FLJ20920, clone MGC:25878 IMAGE:4210220, mRNA, complete cds, fatty acid Coenzyme A ligase, long chain 2, fatty acid Coenzyme A ligase, long chain 5, fatty-acid-Coenzyme A ligase, long-chain 1, gonadotropin-regulated long chain acyl-CoA synthetase, lipidosis-related protein lipidosin |
| 1596 | 20983 | AI044900 | o, v | fatty acid Coenzyme A ligase, long chain 2, fatty-acid-Coenzyme A ligase, long-chain 2 | ESTs, Weakly similar to fatty acid Coenzyme A ligase, long chain 2; acetyl-Coenzyme A synthetase; acetate-CoA ligase; acetyl-Coenzyme A synthetase 1 (ADP forming); acetyl-CoA synthetase [*Mus musculus*] [*M. musculus*], *Mus musculus*, Similar to fatty-acid-Coenzyme A ligase, long-chain 6, clone MGC:28744 IMAGE:4481949, mRNA, complete cds, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2901 | 20984 | D90109 | o, gg, hh, oo, uu | fatty acid Coenzyme A ligase, long chain 2, fatty-acid-Coenzyme A ligase, long-chain 2 | Mus musculus, Similar to hypothetical protein FLJ20920, clone MGC:25878 IMAGE:4210220, mRNA, complete cds, fatty acid Coenzyme A ligase, long chain 2, fatty acid Coenzyme A ligase, long chain 5, fatty-acid-Coenzyme A ligase, long-chain 1, gonadotropin-regulated long chain acyl-CoA synthetase, lipidosis-related protein lipidosin ESTs, Weakly similar to fatty acid Coenzyme A ligase, long chain 2; acetyl-Coenzyme A synthetase; acetate-CoA ligase; acetyl-Coenzyme A synthetase 1 (ADP forming); acetyl-CoA synthetase [Mus musculus] [M. musculus], Mus musculus, Similar to fatty-acid-Coenzyme A ligase, long-chain 6, clone MGC:28744 IMAGE:4481949, mRNA, complete cds, Mus musculus, Similar to hypothetical protein FLJ20920, clone MGC:25878 IMAGE:4210220, mRNA, complete cds, fatty acid Coenzyme A ligase, long chain 2, fatty acid Coenzyme A ligase, long chain 5, fatty-acid-Coenzyme A ligase, long-chain 1, gonadotropin-regulated long chain acyl-CoA synthetase, lipidosis-related protein lipidosin |
| 4113 | 3743 | NM_057107 | nn | fatty acid Coenzyme A ligase, long chain 3, fatty-acid-Coenzyme A ligase, long-chain 3 | fatty acid Coenzyme A ligase, long chain 3, fatty-acid-Coenzyme A ligase, long-chain 3 |
| 4016 | 15925 | NM_053607 | m | fatty acid Coenzyme A ligase, long chain 5, fatty-acid-Coenzyme A ligase, long-chain 5 | ESTs, Weakly similar to fatty acid Coenzyme A ligase, long chain 2; acetyl-Coenzyme A synthetase; acetate-CoA ligase; acetyl-Coenzyme A synthetase 1 (ADP forming); acetyl-CoA synthetase [Mus musculus] [M. musculus], Mus musculus, Similar to fatty-acid-Coenzyme A ligase, long-chain 6, clone MGC:28744 IMAGE:4481949, mRNA, complete cds, Mus musculus, Similar to hypothetical protein FLJ20920, clone MGC:25878 IMAGE:421 0220, mRNA, complete cds, fatty acid Coenzyme A ligase, long chain 2, fatty acid Coenzyme A ligase, long chain 5, fatty-acid-Coenzyme A ligase, long-chain 5, hypothetical protein PRTD NX3 |
| 4022 | 13005 | NM_053623 | a | fatty acid-Coenzyme A ligase, long chain 4, fatty-acid-Coenzyme A ligase, long-chain 4 | |
| 2264 | 10182 | AI176185 | tt | FBJ osteosarcoma oncogene, v-fos FBJ murine osteosarcoma viral oncogene homolog | FBJ murine osteosarcoma viral oncogene homolog B, FBJ osteosarcoma oncogene, FBJ osteosarcoma oncogene B, v-fos FBJ murine osteosarcoma viral oncogene homolog |
| 4066 | 20868 | NM_053843 | y, xx | Fc fragment of IgG, low affinity IIIa, receptor for (CD16), Fc receptor, IgG, low affinity III | |
| 3944 | 12363 | NM_033351 | oo | Fc fragment of IgG, receptor, transporter, alpha, Fc receptor, IgG, alpha chain transporter | Fc fragment of IgG, receptor, transporter, alpha, Fc receptor, IgG, alpha chain transporter |
| 3944 | 12364 | NM_033351 | o | Fc fragment of IgG, receptor, transporter, alpha, Fc receptor, IgG, alpha chain transporter | Fc fragment of IgG, receptor, transporter, alpha, Fc receptor, IgG, alpha chain transporter |
| 3327 | 21663 | NM_017126 | l, pp | ferredoxin 1 | ferredoxin 1, similar to RIKEN cDNA B230118G17 gene |
| 3573 | 8214 | NM_022500 | f, n | ferritin light chain 1, ferritin, light polypeptide | ESTs, Moderately similar to ferritin light chain 1 [Rattus norvegicus] [R. norvegicus], ESTs, Moderately similar to FRL2 MOUSE FERRITIN LIGHT CHAIN 2 [M. musculus], RIKEN cDNA 4933416E14 gene, ferritin light chain 1, ferritin light chain 2, ferritin, light polypeptide |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4333 | 8210 | 361960 | e | ferritin light chain 1, ferritin, light polypeptide | ESTs, Moderately similar to ferritin light chain 1 [*Rattus norvegicus*] [*R. norvegicus*], ESTs, Moderately similar to FRL2 MOUSE FERRITIN LIGHT CHAIN 2 [*M. musculus*], RIKEN cDNA 4933416E14 gene, ferritin light chain 1, ferritin light chain 2, ferritin, light polypeptide |
| 3965 | 14042 | NM_053348 | cc | fetuin B, fetuin beta | expressed sequence AW413091, fetuin B, fetuin beta, histidine-rich glycoprotein |
| 3016 | 20699 | M35601 | vv | fibrinogen, A alpha polypeptide, fibrinogen, alpha polypeptide | |
| 3016 | 20700 | M35601 | a, r, x, vv | fibrinogen, A alpha polypeptide, fibrinogen, alpha polypeptide | |
| 2112 | 6479 | AI169690 | h, l, q | fibrinogen, gamma polypeptide | |
| 3071 | 6477 | NM_012559 | dd | fibrinogen, gamma polypeptide | |
| 3157 | 644 | NM_012846 | kk | fibroblast growth factor 1, fibroblast growth factor 1 (acidic) | fibroblast growth factor 1, fibroblast growth factor 1 (acidic) |
| 3039 | 13488 | M91 599 | g, General, uu | fibroblast growth factor receptor 4 | |
| 2957 | 5616 | L00191 | j | fibronectin 1 | EST, Highly similar to FIBRONECTIN PRECURSOR [*R. norvegicus*], ESTs, Weakly similar to PROTEIN-TYROSINE PHOSPHATASE ETA PRECURSOR [*M. musculus*], fibronectin 1 |
| 3433 | 5617 | NM_019143 | k | fibronectin 1 | EST Highly similar to FIBRONECTIN PRECURSOR [*R. norvegicus*], ESTs, Weakly similar to PROTEIN-TYROSINE PHOSPHATASE ETA PRECURSOR *M. musculus* fibronectin 1 |
| 3433 | 5618 | NM_019143 | k | fibronectin 1 | EST, Highly similar to FIBRONECTIN PRECURSOR [*R. norvegicus*], ESTs, Weakly similar to PROTEIN-TYROSINE PHOSPHATASE ETA PRECURSOR *M. musculus* fibronectin 1 |
| 3433 | 5619 | NM_019143 | General | fibronectin 1 | EST, Highly similar to FIBRONECTIN PRECURSOR [*R. norvegicus*], ESTs, Weakly similar to PROTEIN-TYROSINE PHOSPHATASE ETA PRECURSOR [*M. musculuS*], fibronectin 1 |
| 3433 | 5622 | NM_019143 | l, ii | fibronectin 1 | EST, Highly similar to FIBRONECTIN PRECURSOR [*R. norvegicus*], ESTs, Weakly similar to PROTEIN-TYROSINE PHOSPHATASE ETA PRECURSOR [*M. musculus*], fibronectin 1 |
| 4326 | 5624 | R47122 | bb, cc | fibronectin 1 | EST, Highly similar to FIBRONECTIN PRECURSOR [*R. norvegicus*], ESTs, Weakly similar to PROTEIN-TYROSINE PHOSPHATASE ETA PRECURSOR [*M. musculus*], fibronectin 1 |
| 4450 | 20821 | X62671 | ll | Finkel-Biskis-Reilly murine sarcoma virus (FBR-MuSV) ubiquitously expressed (fox derived), Finkel-Biskis-Reilly murine sarcoma virus (FBR-MuSV) ubiquitously expressed (fox derived); ribosomal protein S30 | EST, Moderately similar to 148346 ribosomal protein fau - mouse [*M. musculus*], EST, Weakly similar to UBIM_HUMAN UBIQUITIN-LIKE PROTEIN FUBI {SUB 1-74 [*H. sapiens*], EST, Weakly similar to UBIMRAT UBIQUITIN-LIKE PROTEIN FUBI [*R. norvegicus*], Finkel-Biskis-Reilly murine sarcoma virus (FBR-MuSV) ubiquitously expressed (fox derived) |
| 3239 | 15296 | NM_013102 | k | FK506 binding protein 1A (12 kD), FK506 binding protein 1a (12 kDa), FK506 binding protein 2(13 kDa), FK506 binding protein 2 (13 kD) | FK506 binding protein 10 (65 kDa), FK506 binding protein 1A (12 kD), FK506 binding protein 1a (12 kDa), FK506 binding protein 5, FK506 binding protein 7(23 kDa), FK506 binding protein 8 (38 kDa) |
| 3621 | 24344 | NM_022701 | pp | flotillin 1 | flotillin 1 |
| 3072 | 11732 | NM_012561 | p | follistatin | follistatin, transmembrane protein with EGE-like and two follistatin-like domains 1 |
| 3131 | 1260 | NM_012743 | d | forkhead box A2, hepatocyte nuclear factor 3, beta | |
| 3314 | 1262 | NM_017077 | c, v, rr, xx | forkhead box A3 hepatocyte nuclear factor 3 gamma | ESTs, Weakly similar to HN3G_RAT HEPATOCYTE NUCLEAR FACTOR 3-GAMMA (HNF-3G) [*R. norvegicus*], RIKEN |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | cDNA 1200010K03 gene, expressed sequence AI450827, forkhead box A3, forkhead box B1, hepatocyte nuclear factor 3. gamma |
| 3843 | 906 | NM_031633 | ss | forkhead box M1 | |
| 3190 | 1813 | NM_012953 | l, p, y, z, ee | FOS-like antigen 1, fos-like antigen 1 | ESTs, Moderately similar to S15750 transforming protein [*H. sapiens*], FOS-like antigen 1, fos-like antiqen 1 |
| 3854 | 18403 | NM_031677 | r | four and a half LIM domains 2 | EST, Weakly similar to four and a half LIM domains 2 [*Rattus norvegicus*] [*R. norvegicus*], activator of CREM in testis, four and a half LIM domains 2, four and a half LIM domains 3, vascular Rab-GAP/TBC containing |
| 3970 | 3844 | NM_053371 | j | fracture callus 1 homolog (rat), fractured callus expressed transcript 1 | EST, Moderately similar to IM9B_HUMAN MITOCHONDRIAL IMPORT INNER MEMBRANE TRANSLOCASE SUBUNIT TIM9 B (FRACTURE CALLUS PROTEIN 1) (FXC1) [*H. sapiens*], fracture callus 1 homolog (rat), fractured callus expressed transcript 1 |
| 3290 | 15620 | NM_017005 | p | fumarate hydratase, fumarate hydratase 1 | fumarate hydratase, fumarate hydratase 1 |
| 3354 | 23961 | NM_017181 | b, uu, vv | fumarylacetoacetate hydrolase, fumarylacetoacetate hydrolase (fumarylacetoacetase) | ESTs, Weakly similar to FAAA_RAT Fumarylacetoacetase (Fumarylacetoacetate hydrolase) (Beta-diketonase) (FAA) [*R. norvegicus*], fumarylacetoacetate hydrolase, fumarylacetoacetate hydrolase (fumarylacetoacetase) |
| 3847 | 18368 | NM_031648 | k | FXYD domain containing ion transport regulator 1 (phospholemman), FXYD domain-containing ion transport regulator 1 | EST, Weakly similar to PLM_HUMAN PHOSPHOLEMMAN PRECURSOR [*H. sapiens*], FXYD domain containing ion transport regulator 1 (phospholemman), FXYD domain-containing ion transport regulator 1, FXYD domain-containing ion transport regulator 6 |
| 3847 | 18369 | NM_031648 | s | FXYD domain containing ion transport regulator 1 (phospholemman), FXYD domain-containing ion transport regulator 1 | EST, Weakly similar to PLM_HUMAN PHOSPHOLEMMAN PRECURSOR [*H. sapiens*], FXYD domain containing ion transport regulator 1 (phospholemman), FXYD domain-containing ion transport regulator 1, FXYD domain-containing ion transport rengulator 6 |
| 3540 | 23151 | NM_022005 | e | FXYD domain-containing ion transport regulator 6 | |
| 3849 | 866 | NM_031657 | gg, hh, pp | G protein-coupled receptor kinase 6 | ESTs, Weakly similar to GRK6 MOUSE G PROTEIN-COUPLED RECEPTOR KINASE GRK6 [*M. musculus*], G protein-coupled receptor kinase 6, adrenergic receptor kinase, beta 1 |
| 656 | 23180 | AA892649 | j, l, General, cc | GABA(A) receptor-associated protein, gamma-aminobutyric acid receptor associated protein | ESTs, Weakly similar to GABA(A) receptor-associated protein like 2; ganglioside expression factor 2 [*Rattus norvegicus*] [*R. norvegicus*], GABA(A) receptor-associated protein, GABA(A) receptor-associated protein like 1, GABA(A) receptor-associated protein like 2, GABA(A) receptor-associated protein-like 2, GABA(A) receptors associated protein like 3, gamma-aminobutyric acid (GABA(A)) receptor-associated protein-like 1 |
| 4138 | 25693 | NM_080783 | jj, xx | galactose-4-epimerase, UDP, galactose-4-epimerase, UDP- | EST, Moderately similar to UDP-GLUCOSE 4-EPIMERASE [*R. norvegicus*], RIKEN cDNA 2610025M23 gene, UDP-glucuronate decarboxylase 1, galactose-4-epimerase, UDP, galactose-4-epimerase, UDP- |
| 3720 | 15805 | NM_031028 | g | gamma-aminobutyric acid (GABA) B receptor, 1, gamma-aminobutyric acid (GABA-B) receptor, 1 | |
| 3720 | 15807 | NM_031028 | s | gamma-aminobutyric acid (GABA) B receptor, 1, gamma-aminobutyric acid (GABA-B) receptor, 1 | |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3881 | 11611 | NM_031756 | w | gamma-glutamyl carboxylase | gamma-glutamyl carboxylase |
| 3380 | 614 | NM_017251 | General, rr, uu | gap junction membrane channel protein beta 1, gap junction protein, beta 1, 32 kD (connexin 32, Charcot-Marie-Tooth neuropathy, X-linked) | RIKEN cDNA D230044M03 gene, gap junction protein, beta 1, 32 kD (connexin 32, Charcot-Marie-Tooth neuropathy, X-linked) |
| 3459 | 5661 | NM_019241 | u | gap junction membrane channel protein beta 5, gap junction protein, beta 5 (connexin 31.1) | |
| 2974 | 15073 | L22761 | ww | GATA binding protein 4 | GATA binding protein 4, GATA binding protein 5, trichorhinophalangeal syndrome I, trichorhinophalangeal syndrome I (human) |
| 1902 | 18679 | AI103496 | bb | GDP dissociation inhibitor 1 guanosine diphosphate (GDP) dissociation inhibitor 1 | GDP dissociation inhibitor 1, guanosine diphosphate (GDP) dissociation inhibitor 2 |
| 3318 | 1383 | NM_017088 | General | GDP dissociation inhibitor 1 guanosine diphosphate (GDP) dissociation inhibitor 1 | GDP dissociation inhibitor 1, guanosine diphosphate (GDP) dissociation inhibitor 2 |
| 3964 | 18949 | NM_053345 | f | general transcription factor II A, 2 (12 kD subunit), general transcription factor IIA, 2 (12 kD subunit) | general transcription factor II A, 2 (12 kD subunit), general transcription factor IIA, 2 (12 kD subunit) |
| 3721 | 626 | NM_031032 | b, h, m, s, x, General, dd, oo | glia maturation factor, beta | glia maturation factor, beta |
| 3430 | 13715 | NM_019139 | gg, hh | glial cell derived neurotrophic factor, glial cell line derived neurotrophic factor | glial cell derived neurotrophic factor, glial cell line derived neurotrophic factor, neurturin |
| 3044 | 1678 | M96674 | l, General, nn, pp | glucagon receptor | ESTs, Weakly similar to GLUCAGON RECEPTOR PRECURSOR [*M. musculus*], glucagon receptor |
| 307 | 3619 | NM_012565 | h, r, kk | glucokinase, glucokinase (hexokinase 4, maturity onset diabetes of the young 2) | |
| 3824 | 5496 | NM_031589 | e, k, l, m, General, dd, qq, ss | glucose-6-phosphatase, transport (glucose-6-phosphate) protein 1, glucose-6-phosphatase, transport protein 1 | *Mus musculus*, Similar to solute carrier family 37 (glycerol-3-phosphate transporter), member 1, clone MGC:28167 IMAGE:3985469, mRNA, complete cds, glucose-6-phosphatase, transport (glucose-6-phosphate) protein 1, glucose-6-phosphatase, transport protein 1, solute carrier family 37 (glycerol-3-phosphate transporter), member 1 |
| 3824 | 5497 | NM_031589 | a, k, l, qq | glucose-6-phosphatase, transport (glucose-6-phosphate) protein 1, glucose-6-phosphatase, transport protein 1 | *Mus musculus*, Similar to solute carrier family 37 (glycerol-3-phosphate transporter), member 1, clone MGC:28167 IMAGE:3985469, mRNA, complete cds, glucose-6-phosphatase, transport (glucose 6-phosphate) protein 1, glucose-6-phosphatase, transport protein 1, solute carrier family 37 (glycerol-3-phosphate transporter) member 1 |
| 3075 | 4573 | NM_012570 | l, General | glutamate dehydrogenase, glutamate dehydrogenase 1 | glutamate dehydrogenase, glutamate dehydrogenase 1 |
| 3075 | 4574 | NM_012570 | h, l, p, General, dd, ii, uu | glutamate dehydrogenase, glutamate dehydrogenase 1 | glutamate dehydrogenase, glutamate dehydrogenase 1 |
| 3076 | 20744 | NM_012571 | e, ll, oo | glutamate oxaloacetate transaminase 1, soluble, glutamic-oxaloacetic transaminase 1, soluble (aspartate aminotransferase 1) | |
| 3077 | 85 | NM_012572 | c | glutamate receptor, ionotropic, kainate 4 | ESTs, Highly similar to GLK4_HUMAN GLUTAMATE RECEPTOR, IONOTROPIC KAINATE 4 PRECURSOR [*H. sapiens*], glutamate receptor, ionotropic, kainate 5 (gamma 2) |
| 3078 | 24504 | NM_012574 | k | glutamate receptor, ionotropic, N-methyl D-aspartate 2B, glutamate receptor, ionotropic, NMDA2B (epsilon 2) | glutamate receptor, ionotropic, N-methyl D-aspartate 2B |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3311 | 11152 | NM_017073 | q, z | glutamate-ammonia ligase (glutamine synthase), glutamine synthetase | |
| 3311 | 11153 | NM_017073 | q, r, s, z, rr | glutamate-ammonia ligase (glutamine synthase), glutamine synthetase | |
| 3402 | 14002 | NM_017305 | qq | glutamate-cysteine ligase, modifier subunit, glutamate-cysteine ligase, modifier subunit | glutamate-cysteine ligase, modifier subunit, glutamate-cysteine ligase, modifier subunit |
| 3402 | 14003 | NM_017305 | qq, vv | glutamate-cysteine ligase, modifier subunit, glutamate-cysteine ligase, modifier subunit | glutamate-cysteine ligase, modifier subunit, glutamate-cysteine ligase, modifier subunit |
| 2947 | 1247 | J05181 | vv | glutamate-cysteine ligase, catalytic subunit | *Homo sapiens*, Similar to glutamate-cysteine ligase, catalytic subunit, clone MGC:26341 IMAGE:4814728, mRNA, complete cds, glutamate-cysteine ligase, catalytic subunit |
| 3074 | 20717 | NM_012569 | c | glutaminase | ESTs, Highly similar to GLSK_RAT GLUTAMINASE, KIDNEY ISOFORM PRECURSOR [*R. norvegicus*], ESTs, Moderately similar to GLSK_HUMAN GLUTAMINASE, KIDNEY ISOFORM, MITOCHONDRIAL PRECURSOR (GLS) (L-GLUTAMINE AMIDOHYDROLASE) (K-GLUTAMINASE) [*H. sapiens*], *Homo sapiens* glutaminase isoform M precursor, mRNA, complete cds, expressed sequence AI314027 glutaminase |
| 231 | 5331 | AA818996 | ii, rr | glutaminyl-tRNA synthetase | glutaminyl-tRNA synthetase |
| 1967 | 23596 | AI105435 | uu, vv | glutaryl-Coenzyme A dehydrogenase | expressed sequence AI266902, expressed sequence D17825, glutaryl-Coenzyme A dehydrogenase |
| 3689 | 1853 | NM_030826 | g | glutathione peroxidase 1 | ESTs, Weakly similar to GSHC_RAT Glutathione peroxidase (GSHPX-1) (Cellular glutathione peroxidase) [*R. norvegicus*], glutathione peroxidase 1, glutathione peroxidase 2, glutathione peroxidase 2 (gastrointestinal) |
| 3347 | 17686 | NM_017165 | o | glutathione peroxidase 4, glutathione peroxidase 4 (phospholipid hydroperoxidase) | ESTs, Weakly similar to GSHH_RAT Phospholipid hydroperoxide glutathione peroxidase, mitochondrial precursor (PHGPx) (GPX-4) [*R. norvegicus*], RIKEN cDNA 2310016016 gene, RIKEN cDNA 3110050F08 gene, glutathione peroxidase 4, glutathione peroxidase 4 (phospholipid hydroperoxidase) |
| 3292 | 18989 | NM_017013 | qq, vv | glutathione S-transferase A2, glutathione S-transferase, alpha 2 (Yc2) | ESTs, Weakly similar to GTA1_RAT GLUTATHIONE S-TRANSFERASE YA (LIGANDIN) (CHAIN 1) (GST CLASS-ALPHA) (CLONES PGST94 & PGTR261) [*R. norvegicus*], glutathione S-transferase A2, glutathione S-transferase, alpha 2 (Yc2) |
| 3796 | 18990 | NM_031509 | e | glutathione 5-transferase A2, ESTs, glutathione S-transferase, alpha 2 (Yc2) | Weakly similar to GTA1_RAT GLUTATHIONE S-TRANSFERASE YA (LIGANDIN) (CHAIN 1) (GST CLASS-ALPHA) (CLONES PGST94 & PGTR261) [*R. norvegicus*], glutathione S-transferase A2, glutathione S-transferase, alpha 2 (Yc2) |
| 2926 | 21011 | H32189 | nn | glutathione S-transferase M2 (muscle), glutathione 5-transferase, mu 2 | |
| 2942 | 21012 | J02592 | b, l, General, gg, hh, kk, ll | glutathione S-transferase M2 (muscle), glutathione S-transferase, mu 2 | |
| 2945 | 21014 | J03914 | b, l, o, x, General, ll, rr | glutathione S-transferase M2 (muscle), glutathione S-transferase, mu 2 | |
| 3293 | 21013 | NM_017014 | cc | glutathione S-transferase M2 (muscle), glutathione S-transferase, mu 2 | |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3293 | 21015 | NM_017014 | s, cc | glutathione S-transferase M2 (muscle), glutathione S-transferase, mu 2 | |
| 1246 | 14583 | AB008807 | dd, uu | glutathione S-transferase omega I glutathione-S-transferase like glutathione transferase omega | ESTs, Weakly similar to GTO1_RAT Glutathione transferase omega 1 (GSTO 1-1) (Glutathione-dependent dehydroascorbate reductase) [*R. norvegicus*], ESTs, Weakly similar to GTXH_HUMAN GLUTATHIONE-S-TRANSFERASE HOMOLO [*H. sapiens*], RIKEN cDNA 1700020F09 gene, glutathione S-transferase omega 1, glutathione transferase zeta 1 (maleylacetoacetate isomerase), glutathione S-transferase like; glutathione transferase omega |
| 1246 | 25148 | AB008807 | bb | glutathione S-transferase omega 1, glutathione-S-transferase like; glutathione transferase omega | |
| 3953 | 1524 | NM_053293 | General | glutathione S-transferase theta 1, glutathione S-transferase, theta 1 | expressed sequence AI118089, glutathione S-transferase theta 1, glutathione S-transferase, theta 1 |
| 3143 | 961 | NM_012796 | p | glutathione S-transferase theta 2, glutathione S-transferase, theta 2 | glutathione S-transferase theta 2, glutathione S-transferase, theta 2 |
| 2980 | 6406 | L38615 | v | glutathione synthetase | EST, Highly similar to GSHB MOUSE GLUTATHIONE SYNTHETASE [*M. musculus*], glutathione synthetase |
| 3291 | 8417 | NM_017008 | l | glyceraldehyde-3-phosphate dehydrogenase | ESTs, Moderately similar to G3P MOUSE GLYCERALDEHYDE 3-PHOSPHATE DEHYDROGENASE [*M. musculus*], *Mus musculus* 12 days embryo head cDNA, RIKEN full-length enriched library, clone:3000002C10:glyceraldehyde-3-phosphate dehydrogenase, full insert sequence, RIKEN cDNA 4930448K20 gene, glyceraldehyde-3-phosphate dehydrogenase |
| 3673 | 20380 | NM_024381 | o | glycerol kinase | ESTs, Weakly similar to GLPK MOUSE GLYCEROL KINASE [*M.musculus*], RIKEN cDNA 2310009E04 gene, glucokinase activity, related sequence 1, glucokinase activity, related sequence 2, glycerol kinase, glycerol kinase pseudogene 2 |
| 3317 | 1550 | NM_017084 | uu | glycine N-methyltransferase | glycine N-methyltransferase |
| 3317 | 1551 | NM_017084 | uu | glycine N-methyltransferase | glycine N-methyltransferase |
| 3317 | 1552 | NM_017084 | g, uu | glycine N-methyltransferase | glycine N-methyltransferase |
| 4058 | 16311 | NM_053818 | j | glycine transporter 1, solute carrier family 6 (neurotransmitter transporter, glycine), member 9 | |
| 3932 | 590 | NM_032080 | b, c, m, kk | glycogen synthase kinase 3 beta | RIKEN cDNA 9130221H12 gene, glycogen synthase kinase 3 beta |
| 3932 | 591 | NM_032080 | b, c, l, z, General, tt, vv | glycogen synthase kinase 3 beta | RIKEN cDNA 9130221H12 gene, glycogen synthase kinase 3 beta |
| 4167 | 19456 | NM_133298 | l, cc, qq, uu | glycoprotein (transmembrane) nmb | glycoprotein (transmembrane) nmb |
| 4167 | 4048 | NM_133298 | l, cc, qq, uu | glycoprotein (transmembrane) nmb | glycoprotein (transmembrane) nmb |
| 4167 | 4049 | NM_133298 | l, cc, tt, uu | glycoprotein (transmembrane) nmb | glycoprotein (transmembrane) nmb |
| 196 | 16756 | AA818089 | q, z | glycyl-tRNA synthetase | glycyl-tRNA synthetase |
| 4004 | 21154 | NM_053584 | m, z, dd, ee | golgi SNAP receptor complex member 1 | *Homo sapiens,* Similar to golgi SNAP receptor complex member 1, clone MGC:13657 IMAGE:4250494, mRNA, complete cds, golgi SNAP receptor complex member 1 |
| 3858 | 1004 | NM_031685 | m, x, dd | golgi SNAP receptor complex member 2 | golgi SNAP receptor complex member 2 |
| 3324 | 20745 | NM_017113 | a, k, l, cc, tt, uu | granulin | granulin |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3324 | 20746 | NM_017113 | a, j, l, cc, ss, uu, vv | granulin | granulin |
| 3650 | 352 | NM_024127 | s, General | growth arrest and DNA-damage-inducible 45 alpha, growth arrest and DNA-damage-inducible, alpha | growth arrest and DNA-damage-inducible 45 alpha, growth arrest and DNA-damage-inducible 45 beta, growth arrest and DNA-damage-inducible, alpha |
| 3650 | 353 | NM_024127 | n, z, General, ee, kk, qq, ww | growth arrest and DNA-damage-inducible 45 alpha, growth arrest and DNA-damage-inducible, alpha | growth arrest and DNA-damage-inducible 45 alpha, growth arrest and DNA-damage-inducible 45 beta, growth arrest and DNA-damage-inducible, alpha |
| 3650 | 354 | NM_024127 | n, r, General, qq, vv | growth arrest and DNA-damage-inducible 45 alpha, growth arrest and DNA-damage-inducible, alpha | growth arrest and DNA-damage-inducible 45 alpha, growth arrest and DNA-damage-inducible 45 beta, growth arrest and DNA-damage-inducible, alpha |
| 1715 | 17506 | AI070068 | n, kk | growth arrest and DNA-damage-inducible, beta | growth arrest and DNA-damage-inducible 45 beta, growth arrest and DNA-damage-inducible, alpha, growth arrest and DNA-damage-inducible, beta |
| 3840 | 15767 | NM_031623 | n, y, z, General, dd | growth factor receptor bound protein 14, growth factor receptor-bound protein 14 | amyloid beta (A4) precursor protein-binding, family B, member 1 interacting protein, growth factor receptor bound protein 10, growth factor receptor bound protein 14, growth factor receptor-bound protein 10, growth factor receptor-bound protein 14 |
| 1376 | 17524 | AI010568 | ss | growth hormone receptor | growth hormone receptor |
| 3819 | 939 | NM_031577 | z | growth hormone releasing hormone | |
| 3687 | 862 | NM_024487 | w | GrpE-like 1, mitochondrial, GrpE-tike protein cochaperone | |
| 3492 | 1070 | NM_019368 | f, q, z | GS15, blocked early in transport 1 homolog (*S. cerevisaie*)-like | |
| 3667 | 15350 | NM_024356 | p | GTP cyclohydrolase 1, GTP cyclohydrolase 1 (dopa-responsive dystonia) | GTP cyclohydrolase 1, GTP cyclohydrolase 1 (dopa-responsive dystonia) |
| 3142 | 16947 | NM_012793 | a, b, e, m, s, z, General, qq, uu, vv | guanidinoacetate N-methyltransferase, guanidinoacetate methyltransferase | expressed sequence AA571402, guanidinoacetate N-methyltransferase, guanidinoacetate methyltransferase |
| 3142 | 16948 | NM_012793 | qq, uu | guanidinoacetate N-methyltransferase, guanidinoacetate methyltransferase | expressed sequence M571402, guanidinoacetate N-methyltransferase, guanidinoacetate methyltransferase |
| 3722 | 690 | NM_031034 | t, v, General, mm | guanine nucleotide binding protein (G protein) alpha 12, guanine nucleotide binding protein, alpha 12 | ESTs, Moderately similar to guanine nucleotide binding protein (G protein) alpha 12 [*Rattus norvegicus*] [*R. norvegicus*], guanine nucleotide binding protein (G protein), alpha 13, guanine nucleotide binding protein, alpha 12, guanine nucleotide binding protein, alpha 13 |
| 3722 | 691 | NM_031034 | t, mm | guanine nucleotide binding protein (G protein) alpha 12, guanine nucleotide binding protein, alpha 12 | ESTs, Moderately similar to guanine nucleotide binding protein (G protein) alpha 12 [*Rattus norvegicusi* [*R. norvegicus*], guanine nucleotide binding protein (G protein), alpha 13, guanine nucleotide binding protein, alpha 12, guanine nucleotide binding protein, alpha 13 |
| 184 | 2143 | AA817892 | e, gg, hh, jj | guanine nucleotide binding protein (G protein), beta polypeptide 2, guanine nucleotide binding protein, beta 2 | ESTs, Weakly similar to C Chain C, Apaf-1 Card In Complex With Prodomain Of Procaspase-9 {SUB 1-95 [*H. sapiens*], Homo sapiens mRNA expressed only in placental villi, clone SMAP5, PWP2 periodic tryptophan protein homolog (yeast), *Rattus norvegicus* guanine nucleotide binding protein beta 4 subunit mRNA, partial cds, guanine nucleotide binding protein (G protein), beta polypeptide 2, guanine nucleotide binding protein, beta 2 |
| 4156 | 14959 | NM_130734 | h, x, General, dd, ee | guanine nucleotide binding protein (G protein), beta polypeptide 2-like 1, guanine nucleotide binding protein, beta 2, related sequence 1 | EST, Weakly similar to B33928 GTP-binding protein beta chain homolog [*H. sapiens*], EST, Weakly similar to GBLP_HUMAN GUANINE NUCLEOTIDE-BINDING PROTEIN BETA SUBUNIT-LIKE PROTEIN 12.3 [*H. sapiensl*, *Homo sapiens* cDNA: |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | FLJ21913 fis, clone HEP03888, *Mus musculus*, Similar to hypothetical protein FLJ10385, clone MGC:28622 IMAGE:4220923, mRNA, complete cds, expressed sequence AL033335, guanine nucleotide binding protein (G protein), beta polypeptide 1-like, guanine nucleotide binding protein (G protein), beta polypeptide 2-like 1, guanine nucleotide binding protein, beta 2, related sequence 1 |
| 2168 | 14960 | AI171319 | gg, hh | guanine nucleotide binding protein (G protein), beta polypeptide 2-like 1, guanine nucleotide binding protein, beta 2, related sequence 1 | EST, Weakly similar to B33928 GTP-binding protein beta chain homolog [*H. sapiens*], EST, Weakly similar to GBLP__HUMAN GUANINE NUCLEOTIDE-BINDING PROTEIN BETA SUBUNIT-LIKE PROTEIN 12.3 [*H. sapiens*], *Homo sapiens* cDNA: FLJ21913 fis, clone HEP03888, *Mus musculus*, Similar to hypothetical protein EU 10385, clone MGC:28622 IMAGE:4220923, mRNA, complete cds, SWI/SNF related, matrix associated, actin dependent regulator of chromatin, subfamily b, member 1, expressed sequence AL033335, guanine nucleotide binding protein (G protein), beta polypeptide 1-like, guanine nucleotide binding protein (G protein), beta polypeptide 2-like 1, guanine nucleotide binding protein, beta 2, related sequence 1 |
| 3656 | 1878 | NM_024138 | cc | guanine nucleotide binding protein (G protein) gamma 7, guanine nucleotide binding protein (G protein), gamma 7 subunit | guanine nucleotide binding protein (G protein), gamma 12, guanine nucleotide binding protein (G protein), gamma 7 |
| 3079 | 16024 | NM_012578 | m | H1 histone family, member O | H1 histone family, member O, H1 histone family, member O (oocyte-specific) |
| 3079 | 16025 | NM_012578 | m, ww | H1 histone family, member O | H1 histone family, member O, H1 histone family, member O (oocyte-specific) |
| 3079 | 16026 | NM_012578 | m, ww | H1 histone family, member O | H1 histone family, member O, H1 histone family, member O (oocyte-specific) |
| 3612 | 17661 | NM_022674 | c, d, oo, xx | H2A histone family, member Z | EST, Weakly similar to histone H2A.F/Z variant [*Homo sapiens*] [*H. sapiens*], ESTs, Highly similar to S03644 histone H2A.Z - rat [*R. norvegicus*], ESTs, Weakly similar to H2AZ__HUMAN HISTONE H2A [*H. sapiens*], H2A histone family, member Z, *Homo sapiens* cDNA FLJ32241 fis, clone PLACE6005231, RIKEN cDNA C530002L11 gene, histone H2A.F/Z variant |
| 3192 | 5034 | NM_012966 | v | heat shock 10 kDa protein 1 (chaperonin 10), heat shock 10 kD protein 1 (chaperonin 10) | ESTs, Weakly similar to S47532 chaperonin groES [*H. sapiens*], expressed sequence AW108200, heat shock 10 kDa protein 1 (chaperonin 10), heat shock 10KD protein 1 (chaperonin 10) |
| 2989 | 1466 | M14050 | p, q, General, dd, ff | heat shock 70 kD protein 5 (glucose-regulated protein, 78 kD) | EST, Weakly similar to GR78__RAT 78 KD GLUCOSE-REGULATED PROTEIN PRECURSOR (GRP 78) (IMMUNOGLOBULIN HEAVY CHAIN BINDING PROTEIN) (BIP) (STEROIDOGENESIS-ACTIVATOR POLYPEPTIDE) [*R. norvegicus*], expressed sequence AL022860, heat shock 70 kD protein 5 (glucose-regulated protein, 78 kD) |
| 3665 | 17764 | NM_024351 | h, l, w, uu | heat shock 70 kD protein 8 | EST, Moderately similar to HS7C__HUMAN HEAT SHOCK COGNATE 71 KDA PROTEIN [*H. sapiens*], EST, Weakly similar to A27077 dnaK-type molecular chaperone [*H. sapiens*], EST, Weakly similar to A45935 dnaK-type molecular chaperone hsc70-mouse [*M. musculus*], ESTs, Moderately similar to HS7C MOUSE HEAT SHOCK COGNATE 71 KDA PROTEIN [*M. musculus*], ESTs, Weakly similar to HS7C MOUSE HEAT SHOCK COGNATE |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | 71 KDA PROTEIN [*M. musculus*], heat shock 70 kD protein 8 |
| 3665 | 17765 | NM_024351 | l | heat shock 70 kD protein 8 | EST Moderately similar to HS7C_HUMAN HEAT SHOCK COGNATE 71 KDA PROTEIN [*H. sapiens*], EST, Weakly similar to A27077 dnaK type molecular chaperone [*H. sapiens*], EST, Weakly similar to A45935 dnaK-type molecular chaperone hsc70 - mouse [*M. musculus*], ESTs, Moderately similar to HS7C MOUSE HEAT SHOCK COGNATE 71 KDA PROTEIN [*M. musculus*], ESTs, Weakly similar to HS7C MOUSE HEAT SHOCK COGNATE 71 KDA PROTEIN [*M. musculus*], heat shock 70 kD protein 8 |
| 3869 | 21693 | NM_031714 | p, tt | heat-responsive protein 12, translational inhibitor protein p14.5 | *Mus musculus* adult male liver cDNA, RIKEN full-length enriched library, clone: 1300015121 heat-responsive protein 12, full insert sequence, heat-responsive protein p14.5, translational inhibitor protein p14.5 |
| 2427 | 16081 | AI179610 | s, rr | heme oxygenase (decycling) 1 | heme oxygenase (decycling) 1 |
| 1256 | 19702 | AF008587 | p | hemochromatosis | EST, Highly similar to HFE_HUMAN HEREDITARY HAEMOCHROMATOSIS PROTEIN PRECURSOR [*H. sapiens*], hemochromatosis |
| 499 | 18897 | AA875207 | g | hemoglobin beta chain complex, hemoglobin, beta | EST, Moderately similar to HBB1_RAT Hemoglobin beta chain, major-form [*R. norvegicus*], expressed sequence AI036344, hemoglobin, beta, hemoglobin, beta adult major chain, hemoglobin, beta adult minor chain. hemoglobin, delta |
| 3940 | 17829 | NM_033234 | v | hemoglobin beta chain complex, hemoglobin, beta | EST, Moderately similar to HBB1_RAT Hemoglobin beta chain, major-form [*R. norvegicus*], expressed sequence AI036344, hemoglobin, beta, hemoglobin, beta adult major chain, hemoglobin, beta adult minor chain. hemoglobin, delta |
| 3543 | 25699 | NM_022180 | General, tt | hepatic nuclear factor 4, hepatocyte nuclear factor 4, alpha | ESTs, Weakly similar to HEPATOCYTE NUCLEAR FACTOR 4 [*M. musculus*], *Mus musculus*, clone IMAGE:4990763, mRNA, hepatic nuclear factor 4, hepatocyte nuclear factor 4, alpha |
| 3543 | 20257 | NM_022180 | General | hepatic nuclear factor 4, hepatocyte nuclear factor 4, alpha | ESTs, Weakly similar to HEPATOCYTE NUCLEAR FACTOR 4 [*M. musculus*], *Mus musculus*, clone IMAGE:4990763, mRNA, hepatic nuclear factor 4, hepatocyte nuclear factor 4, alpha |
| 3295 | 649 | NM_017017 | cc | hepatocyte growth factor, hepatocyte growth factor (hepapojetin A; scatter factor) | hepatocyte growth factor hepatocyte growth factor (hepapoietin A scatter factor) |
| 3666 | 844 | NM_024352 | h, l, n, uu | hepatocyte growth factor-like, macrophage stimulating 1 (hepatocyte growth factor-like) | |
| 3982 | 22586 | NM_053469 | a, n, y | hepcidin antimicrobial peptide | hepcidin antimicrobial peptide |
| 3323 | 1548 | NM_017112 | b, General | hepsin, hepsin (transmembrane protease, serine 1) | ESTs, Weakly similar to HEPS_RAT SERINE PROTEASE HEPSIN [*R. norvegicus*], ESTs, Weakly similar to TMS2_MOUSE TRANSMEMBRANE PROTEASE, SERINE 2 (EPITHELIASIN) (PLASMIC TRANSMEMBRANE PROTEIN X) [*M. musculus*], *Mus musculus* airway trypsin-like protease mRNA, complete cds, *Mus musculus*, Similar to transmembrane protease, serine 4, clone MGC:29209 IMAGE:5030266, mRNA, complete cds, hepsin, hepsin (transmembrane protease, serine 1) |
| 3783 | 4234 | NM_031330 | m, ff | heterogeneous nuclear ribonucleoprotein A/B | DAZ associated protein 1, Musashi homolog 1 (*Drosophila*), Musashi homolog 2 (*Drosophila*), RIKEN cDNA 4933434H11 gene, expressed sequence AA959857, heterogeneous nuclear ribonucleoprotein A/B, musashi homolog 1 (*Drosophila*) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3379 | 17502 | NM_017248 | rr | heterogeneous nuclear ribonucleoprotein A1 | ESTs, Highly similar to 152962 FBRNP [*H. sapiens*], ESTs, Highly similar to heterogeneous ribonuclear particle protein A1 [*H. sapiens*], ESTs, Moderately similar to heterogeneous ribonuclear particle protein A1 [*H. sapiens*], ESTs, Weakly similar to ROA1_RAT Heterogeneous nuclear ribonucleoprotein A1 (Helix-destabilizing protein) (Single-strand binding protein) (hnRNP core protein A1) (HDP) [*R. norvegicus*], Homo sapiens cDNA: FLJ22720 fis, clone H5114320, *Mus musculus*, Similar to TAR DNA binding protein, clone MGC:19284 IMAGE:4016437, mRNA, complete cds, RIKEN cDNA 4930547K05 gene, heterogeneous nuclear ribonucleoprotein A1 |
| 3379 | 15012 | NM_017248 | kk | heterogeneous nuclear ribonucleoprotein A1 | ESTs, Highly similar to 152962 FBRNP [*H. sapiens*], ESTs, Highly similar to S12520 core protein A1 [*H. sapiens*], ESTs, Highly similar to heterogeneous ribonuclear particle protein A1 [*H. sapiens*], ESTs, Moderately similar to heterogeneous ribonuclear particle protein A1 [*H. sapiens*], ESTs, Weakly similar to ROA1_RAT Heterogeneous nuclear ribonucleoprotein A1 (Helix-destabilizing protein) (Single-strand binding protein) (hnRNP core protein A1) (HDP) [*R. norvegicus*], Homo sapiens cDNA: FLJ22720 fis, clone HSI14320, *Mus musculus*, Similar to TAR DNA binding protein, clone MGC:19284 IMAGE:4016437, mRNA, complete cds, RIKEN cDNA 2610510D13 gene, RIKEN cDNA 4930547K05 gene, heterogeneous nuclear ribonucleoprotein A1, heterogeneous nuclear ribonucleoprotein A3 |
| 4122 | 2413 | NM_057141 | l, n | heterogeneous nuclear ribonucleoprotein K | ESTs, Highly similar to heterogeneous nuclear ribonucleoprotein K, isoform b; dC-stretch binding protein; transformation upregulated nuclear protein [*Homo sapiens*] [*H. sapiens*], ESTs, Weakly similar to heterogeneous nuclear ribonucleoprotein K [*Rattus norvegicus*] [*R. norvegicus*], heterogeneous nuclear ribonucleoprotein K, poly(rC) binding protein 3, poly(rC) binding protein 4 |
| 4122 | 2416 | NM_057141 | w | heterogeneous nuclear ribonucleoprotein K | ESTs, Highly similar to heterogeneous nuclear ribonucleoprotein K, isoform b; dC-stretch binding protein; transformation upregulated nuclear protein [*Homo sapiens*] [*H. sapiens*], ESTs, Weakly similar to heterogeneous nuclear ribonucleoprotein K [*Rattus norvegicus*] [*R. norvegicus*], heterogeneous nuclear ribonucleoprotein K, poly(rC) binding protein 3, poly(rC) binding protein 4 |
| 885 | 16945 | AA925541 | c | heterogeneous nuclear ribonucleoprotein L | heterogeneous nuclear ribonucleoprotein L |
| 1666 | 19835 | AI058964 | ll | heterogeneous nuclear ribonucleoprotein U, heterogeneous nuclear ribonucleoprotein U (scaffold attachment factor A) | E1B-55 kDa-associated protein 5, EST, Weakly similar to heterogenous nuclear ribonucleoprotein U; scaffold attachment factor A; nuclear matrix protein sp120 [*Mus musculus*] [*M. musculus*], expressed sequence AI465155, heterogeneous nuclear ribonucleoprotein U |
| 4121 | 19834 | NM_057139 | v | heterogeneous nuclear ribonucleoprotein U, heterogeneous nuclear ribonucleoprotein U (scaffold attachment factor A) | EIB-55 kDa-associated protein 5, EST, Weakly similar to heterogenous nuclear ribonucleoprotein U; scaffold attachment factor A; nuclear matrix protein sp120 [*Mus musculus*] [*M. musculus*], expressed sequence AI465155, heterogeneous nuclear ribonucleoprotein U |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3127 | 1372 | NM_012734 | xx | hexokinase 1 | ESTs, Weakly similar to A35244 hexokinase [*M. musculus*], *Mus musculus*, Similar to hexokinase 1, clone MGC:28816 IMAGE:4504302, mRNA, complete cds, hexokinase 1 |
| 1299 | 10108 | AI007857 | b, General, dd | HGF-regulated tyrosine kinase substrate, hepatocyte growth factor-regulated tyrosine kinase substrate | ESTs, Weakly similar to HGF-regulated tyrosine kinase substrate [*Mus musculus*] [*M. musculus*], HGF-regulated tyrosine kinase substrate, RIKEN cDNA 1700013B03 gene, WD40- and FYVE-domain containing protein 2, hepatocyte growth factor-regulated tyrosine kinase substrate, myotubularin related protein 3, phosphoinositide-binding protein SR1, target of myb1 homolog (chicken), zinc finger protein, subfamily 2A (FYVE domain containing) 1 |
| 4145 | 24604 | NM_080906 | r, pp | HIF-1 responsive RTP801, RIKEN cDNA 5830413E08 gene | HIF-1 responsive RTP801, *Homo sapiens*, Similar to RIKEN cDNA 1700037B15 gene, clone MGC:9960 IMAGE:3877854, mRNA, complete cds |
| 3355 | 15434 | NM_017187 | y | high mobility group box 2, high-mobility group (nonhistone chromosomal) protein 2 | EST, Moderately similar to HMG2_RAT High mobility group protein 2 (HMG-2) [*R. norvegicus*], ESTs, Weakly similar to 2001363A high mobility group protein 2 [*H. sapiens*], ESTs, Weakly similar to HMG2_RAT High mobility group protein 2 (HMG-2) [*R. norvegicus*], *Homo sapiens*, clone MGC:33358 IMAGE:5266418, mRNA, complete cds, RIKEN cDNA 2610021J01 gene, expressed sequence 080539, high mobility group box 2, high-mobility group (nonhistone chromosomal) protein 2 |
| 3355 | 15437 | NM_017187 | r, y, ww | high mobility group box 2, high-mobility group (nonhistone chromosomal) protein 2 | EST, Moderately similar to HMG2_RAT High mobility group protein 2 (HMG-2) [*R. norvegicus*], ESTs, Weakly similar to 2001363A high mobility group protein 2 [*H. sapiensl*], ESTs, Weakly similar to HMG2_RAT High mobility group protein 2 (HMG-2) [*R. norvegicus*], *Homo sapiens*, clone MGC:33358 IMAGE:526641 8, mRNA, complete cds, RIKEN cDNA 2610021J01 gene, expressed sequence 080539, high mobility group box 2, high-mobility group (nonhistone chromosomal) protein 2 |
| 3344 | 70 | NM_017159 | b, c, y | histidine ammonia lyase, histidine ammonia-lyase | histidine ammonia lyase, histidine ammonia lyase |
| 592 | 17345 | AA892014 | c | HLA-B associated transcript 1, HLA-B-associated transcript 1A | ESTs, Highly similar to 533681 translation initiation factor eIF-4A.I [*H. sapiens*], ESTs, Weakly similar to A42811 nuclear RNA helicase (DEAD family) homolog - rat [*R. norvegicus*], RIKEN cDNA 2610307D23 gene, hypothetical protein MGC6664 |
| 592 | 17346 | M892014 | k | HLA-B associated transcript 1, HLA-B-associated transcript IA | ESTs, Highly similar to 533681 translation initiation factor eIF-4A.I [*H. sapiens*], ESTs, Weakly similar to A42811 nuclear RNA helicase (DEAD family) homolog - rat [*R. norvegicus*], RIKEN cDNA 2610307D23 gene, hypothetical protein MG06664 |
| 3670 | 20772 | NM_024363 | c, v, oo | HMT1 hnRNP methyltransferase-like 2 (*S. cerevisiae*), heterogeneous nuclear ribonucleoproteins methyltransferase-like 2 (*S. cerevisaie*) | EST, Moderately similar to ANM1_HUMAN PROTEIN ARGININE N-METHYLTRANSFERASE 1 [*H. sapiens*], EST, Weakly similar to ANM1_HUMAN PROTEIN ARGININE N-METHYLTRANSFERASE 1 [*H. sapiens*], ESTs, Moderately similar to ANM1_MOUSE PROTEIN ARGININE N-METHYLTRANSFERASE 1 [*M. musculus*], ESTs, Weakly similar to ANM1_MOUSE PROTEIN ARGININE N-METHYLTRANSFERASE 1 [*M. musculus*], HMT1 hnRNP methyltransferase-like 2 (*S. cerevisaie*), RIKEN cDNA 2410018A17 gene, coactivator-associated arginine |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | methyltransferase 1, coactivator-associated arginine methyltransferase-1, heterogeneous nuclear ribonucleoproteins methyltransferase-like 2 (*S. cerevisaie*), heterogeneous nuclear ribonucleoproteins methyltransferase-like 2 (*S. cerevisaie*), |
| 3733 | 7351 | NM_031059 | g | homeo box, msh-like 1, msh homeo box homolog 1 (*Drosophila*) | homeo box, msh-like 1, homeo box, msh-like 3, msh homeo box homolog 1 (*Drosophila*), spinal cord axial homeobox gene 1 |
| 3956 | 15749 | NM_053309 | cc | Homer, neuronal immediate early gene, 2, homer, neuronal immediate early gene, 2 | Homer, neuronal immediate early gene, 2, homer, neuronal immediate early gene, 1 |
| 3956 | 15750 | NM_053309 | e | Homer, neuronal immediate early gene, 2, homer, neuronal immediate early gene, 2 | Homer, neuronal immediate early gene, 2, homer, neuronal immediate early gene, 1 |
| 3956 | 15751 | NM_053309 | x | Homer, neuronal immediate early gene, 2, homer, neuronal immediate early gene, 2 | Homer, neuronal immediate early gene, 2, homer, neuronal immediate early gene, 1 |
| 2592 | 573 | AI232087 | h, l, m, qq | hydroxyacid oxidase (glycolate oxidase) 3, hydroxyacid oxidase 3 (medium-chain) | |
| 3943 | 1409 | NM_033349 | t, jj | hydroxyacyl glutathione hydrolase | ESTs Highly similar to GLO2_HUMAN HYDROXYACYLGLUTATHIONE HYDROLASE E [*H. sapiens*], *Mus musculus* Similar to hydroxyacyl glutathione hydrolase, clone MGC:6697 IMAGE:3583919, mRNA, complete cds, RIKEN cDNA 0610025L15 gene, RIKEN cDNA 1500017E18 gene, brain protein 17, hydroxyacyl glutathione hydrolase |
| 3316 | 23660 | NM_017080 | a, l, vv | hydroxysteroid (11-beta) dehydrogenase 1, hydroxysteroid 11-beta dehydrogenase 1 | ESTs, Weakly similar to OHI1_RAT Corticosteroid 11-beta-dehydrogenase, isozyme 1 (11-DH) (11-beta-hydroxysteroid dehydrogenase 1) (11-beta-HSD1) [*R. norvegicus*], *Mus musculus*, Similar to hydroxysteroid 17-beta dehydrogenase 11, clone MGC:30360 IMAGE:5132342, mRNA, complete cds, *Mus musculus*, clone MGC:6908 IMAGE:2655855, mRNA, complete cds, hydroxysteroid (11-beta) dehydrogenase 1, hydroxysteroid 11-beta dehydrogenase 1, retinal short-chain dehydrogenase/reductase retSDR2 |
| 3372 | 21743 | NM_017235 | jj | hydroxysteroid (17-beta) dehydrogenase 7 | ESTs, Highly similar to DHB7_RAT ESTRADIOL 17 BETA-DEHYDROGENASE 7 (17-BETA-HSD 7) (17-BETA-HYDROXYSTEROID DEHYDROGENASE 7) (PRL RECEPTOR ASSOCIATED PROTEIN) (PRAP) [*R. norvegicus*], PAN2 protein, RIKEN cDNA 3110030G19 gene, WW domain-containing oxidoreductase, hydroxysteroid (17-beta) dehydrogenase 7 |
| 3372 | 21744 | NM_017235 | bb, ii, jj | hydroxysteroid (17-beta) dehydrogenase 7 | PAN2 protein, RIKEN cDNA 3110030G19 gene, WW domain-containing oxidoreductase, hydroxysteroid (17-beta) dehydrogenase 7, hydroxysteroid 17-beta dehydrogenase 7 |
| 3027 | 13547 | M63983 | e | hypoxanthine guanine phosphoribosyl transferase, hypoxanthine phosphoribosyltransferase 1 (Lesch-Nyhan syndrome) | EST, Moderately similar to The Crystal Structure Of Icam-2 {SUB 25-216 [*H. sapiens*], ESTs, Weakly similar to S18140 hypoxanthine phosphoribosyltransferase (EC 2.4.2.8) - rat [*R. norvegicus*], hypoxanthine guanine phosphoribosyl transferase, hypoxanthine phosphoribosyltransferase 1 (Lesch-Nyhan syndrome) |
| 1257 | 20438 | AF009656 | e, u | hypoxanthine guanine phosphoribosyl transferase, hypoxanthine phosphoribosyltransferase 1 (Lesch-Nyhan syndrome) | ESTs, Weakly similar to S18140 hypoxanthine phosphoribosyltransferase (EC 2.4.2.8) - rat [*R. norvegicus*], hypoxanthine guanine phosphoribosyl transferase, hypoxanthine phosphoribosyltransferase 1 (Lesch-Nyhan syndrome) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3668 | 1146 | NM_024359 | a, m | hypoxia inducible factor 1, alpha subunit, hypoxia-inducible factor 1, alpha subunit (basic helix-loop-helix transcription factor) | *Mus musculus* inhibitory PAS domain protein (Ipas) mRNA, complete cds, hypoxia inducible factor 1, alpha subunit, hypoxia-inducible factor 1, alpha subunit (basic helix-loop-helix transcription factor), neuronal PAS domain protein 1, single-minded 1, single-minded 2, single-minded homolog 1 (*Drosophila*) |
| 3668 | 1148 | NM_024359 | a | hypoxia inducible factor 1, alpha subunit, hypoxia-inducible factor 1, alpha subunit (basic helix-loop-helix transcription factor) | *Mus musculus* inhibitory PAS domain protein (Ipas) mRNA, complete cds, hypoxia inducible factor 1, alpha subunit, hypoxia-inducible factor 1, alpha subunit (basic helix-loop-helix transcription factor), neuronal PAS domain protein 1, single-minded 1, single-minded 2, single-minded homolog 1 (*Drosophila*) |
| 3662 | 22079 | NM_024157 | a, General, uu, vv | I factor (complement), complement component factor i | I factor (complement), complement component factor i |
| 3011 | 23610 | M32754 | l | inhibin alpha, inhibin, alpha | inhibin alpha, inhibin, alpha |
| 3144 | 10248 | NM_012797 | ff | inhibitor of DNA binding 1, inhibitor of DNA binding 1, dominant negative helix-loop-helix protein | |
| 2031 | 16510 | AI137583 | b, w, ii, rr, tt | inhibitor of DNA binding 2, inhibitor of DNA binding 2, dominant negative helix-loop-helix protein | ESTs, Weakly similar to JC2112 helix-loop-helix protein, Id2 - rat [*R. norvegicus*], inhibitor of DNA binding 2, inhibitor of DNA binding 2, dominant negative helix-loop-helix protein, inhibitor of DNA binding 4, inhibitor of DNA binding 4, dominant negative helix-loop-helix protein |
| 3226 | 16511 | NM_013060 | rr | inhibitor of DNA binding 2, inhibitor of DNA binding 2, dominant negative helix-loop-helix protein | ESTs, Weakly similar to JC2112 helix-loop-helix protein, Id2 - rat [*R. norvegicus*], inhibitor of DNA binding 2, inhibitor of DNA binding 2, dominant negative helix-loop-helix protein, inhibitor of DNA binding 4, inhibitor of DNA binding 4, dominant negative helix-loop-helix protein |
| 4143 | 13424 | NM_080899 | ww | inhibitor of kappa light polypeptide enhancer in B-cells, kinase complex-associated protein inhibitor of kappa light polypeptide gene enhancer in B-cells, kinase complex-associated protein | inhibitor of kappa light polypeptide gene enhancer in B-cells, kinase complex-associated protein |
| 3928 | 18640 | NM_032057 | p, ee | inositol (myo)-1(or 4)-monophosphatase 1, inositol(myo)-1(or 4)-monophosphatase 1 | inositol (myo)-1(or 4)-monophosphatase 1 inositol (myo)-1(or 4)-monophosphatase 2, inositol(myo)-1(or 4)-monophosphatase 1 |
| 3250 | 1712 | NM_013138 | nn | inositol 1 4,5-triphosphate receptor 3, inositol 1,4,5-triphosphate receptor, type 3 | ESTs, Highly similar to IP3R MOUSE INOSITOL 1,4,5-TRISPHOSPHATE-BINDING PROTEIN TYPE I RECEPTOR [*M. musculus*], ESTs, Moderately similar to IP3R MOUSE INOSITOL 1,4,5-TRISPHOSPHATE-BINDING PROTEIN TYPE 1 RECEPTOR [*M. musculus*], ESTs, Moderately similar to 1P3S_MOUSE_1 [Segment 1 of 2] Inositol 1,4,5-trisphosphate receptor type 2 (Type 2 inositol 1,4,5-trisphosphate receptor) (Type 2 InsP3 receptor) (IP3 receptor isoform 2) (InsP3R2) (Inositol 1,4,5-trisphosphate type V receptor) (Fragments) [*M. musculus*], ESTs, Weakly similar to IP3R MOUSE INOSITOL 1,4,5-TRISPHOSPHATE-BINDING PROTEIN TYPE 1 RECEPTOR [*M. musculus*], inositol 1,4,5-triphosphate receptor 1, inositol 1,4,5-triphosphate receptor 3, inositol 1,4,5-triphosphate |
| 3635 | 19669 | NM_022944 | x | inositol polyphosphate phosphatase-like 1 | EWS/FL11 activated transcript 2, 5H2 domain protein 1A, inositol polyphosphate phosphatase-like 1 |
| 2992 | 21053 | M15481 | qq | insulin-like growth factor 1, insulin-like growth factor 1 (somatomedin C) | |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4406 | 21054 | X06107 | g, v | insulin-like growth factor 1, insulin-like growth factor 1 (somatomedin C) | |
| 1428 | 24411 | AI012577 | h, z | insulin-like growth factor 2, insulin-like growth factor 2 (somatomedin A) | insulin-like growth factor 2, insulin-like growth factor 2 (somatomedin A) |
| 2995 | 24407 | M17960 | v | insulin-like growth factor 2, insulin-like growth factor 2 (somatomedin A) | insulin-like growth factor 2, insulin-like growth factor 2 (somatomedin A) |
| 3798 | 24410 | NM_031511 | g | insulin-like growth factor 2, insulin-like growth factor 2 (somatomedin A) | insulin-like growth factor 2, insulin-like growth factor 2 (somatomedin A) |
| 3959 | 25480 | NM_053329 | x | insulin-like growth factor binding protein acid labile subunit | ESTs, Weakly similar to A41915 insulin-like growth factor-binding complex acid-labile chain precursor [*H. sapiens*], ESTs, Weakly similar to ALS MOUSE INSULIN-LIKE GROWTH FACTOR BINDING PROTEIN COMPLEX ACID LABILE CHAIN PRECURSOR [*M. musculus*], RIKEN cDNA 1200009O22 gene, glycoprotein A repetitions predominant, glycoprotein Ib (platelet), alpha polypeptide, insulin-like growth factor binding protein, acid labile subunit, toll-like receptor 3, toll-like receptor 4, toll-like receptor 5 |
| 4454 | 16413 | X65036 | oo | integrin alpha 7, integrin, alpha 7 | integrin alpha 6, integrin alpha 7, integrin, alpha 6, integrin, alpha 7 |
| 4454 | 16414 | X65036 | u | integrin alpha 7, integrin, alpha 7 | integrin alpha 6, integrin alpha 7, integrin, alpha 6, integrin, alpha 7 |
| 2330 | 14989 | AI177366 | b | integrin beta 1 (fibronectin receptor beta), integrin, beta 1 (fibronectin receptor, beta polypeptide, antigen CD29 includes MDF2, MSK12) | integrin beta 1 (fibronectin receptor beta), integrin beta 2, integrin beta 7, integrin, beta 1 (fibronectin receptor, beta polypeptide, antigen CD29 includes MDF2, MSK12), integrin, beta 2 (antigen CD18 (p95), lymphocyte function-associated antigen 1; macrophage antigen 1 (mac-1) beta subunit), integrin, beta 7 |
| 3493 | 1818 | NM_019369 | a, uu | inter alpha-trypsin inhibitor, heavy chain 4, inter-alpha (globulin) inhibitor H4 (plasma Kallikrein-sensitive glycoprotein) | EST, Weakly similar to JC5953 inter-alpha-inhibitor H4P heavy chain - rat [*R. norvegicus*], ESTs, Weakly similar to INTER-ALPHA-TRYPSIN INHIBITOR HEAVY CHAIN H2 PRECURSOR [*M. musculus*], inter alpha-trypsin inhibitor, heavy chain 4, inter-alpha (globulin) inhibitor H4 (plasma Kallikrein-sensitive glycoprotein) |
| 3193 | 2554 | NM_012967 | vv | intercellular adhesion molecule, intercellular adhesion molecule 1 (CD54), human rhinovirus receptor | ESTs, Weakly similar to ICA1_HUMAN INTERCELLULAR ADHESION MOLECULE-1 PRECURSOR [*H. sapiens*], intercellular adhesion molecule, intercellular adhesion molecule 1 (CD54), human rhinovirus receptor, intercellular adhesion molecule 3, intercellular adhesion molecule 5, telencephalin |
| 3193 | 2555 | NM_012967 | vv | intercellular adhesion molecule, intercellular adhesion molecule 1 (CD54), human rhinovirus receptor | ESTs, Weakly similar to ICA1_HUMAN INTERCELLULAR ADHESION MOLECULE-1 PRECURSOR [*H. sapiens*], intercellular adhesion molecule, intercellular adhesion molecule 1 (CD54), human rhinovirus receptor, intercellular adhesion molecule 3, intercellular adhesion molecule 5, telencephalin |
| 3082 | 20126 | NM_012591 | u, nn | interferon regulatory factor 1 | ESTs, Moderately similar to sirtuin 2 (silent mating type information regulation 2, homolog) 2 (*S. cerevisaie*) [*Rattus norvegicus*] [*R. norvegicus*], *Mus musculus*, Similar to sirtuin silent mating type information regulation 2 homolog 7 (*S. cerevisaie*), clone MGC:37560 IMAGE:4987746, mRNA, complete cds, expressed sequence AI646973, interferon regulatory factor 1, interferon regulatory factor 2, interferon regulatory factor 4, interferon regulatory factor 5, sirtuin 1 ((silent mating type information regulation 2, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | homolog) 1 (*S. cerevisaie*), sirtuin 2 (silent mating type information regulation 2, homolog) 2 (*S. cerevisaie*), sirtuin 3 (silent mating type information regulation 2, |
| 3082 | 21162 | NM_012591 | d, u | interferon regulatory factor 1 | expressed sequence AI646973, interferon regulatory factor 1, interferon regulatory factor 2, interferon regulatory factor 4, interferon reciulatorv factor 5 |
| 3460 | 17908 | NM_019242 | f, General, ee, pp | interferon-related developmental regulator 1 | ESTs, Weakly similar to IFR1_RAT INTERFERON-RELATED DEVELOPMENTAL REGULATOR 1 (NERVE GROWTH FACTOR-INDUCIBLE PROTEIN PC4) (IRPR) [*R. norvegicus*], interferon-related developmental regulator 1, interferon-related developmental regulator 2 |
| 3799 | 24710 | NM_031512 | vv | interleukin 1 beta, interleukin 1, beta | |
| 3218 | 115 | NM_013037 | u | interleukin 1 receptor-like 1 | interleukin 1 receptor-like 1 |
| 3246 | 14300 | NM_013129 | pp | interleukin 15 | interleukin 15 |
| 4175 | 656 | NM_133380 | x | interleukin 4 receptor, interleukin 4 receptor, alpha | colony stimulating factor 2 receptor, beta 1, low-affinity (granulocyte-macrophage), interleukin 4 receptor, interleukin 4 receptor, alpha |
| 3296 | 6598 | NM_017020 | j, n, xx | interleukin 6 receptor, interleukin 6 receptor alpha | interleukin 6 receptor |
| 3797 | 17427 | NM_031510 | p | isocitrate dehydrogenase 1 (NADP+), soluble | ESTs, Highly similar to IDHC_RAT ISOCITRATE DEHYDROGENASE [NADP] CYTOPLASMIC (OXALOSUCCINATE DECARBOXYLASE) (IDH) (NADP+-SPECIFIC ICDH) (IDP) [*R. norvegicus*], expressed sequence AI788952, isocitrate dehydrogenase 1 (NADP+), soluble, isocitrate dehydrogenase 2 (NADP+), mitochondrial |
| 4025 | 23305 | NM_053638 | jj | isocitrate dehydrogenase 3 (NAD+) alpha | isocitrate dehydrogenase 3 (NAD+) alpha |
| 3083 | 4449 | NM_012592 | z, General | isovaleryl Coenzyme A dehydrogenase, isovaleryl coenzyme A dehydrogenase | ESTs, Moderately similar to IVD_HUMAN ISOVALERYL-COA DEHYDROGENASE, MITOCHONDRIAL PRECURSOR [*H. sapiens*], isovaleryl Coenzyme A dehydrogenase, isovaleryl coenzyme A dehydrogenase |
| 3083 | 4450 | NM_012592 | p | isovaleryl Coenzyme A dehydrogenase, isovaleryl coenzyme A dehydrogenase | ESTs, Moderately similar to IVD_HUMAN ISOVALERYL-COA DEHYDROGENASE, MITOCHONDRIAL PRECURSOR [*H. sapiens*], isovaleryl Coenzyme A dehydrogenase, isovaleryl coenzyme A dehydrogenase |
| 2869 | 25233 | AJ000556 | p, mm | Janus kinase 1, Janus kinase 1 (a protein tyrosine kinase) | |
| 3800 | 12580 | NM_031514 | m, v | Janus kinase 2, Janus kinase 2 (a protein tyrosine kinase) | ESTs, Weakly similar to JC4127 protein-tyrosine kinase (EC 2.7.1.112) - rat [*R. norvegicus*], Janus kinase 1, Janus kinase 1 (a protein tyrosine kinase), Janus kinase 2, Janus kinase 2 (a protein tyrosine kinase), expressed sequence AI504024, expressed sequence C81 284, tyrosine |
| 3451 | 2632 | NM_019213 | s | jumping translocation breakpoint | ESTs, Highly similar to jumping translocation breakpoint [*Rattus norvegicus*] [*R. norvegicus*], ESTs, Moderately similar to jumping translocation breakpoint [*Rattus norvegicus*] [*R. norvegicus*], jumping translocation breakpoint |
| 3535 | 20162 | NM_021835 | u, tt | Jun oncogene, v-jun sarcoma virus 17 oncogene homolog (avian) | Jun oncogene, v-jun sarcoma virus 17 oncogene homolog (avian) |
| 3535 | 22350 | NM_021835 | ll | Jun oncogene, v-jun sarcoma virus 17 oncogene homolog | Jun oncogene, v-jun sarcoma virus 17 oncogene homolog (avian) (avian) |
| 3535 | 22351 | NM_021835 | kk, tt | Jun oncogene, v-jun sarcoma virus 17 oncogene homolog (avian) | Jun oncogene, v-jun sarcoma virus 17 oncogene homolog (avian) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3535 | 22352 | NM_021835 | y, kk, ss, ll | Jun oncogene, v-jun sarcoma virus 17 oncogene homolog (avian) | Jun oncogene, v-jun sarcoma virus 17 oncogene homolog (avian) |
| 3895 | 15864 | NM_031797 | x | kangai 1 (suppression of tumorigenicity 6, prostate), kangai 1 (suppression of tumorigenicity 6, prostate; CD82 antigen (R2 leukocyte antigen, antigen detected by monoclonal and antibody IA4)) | kangai 1 (suppression of tumorigenicity 6, prostate), kangai 1 (suppression of tumorigenicity 6, prostate; CD82 antigen (R2 leukocyte antigen, antigen detected by monoclonal and antibody IA4)), tetraspan 1 |
| 3913 | 16726 | NM_031855 | General, dd | ketohexokinase, ketohexokinase (fructokinase) | ketohexokinase, ketohexokinase (fructokinase) |
| 4021 | 659 | NM_053622 | q | K1AA0618 gene product, nuclear pore membrane protein 121 | EST, Moderately similar to N121_HUMAN NUCLEAR ENVELOPE PORE MEMBRANE PROTEIN POM 121 (PORE MEMBRANE PROTEIN OF 121 KDA) (P145) [*H. sapiens*], EST, Weakly similar to N121_HUMAN NUCLEAR ENVELOPE PORE MEMBRANE PROTEIN POM 121 (PORE MEMBRANE PROTEIN OF 121 KDA) (P145) [*H. sapiens*], ESTs, Weakly similar to nuclear pore membrane glycoprotein 121 kD [*Rattus norvegicus*] [*R. norvegicus*], ESTs, Weakly similar to DDX9 MOUSE ATP-DEPENDENT RNA HELICASE A [*M. musculus*], KIAA0410 gene product, KIAA0618 gene product, *Mus musculus*, clone IMAGE:4949762, mRNA, partial cds, *Mus musculus*, clone IMAGE:5148310, mRNA, *Mus musculus*, clone IMAGE:5321620, mRNA, partial cds, POM (POM121 rat homolog) and ZP3 fusion, Snf2-related CBP activator protein, melanoma antigen, family 0, 3 |
| 3116 | 1850 | NM_012696 | a | kininogen | kininogen |
| 3116 | 1854 | NM_012696 | a | kininogen | kininogen |
| 3991 | 14380 | NM_053536 | tt | Kruppel-like factor 15 | |
| 4128 | 8641 | NM_057211 | f | Kruppel-iike factor 9, basic transcription element binding protein 1 | ESTs, Moderately similar to Kruppel-like factor 9 [*Rattus norvegicus*] [*R. norvegicus*], Kruppel-like factor 9, basic transcription element binding protein 1, expressed sequence AL022736 |
| 4080 | 794 | NM_053902 | l | kynureninase (L-kynurenine hydrolase) | *Mus musculus*, Similar to kynureninase (L-kynurenine hydrolase), clone MGC:30315 IMAGE:51 36970, mRNA, complete cds, kynureninase (L-kynurenine hydrolase) |
| 3332 | 24885 | NM_017138 | q, ll | laminin receptor 1 (67 kD, ribosomal protein SA) | EST, Weakly similar to 1405340A protein 40 kD [*M. musculus*], EST, Weakly similar to RSP4 MOUSE 40S RIBOSOMAL PROTEIN SA [*M. musculus*], ESTs, Highly similar to A31233 ribosomal protein RS.40K, cytosolic [*H. sapiens*], ESTs, Moderately similar to laminin-binding protein [*H. sapiens*], expressed sequence AL022858, laminin receptor 1 (67 kD, ribosomal protein SA) |
| 3332 | 24886 | NM_017138 | l, ll | laminin receptor 1 (67 kD, ribosomal protein SA) | EST, Weakly similar to 1405340A protein 40 kD [*M. musculus*], EST, Weakly similar to RSP4 MOUSE 40S RIBOSOMAL PROTEIN SA [*M. musculus*], ESTs, Highly similar to A31233 ribosomal protein RS.40K, cytosolic [*H. sapiens*], ESTs, Moderately similar to laminin-binding protein [*H. sapiens*], expressed sequence AL022858, laminin receptor 1 (67 kD, ribosomal protein SA) |
| 3728 | 301 | NM_031049 | jj | lanosterol synthase, lanosterol synthase (2,3-oxidosqualene-lanosterol cyclase) | lanosterol synthase (2,3-oxidosquatene-lanosterol cyclase) |
| 3728 | 302 | NM_031049 | jj | lanosterol synthase, lanosterol synthase (2,3-oxidosqualene-lanosterol cyclase) | lanosterol synthase (2,3-oxidosqualene-lanosterol cyclase) |
| 3728 | 303 | NM_031049 | k, jj | lanosterol synthase, lanosterol synthase (2,3-oxidosqualene-lanosterol cyclase) | lanosterol synthase (2,3-oxidosqualene-lanosterol cyclase) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3519 | 19059 | NM_021587 | a | latent transforming growth factor beta binding protein 1 | EST, Weakly similar to transforming growth factor-beta (TGF-beta) masking protein large subunit [*Rattus norvegicus*] [*R. norvegicus*], ESTs, Highly similar to FIBRILLIN 2 PRECURSOR [*M. musculus*], ESTs, Weakly similar to transforming growth factor-beta (TGF-beta) masking protein large subunit [*Rattus norvegicus*] [*R. norvegicus*], RIKEN cDNA 2310046A13 gene, fibulin 1, latent transforming growth factor beta binding protein 1 |
| 3299 | 670 | NM_017024 | a, m, v, cc, uu, vv | lecithin cholesterol acyltransferase, lecithin-cholesterol acyltransferase | EST, Weakly similar to LCAT_MOUSE PHOSPHATIDYLCHOLINE-STEROL ACYLTRANSFERASE PRECURSOR [*M. musculus*], EST, Weakly similar to LCAT_HUMAN PHOSPHATIDYLCHOLINE-STEROL ACYLTRANSFERASE PRECURSOR [*H. sapiens*], ESTs, Moderately similar to LCAT_HUMAN PHOSPHATIDYLCHOLINE-STEROL ACYLTRANSFERASE PRECURSOR [*H. sapiens*], expressed sequence C87498, lecithin cholesterol acyltransferase, lecithin-cholesterol acyltransferase, lysophospholipase 3, lysophospholipase 3 (lysosomal phospholipase A2) |
| 3903 | 22321 | NM_031832 | f, j, General, ss | lectin, galactose binding, soluble 3, lectin, galactoside-binding, soluble, 3 (galectin 3) | EST, Weakly similar to A35820 galectin 3 [*H. sapiens*], galectin-related inter-fiber protein, lectin, galactoside-binding, soluble, 3 (galectin 3) |
| 4075 | 14992 | NM_053886 | dd | lectin, mannose-binding, 1 | ERGL protein; ERGIC-53-like protein, EST, Weakly similar to RIKEN cDNA 1300009F09 [*Mus musculus*] [*M. musculus*], ESTs, Weakly similar to RIKEN cDNA 1300009F09 [*Mus musculus*] [*M. musculus*], ESTs, Weakly similar to 2208374A cis-Golgi/intermediate compartment protein [*Rattus norvegicus*] [*R. norvegicus*], *Mus musculus*, Similar to ERGL protein; ERGIC-53-like protein, clone MGC:28923 IMAGE:4925160, mRNA, complete cds, RIKEN cDNA 1300009F09 gene, chromosome 5 open reading frame 8, lectin, mannose-binding, 1 |
| 3084 | 24735 | NM_012596 | pp | leptin receptor | leptin receptor |
| 991 | 22283 | AA945172 | mm | leucine aminopeptidase 3 | aminopeptidase-like 1, leucine aminopeptidase 3 |
| 4176 | 10195 | NM_133383 | w | likely homolog of rat and mouse retinoid-inducible serine carboxypeptidase, retinoid-inducible serine caroboxypetidase | |
| 3838 | 1683 | NM_031621 | e, ww | linker of T-cell receptor pathways, lymphocyte adaptor protein | ESTs, Weakly similar to linker of T-cell receptor pathways [*Rattus norvegicus*] [*R. norvegicus*], ESTs, Weakly similar to ShcC [*M. musculus*], linker of T-cell receptor pathways, lymphocyte adaptor protein, src homology 2 domain-containing transforming protein C1, src homology 2 domain-containing transforming protein D |
| 3125 | 16613 | NM_012732 | c | lipase A, lysosomal acid, cholesterol esterase (Wolman disease), lysosomal acid lipase 1 | ESTs, Weakly similar to cholesterol esterase (pancreatic), see D3Wox12, D3Wox13, D3Wox26 and D3Mgh25 [*Rattus norvegicus*] [*R. norvegicus*], lipase A, lysosomal acid, cholesterol esterase (Wolman disease), lysosomal acid lipase 1 |
| 3125 | 10260 | NM_012732 | y | lipase A, lysosomal acid, cholesterol esterase (Wolman disease), lysosomal acid lipase 1 | ESTs, Weakly similar to cholesterol esterase (pancreatic), see D3Wox12, D3Wox13, D3Wox26 and D3Mgh25 [*Rattus norvegicus*] [*R. norvegicus*], lipase A, lysosomal acid, cholesterol esterase (Wolman disease), lysosomal acid base 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3085 | 2505 | NM_012597 | w | lipase, hepatic | ESTs, Weakly similar to S15893 triacylglycerol lipase [*M. musculus*], lipase, hepatic |
| 3553 | 10509 | NM_022268 | p, General | liver glycogen phosphorylase, phosphorylase, glycogen; liver (Hers disease, glycogen storage disease type VI) | liver glycogen phosphorylase, muscle glycogen phosphorylase, phosphorylase, glycogen; liver (Hers disease, glycogen storage disease type VI) |
| 3553 | 25814 | NM_022268 | l | liver glycogen phosphorylase, phosphorylase, glycogen; liver (Hers disease, glycogen storage disease type VI) | liver glycogen phosphorylase, muscle glycogen phosphorylase, phosphorylase, glycogen; liver (Hers disease, glycogen storage disease type VI) |
| 3357 | 1541 | NM_017193 | ee | L-kynurenine/alpha-aminoadipate aminotransferase, kynurenine aminotransferase II | |
| 3161 | 18767 | NM_012857 | qq | lysosomal membrane glycoprotein 1, lysosomal-associated membrane protein 1 | CD68 antigen, ESTs, Weakly similar to LMP1_RAT LYSOSOME-ASSOCIATED MEMBRANE GLYCOPROTEIN 1 PRECURSOR (LAMP-1) (120 KD LYSOSOMAL MEMBRANE GLYCOPROTEIN) (LGP-120) (CD107A) [*R. norvegicus*], chromosome 20 open reading frame 103, lysosomal membrane glycoprotein 1, lysosomal-associated membrane protein 1, lysosomal-associated membrane protein 3 |
| 3161 | 18770 | NM_012857 | m, ff, ii, rr | lysosomal membrane glycoprotein 1 lysosomal-associated membrane protein 1 | CD68 antigen, ESTs, Weakly similar to LMP1_RAT LYSOSOME-ASSOCIATED MEMBRANE GLYCOPROTEIN 1 PRECURSOR (LAMP-1) (120 KD LYSOSOMAL MEMBRANE GLYCOPROTEIN) (LGP-120) (CD107A) [*R. norvegicus*], chromosome 20 open reading frame 103, lysosomal membrane glycoprotein 1, lysosomal-associated membrane protein 1, lysosomal-associated membrane protein 3 |
| 2961 | 790 | L10073 | g | lysosomal membrane glycoprotein 1, lysosomal-associated membrane protein 1 | |
| 3309 | 6653 | NM_017068 | tt | lysosomal membrane glycoprotein 2, lysosomal-associated membrane protein 2 | CD68 antigen, ESTs, Weakly similar to JC4317 lysosome-associated membrane protein 2 precursor, splice form B [*H. sapiens*], lysosomal membrane glycoprotein 2, lysosomal-associated membrane protein 2 |
| 663 | 12118 | AA892775 | l, General, gg, hh, kk | lysozyme, lysozyme (renal amyloidosis) | EST, Weakly similar to LYC1_RAT Lysozyme C, type 1 precursor (1,4-beta-N-acetylmuramidase C) [*R. norvegicus*], RIKEN cDNA 9530003J23 gene, lysozyme, lysozyme (renal amyloidosis), similar to lysozyme C-1 (1,4-beta-N-acylmuramidase C.EC3.2.1.17) |
| 3308 | 1942 | NM_017061 | a | lysyl oxidase | ESTs, Moderately similar to LYOX_HUMAN PROTEIN-LYSINE 6-OXIDASE PRECURSOR [*H. sapiens*], ESTs, Moderately similar to LYOX_RAT Protein-lysine 6-oxidase precursor (Lysyl oxidase) [*R. norvegicus*], ESTs, Weakly similar to LYOX_RAT Protein-lysine 6-oxidase precursor (Lysyl oxidase) [*R. norvegicus*], lysyl oxidase, lysyl oxidase-like, lysyl oxidase-like 1, lysyl oxidase-like 2 |
| 3308 | 1946 | NM_017061 | ss | lysyl oxidase | ESTs Moderately similar to LYOX_HUMAN PROTEIN-LYSINE 6-OXIDASE PRECURSOR [*H. sapiens*], ESTs, Moderately similar to LYOX_RAT Protein-lysine 6-oxidase precursor (Lysyl oxidase) [*R. norvegicus*], ESTs, Weakly similar to LYOX_RAT Protein-lysine 6-oxidase precursor (Lysyl oxidase) [*R. norvegicus*], lysyl oxidase, lysyl oxidase-like, lysyl oxidase-like 1, lysyl oxidase-like 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3446 | 15242 | NM_019191 | f, General, jj | MAD homolog 2 (*Drosophila*), MAD, mothers against decapentaplegic homolog 2 (*Drosophila*) | MAD homolog 2 (*Drosophila*), MAD, mothers against decapentaplegic homolog 2 (*Drosophila*) |
| 4427 | 12859 | X53052 | s, v | major intrinsic protein of eye lens fiber, major intrinsic protein of lens fiber | |
| 1304 | 17353 | AI008020 | o | malic enzyme 1, NADP(+)-dependent, cytosolic, malic enzyme, supernatant | |
| 3087 | 18746 | NM_012600 | gg, hh | malic enzyme 1, NADP(+)-dependent, cytosolic, malic enzyme, supernatant | |
| 3004 | 6626 | M24353 | l, k, General, ll | mannosidase 2, alpha 1, mannosidase, alpha, class 2A, member 1 | EST, Weakly similar to MAN2_HUMAN ALPHA-MANNOSIDASE II [*H. sapiens*], KIAA0935 protein, mannosidase 2, alpha 1, mannosidase 2, alpha B1, mannosidase 2, alpha B2, mannosidase, alpha, class 2A, member 2, mannosidase, alpha, class 2B, member 1 |
| 3442 | 269 | NM_019180 | d | mast cell protease 6, tryptase, alpha | EST, Moderately similar to C35863 tryptase [*H. sapiens*], EST, Weakly similar to JC4171 tryptase (EC 3.4.21.59) precursor - rat [*R. norvegicus*], ESTs, Weakly similar to MCT6 MOUSE MAST CELL PROTEASE 6 PRECURSOR [*M. musculus*], *Mus musculus* mRNA for testis serine protease2, complete cds, implantation serine protease 1, mast cell protease 6, tryptase beta 1 |
| 3198 | 1525 | NM_012980 | v | matrix metalloproteinase 11, matrix metalloproteinase 11 (stromelysin 3) | ESTs, Weakly similar to JC6197 stromelysin 3 (EC 3.4.24.-) - rat [*R. norvegicus*], matrix metalloproteinase 11, matrix metalloproteinase 11 (stromelysin 3), matrix metalloproteinase-like 1 |
| 3162 | 395 | NM_012864 | v | matrix metalloproteinase 7 matrix metalloproteinase 7 (matrilysin, uterine) | |
| 4363 | 16675 | U17565 | ww | MCM6 minichromosome maintenance deficient 6 (MIS5 homolog, *S. pombe*)(*S. cerevisiae*), mini chromosome maintenance deficient 6 (*S. cerevisaie*) | EST Weakly similar to MCM5_HUMAN DNA REPLICATION LICENSING FACTOR MCM5 [*H. sapiens*], ESTs, Weakly similar to MCM6_HUMAN DNA REPLICATION LICENSING FACTOR MCM6 [*H. sapiens*], MCM2 minichromosome maintenance deficient 2, mitotin (*S. cerevisiae*), MCM6 minichromosome maintenance deficient 6 (MIS5 homolog, *S. pombe*) (*S. cerevisiae*), mini chromosome maintenance deficient 2 (*S. cerevisiae*), mini chromosome maintenance deficient 5 (*S. cerevisaie*), mini chromosome maintenance deficient 6 (*S. cerevisaie*), mini chromosome maintenance deficient 7 (*S. cerevisaie*) |
| 549 | 19321 | AA891666 | t | melanoma antigen, family D,1 | RIKEN cDNA 17CDC56A17 gene, RIKEN cDNA 1700080016 gene, RIKEN cDNA 2410003J06 gene, RIKEN cDNA 3830417A13 gene, melanoma antigen, family D, 1, melanoma antigen, family L, 2 |
| 3936 | 17933 | NM_032615 | m, o, z, General, dd, rr | membrane interacting protein of RGS16 | |
| 3936 | 17934 | NM_032615 | o, z, General, nn | membrane interacting protein of RGS16 | |
| 3936 | 17935 | NM_032615 | o, s | membrane interacting protein of RGS16 | |
| 3089 | 16850 | NM_012608 | k | membrane metallo endopeptidase, membrane metallo-endopeptidase (neutral endopeptidase, enkephalinase, CALLA, CD10) | ESTs, Highly similar to NEP_HUMAN NEPRILYSIN [*H. sapiens*], *Mus musculus* endothelin converting enzyme-2 mRNA, complete cds, membrane metallo endopeptidase, membrane metallo endopeptidase (neutral endopeptidase, enkephalinase, CALLA, CD10) |
| 3251 | 5837 | NM_013143 | s | meprin 1 alpha, meprin A, alpha (PABA peptide hydrolase) | expressed sequence AI098089, meprin 1 alpha, meprin A, alpha (PABA peptide hydrolase) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4245 | 16354 | NM_138843 | v, xx | mercaptopyruvate sulfurtransferase | ESTs, Moderately similar to THTM_RAT 3-MERCAPTOPYRUVATE SULFURTRANSFERASE (MST) [*R. norvegicus*], mercaptopyruvate sulfurtransferase, thiosulfate sulfurtransferase mitochondrial |
| 4239 | 15189 | NM_138826 | q, w | metallothionein 1, metallothionein 1A (functional) | EST, Moderately similar to Cd-7 Metallothionein-2 [*H. sapiens*], EST, Moderately similar to SMHU1E metallothionein 1E [*H. sapiens*], ESTs, Moderately similar to MT1_RAT METALLOTHIONEIN-I (MT-I) [*R. norvegicus*], metallothionein 1, metallothionein 4 metallothionein IV |
| 4239 | 15190 | NM_138826 | n, w, ii | metallothionein 1, metallothionein 1A (functional) | EST, Moderately similar to Cd-7 Metallothionein-2 [*H. sapiens*], EST, Moderately similar to SMHU1E metallothionein 1E [*H. sapiens*], ESTs, Moderately similar to MT1_RAT METALLOTHIONEIN-I (MT-I) [*R. norvegicus*], metallothionein 1, metallothionein 4, metallothionein IV |
| 234 | 576 | AA819118 | vv | methionine adenosyltransferase I, alpha | *Mus musculus*, clone MGC:6545 IMAGE:2655444, mRNA, complete cds, expressed sequence AI046368, methionine adenosyltransferase I, alpha |
| 4421 | 575 | X15734 | a, l | methionine adenosyltransferase I, alpha | *Mus musculus*, clone MGC:6545 IMAGE:2655444, mRNA, complete cds, expressed sequence AI046368, methionine adenosyltransferase I, alpha |
| 3593 | 8984 | NM_022539 | ww | methionine aminopeptidase 2, methionyl aminopeptidase 2 | ESTs, Moderately similar to AMP2 MOUSE METHIONINE AMINOPEPTIDASE 2 [*M. musculus*], methionine aminopeptidase 2, methionyl aminopeptidase 2 |
| 3734 | 400 | NM_031062 | jj, ww | mevalonate (diphospho) decarboxylase | diphosphomevalonate decarboxylase, mevalonate (diphospho) decarboxylase |
| 3735 | 21701 | NM_031063 | jj | mevalonate kinase, mevalonate kinase (mevalonic aciduria) | mevalonate kinase, mevalonate kinase (mevalonic aciduria) |
| 3364 | 13938 | NM_017212 | g | microtubule-associated protein tau | |
| 3590 | 5666 | NM_022529 | r | mitochondrial ribosomal protein L23 | |
| 4164 | 17564 | NM_133283 | ff | mitogen activated protein kinase kinase 2, mitogen-activated protein kinase kinase 2 | |
| 4164 | 21848 | NM_133283 | v, y | mitogen activated protein kinase kinase 2, mitogen-activated protein kinase kinase 2 | |
| 4164 | 21849 | NM_133283 | ff | mitogen activated protein kinase kinase 2, mitogen-activated protein kinase kinase 2 | |
| 3378 | 1418 | NM_017246 | u, cc | mitogen activated protein kinase kinase 5, mitogen-activated protein kinase kinase 5 | mitogen activated protein kinase kinase 5, mitogen-activated protein kinase kinase 5 |
| 3224 | 12370 | NM_013055 | u | mitogen activated protein kinase kinase kinase 12, mitogen-activated protein kinase kinase kinase 12 | ESTs, Highly similar to A55318 serine/threonine protein kinase [*M. musculus*], *Mus musculus*, Similar to mitogen-activated protein kinase kinase kinase 9, clone MGC:27778 IMAGE:3156324, mRNA, complete cds, RIKEN cDNA 9130019115 gene, expressed sequence 081508, mitogen activated protein kinase kinase kinase 11, mitogen activated protein kinase kinase kinase 12, mitogen-activated protein kinase kinase 10, mitogen-activated protein kinase kinase kinase 11, mitogen-activated protein |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3839 | 14956 | NM_031622 | l | mitogen-activated protein kinase 6 | kinase kinase kinase 12, mitogen-activated protein kinase kinase kinase 13, mitogen-activated protein kinase kinase kinase 7 ESTs, Weakly similar to 840033 protein kinase (EC 2.7.1.37) ERK3 - rat [*R. norvegicus*], mitogen-activated protein kinase kinase 4, mitogen-activated protein kinase 6 |
| 872 | 16499 | AA925300 | d | mitogen-activated protein kinase kinase kinase 3 | ESTs, Highly similar to M3K3 MOUSE MITOGEN-ACTIVATED PROTEIN KINASE KINASE KINASE 3 [*M. musculus*], ESTs, Moderately similar to S12207 hypothetical protein [*M. musculus*], ESTs, Weakly similar to M3K3_HUMAN MITOGEN-ACTIVATED PROTEIN KINASE KINASE KINASE 3 [*H. sapiens*], hypothetical protein FLJ23074, mitogen activated protein kinase kinase kinase 1, mitogen activated protein kinase kinase kinase 2, mitogen activated protein kinase kinase kinase 3, mitogen-activated protein kinase kinase kinase 2, mitogen-activated protein kinase kinase kinase 3 |
| 3626 | 58 | NM_022715 | nn | Mitral valve prolapse, familial, major vault protein | |
| 2879 | 18456 | D00688 | bb | monoamine oxidase A | KIAA0601 protein, monoamine oxidase A |
| 4226 | 12215 | NM_138502 | o | monoglyceride lipase | *Homo sapiens* cDNA: FLJ22330 fis, clone HRC05729, highly similar to AF131821 *Homo sapiens* clone 24877 mRNA sequence, monoglyceride lipase |
| 3962 | 14934 | NM_053337 | m, x, ll, ww | Msx-interacting zinc finger, Protein inhibitor of activated STAT X | DNA segment, Chr 11 Brigham & Women's Genetics 0280e expressed, Msx-interacting-zinc finger, Protein inhibitor of activated STAT X |
| 1258 | 15292 | AF012714 | ff | multiple inositol polyphosphate histidine phosphatase 1, multiple inositol polyphosphate histidine phosphatase, 1 | |
| 1968 | 15291 | AI111401 | t, ff, mm | multiple inositol polyphosphate histidine phosphatase 1, multiple inositol polyphosphate histidine phosphatase, 1 | |
| 3088 | 2628 | NM_012603 | f, l, y, z, General | myelocytomatosis oncogene, v-myc myelocytomatosis viral oncogene homolog (avian) | myelocytomatosis oncogene, v-myc myelocytomatosis viral oncogene homolog (avian) |
| 3088 | 2629 | NM_012603 | f, l, l, z, General, nn | myelocytomatosis oncogene, v-myc myelocytomatosis viral oncogene homolog (avian) | myelocytomatosis oncogene, v-myc myelocytomatosis viral oncogene homolog (avian) |
| 3375 | 1498 | NM_017239 | v | myosin heavy chain, cardiac muscle, adult, myosin, heavy polypeptide 6, cardiac muscle, alpha (cardiomyopathy, hypertrophic 1) | EST, Weakly similar to MYH6_RAT Myosin heavy chain, cardiac muscle alpha isoform (MyHC-alpha) [*R. norvegicus*], ESTs, Moderately similar to MYOSIN HEAVY CHAIN, CARDIAC MUSCLE ALPHA ISOFORM [*M. musculus*], ESTs, Weakly similar to MYSA_HUMAN MYOSIN HEAVY CHAIN, CARDIAC MUSCLE ALPHA ISOFORM [*H. sapiens*], KIAA1000 protein, myosin heavy chain, cardiac muscle, adult, myosin, heavy polypeptide 2, skeletal muscle, muscle, adult, myosin, heavy polypeptide 4, skeletal muscle, myosin, heavy polypeptide 7 cardiac muscle beta |
| 2455 | 21296 | AI227641 | j | myosin light chain, phosphorylatable, cardiac ventricles, myosin, light polypeptide 2, regulatory, cardiac, slow | |
| 1626 | 24336 | AI045621 | r | myristoylated alanine rich protein kinase C substrate, myristoylated alanine-rich protein kinase C substrate | *Mus musculus* 8 days embryo whole body cDNA, RIKEN full-length enriched library, clone:5730519L10:myristoylated alanine rich protein kinase C substrate, full insert sequence, myristoylated alanine rich protein kinase C substrate, myristoylated alanine-rich protein kinase C substrate |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3050 | 1421 | NM_012500 | f | N-acylaminoacyl-peptide hydrolase, acylpeptide hydrolase | *Mus musculus*, clone IMAGE:4974221, mRNA, partial cds, N-acylaminoacyl-peptide hydrolase |
| 3289 | 1698 | NM_017000 | e | NAD(P)H dehydrogenase, quinone 1 | ESTs, Weakly similar to A34162 NAD(P)H dehydrogenase (quinone) (EC 1.6.99.2) - rat [*R. norvegicus*], NAD(P)H dehydrogenase, quinone 1, NAD(P)H dehydrogenase, quinone 2, NAD(P)H menadione oxidoreductase 2, dioxin inducible |
| 3454 | 20938 | NM_019223 | t | NADH dehydrogenase (ubiquinone) Fe-S protein 6 (13 kD) (NADH-coenzyme Q reductase), NADH dehydrogenase Fe-S protein 6 | ESTs, Highly similar to NUMM MOUSE NADH-UBIQUINONE OXIDOREDUCTASE 13 KD-A SUBUNIT [*M. musculus*], NADH dehydrogenase (ubiquinone) Fe-S protein 6 (13 kD) (NADH-coenzyme Q reductase) |
| 29 | 16901 | AA799479 | r | NADH dehydrogenase (ubiquinone) Fe-S protein 8 (23 kD) (NADH-coenzyme Q reductase) | NADH dehydrogenase (ubiquinone) Fe-S protein 8 (23 kD) (NADH-coenzyme Q reductase) |
| 3090 | 9174 | NM_012612 | g | natriuretic peptide precursor A, natriuretic peptide precursor type A | |
| 3809 | 18389 | NM_031545 | gg, hh | natriuretic peptide precursor B, natriuretic peptide precursor type B | EST, Moderately similar to ANFB MOUSE BRAIN NATRIURETIC PEPTIDE PRECURSOR [*M. musculus*], natriuretic peptide precursor B, natriuretic peptide precursor type B |
| 3200 | 24492 | NM_012987 | jj | nestin | ESTs, Highly similar to S21424 nestin [*H. sapiens*], nestin |
| 4134 | 16108 | NM_080585 | d, q, gg, hh | N-ethylmaleimide sensitive fusion protein attachment protein alpha, N-ethylmaleimide-sensitive factor attachment protein, alpha | N-ethylmaleimide sensitive fusion protein attachment protein alpha, N-ethylmaleimide sensitive fusion protein attachment protein beta, N-ethylmaleimide sensitive fusion protein attachment protein gamma, N-ethylmaleimide-sensitive factor attachment protein, alpha, N-ethylmaleimide-sensitive factor attachment protein, gamma |
| 4134 | 16109 | NM_080585 | e, q | N-ethylmaleimide sensitive fusion protein attachment protein alpha, N-ethylmaleimide-sensitive factor attachment protein, alpha | N-ethylmaleimide sensitive fusion protein attachment protein alpha, N-ethylmaleimide sensitive fusion protein attachment protein beta N-ethylmaleimide sensitive fusion protein attachment protein gamma, N-ethylmaleimide-sensitive factor attachment protein, alpha, N-ethylmaleimide-sensitive factor attachment protein, gamma |
| 3801 | 1783 | NM_031521 | oo | neural cell adhesion molecule 1 | ESTs, Weakly similar to I38344 titin, cardiac muscle [*H. sapiens*], RIKEN cDNA 2900042E01 gene, neural cell adhesion molecule 1, neural cell adhesion molecule 2 |
| 4381 | 11916 | U50842 | qq | neural precursor cell expressed, developmentally down-regulated 4, neural precursor cell expressed, developmentally down-regulated gene 4a | |
| 4250 | 9896 | NM_138878 | p | neural precursor cell expressed, developmentally down-regulated 8, neural precursor cell expressed, developmentally down-regulated gene 8 | EST, Highly similar to S66575 ubiquitin/ribosomal protein CEP52 - rat (fragment) [*R. norvegicus*], ESTs, Moderately similar to ubiquitin A-52 residue ribosomal protein fusion product 1; ubiquitin/60S ribosomal fusion protein [*Mus musculus*] [*M. musculus*], neural precursor cell expressed, developmentally down-regulated 8, neural precursor cell expressed, developmentally down-regulated gene 8, ubiquitin A-52 residue ribosomal protein fusion product 1 |
| 3833 | 19023 | NM_031609 | cc | neuroblastoma, suppression of tumorigenicity 1 | dante, neuroblastoma, suppression of tumorigenicity 1 |
| 3091 | 24506 | NM_012614 | d, v | neuropeptide Y | RIKEN cDNA 071CDC5A05 gene, neuropeptide Y |
| 3463 | 24849 | NM_019248 | e, u | neurotrophic tyrosine kinase, receptor, type 3 | neurotrophic tyrosine kinase, receptor, type 3 |
| 2767 | 14666 | AI236912 | z | NGFI-A binding protein 1 (EGR1 binding protein 1), Ngfi-A binding protein 1 | EST, Weakly similar to Ngfi-A binding protein 1 [*Rattus norvegicus*] [*R. norvegicus*], NGFI-A binding protein 1 (EGRi binding |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | protein 1), NGFI-A binding protein 2 (EGR1 binding protein 2), Ngfi-A binding protein 1, Ngfi-A binding protein 2 |
| 4390 | 1715 | U72660 | o, mm | ninjurin 1 | ninjurin 1, ninjurin 2 |
| 3387 | 570 | NM_017271 | a, l, v, General, dd, oo | nuclear distribution gene C homolog (*A. ridulans*) nuclear distribution gene C homolog (*Aspergillus*) | ESTs, Moderately similar to A55897 prolactin-induced T cell protein c15 - rat [*R. norvegicus*], KIAA1 068 protein, *Mus musculus*, Similar to KIAA1068 protein, clone IMAGE:4236345, mRNA, partial cds, expressed sequence AL022907, nuclear distribution gene C homolog (*A. ridulans*), |
| 3201 | 764 | NM_012988 | c, p, r, z, General | nuclear factor I/A | nuclear factor I/A, nuclear factor I/B, nuclear factor I/C, nuclear factor I/X, nuclear factor I/X (CCAAT-binding transcription factor) |
| 3201 | 765 | NM_012988 | h, q, z, General | nuclear factor I/A | nuclear factor I/A, nuclear factor I/B, nuclear factor I/C, nuclear factor I/X, nuclear factor I/X (CCAAT-binding transcription factor) |
| 1249 | 17963 | AB012231 | h | nuclear factor 1B | Nuclear Factor IA, nuclear factor IA, nuclear factor I/B, nuclear factor I/C, nuclear factor IX, nuclear factor IIX (CCAAT-binding transcription factor) |
| 1250 | 24414 | AB012234 | ii | nuclear factor l/X, nuclear factor l/X (CCAAT-binding transcription factor) | Nuclear Factor IA, nuclear factor I/A, nuclear factor I/B, nuclear factor I/C, nuclear factor IX, nuclear factor l/X (CCAAT-binding transcription factor) |
| 4453 | 25090 | X63594 | ii | nuclear factor of kappa light chain gene enhancer in B-cells inhibitor, alpha, nuclear factor of kappa light polypeptide gene enhancer in B-cells inhibitor, aloha | |
| 3841 | 1639 | NM_031627 | c, x, General, ss | nuclear receptor subfamily 1, group H, member 3 | EST, Moderately similar to NRH3_RAT Oxysterols receptor LXR-alpha (Liver X receptor alpha) (Nuclear orphan receptor LXR-alpha) (RLD-1) [*R. norvegicus*], EST, Weakly similar to 138975 nuclear orphan receptor LXR-alpha L*H. sapiens*], expressed sequence AU018371, nuclear receptor subfamily 1, group H, member 3 |
| 3529 | 19712 | NM_021745 | t, General, ff, kk, oo | nuclear receptor subfamily 1, group H, member 4 | EST, Weakly similar to 138975 nuclear orphan receptor LXR-alpha [*H. sapiens*], ESTs, Moderately similar to JC4014 steroid hormone-nuclear receptor NER [*H. sapiens*], expressed sequence AI957360, nuclear receptor subfamily 1, group H, member 4 |
| 3876 | 1214 | NM_031741 | z, jj | nuclear receptor subfamily 1 group H, member 4 solute carrier family 2 (facilitated glucose transporter) member 5, solute carrier family 2 (facilitated glucose/fructose transporter), member 5, synaptojanin 2 binding protein | solute carrier family 2 (facilitated glucose transporter), member 5, solute carrier family 2 (facilitated glucose/fructose transporter), member 5 |
| 352 | 719709 | NM_021742 | d | nuclear receptor subfamily 5, group A, member 2 | nuclear receptor subfamily 5, group A, member 2, nuclear receptor subfamily 6, group A, member 1 |
| 1287 | 18731 | AF093139 | ww | nuclear RNA export factor 1, nuclear RNA export factor 1 homolog (*S. cerevisiae*) | |
| 488 | 4339 | AA875121 | d | nuclear transcription factor Y, gamma, nuclear transcription factor-Y gamma | |
| 3163 | 4338 | NM_012866 | ll | nuclear transcription factor Y, gamma, nuclear transcription factor-Y gamma | |
| 3815 | 16164 | NM_031563 | h, m, n, General | nuclease sensitive element binding protein 1 | ESTs, Highly similar to 139382Y box-binding protein 1 - human [*H. sapiens*], ESTs, Moderately similar to P50015 DNA-binding protein B [*H. sapiens*], RIKEN cDNA 1700102N10 gene, Y box protein 2, nuclease sensitive element binding protein 1 |
| 3203 | 17393 | NM_012992 | b, l, j, General, qq | nucleophosmin (nucleolar phosphoprotein B23, numatrin), nucleophosmin 1 | ESTs, Highly similar to A32915 nucleophosmin [*H. sapiens*], nucleophosmin 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3203 | 17394 | NM_012992 | General | nucleophosmin (nucleolar phosphoprotein B23, numatrin), nucleophosmin 1 | ESTs, Highly similar to A32915 nucleophosmin [*H. sapiens*], nucleophosmin 1 |
| 3202 | 16417 | NM_012991 | l, x, General, vv | nucleoporin 50 kD, nucleoprotein 50 | nucleoporin 50 kD, nucleoprotein 50 |
| 3738 | 1855 | NM_031074 | d | nucleoporin 98, nucleoporin 98 kD | ESTs, Weakly similar to period clock protein [*M. musculus*], RIKEN cDNA 4930432K09 gene, RIKEN cDNA 5430432N15 gene, expressed sequence AA589586, homeo box D13, melanoma antigen, family D, 3, nucleoporin 98 kD, nucleoporin p45, nucleoporin p58, plasma membrane associated protein S3-12 |
| 1278 | 16006 | AF062594 | m, ii | nucleosome assembly protein 1-like 1 | ESTs, Highly similar to 2008109A set gene [*Rattus norvegicus*] [*R. norvegicus*], ESTs, Highly similar to SET_HUMAN SET PROTEIN [*H. sapiens*], SET translocation, SET translocation (myeloid leukemia-associated), nucleosome assembly protein 1-like 1 |
| 1410 | 16010 | AI011922 | e | nucleosome assembly protein 1-like 1 | ESTs, Highly similar to 2008109A set gene [*Rattus norvegicus*] [*R. norvegicus*], ESTs, Highly similar to SET_HUMAN SET PROTEIN [*H. sapiens*], SET translocation, SET translocation (myeloid leukemia-associated), nucleosome assembly protein 1-like 1 |
| 2943 | 24513 | J02705 | v | oncomodulin | oncomodulin |
| 3232 | 13282 | NM_013078 | n, jj | ornithine carbamoyltransferase, ornithine transcarbamylase | ornithine carbamoyltransferase, ornithine transcarbamylase |
| 3232 | 13283 | NM_013078 | h, l, m, s, General, cc, uu | ornithine carbamoyltransferase, ornithine transcarbamylase | ornithine carbamoyltransferase, ornithine transcarbamylase |
| 3092 | 23522 | NM_012615 | c, g, l, m, n, w, General, kk | ornithine decarboxylase 1, ornithine decarboxylase, structural | ESTs, Highly similar to DCOR MOUSE ORNITHINE DECARBOXYLASE [*M. musculus*], ESTs, Weakly similar to DCOR MOUSE ORNITHINE DECARBOXYLASE [*M. musculus*], ESTs, Weakly similar to DCOR_HUMAN ORNITHINE DECARBOXYLASE [*H. sapiens*], ornithine decarboxylase 1, ornithine decarboxylase, structural, ornithine decarboxylase-like protein |
| 3092 | 23523 | NM_012615 | l, v | ornithine decarboxylase 1, ornithine decarboxylase, structural | ESTs, Highly similar to DCOR MOUSE ORNITHINE DECARBOXYLASE [*M. musculus*], ESTs, Weakly similar to DCOR MOUSE ORNITHINE DECARBOXYLASE [*M. musculus*], ESTs, Weakly similar to DCOR_HUMAN ORNITHINE DECARBOXYLASE [*H. sapiens*], ornithine decarboxylase 1, ornithine decarboxylase, structural, ornithine decarboxylase-like protein |
| 3596 | 21062 | NM_022585 | c, kk, tt, ww | ornithine decarboxylase antizyme inhibitor | ESTs, Weakly similar to ODCI_MOUSE Ornithine decarboxylase antizyme inhibitor [*M. musculus*], ornithine decarboxylase antizyme inhibitor |
| 3596 | 21063 | NM_022585 | ff | ornithine decarboxylase antizyme inhibitor | ESTs, Weakly similar to ODCI_MOUSE Ornithine decarboxylase antizyme inhibitor [*M. musculus*], ornithine decarboxylase antizyme inhibitor |
| 4264 | 15134 | NM_139081 | c | ornithine decarboxylase antizyme, ornithine decarboxylase antizyme 1 | |
| 4264 | 25250 | NM_139081 | c, t | ornithine decarboxylase antizyme, ornithine decarboxylase antizyme 1 | |
| 4264 | 25251 | NM_139081 | c, m | ornithine decarboxylase antizyme, ornithine decarboxylase antizyme 1 | |
| 3951 | 412 | NM_053288 | y | orosomucoid 1 | orosomucoid 1, orosomucoid 2, orosomucoid 3 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2949 | 20549 | K01701 | y | oxytocin, oxytocin, prepro- (neurophysin I) | ESTs, Moderately similar to NEU1 MOUSE OXYTOCIN-NEUROPHYSIN 1 PRECURSOR [*M. musculus*], oxytocin, oxytocin, prepro- (neurophysin I) |
| 3818 | 1920 | NM_031576 | c, cc | P450 (cytochrome) oxidoreductase | |
| 3491 | 18819 | NM_019367 | gg, hh, ii | palmitoyl-protein thioesterase 2 | palmitoyl-protein thioesterase 2 |
| 3575 | 5319 | NM_022502 | r, u, z | palmitoyl-protein thioesterase, palmitoyl-protein thioesterase 1 (ceroid-lipofuscinosis, neuronal 1, infantile) | DNA segment, Chr 4, ERATO Doi 184, expressed, ESTs, Moderately similar to PPT MOUSE PALMITOYL-PROTEIN THIOESTERASE PRECURSOR [*M. musculus*], ESTs, Weakly similar to A54717 palmitoyl-protein thioesterase precursor - rat [*R. norvegicus*], ESTs, Weakly similar to PPT MOUSE PALMITOYL PROTEIN THIOESTERASE PRECURSOR [*M. musculus*], Mus musculus adult male thymus cDNA, RIKEN full-length enriched library, clone:5830469K14:palmitoyl-protein thioesterase, full insert sequence, RIKEN cDNA 9530002B09 gene, palmitoyl-protein thioesterase, palmitoyl-protein thioesterase 1 (ceroid-lipofuscinosis, neuronal 1, infantile) |
| 3775 | 16157 | NM_031235 | oo | par-3 (partitioning defective 3) homolog (*C. elegans*), par-3 partitioning defective 3 homolog (*C. elegans*) | RIKEN cDNA 2810455B10 gene, RIKEN cDNA 4930448K12 gene, amyotrophic lateral sclerosis 2 (juvenile) chromosome region, candidate 19, par-3 (partitioning defective 3) homolog (*C. elegans*) |
| 3572 | 9183 | NM_022499 | s, nn | parvalbumin | parvalbumin |
| 3368 | 18147 | NM_017226 | cc | peptidyl arginine deiminase, type II | ESTs, Highly similar to PROTEIN-ARGININE DEIMINASE [*M. musculus*], peptidyl arginine deiminase, type II |
| 3206 | 1640 | NM_013000 | pp | peptidylglycine alpha-amidating monooxygenase | ESTs, Weakly similar to AMD MOUSE PEPTIDYL-GLYCINE ALPHA-AMIDATING MONOOXYGENASE PRECURSOR [*M. musculus*], peptidylglycine alpha-amidating monooxygenase |
| 3206 | 1649 | NM_013000 | n | peptidylglycine alpha-amidating monooxygenase | ESTs, Weakly similar to AMD MOUSE PEPTIDYL-GLYCINE ALPHA-AMIDATING MONOOXYGENASE PRECURSOR [*M. musculus*], peptidylglycine alpha-amidating monooxygenase |
| 3321 | 4392 | NM_017101 | mm | peptidylprolyl isomerase A, peptidylprolyl isomerase A (cyclophilin A) | EST, Moderately similar to A Chain A, Cyclophilin A [*H. sapiens*], ESTs, Highly similar to CYPH MOUSE PEPTIDYL-PROLYL CIS-TRANS ISOMERASE A [*M. musculus*], ESTs, Moderately similar to A Chain A, Human Cyclophilin A Complexed With 2-Thr Cyclosporin [*H. sapiens*], ESTs, Weakly similar to A Chain A, Cyclophilin A [*H. sapiens*], ESTs, Weakly similar to A Chain A, Human Cyclophilin A Complexed With 2-Thr Cyclosporin [*H. sapiens*], ESTs, Weakly similar to CYPH_RAT Peptidyl-prolyl cis-trans isomerase A (PPIase) (Rotamase) (Cyclophilin A) (Cyclosporin A-binding protein) (P31) [*R. norvegicus*], RIKEN cDNA 2510026K04 gene, expressed sequence AI256741, expressed sequence AW457192, peptidylprolyl isomerase A |
| 3321 | 4393 | NM_017101 | bb, mm | peptidylprolyl isomerase A, peptidyiprolyl isomerase A (cyclophilin A) | EST, Moderately similar to A Chain A, Cyclophilin A [*H. sapiens*], ESTs, Highly similar to CYPH MOUSE PEPTIDYL-PROLYL 015-TRANS ISOMERASE A [*M. musculusj*, ESTs, Moderately similar to A Chain A, Human Cyclophilin A Complexed With 2-Thr Cyclosporin [*H. sapiens*], ESTs, Weakly similar to A Chain A, Cyclophilin A [*H. sapiens*], ESTs, Weakly similar to A Chain A, Human Cyclophilin A Complexed With 2-Thr Cyclosporin [*H. sapiens*], ESTs, Weakly similar to CYPH_RAT Peptidyl-prolyl |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | cis-trans isomerase A (PPIase) (Rotamase) (Cyclophilin A) (Cyclosporin A-binding protein) (P31) [*R. norvegicus*], RIKEN cDNA 251 0026 kD4 gene, expressed sequence AI256741, expressed sequence AW4571 92, peptidylprolyl isomerase A |
| 3301 | 4500 | NM_017037 | m, General, ii, qq, uu, vv | peripheral myelin protein 22, peripheral myelin protein, 22 kDa | peripheral myelin protein 22, peripheral myelin protein, 22 kDa |
| 1252 | 22567 | AB017544 | u, kk | peroxisomal biogenesis factor 14 | peroxisomal biogenesis factor 14 |
| 3822 | 405 | NM_031587 | f, k, w, cc | peroxisomal membrane protein 2 (22 kD), peroxisomal membrane protein 2, 22 kDa | ESTs, Weakly similar to MPV1 MOUSE MPV17 PROTEIN [*M. musculus*], MpV17 transgene, murine homolog, glomerulosclerosis, Mpvl 7 transgene, kidney disease mutant, peroxisomal membrane protein 2, 22 kDa |
| 4168 | 8436 | NM_133299 | b, General, vv | peroxisomal trans 2-enoyl reductase; putative short chain alcohol dehydrogenase, peroxisomal trans-2-enoyl-CoA reductase | CoA 2,4-dienoyl CoA reductase 1, mitochondrial, 2,4-dienoyl CoA reductase 2, peroxisomal, 2 4-dienoyl-Coenzyme A reductase 2, peroxisomal, peroxisomal trans-2-enoyl-CoA reductase, putative peroxisomal 2,4-dienoyl-CoA reductase |
| 1681 | 8330 | AI059434 | g | peroxisome proliferative activated receptor, gamma, coactivator 1 | |
| 3093 | 6055 | NM_012619 | b, l, General, uu | phenylalanine hydroxylase | ESTs, Highly similar to WHHUF phenylalanine 4-monooxygenase [*H. sapiens*], phenylalanine hydroxylase |
| 3832 | 11296 | NM_031606 | b, m, General, oo, ww, xx | phosphatase and tensin homolog, phosphatase and tensin homolog (mutated in multiple advanced cancers 1) | ESTs, Weakly similar to PTEN MOUSE PROTEIN-TYROSINE PHOSPHATASE PTEN [*M. musculus*], *Mus musculus* mRNA for tyrosine phosphatase (Tpte gene), isoform A, splice variant A, phosphatase and tensin homolog, phosphatase and tensin homolog (mutated in multiple advanced cancers 1), phosphatase and tensin homolog (mutated in multiple advanced cancers 1) pseudogene 1 |
| 3832 | 11297 | NM_031606 | ss | phosphatase and tensin homolog, phosphatase and tensin homolog (mutated in multiple advanced cancers 1) | ESTs, Weakly similar to PTEN MOUSE PROTEIN-TYROSINE PHOSPHATASE PTEN [*M. musculus*], *Mus musculus* mRNA for tyrosine phosphatase (Tpte gene), isoform A, splice variant A, phosphatase and tensin homolog, phosphatase and tensin homolog (mutated in multiple advanced cancers 1), phosphatase and tensin homolog (mutated in multiple advanced cancers 1) pseudogene 1 |
| 3404 | 23130 | NM_017307 | j, z, General | phosphate cytidylyltransferase 1, choline, alpha isoform | ESTs, Weakly similar to PM34_MOUSE PEROXISOMAL MEMBRANE PROTEIN PMP34 (34 KDA PEROXISOMAL MEMBRANE PROTEIN) (SOLUTE CARRIER FAMILY 25, MEMBER 17) [*M. musculus*], ESTs, Weakly similar to TXTP_HUMAN TRICARBOXYLATE TRANSPORT PROTEIN PRECURSOR [*H. sapiens*], ESTs, Weakly similar to TXTP_RAT Tricarboxylate transport protein, mitochondrial precursor (Citrate transport protein) (CTP) (Tricarboxylate carrier protein) [*R. norvegicus*], *Mus musculus*, Similar to hypothetical protein FLJ20551, clone MGC:18873 IMAGE:4235245, mRNA, complete cds, RIKEN cDNA 1300019P08 gene, expressed sequence AI194714, expressed sequence AW108044, ornithine transporter 2, solute carrier family 25 (mitochondrial carrier), member 18, solute carrier family 25 (mitochondrial oxodicarboxylate carrier), member 21, uncoupling protein 2, mitochondrial |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3373 | 15598 | NM_017236 | rr | phosphatidylethanolamine binding protein, prostatic binding protein | *Homo sapiens,* clone MGC:22776 IMAGE:4700840, mRNA, complete cds, RIKEN cDNA 1700023AI8 gene, RIKEN cDNA 1700081D17 gene, phosphatidylethanolamine binding protein, prostatic binding protein |
| 3369 | 442 | NM_017229 | y | phosphodiesterase 3B, cGMP-inhibited | ESTs, Highly similar to CN3B MOUSE CGMP-INHIBITED 3',5'-CYCLIC PHOSPHODIESTERASE B [*M. musculus*], ESTs, Highly similar to CN3B RAT CGMP-INHIBITED 3',5'-CYCLIC PHOSPHODIESTERASE B [*R. norvegicus*], ESTs, Highly similar to CN3B_HUMAN CGMP-INHIBITED 3',5'-CYCLIC PHOSPHODIESTERASE B [*H. sapiens*], expressed sequence AI847709, phosphodiesterase 3B, cGMP-inhibited |
| 65 | 14250 | AA799729 | qq, vv | phosphodiesterase 4B, cAMP specific, phosphodiesterase 4B, cAMP-specific (phosphodiesterase E4 dunce homolog *Drosophila*) | phosphodiesterase 4B, cAMP specific, phosphodiesterase 4B, cAMP-specific (phosphodiesterase E4 dunce homolog, *Drosophila*), phosphodiesterase 9A |
| 3870 | 1339 | NM_031715 | e, bb | phosphofructokinase, muscle | ESTs, Highly similar to phosphofructokinase, muscle; phosphofructokinase-1 A isozyme [*Mus musculus*] [*M. musculus*], expressed sequence AI131669, phosphofructokinase, muscle |
| 2975 | 12058 | L25387 | t | phosphofructokinase, platelet | ESTs, Highly similar to K6PKMOUSE 6-PHOSPHOFRUCTOKINASE, TYPE C (PHOSPHOFRUCTOKINASE 1) (PHOSPHOHEXOKINASE) (PHOSPHOFRUCTO-1-KINASE ISOZYME C) (PFK-C) [*M. musculus*], ESTs, Moderately similar to A53047 6-phosphofructokinase [*R. norvegicus*], ESTs, Weakly similar to JC2055 6-phosphofructokinase [*H. sapiens*], ESTs, Weakly similar to K6PL MOUSE 6-PHOSPHOFRUCTOKINASE, LIVER TYPE [*M. musculus*], phosphofructokinase, platelet |
| 3300 | 24861 | NM_017033 | p, General | phosphoglucomutase 1, phosphoglucomutase 2 | ESTs, Highly similar to PMRT phosphoglucomutase (EC 5.4.2.2) 1 - rat [*R. norvegicus*], ESTs, Highly similar to S62628 phosphoglucomutase-related protein - mouse [*M. musculus*], ESTs, Moderately similar to S62628 phosphoglucomutase-related protein - mouse [*M. musculus*], RIKEN cDNA 2610020G18 gene, phosphoglucomutase 1 |
| 3300 | 24862 | NM_017033 | x, General | phosphoglucomutase 1, phosphoglucomutase 2 | ESTs, Highly similar to PMRT phosphoglucomutase (EC 5.4.2.2) 1 - rat [*R. norvegicus*], ESTs, Highly similar to S62628 phosphoglucomutase-related protein - mouse [*M. musculus*], ESTs, Moderately similar to S62628 phosphoglucomutase-related protein - mouse [*M. musculus*], RIKEN cDNA 2610020G18 gene, phosphoglucomutase 1 |
| 3952 | 1311 | NM_053291 | j, s, t | phosphoglycerate kinase 1 | ESTs, Highly similar to A33792 phosphoglycerate kinase (EC 2.7.2.3) - rat [*R. norvegicus*], phosphoglycerate kinase 1, phosphoglycerate kinase 2 |
| 2105 | 4091 | AI169417 | l, rr, tt | phosphoglycerate mutase 1, phosphoglycerate mutase 1 (brain) | ESTs, Highly similar to PMGB_HUMAN PHOSPHOGLYCERATE MUTASE, BRAIN FORM [*H. sapiens*], phosphoglycerate mutase 1, phosphoglycerate mutase 1 (brain) |
| 3376 | 24582 | NM_017243 | kk, pp | phosphoribosyl pyrophosphate synthetase 1 | *Mus musculus,* phosphoribosyl pyrophosphate synthetase-associated protein 2, clone MGC:36957 IMAGE:4947226, mRNA, complete cds, RIKEN cDNA 5730409F23 gene, expressed sequence O76678, phosphoribosyl pyrophosphate synthetase 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 107 | 4832 | AA800190 | oo | phosphorylase, glycogen; brain | liver glycogen phosphorylase, muscle glycogen phosphorylase, phosphorylase, glycogen; brain |
| 4038 | 13369 | NM_053742 | v | phosphotidylinositol transfer protein, beta | ESTs, Highly similar to PPI2_HUMAN PHOSPHATIDYLINOSITOL TRANSFER PROTEIN BETA ISOFORM [*H. sapiens*], phosphotidylinositol transfer protein, beta |
| 3550 | 20312 | NM_022224 | bb | phosphotriesterase related | phosphotriesterase related |
| 3844 | 6554 | NM_031640 | f | plasma glutamate carboxypeptidase | plasma glutamate carboxypeptidase |
| 2571 | 19288 | AI231305 | e | platelet derived growth factor receptor, alpha polypeptide, platelet-derived growth factor receptor, alpha polypeptide | platelet derived growth factor receptor, alpha polypeptide, platelet-derived growth factor receptor, alpha polypeptide, platelet-derived growth factor receptor, beta polypeptide |
| 1454 | 1332 | AI013222 | mm | platelet derived growth factor, alpha, platelet-derived growth factor alpha polypeptide | platelet derived growth factor, alpha, platelet derived growth factor alpha polypeptide |
| 4394 | 25642 | U77697 | gg, hh | platelet/endothelial cell adhesion molecule, platelet/endothelial cell adhesion molecule (CD31 antigen) | |
| 4082 | 17937 | NM_053911 | ss, uu | pleckstrin homology, Sec7 and coiled/coil domains 2, pleckstrin homology, Sec7 and coiled/coil domains 2 (cytohesin-2) | F-box only protein 8, KIAA0522 protein, KIAA1110 protein, *Mus musculus*, Similar to KIAA0763 gene product, clone IMAGE:4503056, mRNA, partial cds, f-box only protein 8, pleckstrin homology, Sec7 and coiled/coil domains 2, pleckstrin homology, Sec7 and coiled/coil domains 2 (cytohesin-2) |
| 3532 | 20090 | NM_021757 | v, ww | pleiotropic regulator 1 (PRL1homolog, Arabidopsis), pleiotropic regulator 1, PRL1 homolog (Arabidopsis) | WD repeat domain 12, f-box and WD-40 domain protein 4, katanin p80 (WD40-containing) subunit B 1, pleiotropic regulator 1 (PRL1homolog, Arabidopsis), pleiotropic regulator 1, PRL1 homolog (Arabidopsis), transducin (beta)-like 2 |
| 4361 | 1392 | U10188 | j | polo-like kinase (*Drosophila*), polo-like kinase homolog, (*Drosophila*) | *Rattus norvegicus* polo-like kinase isoform mRNA, partial cds, endoplasmic reticulum (ER) to nucleus signalling 1, polo-like kinase (*Drosophila*), polo-like kinase homolog, (*Drosophila*) |
| 2650 | 5778 | AI233246 | ii | polymerase (RNA) II (DNA directed) polypeptide B (140 kD) | EST, Weakly similar to T42723 probable DNA-directed RNA polymerase (EC 2.7.7.6) I second largest chain - mouse [*M. musculus*], ESTs, Weakly similar to RNA polymerase 1(127 kDa subunit) [*Rattus norvegicus*] [*R. norvegicus*], ESTs, Weakly similar to T42723 probable DNA-directed RNA polymerase (EC 2.7.7.6)1 second largest chain - mouse [*M. musculus*], RIKEN cDNA 2700078H01 gene, RNA polymerase 1-2 (128 kDa subunit), RNA polymerase I (127 kDa subunit), polymerase (RNA) II (DNA directed) polypeptide B (140 kD) |
| 2654 | 5779 | AI233350 | l | polymerase (RNA) II (DNA directed) polypeptide B (140 kD) | EST, Weakly similar to T42723 probable DNA-directed RNA polymerase (EC 2.7.7.6) I second largest chain - mouse [*M. Musculus*], ESTs, Weakly similar to RNA polymerase 1(127 kDa subunit) [*Rattus norvegicus*] [*R. norvegicus*], ESTs, Weakly similar to T42723 probable DNA-directed RNA polymerase (EC 2.7.7.6)1 second largest chain - mouse [*M. musculus*], RIKEN cDNA 2700078H01 gene, RNA polymerase 1-2 (128 kDa subunit), RNA polymerase I (127 kDa subunit), polymerase (RNA) II (DNA directed) polypeptide B (140 kD) |
| 4085 | 15857 | NM_053948 | b, e, bb, oo, ww | polymerase (RNA) II (DNA directed) polypeptide G | polymerase (RNA) II (DNA directed) polypeptide G |
| 2865 | 4714 | AI639518 | k, ww, xx | polymerase (RNA) II (DNA directed) polypeptide H | polymerase (RNA) II (DNA directed) polypeptide H |
| 3508 | 15911 | NM_019907 | ww | postsynaptic protein CRIPT, postsynaptic protein Cript | |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3298 | 11836 | NM_017023 | g | potassium inwardly-rectifying channel, subfamily J, member 1 | potassium inwardly-rectifying channel, subfamily J, member 1 |
| 3195 | 24528 | NM_012973 | g | potassium voltage-gated channel, lsk-related family, member 1, potassium voltage-gated channel, lsk-related member 1 subfamily, member 1 | potassium voltage-gated channel, lsk-related family, member 1, potassium voltage gated channel, lsk-related subfamily, |
| 4184 | 2788 | NM_133528 | z, ee | preimplantation protein 3 | preimplantation protein 3 |
| 4476 | 1620 | X97374 | bb | prepronociceptin | |
| 3438 | 20256 | NM_019163 | ii | presenilin 1, presenilin 1 (Alzheimer disease 3) | presenilin 1, presenilin 1 (Alzheimer disease 3) |
| 3096 | 18553 | NM_012631 | b, c, qq, vv | prion protein, prion protein (p27-30) (Creutzfeld-Jakob disease, Gerstmann-Strausler-Scheinker syndrome, fatal familial insomnia) | prion protein, prion protein (p27-30) (Creutzfeld-Jakob disease, Gerstmann-Strausler-Scheinker syndrome, fatal familial insomnia) |
| 3946 | 23895 | NM_033485 | tt | PRKC, apoptosis, WT1, regulator | ESTs, Weakly similar to Ser/Arg-related nuclear matrix protein; plenty-of-prolines-101; serine/arginine repetitive matrix protein 1 [*Mus musculus*] [*M. musculus*], *Mus musculus*, Similar to hypothetical protein MGC13125, clone MGC:38070 IMAGE:5252666, mRNA, complete cds, PRKC, apoptosis, WT1, regulator, expressed sequence AI480556, glucocorticoid-induced gene 1, serine/aminine repetitive matrix 1 |
| 3457 | 15504 | NM_019237 | d | procollagen C-endopeptidase enhancer procollagen C-proteinase enhancer protein | EST, Weakly similar to PCO1_HUMAN PROCOLLAGEN C-PROTEINASE ENHANCER PROTEIN PRECURSOR [*H. sapiens*], ESTs, Weakly similar to PCO1_RAT Procollagen C-proteinase enhancer protein precursor (PCPE) (Type I procollagen COOH-terminal proteinase enhancer) (Type 1 procollagen C-proteinase enhancer protein) [*R. norvegicus*], expressed sequence AI043106, membrane frizzled-related protein, procollagen C-endopeptidase enhancer, procollagen C-endopeptidase enhancer 2, procollagen C-proteinase enhancer protein |
| 3205 | 19391 | NM_012998 | t, y, mm | procollagen-proline, 2-oxoglutarate 4-dioxygenase (proline 4-hydroxylase), beta polypeptide (protein disulfide isomerase; thyroid hormone binding protein p55), prolyl 4-hydroxylase, beta polypeptide | |
| 3205 | 19392 | NM_012998 | j, gg, hh | procollagen-proline, 2-oxoglutarate 4-dioxygenase (proline 4-hydroxylase), beta polypeptide (protein disulfide isomerase; thyroid hormone binding protein p55), prolyl 4-hydroxylase, beta polypeptide | |
| 3205 | 19393 | NM_012998 | gg, hh, ll | procollagen-proline, 2-oxoglutarate 4-dioxygenase (proline 4-hydroxylase), beta polypeptide (protein disulfide isomerase; thyroid hormone binding protein p55), prolyl 4-hydroxylase, beta polypeptide | |
| 3534 | 17936 | NM_021766 | qq | progesterone receptor membrane component 1 | *Homo sapiens*, clone MGC:32124 IMAGE:4877960, mRNA, complete cds, RIKEN cDNA 4631434019 gene, progesterone receptor membrane component 1 |
| 3031 | 21670 | M80601 | f, l, z, General | programmed cell death 2 | ESTs, Weakly similar to A41257 apoptosis protein RP-8 - rat (fragment) [*R. norvegicus*], RIKEN cDNA 6030457N17 gene, programmed cell death 2 |
| 3095 | 24568 | NM_012630 | g | prolactin receptor | prolactin receptor, prolactin receptor related sequence 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3559 | 11454 | NM_022381 | c, f, kk, tt | proliferating cell nuclear antigen | proliferating cell nuclear antigen |
| 3559 | 11455 | NM_022381 | c, f, jj, kk, nn | proliferating cell nuclear antigen | proliferating cell nuclear antigen |
| 3462 | 888 | NM_019246 | n | proprotein convertase subtilisin/kexin type 7 | proprotein convertase subtilisin/kexin type 7 |
| 1829 | 18838 | AI101102 | ee | prosaposin, prosaposin (variant Gaucher disease and variant metachromatic leukodystrophy) | |
| 3209 | 23543 | NM_013013 | w, y | prosaposin, prosaposin (variant Gaucher disease and variant metachromatic leukodystrophy) | |
| 3209 | 23544 | NM_013013 | c | prosaposin, prosaposin (variant Gaucher disease and variant metachromatic leukodystrophy) | |
| 3119 | 503 | NM_012704 | k | prostaglandin E receptor 3 (subtype EP3) | |
| 3461 | 21109 | NM_019243 | r | prostaglandin F2 receptor negative regulator | RIKEN cDNA 4833439017 gene, immunoglobulin superfamily, member 2, immunoglobulin superfamily, member 3, immunoglobulin superfamily, member 8, prostaglandin F2 receptor negative regulator |
| 3812 | 692 | NM_031557 | g | prostaglandin I2 (prostacyclin) synthase | EST, Highly similar to PTGI_RAT Prostacyclin synthase (Prostaglandin I2 synthase) [*R. norvegicus*], cytochrome P450, subfamily VIIIB (sterol 12-alpha-hydroxylase), polypeptide 1, prostaglandin I2 (prostacyclin) synthase |
| 3370 | 20192 | NM_017232 | s | prostaglandin-endoperoxide synthase 2, prostaglandin-endoperoxide synthase 2 (prostaglandin G/H synthase and cyclooxygenase) | prostaglandin-endoperoxide synthase 2, prostaglandin-endoperoxide synthase 2 (prostaglandin G/H synthase and cyclooxygenase) |
| 3370 | 20193 | NM_017232 | qq, vv | prostaglandin-endoperoxide synthase 2, prostaglandin-endoperoxide synthase 2 (prostaglandin G/H synthase and cyclooxygenase) | prostaglandin-endoperoxide synthase 2, prostaglandin-endoperoxide synthase 2 (prostaglandin G/H synthase and cyclooxygenase) |
| 3921 | 15470 | NM_031978 | u, mm | proteasome (prosome, macropain) 26S subunit, non-ATPase, 1 | proteasome (prosome, macropain) 26S subunit, non-ATPase, 1, proteasome (prosome, macropain) 26S subunit, non-ATPase, 2 |
| 2219 | 7579 | AI172453 | v | proteasome (prosome, macropain) 26S subunit, non-ATPase, 10 | RIKEN cDNA 0610013D04 gene, ankyrin repeat and SOCS box-containing protein 8, ankyrin repeat family A (RF)(ANK-like), 2, fern-1 homolog b (*C. elegans*), feminization 1 homolog b (*C. elegans*), proteasome (prosome, macropain) 26S subunit, non-ATPase. 10 |
| 4154 | 13515 | NM_130430 | y | proteasome (prosome, macropain) 26S subunit, non-ATPase, 9 | *Homo sapiens* cDNA FLJ30777 fis, clone FEBRA2000803, proteasome (prosome, macropain) 26S subunit, non-ATPase, 9 |
| 3385 | 15224 | NM_017264 | f | proteaseome (prosome, macropain) 28 subunit, alpha, proteasome (prosome, macropain) activator subunit 1 (PA28 alpha) | proteaseome (prosome, macropain) 28 subunit, 3, proteasome (prosome, macropain) 28 subunit, alpha, proteasome (prosome, macropain) activator subunit 1 (PA28 alpha), proteasome (prosome, macropain) activator subunit 3 (PA28 gamma: Ki) |
| 3391 | 15141 | NM_017278 | gg, hh | proteasome (prosome, macropain) subunit, alpha type 1, proteasome (prosome, macropain) subunit, alpha type. 1 | proteasome (prosome, macropain) subunit, alpha type 1, proteasome (prosome, macropain) subunit, alpha type, 1 |
| 3392 | 5747 | NM_017279 | p | proteasome (prosome, macropain) subunit, alpha type 2, proteasome (prosome, macropain) subunit, alpha type. 2 | RIKEN cDNA 5430437J10 gene, proteasome (prosome, macropain) subunit, alpha type 2, proteasome (prosome, macropain) subunit, alpha type, 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3392 | 5748 | NM_017279 | xx | proteasome (prosome, macropain) subunit, alpha type 2, proteasome (prosome, macropain) subunit, alpha type, 2 | RIKEN cDNA 5430437J10 gene, proteasome (prosome, macropain) subunit, alpha type 2, proteasome (prosome, macropain) subunit, alpha type, 2 |
| 3393 | 1447 | NM_017281 | t | proteasome (prosome, macropain) subunit, alpha type 4, proteasome (prosome, macropain) subunit, alpha type, 4 | EST, Moderately similar to PRC9_HUMAN PROTEASOME COMPONENT C9 [*H. sapiens*], proteasome (prosome, macropain) subunit, alpha type 4, proteasome (prosome, macropain) subunit, alpha type. 4 |
| 3394 | 3254 | NM_017282 | e, kk, mm, nn | proteasome (prosome, macropain) subunit, alpha type 5, proteasome (prosome, macropain) subunit, alpha type, 5 | proteasome (prosome, macropain) subunit, alpha type 5, proteasome (prosome, macropain) subunit, alpha type, 5 |
| 3394 | 3256 | NM_017282 | l, j, xx | proteasome (prosome, macropain) subunit, alpha type 5, proteasome (prosome, macropain) subunit, alpha type. 5 | proteasome (prosome, macropain) subunit, alpha type 5, proteasome (prosome, macropain) subunit, alpha type, 5 |
| 3395 | 15535 | NM_017283 | ll | proteasome (prosome, macropain) subunit, alpha type 6, proteasome (prosome, macropain) subunit, alpha type, 6 | ESTs, Highly similar to 530274 multicatalytic endopeptidase complex [*H. sapiens*], ESTs, Weakly similar to JX0230 multicatalytic endopeptidase complex (EC 3.4.99.46) iota chain - rat [*R. norvegicus*], proteasome (prosome, macropain) subunit. alpha type 6 |
| 3762 | 15539 | NM_031132 | v | proteasome (prosome, macropain) subunit, alpha type 6, proteasome (prosome, macropain) subunit, alpha type, 6, transforming growth factor, beta receptor II, transforming growth factor, beta receptor II (70-80 kD) | ESTs, Highly similar to 530274 multicatalytic endopeptidase complex [*H. sapiens*], ESTs, Weakly similar to JX0230 multicatalytic endopeptidase complex (EC 3.4.99.46) iota chain - rat [*R. norvegicus*], proteasome (prosome, macropain) subunit, alpha type 6, transforming growth factor, beta receptor II, transforming growth factor, beta receptor II (70-80 kD) |
| 3396 | 12523 | NM_017285 | tt | proteasome (prosome, macropain) subunit, beta type 3, proteasome (prosome, macropain) subunit, beta type, 3 | EST, Moderately similar to 540468 proteasome subunit RC10-li - rat [*R. norvegicus*], ESTs, Weakly similar to proteasome (prosome, macropain) subunit, beta type, 3 [*Mus musculus*] [*M. musculus*], ESTs, Weakly similar to 540468 proteasome subunit RC10-li - rat [*R. norvegicus*], proteasome (prosome, macropain) subunit, beta type 3, proteasome (prosome, macropain) subunit, beta type 3 |
| 3396 | 12524 | NM_017285 | kk | proteasome (prosome, macropain) subunit, beta type 3, proteasome (prosome, macropain) subunit, beta type, 3 | EST, Moderately similar to 540468 proteasome subunit RC10-li - rat [*R. norvegicus*], ESTs, Weakly similar to proteasome (prosome, macropain) subunit, beta type, 3 [*Mus musculus*] [*M. musculus*], ESTs, Weakly similar to 540468 proteasome subunit RC10-li - rat [*R. norvegicus*], proteasome (prosome, macropain) subunit, beta type 3, proteasome (prosome, macropain) subunit, beta type 3 |
| 3842 | 20940 | NM_031629 | y, nn | proteasome (prosome, macropain) subunit, beta type 4, proteasome (prosome, macropain) subunit, beta type, 4 | proteasome (prosome, macropain) subunit, beta type 4, proteasome (prosome, macropain) subunit, beta type, 4 |
| 3842 | 20941 | NM_031629 | bb | proteasome (prosome, macropain) subunit, beta type 4, proteasome (prosome, macropain) subunit, beta type, 4 | proteasome (prosome, macropain) subunit, beta type 4, proteasome (prosome, macropain) subunit, beta type, 4 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3842 | 20942 | NM_031629 | mm | proteasome (prosome, macropain) subunit, beta type 4, proteasome (prosome, macropain) subunit, beta type, 4 | proteasome (prosome, macropain) subunit, beta type 4, proteasome (prosome, macropain) subunit, beta type, 4 |
| 2896 | 9135 | D45247 | b, mm | proteasome (prosome, macropain) subunit, beta type 5, proteasome (prosome, macropain) subunit, beta type, 5 | EST, Moderately similar to PSB5_RAT Proteasome subunit beta type 5 precursor (Proteasome epsilon chain) (Macropain epsilon chain) (Multicatalytic endopeptidase complex epsilon chain) (Proteasome subunit X) (Proteasome chain 6) [R. norvegicus], RIKEN cDNA 5830406J20 gene, proteasome (prosome, macropain) subunit, beta type 5, proteasome (prosome, macropain) subunit beta type 5 |
| 2896 | 9134 | D45247 | j, y | proteasome (prosome, macropain) subunit, beta type 5, proteasome (prosome, macropain) subunit, beta type, 5 | |
| 4108 | 22849 | NM_057099 | c | proteasome (prosome, macropain) subunit, beta type 6, proteasome (prosome, macropain) subunit, beta type, 6 | proteasome (prosome, macropain) subunit, beta type 6, proteasome (prosome, macropain) subunit, beta type, 6 |
| 3120 | 4002 | NM_012708 | p, General, nn | proteasome (prosome, macropain) subunit, beta type, 9 (large multifunctional protease 2), proteosome (prosome, macropain) subunit, beta type 9 (large multifunctional protease 2) | proteasome (prosome, macropain) subunit, beta type, 9 (large multifunctional protease 2), proteosome (prosome, macropain) subunit, beta type 9 (large multifunctional protease 2) |
| 3120 | 4003 | NM_012708 | p | proteasome (prosome, macropain) subunit, beta type, 9 (large multifunctional protease 2), proteosome (prosome, macropain) subunit, beta type 9 (large multifunctional protease 2) | proteasome (prosome, macropain) subunit, beta type, 9 (large multifunctional protease 2), proteosome (prosome, macropain) subunit, beta type 9 (large multifunctional protease 2) |
| 3120 | 4004 | NM_012708 | nn | proteasome (prosome, macropain) subunit, beta type, 9 (large multifunctional protease 2), proteosome (prosome, macropain) subunit, beta type 9 (large multifunctional protease 2) | proteasome (prosome, macropain) subunit, beta type, 9 (large multifunctional protease 2), proteosome (prosome, macropain) subunit, beta type 9 (large multifunctional protease 2) |
| 3120 | 4005 | NM_012708 | General | proteasome (prosome, macropain) subunit, beta type, 9 (large multifunctional protease 2), proteosome (prosome, macropain) subunit, beta type 9 (large multifunctional protease 2) | multifunctional protease 2) proteasome (prosome, macropain) subunit, beta type, 9 (large multifunctional protease 2), proteosome (prosome, macropain) subunit, beta type 9 (large multifunctional protease 2) |
| 3145 | 556 | NM_012803 | b, u, x, dd | protein C, protein C (inactivator of coagulation S18994 factors Va and VIIIa) | B-factor, properdin, ESTs, Weakly similar to protein C (activated) (EC 3.4.21.69) precursor - rat [R. norvegicus], histocompatibility 2, complement component factor B, protein C, protein C (inactivator of coagulation factors Va and VIIIa) |
| 3121 | 24545 | NM_012713 | s | protein kinase C, beta, protein kinase C, beta 1 | |
| 3577 | 1468 | NM_022507 | dd | protein kinase C, zeta | protein kinase C, iota, protein kinase C, lambda, protein kinase C, zeta |
| 3351 | 114 | NM_017175 | oo | protein kinase C-like 1 | EST, Weakly similar to B Chain B, Crystal Structure Of Human Rhoa Complexed With The Effector Domain Of The Protein Kinase PknPRK1 {SUB 13-98 [H. sapiens], ESTs, Highly similar to PKL1 MOUSE PROTEIN KINASE C-LIKE 1 [M. musculus], ESTs, Highly similar to PKL1_RAT PROTEIN KINASE C-LIKE 1 (PROTEIN-KINASE C-RELATED KINASE 1) (PROTEIN KINASE C LIKE PKN) (SERINE-THREONINE PROTEIN KINASE N) (PROTEASE- |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | ACTIVATED KINASE 1) (PAK-1) [*R. norvegicus*], expressed sequence AI507382, expressed sequence AW209115, protein kinase C-like 1, protein kinase PKNbeta |
| 3920 | 17601 | NM_031976 | ww | protein kinase, AMP-activated, beta 1 non-catalytic subunit | expressed sequence AW049591, protein kinase, AMP-activated, beta 1 non-catalytic subunit |
| 3405 | 19671 | NM_017309 | k, mm | protein phospatase 3, regulatory subunit B, alpha isoform (calcineurin B, type I), protein phosphatase 3 (formerly 2B), regulatory subunit B (19 kD), alpha isoform (calcineurin B, type I) | ESTs, Highly similar to CALC_MOUSE CALCINEURIN B SUBUNIT ISOFORM 2 (PROTEIN PHOSPHATASE 2B REGULATORY SUBUNIT 2) (PROTEIN PHOSPHATASE 3 REGULATORY SUBUNIT B ALPHA ISOFORM 2) [*M. musculus*], ESTs, Weakly similar to calcium binding protein Kip 2 [*M. musculus*], Homo sapiens cDNA FLJ32962 fis, clone TEST12008387, highly similar to CALCINEURIN B-LIKE PROTEIN, *Mus musculus*, Similar to hypothetical protein FLJ12443, clone MGC:8148 IMAGE:3589626, mRNA, complete cds, protein phospatase 3, regulatory subunit B, alpha isoform (calcineurin B, type I), protein phosphatase 3 (formerly 2B), regulatory subunit B (19 kD), alpha isoform (calcineurin |
| 3571 | 4647 | NM_022498 | h, r, w, rr | protein phosphatase 1, catalytic subunit, gamma isoform | protein phosphatase 1, catalytic subunit, gamma isoform |
| 3613 | 24564 | NM_022676 | bb | protein phosphatase 1, regulatory (inhibitor) subunit 1A | EST, Weakly similar to IPP1_HUMAN PROTEIN PHOSPHATASE INHIBITOR 1 [*H. sapiens*], ESTs, Moderately similar to PROTEIN PHOSPHATASE INHIBITOR 1 [*R. norvegicus*], *Mus musculus*, clone MGC:18770 IMAGE:4164563, mRNA, complete cds, RIKEN cDNA 4930565M23 gene, protein phosphatase 1 regulatory subunit 1A, protein phosphatase 1, regulatory (inhibitor) subunit 1A |
| 4334 | 25505 | S65091 | g, y | protein phosphatase 1, regulatory (inhibitor) subunit 1C | |
| 3302 | 3202 | NM_017039 | t | protein phosphatase 2 (formerly 2A), catalytic subunit, alpha isoform, protein phosphatase 2a, catalytic subunit, alpha isoform | protein phosphatase 2 (formerly 2A), catalytic subunit, alpha isoform, protein phosphatase 2a, catalytic subunit, alpha isoform |
| 3302 | 3203 | NM_017039 | oo | protein phosphatase 2 (formerly 2A), catalytic subunit, alpha isoform, protein phosphatase 2a, catalytic subunit. alpha isoform | proteIn phosphatase 2 (formerly 2A), catalytic subunit, alpha isoform, protein phosphatase 2a, catalytic subunit, alpha isoform |
| 1566 | 5648 | AI044035 | ss | protein phosphatase 4, regulatory subunit 1 | ESTs, Weakly similar to protein phosphatase 4, regulatory subunit 1 [*Rattus norvegicus*] [*R. norvegicus*], ESTs Weakly similar to protein serine/threonine phosphatase 4 regulatory subunit I [*H. sapiens*], protein phosphatase 2 (formerly 2A), regulatory subunit A (PR 65), alpha isoform, protein phosphatase 4, regulatory subunit 1 |
| 3820 | 24219 | NM_031579 | n, General | protein tyrosine phosphatase 4a1, protein tyrosine phosphatase type VA, member 1 | protein tyrosine phosphatase 4a1, protein tyrosine phosphatase 4a3, protein tyrosine phosphatase type VA, member 1, protein tyrosine phosphatase type IVA, member 3 |
| 3097 | 1840 | NM_012637 | g | protein tyrosine phosphatase, non-receptor type 1 | EST, Moderately similar to A34845 protein-tyrosine-phosphatase (EC 3.1.3.48), nonreceptor type 1B - rat [*R. norvegicus*], ESTs, Moderately similar to PTN1_HUMAN PROTEIN-TYROSINE PHOSPHATASE, NON-RECEPTOR TYPE 1 [*H. sapiens*], protein tyrosine phosphatase, non-receptor type 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3097 | 1841 | NM_012637 | ww | protein tyrosine phosphatase, non-receptor type 1 | EST, Moderately similar to A34845 protein-tyrosine-phosphatase (EC 3.1.3.48), nonreceptor type 1B - rat [*R. norvegicus*], ESTs, Moderately similar to PTN1_HUMAN PROTEIN-TYROSINE PHOSPHATASE, NON-RECEPTOR TYPE 1 [*H. sapiens*], protein tyrosine phosphatase, non-receptor type 1 |
| 3097 | 1844 | NM_012637 | ww | protein tyrosine phosphatase, non-receptor type 1 | EST, Moderately similar to A34845 protein-tyrosine-phosphatase (EC 3.1.3.48), nonreceptor type 1B - rat [*R. norvegicus*], ESTs, Moderately similar to PTN1_HUMAN PROTEIN-TYROSINE PHOSPHATASE, NON-RECEPTOR TYPE 1 [*H. sapiens*], protein tyrosine phosphatase, non-receptor type 1 |
| 4301 | 242 | NM_145683 | u | protein tyrosine phosphatase, non-receptor type 7 | protein tyrosine phosphatase, non-receptor type 7 |
| 3210 | 11905 | NM_013016 | s, x | protein tyrosine phosphatase, non-receptor type substrate 1 | ESTs, Moderately similar to JC5288 SHP substrate-1 protein, 509 - mouse [*M. musculus*], ESTs, Weakly similar to JC5288 SHP substrate-1 protein, 509 - mouse [*M. musculus*], protein tyrosine phosphatase, non-receptor type substrate 1, signal-regulatory protein beta 1, signal regulatory protein beta 2 |
| 3005 | 668 | M25823 | jj | protein tyrosine phosphatase, receptor type, C | ESTs, Highly similar to CD45_HUMAN LEUKOCYTE COMMON ANTIGEN PRECURSOR [*H. sapiens*] protein tyrosine phosphatase, receptor type C |
| 3431 | 14971 | NM_019140 | n, bb | protein tyrosine phosphatase, receptor type, D | ESTs, Weakly similar to 2103274A receptor type protein Tyr phosphatase [*M. musculus*], RIKEN cDNA 1600019004 gene, expressed sequence AU040377, protein tyrosine phosphatase, receptor type, S |
| 3431 | 14975 | NM_019140 | dd | protein tyrosine phosphatase, receptor type, D | ESTs, Weakly similar to 2103274A receptor type protein Tyr phosphatase [*M. musculus*], RIKEN cDNA 1600019004 gene, expressed sequence AU040377, protein tyrosine phosphatase, receptor type, S |
| 3464 | 1973 | NM_019249 | h, q, r, w, z, General, ee, nn | protein tyrosine phosphatase, receptor type, F, protein tyrosine phosphatase, receptor type, F | ESTs, Weakly similar to 2103274A receptor type protein Tyr phosphatase [*M. musculus*], ESTs, Weakly similar to S40282 protein-tyrosine-phosphatase [*M. musculus*], ESTs, Weakly similar to 546216 leukocyte antigen-related protein precursor - rat [*R. norvegicus*], Mus musculus, clone IMAGE:5101040, mRNA, partial cds, protein tyrosine phosphatase, non-receptor type 9, protein tyrosine phosphatase, receptor type, D, protein tyrosine phosphatase, receptor type, F, protein tyrosine phosphatase, receptor-type, F |
| 3700 | 20410 | NM_030990 | g, bb, cc | proteolipid protein (myelin), proteolipid protein 1 (Pelizaeus-Merzbacher disease, spastic paraplegia 2, uncomplicated) | *Mus musculus* 15 days embryo male testis cDNA, RIKEN full-length enriched library, clone:8030496P1 9:glycoprotein m6b, full insert sequence, *Mus musculus*, clone MGC:32434 IMAGE:5041793, mRNA, complete cds, PH domain containing protein in retina 1, glycoprotein m6b, proteolipid protein (myellin) |
| 3526 | 22916 | NM_021740 | ff | prothymosin alpha, prothymosin, alpha (gene sequence 28) | ESTs, Highly similar to THYA_HUMAN PROTHYMOSIN ALPHA [*H. sapiens*], RIKEN cDNA 2610009E16 gene, prothymosin alpha, prothymosin, alpha (gene sequence 28) |
| 3826 | 21843 | NM_031594 | e, ee, tt, ww | purinergic receptor P2X, ligand-gated ion channel 4, purinergic receptor P2X, ligand-gated ion channel, 4 | purinergic receptor P2X, ligand-gated ion channel 4, purinergic receptor P2X, ligand-gated ion channel, 4 |
| 3382 | 1496 | NM_017255 | qq, vv | purinergic receptor P2Y, G-protein coupled 2, purinergic receptor P2Y, G-protein coupled, 2 | G protein-coupled receptor 31, G protein-coupled receptor 35, *Mus musculus*, clone MGC:28142 IMAGE:3982042, mRNA, complete cds, RIKEN cDNA 2610302I02 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | gene, RIKEN cDNA 5830408N17 gene, expressed sequence AI662791, purinergic receptor P2Y, G-protein coupled 2, purinergic receptor P2Y, G-protein coupled, 2 |
| 3855 | 15823 | NM_031680 | g | pyrimidinergic receptor P2Y, G-protein coupled, 4 | G protein-coupled receptor 17, G protein-coupled receptor 23, G protein-coupled receptor 35, purinergic receptor (family A group 5), pyrimidinergic receptor P2Y, G protein coupled. 4 |
| 4482 | 20426 | Z12158 | ff, gg, hh | pyruvate dehydrogenase (lipoamide) alpha 1, pyruvate dehydrogenase E1 alpha 1 | |
| 3697 | 1928 | NM_030872 | z, General, ee, kk | pyruvate dehydrogenase 2, pyruvate dehydrogenase kinase, isoenzyme 2 | *Mus musculus*, Similar to pyruvate dehydrogenase kinase, isoenzyme 1, clone MGC:28719 IMAGE:4458562, mRNA, complete cds, *Mus musculus*, Similar to pyruvate dehydrogenase kinase, isoenzyme 3, clone MGC:6383 IMAGE:3500763, mRNA, complete cds, pyruvate dehydrogenase 2, pyruvate dehydrogenase kinase isoenzyme 2 |
| 4238 | 14822 | NM_138708 | m, s | RAB geranylgeranyl transferase, b subunit, Rab geranylgeranyltransferase, beta subunit | RAE geranylgeranyl transferase, b subunit, Rab geranylgeranyltransferase, beta subunit, expressed sequence AA409500 |
| 3422 | 20417 | NM_017359 | General | RAB10, member RAS oncogene family | ESTs, Weakly similar to RAB8_HUMAN RAS-RELATED PROTEIN RAB-8 [*H. sapiens*], RAB10, member RAS oncogene family, RAB12, member RAS oncogene family, RAB38, member RAS oncogene family, expressed sequence AA536966, expressed sequence AW107754 |
| 3937 | 20490 | NM_032617 | ll | RAB11B, member RAS oncogene family | EST, Weakly similar to R11B MOUSE RAS-RELATED PROTEIN RAB-11B [*M. musculus*], RAB, member of RAS oncogene family-like 2A, RAB, member of RAS oncogene family-like 2B, RAB11B, member RAS oncogene family, RIKEN cDNA 1110031N17 gene |
| 4007 | 20831 | NM_053589 | g | RAB14, member RAS oncogene family | EST, Highly similar to GTPase Rab14 [*Rattus norvegicus*] [*R. norvegicus*], ESTs, Highly similar to F34323 GTP-binding protein Rab5 [*H. sapiens*], ESTs, Highly similar to RB14_HUMAN RAS-RELATED PROTEIN RAB-14 [*R. norvegicus*], ESTs, Weakly similar to RB14_HUMAN Ras-related protein Rab-14 [*R. norvegicus*], *Mus musculus* Rab-related GTP-binding protein (Rabj) mRNA, complete cds, RAB14, member RAS oncogene family |
| 4132 | 24653 | NM_080580 | e | RAB3D, member RAS oncogene family | RAB3D, member RAS oncogene family |
| 3420 | 21846 | NM_017355 | gg, hh | RAB4B, member RAS oncogene family | *Homo sapiens* cDNA: FLJ21 192 fis, clone COL00107, highly similar to AF165522 *Homo sapiens* ras-related GTP-binding protein 4b (RAB4B) mRNA, RAB4A, member RAS oncogene family, RAB4B, member RAS oncoaene family |
| 217 | 4230 | AA818669 | l, ss | RAB7, member RAS oncogene family | ESTs, Weakly similar to RAB7 MOUSE RAS-RELATED PROTEIN RAB-7 [*M. musculus*], *Mus musculus*, clone MGC:25695 IMAGE:3672128, mRNA, complete cds, RAB7, member RAS oncogene family |
| 3647 | 4228 | NM_023950 | u | RAB7, member RAS oncogene family | ESTs, Weakly similar to RAB7 MOUSE RAS-RELATED PROTEIN RAB-7 [*M. musculus*], *Mus musculus*, clone MGC:25695 IMAGE:3672128, mRNA, complete cds, RAB7, member RAS oncogene family |
| 2891 | 25278 | D30734 | k, ii, tt | RAS p21 protein activator 2 | |
| 3275 | 23361 | NM_013216 | r | RAS-homolog enriched in brain, Ras homolog enriched in brain 2 | ESTs, Weakly similar to RALA MOUSE RAS RELATED PROTEIN RAL-A [*M. musculus*], RAS-homolog enriched in brain, RIKEN cDNA 1810036J22 gene, Ras homolog |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | enriched in brain 2, ras-like protein VTS58635 |
| 1908 | 2069 | AI103616 | bb | ras-related C3 botulinum toxin substrate 1 (rho family, small GTP binding protein Rac1) | ESTs, Highly similar to Cdc42 From Human, Nmr, 20 Structures [*H. sapiens*], *Mus musculus* DBC2 protein (Dbc2) mRNA, complete cds, *Mus musculus* mRNA for small GTPase Tc10, complete cds, RAC3, RIKEN cDNA 1700008H16 gene, ras homolog gene family, member J, ras-like protein, ras-related C3 botulinum toxin substrate 1 (rho family, small GTP binding protein Rac1) |
| 778 | 4661 | AA899709 | e | receptor (calcitonin) activity modifying protein 3 | receptor (calcitonin) activity modifying protein 3 |
| 4001 | 10986 | NM_053571 | c, l, m, General | regucalcin gene promotor region related protein | *Mus musculus*, Similar to KIAA0310 gene product, clone IMAGE:5066362, mRNA, partial cds, regucalcin gene promotor region related protein |
| 3810 | 28 | NM_031546 | v, rr | regucalcin, regucalcin (senescence marker protein-30) | regucalcin, regucalcin (senescence marker protein-30) |
| 869 | 23451 | AA925243 | j | restin (Reed-Steinberg cell-espressed intermediate filament-associated protein), restin (Reed-Steinberg cell-expressed intermediate filament-associated protein) | CLIP-170-related protein, EST, Weakly similar to restin (Reed-Steinberg cell-espressed intermediate filament-associated protein); cytoplasmic linker protein 50 [*Mus musculus*] [*M. musculus*], ESTs, Weakly similar to T42720 cytoplasmic linker protein CLIP-115 - mouse [*M. musculus*], RIKEN cDNA 1500005P14 gene, RIKEN cDNA 4631429H07 gene, RIKEN cDNA 4833417L20 gene, cytoplasmic linker 2, cytoskeleton-associated protein 1, restin (Reed-Steinberg cell-espressed intermediate filament-associated protein), restin (Reed-Steinberg cell-expressed |
| 2546 | 1378 | AI230602 | m | retinoblastoma-like 2, retinoblastoma-like 2(p130) | *Mus musculus* 11 days embryo whole body cDNA, RIKEN full-length enriched library, clone:2700054A06:retinoblastoma-like 1 (p107), full insert sequence, retinoblastoma-like 1 (p107), retinoblastoma-like 2, retinoblastoma-like 2 (p130) |
| 3744 | 1376 | NM_031094 | a | retinoblastoma-like 2, retinoblastoma-like 2 (p130) | *Mus musculus* 11 days embryo whole body cDNA, RIKEN full-length enriched library, clone:2700054A06:retinoblastoma-like 1 (p107), full insert sequence, retinoblastoma-like 1(p107), retinoblastoma-like 2, retinoblastoma-like 2 (p130) |
| 3126 | 23806 | NM_012733 | b, qq | retinol binding protein 1, cellular | ESTs, Weakly similar to RET1_RAT Retinol-binding protein 1, cellular (Cellular retinol-binding protein) (CRBP) [*R. norvegicus*], retinoid binding protein 7, retinol binding protein 1, cellular, retinol binding protein 5, cellular, retinol binding protein 7, cellular |
| 2434 | 3376 | AI179755 | w | Rho guanine nucleotide exchange factor (GEF) 5 | ESTs, Weakly similar to guanine nucleotide regulatory protein [*H. sapiens*], Rho guanine nucleotide exchange factor (GEF) 5 |
| 3512 | 12087 | NM_020082 | d | ribonuclease, RNaseAfamily 4, ribonuclease, RNase A family, 4 | ESTs, Weakly similar to RNL4_RAT Ribonuclease 4 precursor (RNase 4) (RL3) [*R. norvegicus*], angiogenin, angiogenin related protein, angiogenin-like, expressed sequence AI385586, ribonuclease, RNase A family 4, ribonuclease, RNase A family, 4 |
| 3861 | 21575 | NM_031698 | xx | ribophorin II | EST, Moderately similar to RIB2_HUMAN DOLICHYL-DIPHOSPHOOLIGOSACCHARIDE--PROTEIN GLYCOSYLTRANSFERASE 63 KDA SUBUNIT PRECURSOR [*H. sapiens*], ESTs, Moderately similar to RIB2_HUMAN DOLICHYL-DIPHOSPHOOLIGOSACCHARIDE--PROTEIN GLYCOSYLTRANSFERASE 63 KDA SUBUNIT PRECURSOR [*H. sapiens*], ribophorin 2, related sequence 1, ribophorin ll |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3736 | 11849 | NM_031065 | j, z, General, ll | ribosomal protein L10A, ribosomal protein L10a | EST, Moderately similar to R10A MOUSE 60S RIBOSOMAL PROTEIN L10A [*M. musculus*], ribosomal protein L10A, ribosomal protein L10a |
| 2823 | 19112 | AI639157 | w | ribosomal protein L13 | EST, Moderately similar to JC2368 ribosomal protein L13, cytosolic [validated] - rat [*R. norvegicus*], EST, Weakly similar to JC2368 ribosomal protein L13, cytosolic [validated] - rat [*R. norvegicus*], ESTs, Highly similar to ribosomal protein L13; 60S ribosomal protein L13; breast basic conserved protein 1 [*Homo sapiens*] [*H. sapiens*], ESTs, Moderately similar to RL13 MOUSE 60S RIBOSOMAL PROTEIN L13 [*M. musculus*], *Homo sapiens* cDNA FLJ30941 fis, clone FEBRA2007458, Human RPL13-2 pseudogene mRNA, complete cds, ribosomal protein L13 |
| 3748 | 23854 | NM_031101 | General | ribosomal protein L13 | EST, Moderately similar to JC2368 ribosomal protein L13, cytosolic [validated] - rat [*R. norvegicus*], EST, Weakly similar to JC2368 ribosomal protein L13, cytosolic [validated] - rat [*R. norvegicus*], ESTs, Highly similar to ribosomal protein L13; 60S ribosomal protein L13; breast basic conserved protein 1 [*Homo sapiens*] [*H. sapiens*], ESTs, Moderately similar to RL13 MOUSE 60S RIBOSOMAL PROTEIN L13 [*M. musculus*], *Homo sapiens* cDNA FLJ30941 fis, clone FEBRA2007458, Human RPL13-2 pseudogene mRNA, complete cds, ribosomal protein L13 |
| 3749 | 20462 | NM_031102 | h, m | ribosomal protein L18 | ESTs, Weakly similar to 60S RIBOSOMAL PROTEIN L18 [*M. musculus*], ribosomal protein L18 |
| 3750 | 16938 | NM_031103 | ee | ribosomal protein L19 | EST, Weakly similar to RL19 MOUSE 60S RIBOSOMAL PROTEIN L19 [*M. musculus*], ESTs, Weakly similar to RL19_HUMAN 60S RIBOSOMAL PROTEIN L1 [*M. musculus*], ESTs, Weakly similar to RL19_HUMAN 60S ribosomal protein L19 [*R. norvegicus*], ribosomal protein L19 |
| 2235 | 12614 | AI175294 | General | ribosomal protein L21 | EST, Moderately similar to 21132008 ribosomal protein L21 [*H. sapiens*], EST, Moderately similar to RL21_RAT 60S RIBOSOMAL PROTEIN L21 [*R. norvegicus*], EST, Weakly similar to 21132008 ribosomal protein L21 [*H. sapiens*], EST, Weakly similar to RL21 MOUSE 60S RIBOSOMAL PROTEIN L21 [*M. musculus*], EST, Weakly similar to RL21_HUMAN 60S RIBOSOMAL PROTEIN L21 [*H. sapiens*], ESTs, Highly similar to 21132008 ribosomal protein L21 [*H. sapiens*], ESTs, Highly similar to RL21 MOUSE 60S RIBOSOMAL PROTEIN L21 [*M. musculus*], ESTs, Moderately similar to RL21 MOUSE 60S RIBOSOMAL PROTEIN L21 [*M. musculus*], ribosomal protein L21 |
| 3960 | 14928 | NM_053330 | ff, gg, hh | ribosomal protein L21 | EST, Moderately similar to 21132008 ribosomal protein L21 [*H. sapiens*], EST, Moderately similar to RL21_RAT 60S RIBOSOMAL PROTEIN L21 [*R. norvegicus*], EST, Weakly similar to 21132008 ribosomal protein L21 [*H. sapiens*], EST, Weakly similar to RL21 MOUSE 60S RIBOSOMAL PROTEIN L21 [*M. musculus*], EST, Weakly similar to RL21_HUMAN 60S RIBOSOMAL PROTEIN L21 [*H. sapiens*], ESTs, Highly similar to 21132008 ribosomal protein L21 [*H. sapiens*], ESTs, Highly similar to RL21 MOUSE 60S RIBOSOMAL PROTEIN L21 [*M. musculus*], ESTs, Moderately similar to RL21 MOUSE 60S RIBOSOMAL PROTEIN L21 [*M. musculus*], ribosomal protein L21 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3751 | 19268 | NM_031104 | gg, hh | ribosomal protein L22 | ESTs, Highly similar to 60S RIBOSOMAL PROTEIN L22 [*H. sapiens*], RIKEN cDNA 2700038K18 gene, RIKEN cDNA 3110001N18 gene, ribosomal protein L22 |
| 4437 | 5667 | X58200 | h, l, z, General, ee | ribosomal protein L23 | |
| 3582 | 2696 | NM_022515 | z, General, ee | ribosomal protein L24 | *Homo sapiens,* clone MGC:27044 IMAGE:479341 2, mRNA, complete cds, *Mus musculus,* Similar to 60S ribosomal protein L30 isolog, clone MGC:6735 IMAGE:3590401, mRNA, complete cds, ribosomal protein L24 |
| 3582 | 2697 | NM_022515 | ee, ll | ribosomal protein L24 | *Homo sapiens,* clone MGC:27044 IMAGE:4793412, mRNA, complete cds, *Mus musculus,* Similar to 60S ribosomal protein L30 isolog, clone MGC:6735 IMAGE:3590401, mRNA, complete cds, ribosomal protein L24 |
| 3581 | 3027 | NM_022514 | h, w, ee, ll, qq | ribosomal protein L27 | ribosomal protein L27 |
| 3617 | 17729 | NM_022697 | h, v, x | ribosomal protein L28 | ribosomal protein L28 |
| 2487 | 18612 | AI228624 | a, c, e, kk | ribosomal protein L29 | EST, Moderately similar to RL29_HUMAN 60S RIBOSOMAL PROTEIN L29 [*H. sapiens*], EST, Moderately similar to RL29_RAT 60S RIBOSOMAL PROTEIN L29 (P23) [*R. norvegicus*], ESTs, Highly similar to S65784 ribosomal protein L29, cytosolic [*H. sapiens*], ribosomal protein L29 |
| 3338 | 5351 | NM_017150 | j | ribosomal protein L29 | EST, Moderately similar to RL29_HUMAN 60S RIBOSOMAL PROTEIN L29 [*H. sapiens*], EST, Moderately similar to RL29_RAT 60S RIBOSOMAL PROTEIN L29 (P23) [*R. norvegicus*], ESTs, Highly similar to S65784 ribosomal protein L29, cytosolic [*H. sapiens*], ribosomal protein L29 |
| 4437 | 18611 | X58200 | h, l, General, ee | ribosomal protein L29 | EST, Moderately similar to RL29_HUMAN 60S RIBOSOMAL PROTEIN L29 [*H. sapiens*], EST, Moderately similar to RL29_RAT 60S RIBOSOMAL PROTEIN L29 (P23) [*R. norvegicus*], ESTs, Highly similar to S65784 ribosomal protein L29, cytosolic [*H. sapiens*], ribosomal protein L29 |
| 3576 | 1347 | NM_022506 | h, l | ribosomal protein L31 | EST, Weakly similar to RL31_HUMAN 60S RIBOSOMAL PROTEIN L3 [*R. norvegicus*], ESTs, Highly similar to RL31_HUMAN 60S RIBOSOMAL PROTEIN L3 [*M. musculus*], RIKEN cDNA 1700034M11 gene, ribosomal protein L31 |
| 3516 | 15335 | NM_021264 | General, kk | ribosomal protein L35a | |
| 1354 | 22748 | AI009786 | gg, hh | ribosomal protein L41 | ESTs, Highly similar to YZA1_HUMAN HYPOTHETICAL PROTEIN [*H. sapiens*], ribosomal protein L41 |
| 4445 | 15875 | X62145 | ee, gg, hh | ribosomal protein L8 | EST, Highly similar to RL8_HUMAN 60S ribosomal protein L8 [*R. norvegicus*], EST, Weakly similar to JN0923 ribosomal protein L8, cytosolic [*H. sapiens*], ESTs, Highly similar to R5RTL8 ribosomal protein L8, cytosolic [validated] - rat [*R. norvegicus*], ESTs, Highly similar to RL8_HUMAN 60S RIBOSOMAL PROTEIN L [*M. musculus*], ESTs, Moderately similar to RL8_HUMAN 60S RIBOSOMAL PROTEIN L [*M. musculus*], expressed sequence AL024098 ribosomal protein L8 |
| 4445 | 25718 | X62145 | c, cc | ribosomal protein L8 | |
| 4429 | 20427 | X53378 | General, ll | ribosomal protein S13 | ESTs, Moderately similar to RS13_HUMAN 40S RIBOSOMAL PROTEIN S13 [*H. sapiens*], ribosomal protein S13 |
| 3611 | 17567 | NM_022672 | h, gg, hh | ribosomal protein S14 | EST, Weakly similar to JE0129 ribosomal protein S14 - mouse [*M. musculus*], ESTs, Highly similar to JE0129 ribosomal protein S14 - mouse [*M. musculus*], expressed sequence AL023078, ribosomal protein S14 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3339 | 16953 | NM_017151 | h, ll | ribosomal protein S15 | EST, Moderately similar to R3HU15 ribosomal protein S15, cytosolic [*H. sapiens*], ESTs, Highly similar to RS15_HUMAN 40S RIBOSOMAL PROTEIN S15 [*M. musculus*], ribosomal protein S15 |
| 3339 | 16954 | NM_017151 | bb, gg, hh | ribosomal protein S15 | EST, Moderately similar to R3HU15 ribosomal protein S15, cytosolic [*H. sapiens*], ESTs, Highly similar to RS15_HUMAN 40S RIBOSOMAL PROTEIN S15 [*M. musculus*], ribosomal protein S15 |
| 3339 | 16955 | NM_017151 | e | ribosomal protein S15 | EST, Moderately similar to R3HU15 ribosomal protein Sib, cytosolic [*H. sapiens*], ESTs, Highly similar to RS15_HUMAN 40S RIBOSOMAL PROTEIN S15 [*M. musculus*], ribosomal protein S15 |
| 3340 | 21643 | NM_017152 | u, General, ee, ll | ribosomal protein S17 | ESTs, Weakly similar to RS17_HUMAN 40S RIBOSOMAL PROTEIN Si [*H. sapiens*], ribosomal protein S17 |
| 4424 | 20872 | X51707 | h | ribosomal protein S19 | EST, Moderately similar to R3RTI9 ribosomal protein S19, cytosolic [validated] - rat [*R. norvegicus*], EST, Weakly similar to RS19_HUMAN 40S RIBOSOMAL PROTEIN S19 [*H. sapiens*] |
| 3266 | 10499 | NM_013184 | r, ii | ribosomal protein 523 | ESTs, Highly similar to 40S RIBOSOMAL PROTEIN S23 [*H. sapiens*], ESTs, Weakly similar to ribosomal protein S23 [*Rattus norvegicus*] [*R. norvegicus*], *Mus musculus*, Similar to mitochondrial ribosomal protein S12, clone MGC:13892 IMAGE:4209358, mRNA, complete cds, mitochondrial ribosomal protein S12, ribosomal protein S23 |
| 4130 | 10498 | NM_078617 | w, y | ribosomal protein S23 | ESTs, Highly similar to 40S RIBOSOMAL PROTEIN S23 [*H. sapiens*], ESTs, Weakly similar to ribosomal protein S23 [*Rattus norvegicus*] [*R. norvegicus*], *Mus musculus*, Similar to mitochondrial ribosomal protein S12, clone MGC:13892 IMAGE:4209358, mRNA, complete cds, mitochondrial ribosomal protein S12, ribosomal protein S23 |
| 3757 | 24615 | NM_031112 | General | ribosomal protein S24 | EST, Weakly similar to JH021 3 ribosomal protein S24, cytosolic [*H. sapiens*], EST, Weakly similar to RS24_HUMAN 40S RIBOSOMAL PROTEIN S24 [*M. musculus*], ESTs, Highly similar to JH0213 ribosomal protein 524, cytosolic [*H. sapiens*], ribosomal protein S24 |
| 4422 | 10819 | X51536 | h, k | ribosomal protein S3 | EST, Moderately similar to RS3_MOUSE 40S ribosomal protein S3 [*R. norvegicus*], EST, Weakly similar to RS3_MOUSE 40S ribosomal protein S3 [*R. norvegicus*], ESTs, Highly similar to RS3_MOUSE 40S ribosomal protein S3 [*R. norvegicus*], ESTs, Moderately similar to RS3_HUMAN 40S RIBOSOMAL PROTEIN S [*H. sapiens*], ESTs, Weakly similar to RS3 MOUSE 40S RIBOSOMAL PROTEIN S3 [*M. musculus*], hypothetical protein FLJ11252, hypothetical protein FLJ23059, myo-inositol 1-phosphate synthase A1 ribosomal protein S3 |
| 4422 | 25686 | X51536 | z, General | ribosomal protein S3 | |
| 3341 | 1694 | NM_017153 | h, z, General, ee | ribosomal protein S3A, ribosomal protein S3a | EST, Weakly similar to J04662 ribosomal protein S3a, cytosolic [*H. sapiens*], EST, Weakly similar to RS3A MOUSE 40S RIBOSOMAL PROTEIN S3A [*M. musculus*], ESTs, Highly similar to RS3A HUMAN 40S RIBOSOMAL PROTEIN S3 [*H. sapiens*], ribosomal protein 53A, ribosomal protein S3a |
| 4416 | 15652 | X14210 | h, gg, hh | ribosomal protein S4, X-linked | |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4439 | 25702 | X58465 | l | ribosomal protein S5 | EST, Moderately similar to 2113200E ribosomal protein S5 [*H. sapiens*], EST, Weakly similar to 2113200E ribosomal protein S5 [*H. sapiens*], ribosomal protein S5 |
| 4439 | 10109 | X58465 | h, l, ee, ll | ribosomal protein S5 | EST, Moderately similar to 2113200E ribosomal protein S5 [*H. sapiens*], EST, Weakly similar to 2113200E ribosomal protein S5 [*H. sapiens*], ribosomal protein S5 |
| 3345 | 17105 | NM_017160 | ee | ribosomal protein S6 | EST, Moderately similar to R3HU6 ribosomal protein S6, cytosolic [*H. sapiens*], EST, Moderately similar to RS6_HUMAN 40S RIBOSOMAL PROTEIN S6 [*H. sapiens*], EST, Weakly similar to R3HU6 ribosomal protein S6, cytosolic [*H. sapiens*], ESTs, Highly similar to RS6_HUMAN 40S RIBOSOMAL PROTEIN S6 [*H. sapiens*], ESTs, Weakly similar to RS6_HUMAN 40S RIBOSOMAL PROTEIN S6 [*H. sapiens*], ribosomal protein S6 |
| 3816 | 9620 | NM_031570 | h, General, ll | ribosomal protein S7 | EST, Moderately similar to JC4388 ribosomal protein S7, cytosolic [*H. sapiens*], EST, Weakly similar to RS7_HUMAN 40S RIBOSOMAL PROTEIN S7 [*M. musculus*], EST, Weakly similar to R37_HUMAN 40S ribosomal protein S7 (S8) [*R. norvegicus*], ESTs, Highly similar to JC4388 ribosomal protein S7, cytosolic [*H. sapiens*], ESTs, Highly similar to RS7_HUMAN 40S RIBOSOMAL PROTEIN S7 [*H. sapiens*], ESTs, Moderately similar to RS7_HUMAN 40S RIBOSOMAL PROTEIN 37 [*H. sapiens*], ribosomal protein S7 |
| 3816 | 9621 | NM_031570 | General, rr | ribosomal protein S7 | EST, Moderately similar to JC4388 ribosomal protein S7, cytosolic [*H. sapiens*], EST, Weakly similar to R37_HUMAN 40S RIBOSOMAL PROTEIN 37 [*M. musculus*], EST, Weakly similar to R37_HUMAN 40S ribosomal protein S7 (S8) [*R. norvegicus*], ESTs, Highly similar to JC4388 ribosomal protein S7, cytosolic [*H. sapiens*], ESTs, Highly similar to R37_HUMAN 40S RIBOSOMAL PROTEIN S7 [*H. sapiens*], ESTs, Moderately similar to RS7_HUMAN 40S RIBOSOMAL PROTEIN S7 [*H. sapiens*], ribosomal protein S7 |
| 3866 | 16204 | NM_031706 | l, x, General | ribosomal protein S8 | EST, Weakly similar to 40S RIBOSOMAL PROTEIN S8 [*M. musculus*], ESTs, Highly similar to 325022 ribosomal protein S8, cytosolic [*H. sapiens*], ESTs, Moderately similar to RS8_HUMAN 40S RIBOSOMAL PROTEIN S [*H. sapiens*], RIKEN cDNA 1110008P08 gene, ribosomal protein S8 |
| 3886 | 15647 | NM_031773 | l, y | RNA polymerase 1-2 (128 kDa subunit), similar to DNA-directed RNA polymerase I (135 kDa) | EST, Weakly similar to T42723 probable DNA-directed RNA polymerase (EC 2.7.7.6) I second largest chain - mouse [*M. musculus*], ESTs, Weakly similar to RNA polymerase I (127 kDa subunit) [*Rattus norvegicus*] [*R. norvegicus*], ESTs, Weakly similar to T42723 probable DNA-directed RNA polymerase (EC 2.7.7.6)1 second largest chain - mouse [*M. musculus*], RIKEN cDNA 2700078H01 gene, RNA polymerase 1-2 (128 kDa subunit), polymerase (RNA) II (DNA directed) polypeptide B (140 kD), similar to DNA-directed RNA polymerase I (135 kDa) |
| 3412 | 1630 | NM_017325 | qq, vv | runt related transcription factor 1, runt-related transcription factor 1 (acute myeloid leukemia 1; aml1 oncogene) | AML1 = AML1 {alternatively spliced, exons 5 and b}[human, mRNA Partial, 284 nt ], EST, Weakly similar to RUN1_RAT Runt-related transcription factor 1 (Core-binding factor, alpha 2 subunit) (CBF-alpha 2) (Acute myeloid leukemia 1 protein) (Oncogene AML-1) (Polyomavirus enhancer binding protein 2 alpha B subunit) (PEBP2-alpha B) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | (PEA2-alpha B) [*R. norvegicus*], ESTs, Highly similar to A48233 polyomavirus enhancer-binding protein 2 alpha chain type 1 - mouse [*M. musculus*], runt related transcription factor 1, runt-related transcription factor 1 (acute myeloid leukemia 1; aml1 oncogene) |
| 66 | 18060 | AA799735 | c, j, q, x | RuvB-like 1 (*E. coli*), RuvB-like protein 1 | Homer, neuronal immediate early gene, 1B, homer, neuronal immediate early gene, 1 |
| 66 | 18061 | M799735 | dd, oo | RuvB-like 1 (*E. coli*), RuvB-like protein 1 | Homer, neuronal immediate early gene, 1B, homer, neuronal immediate early gene, 1 |
| 3867 | 18055 | NM_031707 | nn | RuvB-like 1 (*E. coli*), RuvB-like protein 1 | Homer, neuronal immediate early gene, 1B, homer, neuronal immediate early gene, 1 |
| 3867 | 18056 | NM_031707 | c | RuvB-like 1 (F. coli), RuvB-like protein 1 | Homer, neuronal immediate early gene, 1B, homer, neuronal immediate early gene, 1 |
| 4311 | 1382 | NM_147177 | c, e, dd | RuvB-like 1 (*E. coli*), RuvB-like protein 1 | Homer, neuronal immediate early gene, 1B, homer, neuronal immediate early gene, 1 |
| 4335 | 1471 | S68809 | e | S100 calcium binding protein A1 | ESTs, Weakly similar to S10A MOUSE 3-100 PROTEIN ALPHA CHAIN [*M. musculus*] S100 calcium binding protein A1, S100 calcium binding protein A11 (calizzarin) S100 calcium binding protein P, S100Z protein, expressed sequence AI266795 |
| 3758 | 19040 | NM_031114 | qq, vv | S100 calcium binding protein A10 (annexin II ligand, calpactin I, light polypeptide (p11)), S100 calcium binding protein A10 (calpactin) | EST, Moderately similar to S110_RAT Calpactin I light chain (P10 protein) (P11) (Cellular ligand of annexin II) (Nerve growth factor induced protein 42C) [*R. norvegicus*], S100 calcium binding protein A10 (annexin II ligand, calpactin I, light polypeptide (p11)), S100 calcium binding protein A10 (calpatin) |
| 2552 | 13618 | AI230724 | kk, tt | SAC1 (supressor of actin mutations 1, homolog)-like (*S. cerevisaie*), SAC1 suppressor of actin mutations 1-like (yeast) | |
| 4052 | 3677 | NM_053798 | x | SAC1 (supressor of actin mutations 1, homolog)-like (*S. cerevisaie*), SAC1 suppressor of actin mutations 1-like (yeast) | |
| 3359 | 20779 | NM_017201 | u | S-adenosylhomocysteine hydrolase | *Mus musculus*, S-adenosylhomocysteine hydrolase-like 1, clone MGC:18748 IMAGE:40071 02, mRNA, complete cds, S-adenosyihomocysteine hydrolase, S-adenosylhomocysteine hydrolase, related sequence 3, expressed sequence AL024110 |
| 3710 | 15682 | NM_031011 | a | S-adenosylmethionine decarboxylase 1 | 3-adenosylmethionine decarboxylase 1, S-adenosylmethionine decarboxylase 2 |
| 3710 | 15683 | NM_031011 | kk, oo | S-adenosylmethionine decarboxylase 1 | S-adenosylmethionine decarboxylase 1, S-adenosylmethionine decarboxylase 2 |
| 3664 | 4655 | NM_024346 | u | Scgn10 like-protein, stathmin-like 3 | Scgn10 like-protein, stathmin-like 3 |
| 3100 | 16220 | NM_012656 | c, cc | secreted acidic cysteine rich glycoprotein, secreted protein, acidic, cysteine-rich (osteonectin) | secreted acidic cysteine rich glycoprotein, secreted protein, acidic, cysteine-rich (osteonectin) |
| 1206 | 3364 | AA998097 | General | selenium donor protein | *Homo sapiens* cDNA FLJ30444 fis, clone BRACE2009235, *Homo sapiens*, clone IMAGE:4293510, mRNA, partial cds, expressed sequence AA589574, selenium donor protein, selenophosphate synthetase 2 |
| 2537 | 4280 | AI230247 | c, v, General | selenoprotein P, plasma, 1 | selenoprotein P, plasma, 1 |
| 3166 | 4282 | NM_012883 | rr | selenoprotein P, plasma, 1, sulfotransferase, estrogen preferring, sulfotransferase, estrogen-preferring | selenoprotein P, plasma, 1, sulfotransferase, estrogen preferring, sulfotransferase, estrogen-preferring |
| 3213 | 17894 | NM_013027 | v | selenoprotein W, 1, selenoprotein W, muscle 1 | ESTs, Weakly similar to SELW MOUSE SELENOPROTEIN W [*M. musculus*], selenoprotein W, 1, selenoprotein W, muscle 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3017 | 21399 | M36410 | General | sepiapterin reductase, sepiapterin reductase (7,8-dihydrobiopterin:NADP$^+$ oxidoreductase) | ESTs, Highly similar to A36024 sepiapterin reductase (EC 1.1.1.153) - rat [*R. norvegicus*], sepiapterin reductase, sepiapterin reductase (7,8-dihydrobiopterin:NADP$^+$ oxidoreductase) |
| 3017 | 21400 | M36410 | n, x, General, dd, ee | sepiapterin reductase, sepiapterin reductase (7,8-dihydrobiopterin:NADP$^+$ oxidoreductase) | ESTs, Highly similar to A36024 sepiapterin reductase (EC 1.1.1.153) - rat [*R. norvegicus*], sepiapterin reductase, sepiapterin reductase (7,8-dihydrobiopterin:NADP$^+$ oxidoreductase) |
| 3585 | 25681 | NM_022519 | r | serine (or cysteine) proteinase inhibitor, clade A (alpha-1 antiproteinase, antitrypsin), member 1 | |
| 3585 | 4212 | NM_022519 | e | serine (or cysteine) proteinase inhibitor, clade A (alpha-1 antiproteinase, antitrypsin), member 1 | |
| 3585 | 4213 | NM_022519 | ee | serine (or cysteine) proteinase inhibitor, clade A (alpha-1 antiproteinase, antitrypsin), member 1 | |
| 1753 | 16058 | AI071490 | General, vv | serine palmitoyltransferase, long chain base subunit 2 | serine palmitoyltransferase, long chain base subunit 2 |
| 3450 | 19241 | NM_019206 | l, y, General, qq | serine/threonine kinase 10 | *Homo sapiens* CTCL tumor antigen se20-9 mRNA, complete cds, Ste20-related serine/threonine kinase, serine/threonine kinase 10 |
| 3456 | 20433 | NM_019232 | tt, xx | serum/glucocorticoid regulated kinase | EST, Weakly similar to SGK_RAT Serine/threonine-protein kinase Sgk (Serum/glucocorticoid-regulated kinase) [*R. norvegicus*], *Mus musculus*, hypothetical protein MGC11287 similar to ribosomal protein 36 kinase, clone MGC:38756 IMAGE:5358742, mRNA, complete cds, RIKEN cDNA 1190006F07 gene, serine/threonine protein kinase CISK, serum/glucocorticoid regulated kinase, serum/glucocorticoid regulated kinase 2, serum/glucocorticoid regulated kinase-like |
| 3902 | 2655 | NM_031821 | l, kk, nn, tt | serum-inducible kinase | ESTs, Highly similar to SNK_RAT Serine/threonine-protein kinase SNK (Serum inducible kinase) [*R. norvegicus*], ESTs, Weakly similar to SNK MOUSE SERINE/THREONINE-PROTEIN KINASE SNK [*M. musculus*], ESTs, Weakly similar to SNK_RAT Serine/threonine-protein kinase SNK (Serum inducible kinase) [*R. norvegicus*], *Homo sapiens* cDNA FLJ30246 fis, clone BRACE2002202, weakly similar to SERINE/THREONINE-PROTEIN KINASE SNK (EC 2.7.1.-), NIMA (never in mitosis gene a)-related expressed kinase 1, NIMA (never in mitosis gene a)-related kinase 4, serum-inducible kinase |
| 497 | 15342 | AA875172 | k | SH3-domain kinase binding protein 1 | Arg/Abl-interacting protein ArgBP2, EST, Weakly similar to J05583 85K SH3 domain-containing proline-rich protein - mouse [*M. musculus*], ESTs, Moderately similar to Arg/Abl-interacting protein ArgBP2 [*Rattus norvegicus*] [*R. norvegicus*], ESTs, Weakly similar to J05583 85K SH3 domain-containing proline-rich protein - mouse [*M. musculus*], RIKEN cDNA 2010203O03 gene, Rac/Cdc42 guanine nucleotide exchange factor (GEF) 6, SH3-domain kinase binding protein 1, sorbin and SH3 domain containing 1 |
| 3214 | 1734 | NM_013028 | oo | short stature homeobox 2 | ES cell derived homeobox, short stature homeobox, short stature homeobox 2 |
| 3872 | 3548 | NM_031723 | u, ww | signal peptidase complex (18 kD) | |
| 3872 | 3549 | NM_031723 | r, tt | signal peptidase complex (18 kD) | |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3358 | 9124 | NM_017199 | j, ii | signal sequence receptor, delta, signal sequence receptor, delta (translocon-associated protein delta) | EST, Moderately similar to SSRD_RAT TRANSLOCON-ASSOCIATED PROTEIN, DELTA SUBUNIT PRECURSOR (TRAP-DELTA) (SIGNAL SEQUENCE RECEPTOR DELTA SUBUNIT) (SSR-DELTA) [*R. norvegicus*], EST, Weakly similar to SSRD_HUMAN TRANSLOCON-ASSOCIATED PROTEIN, DELTA SUBUNIT PRECURSOR [*H. sapiens*], *Mus musculus*, clone IMAGE:4038523, mRNA, partial cds, signal sequence receptor, delta, signal sequence receptor, delta (translocon-associated protein delta) |
| 3358 | 9125 | NM_017199 | u, dd, ii, ll | signal sequence receptor, delta, signal sequence receptor, delta (translocon-associated protein delta) | EST, Moderately similar to SSRD_RAT TRANSLOCON-ASSOCIATED PROTEIN, DELTA SUBUNIT PRECURSOR (TRAP-DELTA) (SIGNAL SEQUENCE RECEPTOR DELTA SUBUNIT) (SSR-DELTA) [*R. norvegicus*], EST, Weakly similar to SSRD_HUMAN TRANSLOCON-ASSOCIATED PROTEIN, DELTA SUBUNIT PRECURSOR [*H. sapiens*], *Mus musculus*, clone IMAGE:4038523, mRNA, partial cds, signal sequence receptor, delta, signal sequence receptor, delta (translocon-associated protein delta) |
| 3358 | 9126 | NM_017199 | g | signal sequence receptor, delta, signal sequence receptor, delta (translocon-associated protein delta) | EST, Moderately similar to SSRD_RAT TRANSLOCON-ASSOCIATED PROTEIN, DELTA SUBUNIT PRECURSOR (TRAP-DELTA) (SIGNAL SEQUENCE RECEPTOR DELTA SUBUNIT) (SSR-DELTA) [*R. norvegicus*], EST, Weakly similar to SSRD_HUMAN TRANSLOCON-ASSOCIATED PROTEIN, DELTA SUBUNIT PRECURSOR [*H. sapiens*], *Mus musculus*, clone IMAGE:4038523, mRNA, partial cds, signal sequence receptor, delta, signal sequence receptor, delta (translocon-associated protein delta) |
| 1241 | 3081 | AA999171 | General | signal transducer and activator of transcription 1, signal transducer and activator of transcription 1, 91 kD | expressed sequence AA408197, signal transducer and activator of transcription 1, signal transducer and activator of transcription 1, 91 kD, signal transducer and activator of transcription 2, signal transducer and activator of transcription 2,11 3 kD, signal transducer and activator of trsnscription 4 |
| 3558 | 1914 | NM_022380 | g | signal transducer and activator of transcription 5B | signal transducer and activator of transcription 5B, signal transducer and activator of transcription 6, interleukin-4 induced |
| 3641 | 15727 | NM_022953 | g | slit homolog 1 (*Drosophila*) | EST, Highly similar to T42626 secreted leucine-rich repeat-containing protein SLIT2 mouse (fragment) [*M. musculus*], ESTs, Weakly similar to hypothetical protein MGC7599; clone MGC:7599 [*Mus musculus*] [*M. musculus*], ESTs, Weakly similar to integral membrane glycoprotein [*Mus musculus*] [*M. musculus*], ESTs, Weakly similar to ALS MOUSE INSULIN-LIKE GROWTH FACTOR BINDING PROTEIN COMPLEX ACID LABILE CHAIN PRECURSOR [*M. musculus*], ESTs, Weakly similar to JG0193 G protein-coupled receptor FEX - mouse [*M. musculus*], ESTs, Weakly similar to Slit-1 protein [*H. sapiens*], *Mus musculus*, Similar to leucine-rich repeat containing 3, clone MGC:30505 IMAGE:4481142, mRNA, complete cds, RIKEN cDNA 9530074E10 gene, slit homolog 1 (*Drosophila*), slit homolog 2 (*Drosophila*), slit homolog 3 (*Drosophila*) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3802 | 20448 | NM_031530 | vv | small inducible cytokine A2, small inducible cytokine A2 (monocyte chemotactic protein 1) | EST, Weakly similar to S07723 immediate-early serum-responsive protein JE precursor - rat [*R. norvegicus*], expressed sequence AI323594, small inducible cytokine A2, small inducible cytokine A24, small inducible cytokine subfamily A (Cys-Cys), member 24 |
| 3802 | 20449 | NM_031530 | vv | small inducible cytokine A2, small inducible cytokine A2 (monocyte chemotactic protein 1) | EST, Weakly similar to S07723 immediate-early serum-responsive protein JE precursor - rat [*R. norvegicus*], expressed sequence AI323594, small inducible cytokine A2, small inducible cytokine A24, small inducible cytokine subfamily A (Cys-Cys), member 24 |
| 3211 | 208 | NM_013025 | vv | small inducible cytokine A3 | |
| 3856 | 2327 | NM_031683 | ll | SMC (structural maintenance of chromosomes 1)-like 1 (*S. cerevisaie*), SMC1 structural maintenance of chromosomes 1-like 1 (yeast) | ESTs, Weakly similar to segregation of mitotic chromosomes b; SMC (segregation of mitotic chromosomes 1)-like 1 (yeast) [*Rattus norvegicus*] [*R. norvegicus*], ESTs, Weakly similar to 154383 chromosome segregation protein smc1 [*H. sapiens*], RIKEN cDNA C030018L16 gene, SMC (structural maintenace of chromosomes 1)-like 2 (*S. cerevisiae*), SMC (structural maintenance of chromosomes 1)-like 1 (*S. cerevisaie*), SMC1 structural maintenance of chromosomes 1-like 1 (yeast), SMC4 structural maintenance of chromosomes 4-like 1 (yeast) |
| 3759 | 1579 | NM_031117 | c, oo, ww | SNRPN upstream reading frame | RIKEN cDNA 2410045I01 gene, SNRPN upstream reading frame, small nuclear ribonucleoprotein B, small nuclear ribonucleoprotein N, small nuclear ribonucleoprotein polypeptide N, small nuclear ribonucleoprotein polypeptides B and B1 |
| 3397 | 20579 | NM_017288 | u | sodium channel, voltage-gated, type I, beta polypeptide | *Mus musculus* brain and heart sodium channel beta 3 subunit mRNA, complete cds, sodium channel beta 3 subunit, sodium channel, voltage-gated, type I, beta polypeptide |
| 3265 | 24490 | NM_013178 | s, cc | sodium channel, voltage-gated, type IV, alpha polypeptide | EST, Highly similar to CIN4_RAT Sodium channel protein, skeletal muscle alpha-subunit (MU-1) [*R. norvegicus*], ESTs, Highly similar to voltage gated Na channel Scn8a [*M. musculus*], ESTs, Moderately similar to voltage gated Na channel Scn8a [*M. musculus*], *Mus musculus* adult male hypothalamus cDNA, RIKEN full-length enriched library, clone:A230108N10:sodium channel, voltage-gated, type II, alpha polypeptide, full insert sequence, sodium channel, voltage-gated, type IV, alpha polypeptide, sodium channel, voltage-gated, type VI, alpha polypeptide |
| 3471 | 15763 | NM_019265 | k | sodium channel, voltage-gated, type XI, alpha polypeptide | RIKEN cDNA 4921522D01 gene, sodium channel, voltage-gated, type XI, alpha polypeptide, sodium channel, voltage-gated, type XII, alpha polypeptide |
| 2978 | 21146 | L35558 | gg, hh | solute carrier family 1 (neuronal/epathelial high affinity glutamate transporter, system Xag) member 1, solute carrier family 1, member 1 | ESTs Weakly similar to EAA3_RAT Excitatory amino acid transporter 3 (Sodium-dependent glutamate/aspartate transporter 3) (Excitatory amino-acid carrier 1) [*R. norvegicus*], *Mus musculus* adult male testis cDNA, RIKEN full-length enriched library, clone:4931413K05:solute carrier family 1, member 1, full insert sequence, *Rattus norvegicus* mRNA for sodium-dependent neutral amino acid transporter, ASCT2, solute carrier family 1 (neuronal/epithelial high affinity glutamate transporter, system Xag), member 1, solute carrier family 1, member 1, solute carrier family 1, member 7 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3896 | 2114 | NM_031798 | u, kk | solute carrier family 12 (sodium/potassium/chloride transporters), member 2, solute carrier family 12, member 2 | Mus musculus strain ILS K-Cl cotransporter (Slc12a5) mRNA, complete cds, cation-chloride cotransporter 6, cation-chloride cotransporter 9, cation-chloride cotransporter-interacting protein 1, solute carrier family 12 (sodium/potassium/chloride transporters), member 2, solute carrier family 12, member 2 |
| 3485 | 235 | NM_019347 | ii | solute carrier family 14 (urea transporter), member 2 | solute carrier family 14 (urea transporter), member 2 |
| 3851 | 24881 | NM_031663 | pp | solute carrier family 18 (vesicular acetylcholine), member 3, solute carrier family 18 (vesicular monoamine), member 3 | Mus musculus, Similar to solute carrier family 18 (vesicular monoamine), member 1, clone MGC:28683 IMAGE:4239930, mRNA, complete cds, solute carrier family 18 (vesicular acetylcholine), member 3, solute carrier family 18 (vesicular monoamine), member 3 |
| 4240 | 16248 | NM_138827 | t, mm | solute carrier family 2 (facilitated glucose transporter), member 1 | Mus musculus, clone MGC:8298 IMAGE:3593581, mRNA, complete cds, solute carrier family 2 (facilitated glucose transporter), member 1 |
| 4240 | 16249 | NM_138827 | p, ff | solute carrier family 2 (facilitated glucose transporter), member 1 | Mus musculus, clone MGC:8298 IMAGE:3593581, mRNA, complete cds, solute carrier family 2 (facilitated glucose transporter), member 1 |
| 4240 | 16250 | NM_138827 | mm | solute carrier family 2 (facilitated glucose transporter), member 1 | Mus musculus, clone MGC:8298 IMAGE:3593581, mRNA, complete cds, solute carrier family 2 (facilitated glucose transporter), member 1 |
| 4240 | 16251 | NM_138827 | mm | solute carrier family 2 (facilitated glucose transporter), member 1 | Mus musculus, clone MGC:8298 IMAGE:3593581, mRNA, complete cds, solute carrier family 2 (facilitated glucose transporter), member 1 |
| 3165 | 15872 | NM_012879 | bb | solute carrier family 2 (facilitated glucose transporter), member 2 | ESTs, Weakly similar to solute carrier family 2 (facilitated glucose transporter), member 2; liver-type glucose transporter [Mus musculus] [M. musculus], solute carrier family 2 (facilitated glucose transporter), member 2 |
| 3472 | 23625 | NM_019269 | o | solute carrier family 22 (organic cation transporter), member 5 | ESTs, Weakly similar to solute carrier family 22 (organic cation transporter), member 5; Lstp-like [Mus musculus] [M. musculus], ESTs, Weakly similar to OCN2 MOUSE ORGANIC CATION/CARNITINE TRANSPORTER 2 [M. musculus], Homo sapiens OAT4L mRNA for organic anion transpoter 4 like protein, complete cds, Mus musculus, Similar to solute carrier family 22 (organic cation transporter)-like 2, clone MGC:25980 IMAGE:4242162, mRNA, complete cds, RIKEN cDNA 4921504E14 gene, expressed sequence AI987855, solute carrier family 22 (organic anion/cation transporter), member 11, solute carrier family 22 (organic cation transporter), member 5, solute carrier family 22 (organic cation transporter), member 9 |
| 4272 | 17549 | NM_139100 | m, ee | solute carrier family 25 (mitochondrial carrier; adenine nucleotide translocator), member 3, solute carrier family 25 (mitochondrial carrier; phosphate carrier), member 3 | RIKEN cDNA 3632410G24 gene, RIKEN cDNA 5730438N18 gene, expressed sequence W51672, solute carrier family 25 (mitochondrial carrier, brain), member 14, solute carrier family 25 (mitochondrial carrier; adenine nucleotide translocator), member 3, solute carrier family 25 (mitochondrial carrier; oxoglutarate carrier), member 11, solute carrier family 25 (mitochondrial carrier; phosphate carrier), member 3 |
| 3874 | 17554 | NM_031736 | o, vv | solute carrier family 27 (fatty acid transporter), member 2 | EST, Weakly similar to VLCS_HUMAN VERY-LONG-CHAIN ACYL-COA SYNTHETASE [H. sapiens], ESTs, Weakly similar to solute carrier family 27 (fatty acid transporter), member 2 [Rattus norvegicus] [R. norvegicus], Homo sapiens cDNA |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | FLJ23784 fis, clone HEP21238, VLCS-H1 protein, fatty-acid-Coenzyme A ligase, very long-chain 1, hypothetical protein MGC4365, solute carrier family 27 (fatty acid transporter), member 2, solute carrier family 27 (fatty acid transporter) member 3 |
| 3857 | 20743 | NM_031684 | dd | solute carrier family 29 (nucleoside transporters), member 1 | ESTs Weakly similar to solute carrier family 29 (nucleoside transporters), member 1 [*Rattus norvegicus*] [*R. norvegicus*], RIKEN cDNA 4933435C21 gene solute carrier family 29 (nucleoside transporters), member 1 |
| 3476 | 20734 | NM_019283 | q, z, General, jj | solute carrier family 3 (activators of dibasic and neutral amino acid transport), member 2 | solute carrier family 3 (activators of dibasic and neutral amino acid transport), member 2 |
| 3476 | 20735 | NM_019283 | l, l, q, z, General | solute carrier family 3 (activators of dibasic and neutral amino acid transport), member 2 | solute carrier family 3 (activators of dibasic and neutral amino acid transport), member 2 |
| 3627 | 180 | NM_022853 | s | solute carrier family 30 (zinc transporter), member 1 | |
| 3215 | 18078 | NM_013030 | r | solute carrier family 34 (sodium phosphate), member 1 | *Rattus norvegicus* mRNA for Na+/Pi-cotransporter type IIc, complete cds, *Rattus norvegicus* mRNA for NaPi-2 alpha, complete cds, Solute carrier family 17 (sodium/hydrogen exchanger), member 2, expressed sequence AI649385, solute carrier family 34 (sodium phosphate), member 1 |
| 455 | 16333 | AA866414 | k | solute carrier family 4 (anion exchanger), member 1, solute carrier family 4, anion exchanger, member 1 (erythrocyte membrane protein band 3, Diego blood group) | ESTs, Moderately similar to B3AT MOUSE BAND 3 ANION EXCHANGE PROTEIN [*M. musculus*], expressed sequence AI503023, solute carrier family 4 (anion exchanger), member 1, solute carrier family 4, anion exchanger, member 1 (erythrocyte membrane protein band 3, Diego blood group) |
| 3303 | 24697 | NM_017048 | rr | solute carrier family 4 (anion exchanger), member 2, solute carrier family 4, anion exchanger, member 2 (erythrocyte membrane protein band 3-like 1) | solute carrier family 4 (anion exchanger), member 2, solute carrier family 4, anion exchanger, member 2 (erythrocyte membrane protein band 3-like 1) |
| 3216 | 313 | NM_013033 | g | solute carrier family 5 (sodium/glucose cotransporter), member 1, solute carrier family 5, member 1 | *Mus musculus*, Similar to solute carrier family 5 (sodium/glucose cotransporter), member 1, clone MGC:29197 IMAGE:5012356, mRNA, complete cds, RIKEN cDNA 2010013B02 gene, RIKEN cDNA 2010104G07 gene, low affinity sodium-dependent glucose cotransporter, solute carrier family 5 (sodium/glucose cotransporter), member 1, solute carrier family 5, member 1, solute carrier family 5, member 3, solute carrier family 5, member 4a |
| 3242 | 24195 | NM_013111 | f, q | solute carrier family 7 (cationic amino acid transporter, y+ system), member 1 | KIAA1613 protein, *Mus musculus*, clone MGC:27672 IMAGE:4911158, mRNA, complete cds, expressed sequence AU018091, solute carrier family 7 (cationic amino acid transporter, y+ system), member 1, solute carrier family 7 (cationic amino acid transporter, y+ system), member 3 |
| 3242 | 24196 | NM_013111 | f, l, q, z, General, dd | solute carrier family 7 (cationic amino acid transporter, y+ system), member 1 | KIAA1613 protein, *Mus musculus*, clone MGC:27672 IMAGE:4911158, mRNA, complete cds, expressed sequence AU018091, solute carrier family 7 (cationic amino acid transporter, y+ system), member 1, solute carrier family 7 (cationic amino acid transporter, y+ system), member 3 |
| 4385 | 25608 | U53927 | t, ff | solute carrier family 7 (cationic amino acid transporter, y+ system), member 2 | ESTs, Weakly similar to cationic amino acid transporter-2A [*Rattus norvegicus*] [*R. norvegicus*], solute carrier family 7 (cationic amino acid transporter, y+ system), member 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1961 | 17171 | AI105137 | oo, rr | somatostatin | EST, Moderately similar to GTK1_RAT Glutathione S-transferase, mitochondrial (GST 13-13) (Glutathione S-transferase subunit 13) (GST class-kappa) [*R. norvegicus*], EST, Weakly similar to GTK1_HUMAN GLUTATHIONE 5-TRANSFERASE, MITOCHONDRIAL (GST 13-13) (GLUTATHIONE S-TRANSFERASE SUBUNIT 13) (GST CLASS-KAPPA) (HDCMD47P) [*H. sapiens*], RIKEN cDNA 0610025I19 gene, glutathione S-transferase subunit 13 homolog, somatostatin |
| 3217 | 24809 | NM_013036 | g | somatostatin receptor 4 | *Mus musculus* urotensin II receptor mRNA, complete cds, somatostatin receptor 4 |
| 3305 | 1877 | NM_017052 | w | sorbitol dehydrogenase, sorbitol dehydrogenase 1 | ESTs, Highly similar to A54674 L-iditol 2-dehydrogenase [*H. sapiens*], sorbitol dehydrogenase, sorbitol dehydrogenase 1 |
| 1667 | 10138 | AI059048 | m | Sp3 transcription factor | Sp3 transcription factor |
| 3331 | 16681 | NM_017136 | r, w, jj | squalene epoxidase | *Homo sapiens* cDNA FLJ30795 fis, clone FEBRA2001124, squalene epoxidase |
| 3331 | 16682 | NM_017136 | t, mm | squalene epoxidase | *Homo sapiens* cDNA FLJ30795 fis, clone FEBRA2001124, squalene epoxidase |
| 3827 | 14542 | NM_031596 | u | squamous cell carcinoma antigen recognised by T cells, squamous cell carcinoma antigen recognized by T-cells 1 | |
| 3827 | 14543 | NM_031596 | jj | squamous cell carcinoma antigen recognised by T cells, squamous cell carcinoma antigen recognized by T-cells 1 | |
| 1247 | 25149 | AB009246 | gg, hh | stem cell growth factor, stem cell growth factor; lymphocyte secreted C-type lectin | |
| 2946 | 20429 | J05035 | t, xx | steroid 5 alpha-reductase 1, steroid-5-alpha-reductase, alpha polypeptide 1 (3-oxo-5 alpha-steroid delta 4-dehydrogenase alpha 1) | RIKEN cDNA 4930435F02 gene, steroid-5-alpha-reductase, alpha polypeptide 1 (3-oxo 5 alpha-steroid delta 4-dehydrogenase alpha 1) |
| 2946 | 20430 | J05035 | bb, qq | steroid 5 alpha-reductase 1, steroid-5-alpha-reductase, alpha polypeptide 1 (3-oxo-5 alpha-steroid delta 4-dehydrogenase alpha 1) | RIKEN cDNA 4930435F02 gene, steroid-5-alpha-reductase, alpha polypeptide 1 (3-oxo 5 alpha-steroid delta 4-dehydrogenase alpha 1) |
| 4351 | 20431 | S81448 | qq, xx | steroid 5 alpha-reductase 1, steroid-5-alpha-reductase, alpha polypeptide 1 (3-oxo-5 alpha-steroid delta 4-dehydrogenase alpha 1) | RIKEN cDNA 4930435F02 gene, steroid-5-alpha-reductase, alpha polypeptide 1 (3-oxo 5 alpha-steroid delta 4-dehydrogenase alpha 1) |
| 4228 | 16179 | NM_138508 | xx | sterol carrier protein 2, sterol carrier protein 2, liver | EST, Weakly similar to NLTP_HUMAN NONSPECIFIC LIPID-TRANSFER PROTEIN PRECURSOR [*H. sapiens*], sterol carrier protein 2, sterol carrier protein 2, liver |
| 4228 | 16180 | NM_138508 | h, l, General, dd, jj, oo | sterol carrier protein 2, sterol carrier protein 2, liver | EST, Weakly similar to NLTP_HUMAN NONSPECIFIC LIPID-TRANSFER PROTEIN PRECURSOR [*H. sapiens*], sterol carrier protein 2, sterol carrier protein 2, liver |
| 4139 | 25799 | NM_080886 | a, f, n, x, cc, ff, jj, uu | sterol-C4-methyl oxidase-like | cholesterol 25-hydroxylase, chromosome 5 open reading frame 4, sterol-C4-methyl oxidase-like |
| 4139 | 21842 | NM_080886 | a, f, jj, pp | sterol-C4-methyl oxidase-like | cholesterol 25-hydroxylase, chromosome 5 open reading frame 4, sterol-C4-methyl oxidase-like |
| 3473 | 1412 | NM_019271 | ww | stress 70 protein chaperone, microsome-associated, 60 kD, stress 70 protein chaperone, microsome-associated, 60 kD human homolog | RIKEN cDNA 4933409K03 gene, stress 70 protein chaperone, microsome-associated, 60 kD |
| 2960 | 17508 | L08814 | e, gg, hh, oo | structure specific recognition protein 1 | ESTs, Weakly similar to S35637 high mobility group 1 protein homolog - rat (fragment) [*R. norvegicus*], *Mus musculus*, clone IMAGE:4948318, mRNA, partial cds, *Mus musculus*, clone IMAGE:5355658, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | mRNA, structure specific recognition protein 1 |
| 886 | 17513 | AA925554 | h, u | succinate dehydrogenase complex, subunit A, flavoprotein (Fp) | succinate dehydrogenase complex, subunit A, flavoprotein (Fp) |
| 4153 | 17512 | NM_130428 | w | succinate dehydrogenase complex, subunit A, flavoprotein (Fp) | succinate dehydrogenase complex, subunit A, flavoprotein (Fp) |
| 4042 | 18174 | NM_053752 | o | succinate-CoA ligase, GDP forming, alpha subunit | |
| 3904 | 4748 | NM_031834 | k, cc, vv | sulfotransferase family 1A, phenol-preferring, member 1, sulfotransferase family, cytosolic, 1A, phenol-preferring, member 1 | Aryl sulfotransferase cytosolic, 1A, phenol-preferring, member 3, RIKEN cDNA 1110030E23 gene, sulfotransferase family 1A, phenol-preferring, member 1, sulfotransferase family, cytosolic, 1A, phenol preferring, member 1, sulfotransferase family, cytosolic, 1A, phenol-preferring, member 2 |
| 3904 | 4749 | NM_031834 | b, k, l, ii | sulfotransferase family 1A, phenol-preferring, member 1, sulfotransferase family, cytosolic, 1A, phenol-preferring, member 1 | Aryl sulfotransferase cytosolic, 1A, phenol-preferring, member 3, RIKEN cDNA 1110030E23 gene, sulfotransferase family 1A, phenol-preferring, member 1, sulfotransferase family, cytosolic, 1A, phenol preferring, member 1, sulfotransferase family, cytosolic, 1A, phenol-preferring, member 2 |
| 3166 | 16301 | NM_012883 | g, w, rr | sulfotransferase, estrogen preferring, sulfotransferase, estrogen-preferring | sulfotransferase, estrogen preferring, sulfotransferase, estrogen-preferring |
| 3304 | 20876 | NM_017050 | k, tt | superoxide dismutase 1, soluble, superoxide dismutase 1, soluble (amyotrophic lateral sclerosis 1 (adult)) | EST, Weakly similar to SODC MOUSE SUPEROXIDE DISMUTASE [*M. musculus*], superoxide dismutase 1, soluble (amyotrophic lateral sclerosis 1 (adult)) |
| 2724 | 21414 | AI235842 | x | superoxide dismutase 2, mitochondrial | |
| 3636 | 18098 | NM_022947 | oo | suppressor of K+ transport defect 3, suppressor of potassium transport defect 3 | |
| 3589 | 4601 | NM_022524 | g | sushi-repeat-containing protein, sushi-repeat-containing protein, X chromosome | ESTs, Weakly similar to down-regulated by v-src gene [*Rattus norvegicus*] [*R. norvegicus*], Homo sapiens mRNA; cDNA DKFZp586N2022 (from clone DKFZp586N2022), RIKEN cDNA 1110039O07 gene, RIKEN cDNA 2610001E17 gene, sushi-repeat protein, sushi-repeat-containing protein, sushi-repeat-containing protein X chromosome |
| 3428 | 24785 | NM_019133 | n | synapsin I | EST, Weakly similar to A35363 synapsin I splice form a [*H. sapiens*], ESTs, Weakly similar to A30411 synapsin Ia - rat [*R. norvegicus*], ESTs, Weakly similar to IRX2_HUMAN IROQUOIS-CLASS HOMEODOMAIN PROTEIN IRX-2 [*H. sapiens*], ESTs, Weakly similar to SYN1 MOUSE SYNAPSIN I [*M. musculus*], *Mus musculus*, clone IMAGE:3992752, mRNA, partial cds, PR00149 protein, RIKEN cDNA 1810026J23 gene, RIKEN cDNA 4933428P19 gene, RIKEN cDNA 5830475F03 gene, guanine nucleotide binding protein (G protein), beta polypeptide 1-like, haspin, hypothetical protein BC007540, hypothetical protein BC011833, synapsin I |
| 3439 | 1608 | NM_019166 | e | synaptogyrin 1 | ESTs, Moderately similar to SNG1_RAT SYNAPTOGYRIN 1 (P29) [*R. norvegicus*], synaptogyrin 1, synaptogyrin 3, synaptogyrin 4 |
| 3487 | 1389 | NM_019350 | g | synaptotagmin 5, synaptotagmin V | NADPH oxidase-related, C2 domain-containing protein, synaptotagmin 5, synaptotagmin V, synaptotagmin XII |
| 3212 | 1588 | NM_013026 | j, t, mm, ww | syndecan 1 | syndecan 1 |
| 3212 | 1589 | NM_013026 | mm | syndecan 1 | syndecan 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3864 | 25652 | NM_031704 | q | syntaxin 5A | ESTs, Moderately similar to syntaxin 5a [*Rattus norvegicus*] [*R. norvegicus*], syntaxin 5A |
| 3864 | 20718 | NM_031704 | n | syntaxin 5A | ESTs, Moderately similar to syntaxin 5a [*Rattus norvegicus*] [*R. norvegicus*], syntaxin 5A |
| 3864 | 20719 | NM_031704 | b, q, y, dd | syntaxin 5A | ESTs, Moderately similar to syntaxin 5a [*Rattus norvegicus*] [*R. norvegicus*], syntaxin 5A |
| 3848 | 9427 | NM_031656 | c, kk | syntaxin 8 | |
| 3848 | 9428 | NM_031656 | p | syntaxin 8 | |
| 3440 | 7489 | NM_019169 | g | synuclein, alpha, synuclein, alpha (non A4 component of amyloid precursor) | synuclein, alpha, synuclein, alpha (non A4 component of amyloid precursor) |
| 4352 | 3324 | AA859980 | a, c, d, jj | t-complex 1, t-complex protein 1 | EST, Moderately similar to S10486 t-complex-type molecular chaperone TCP1 [*H. sapiens*], ESTs, Weakly similar to JQ0866 T-complex protein 1 - rat [*R. norvegicus*], chaperonin containing TCP1, subunit 7 (eta), chaperonin subunit 7 (eta), 1-complex protein 1 |
| 4351 | 8578 | AA859980 | a, c, q, jj, ss | t-complex 1, t-complex protein 1 | EST, Moderately similar to S10486 t-complex-type molecular chaperone TCP1 [*H. sapiens*], ESTs, Weakly similar to JQ0866 T-complex protein 1 - rat [*R. norvegicus*], chaperonin containing TCP1, subunit 7 (eta), chaperonin subunit 7 (eta), t-complex protein 1 |
| 2939 | 26368 | H34047 | jj | t-complex 1, t-complex protein 1 | EST, Moderately similar to S10486 complex-type molecular chaperone TCP1 [*H. sapiens*], ESTs, Weakly similar to JQ0866 T-complex protein 1 - rat [*R. norvegicus*], chaperonin containing TCP1, subunit 7 (eta), chaperonin subunit 7 (eta), t-complex protein 1 |
| 3105 | 21794 | NM_012670 | g, m, s | t-complex 1, t-complex protein 1 | EST, Moderately similar to S10486 t-complex-type molecular chaperone TCP1 [*H. sapiens*], ESTs, Weakly similar to JQ0866 T-complex protein 1 - rat [*R. norvegicus*], chaperonin containing TCP1, subunit 7 (eta), chaperonin subunit 7 (eta), 1-complex protein 1 |
| 3780 | 15661 | NM_031318 | a, b, m, uu, vv | t-complex testis expressed 1, t-complex-associated-testis-expressed 1-like 1 | *Homo sapiens,* Similar to RIKEN cDNA 0610012D17 gene, clone MGC:33212 IMAGE:4830500, mRNA, complete cds, RIKEN cDNA 2310075M16 gene, t-complex testis expressed 1, t-complex-associated-testis-expressed 1-like, t-complex-associated-testis-expressed 1-like 1 |
| 3780 | 15662 | NM_031318 | m, General | t-complex testis expressed 1, t-complex-associated-testis-expressed 1-like 1 | *Homo sapiens,* Similar to RIKEN cDNA 0610012O17 gene, clone MGC:33212 IMAGE:4830500, mRNA, complete cds, RIKEN cDNA 2310075M16 gene, t-complex testis expressed 1, t-complex-associated-testis-expressed 1-like, t-complex-associated-testis-expressed 1-like 1 |
| 3780 | 15663 | NM_031318 | m | t-complex testis expressed 1, t-complex-associated-testis-expressed 1-like 1 | *Homo sapiens,* Similar to RIKEN cDNA 0610012O17 gene, clone MGC:33212 IMAGE:4830500, mRNA, complete cds, RIKEN cDNA 2310075M16 gene, t-complex testis expressed 1, t-complex-associated-testis-expressed 1-like, t-complex-associated-testis-expressed 1-like 1 |
| 4367 | 25593 | U26310 | k | tensin | |
| 3500 | 24626 | NM_019381 | h, x, General | testis enhanced gene transcript, testis enhanced gene transcript (BAX inhibitor 1) | RIKEN cDNA 2900002L20 gene, RIKEN cDNA 4930500J03 gene, RIKEN cDNA 5031406P05 gene, testis enhanced gene transcript (BAX inhibitor 1) |
| 3024 | 24253 | M61142 | s | thimet oligopeptidase 1 | thimet oligopeptidase 1 |
| 3835 | 24235 | NM_031614 | uu | thioredoxin reductase 1 | thioredoxin reductase 1, thioredoxin reductase 2 |
| 3935 | 17474 | NM_032614 | u | thioredoxin-like 2 | thioredoxin-like 2 |
| 7351 | 2031 | AA893860 | General | threonyl-tRNA synthetase | threonyl-tRNA synthetase |
| 3111 | 5850 | NM_012687 | g | thromboxane A synthase 1 | thromboxane A synthase 1 (platelet, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | (platelet, cytochrome P450, subfamily V), thromboxane A synthase 1, platelet | cytochrome P450, subfamily V), thromboxane A synthase 1, platelet |
| 3106 | 17117 | NM_012673 | w | Thy-1 cell surface antigen, thymus cell antigen 1, theta | Thy-1 cell surface antigen, thymus cell antigen 1, theta |
| 3167 | 16870 | NM_012887 | v | thymopoietin | ESTs, Highly similar to THPA_HUMAN THYMOPOIETIN ALPHA [*H. sapiens*], RIKEN cDNA 5630400024 gene, thymopoietin |
| 3167 | 16871 | NM_012887 | r, z, ee, oo | thymopoietin | ESTs, Highly similar to THPA_HUMAN THYMOPOIETIN ALPHA [*H. sapiens*], RIKEN cDNA 5630400024 gene, thymopoietin |
| 3167 | 16872 | NM_012887 | pp | thymopoietin | ESTs, Highly similar to THPA_HUMAN THYMOPOIETIN ALPHA [*H. sapiens*], RIKEN cDNA 5630400024 gene, thymopoietin |
| 3515 | 20816 | NM_021261 | e, ii, ll | thymosin, beta 10 | |
| 3539 | 243 | NM_021989 | ii, rr | tissue inhibitor of metalloproteinase 2 | *Homo sapiens* mRNA, cDNA DKFZp761A0617 (from clone DKFZp761A0617), tissue inhibitor of metalloproteinase 2 |
| 2306 | 17235 | AI176815 | n | tissue inhibitor of metalloproteinase 3, tissue inhibitor of metalloproteinase 3 (Sorsby fundus dystrophy, pseudoinflammatory) | tissue inhibitor of metalloproteinase 3, tissue inhibitor of metalloproteinase 3 (Sorsby fundus dystrophy, pseudoinflammatory) |
| 3220 | 2667 | NM_013048 | b, h, uu | tocopherol (alpha) transfer protein, tocopherol (alpha) transfer protein (ataxia (Friedreich-like) with vitamin E deficiency) | |
| 3544 | 23782 | NM_022183 | xx | topoisomerase (DNA) II alpha, topoisomerase (DNA) II alpha (170 kD) | ESTs, Moderately similar to A40493 DNA topoisomerase [*H. sapiens*], ESTs, Weakly similar to topoisomerase (DNA) II alpha [*Rattus norvegicus*] [*R. norvegicus*], topoisomerase (DNA) II alpha, topoisomerase (DNA) II beta |
| 3104 | 24427 | NM_012669 | pp | transcription factor 1, transcription factor 1, hepatic; LF-B1 hepatic nuclear factor (HNF1), albumin proximal factor | *Homo sapiens*, Similar to hypothetical protein FLJ21616, clone MGC:14941 IMAGE:3947903, mRNA, complete cds, *Mus musculus*, clone IMAGE:3490304, mRNA, partial cds, hypothetical protein FLJ21616, transcription factor 1, transcription factor 1, hepatic; LF-B1, hepatic nuclear factor (HNF1), albumin proximal factor |
| 3240 | 1885 | NM_013103 | l, u, z | transcription factor 2, transcription factor 2, hepatic; LF-B3; variant hepatic nuclear factor | transcription factor 2, transcription factor 2, hepatic; LF-B3; variant hepatic nuclear factor |
| 3968 | 623 | NM_053369 | jj | transcription factor 4 | EST, Highly similar to TRANSCRIPTION FACTOR 4 [*M. musculus*], transcription factor 4 |
| 2959 | 24425 | L08812 | k | transcription factor EC | expressed sequence AI851540, microphthalmia-associated transcription factor, transcription factor EC |
| 3025 | 19823 | M61725 | oo | transcription factor UBF, upstream binding transcription factor, RNA polymerase I | |
| 123 | 18115 | AA800339 | d, General, ee, kk | transferrin | ESTs, Weakly similar to TRFL MOUSE LACTOTRANSFERRIN PRECURSOR [*M. musculus*], RIKEN cDNA 1300017J02 gene, *Rattus norvegicus* Nclone 10 mRNA, transferrin |
| 3699 | 17377 | NM_030989 | jj | transformation related protein 53, tumor protein p53 (Li-Fraumeni syndrome) | transformation related protein 73, tumor protein p53 (Li-Fraumeni syndrome) |
| 3110 | 4185 | NM_012681 | ee, gg, hh | transthyretin, transthyretin (prealbumin, amyloidosis type I) | expressed sequence AA408768, transthyretin, transthyretin (prealbumin, amyloidosis type I) |
| 3110 | 4186 | NM_012681 | n, ee | transthyretin, transthyretin (prealbumin, amyloidosis type I) | expressed sequence AA408768, transthyretin, transthyretin (prealbumin, amyloidosis type I) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1938 | 18277 | AI104399 | t | triosephosphate somerase, triosephosphate isomerase 1 | EST, Highly similar to TPIS MOUSE TRIOSEPHOSPHATE ISOMERASE [*M. musculus*], ESTs, Highly similar to TPIS_HUMAN TRIOSEPHOSPHATE ISOMERASE [*H. sapiens*], *Rattus norvegicus* resection-induced TPI (rs11) mRNA, complete cds, triosephosphate isomerase, triosephosphate isomerase 1 |
| 3023 | 457 | M60666 | c, nn | tropomyosin 1 (alpha), tropomyosin 1, alpha | Homo sapiens cDNA FLJ30635 fis, clone CTONG2002520, expressed sequence AI854628, expressed sequence C76867, tropomyosin 4, tuftelin 1 |
| 3427 | 455 | NM_019131 | k, bb, ll, mm, nn | tropomyosin 1 (alpha), tropomyosin 1, alpha | Homo sapiens cDNA FLJ30635 fis, clone CTONG2002520, expressed sequence AI854628, expressed sequence C76867, tropomyosin 4, tuftelin 1 |
| 3336 | 20859 | NM_017144 | cc | troponin I, cardiac | |
| 3569 | 402 | NM_022403 | c, l, vv, xx | tryptophan 2,3-dioxygenase | tryptophan 2,3-dioxygenase |
| 4072 | 17728 | NM_053867 | n, ee | tumor protein, translationally-controlled 1 | EST, Moderately similar to 306590 IgE-dependent histamine-releasing factor [*H. sapiens*], EST, Weakly similar to TCTP MOUSE TRANSLATIONALLY CONTROLLED TUMOR PROTEIN [*M. musculus*], ESTs, Highly similar to S06590 gE-dependent histamine-releasing factor [*H. sapiens*], ESTs, Moderately similar to TCTP_MOUSE Translationally controlled tumor protein (TCTP) (pZ3) (21 kDa polypeptide) (p21) (Lens epithelial protein) [*R. norvegicus*], Homo sapiens mRNA full length insert cDNA clone EUROIMAGE 926491, apoptosis inhibitor, tumor protein, translationally-controlled I |
| 3829 | 19344 | NM_031603 | ee | tyrosine 3-monooxygenase/tryptophan 5-monooxygenase activation protein, epsilon polypeptide | ESTs, Highly similar to 138947 14-3-3 protein epsilon isoform [*H. sapiens*], tyrosine 3-monooxygenase/tryptophan 5-monooxygenase activation protein, epsilon polypeptide |
| 3222 | 16683 | NM_013052 | r | tyrosine 3-monooxygenase/tryptophan 5-monooxygenase activation protein, eta polypeptide | ESTs, Highly similar to 143F MOUSE 14-3-3 PROTEIN ETA [*M. musculus*], tyrosine 3-monooxygenase/tryptophan 5-monooxygenase activation protein, eta polypeptide, tyrosine 3-monooxygenase/tryptophan 5-monooxygenase activation protein, gamma polypeptide |
| 3222 | 16684 | NM_013052 | pp | tyrosine 3-monooxygenase/tryptophan 5-monooxygenase activation protein, eta polypeptide | ESTs Highly similar to 143F MOUSE 14-3-3 PROTEIN ETA [*M. musculus*], tyrosine 3-monooxygenase/tryptophan 5-monooxygenase activation protein, eta polypeptide, tyrosine 3-monooxygenase/tryptophan 5-monooxygenase activation protein, gamma polypeptide |
| 3208 | 25279 | NM_013011 | bb | tyrosine 3-monooxygenase/tryptophan 5-monooxygenase activation protein, zeta polypeptide | ESTs, Highly similar to A Chain A, 14-3-3 ZetaPHOSPHOPEPTIDE COMPLEX [*H. sapiens*], tyrosine 3-monooxygenase/tryptophan 5-monooxygenase activation protein, zeta polypeptide |
| 3208 | 3405 | NM_013011 | ss | tyrosine 3-monooxygenase/tryptophan 5-monooxygenase activation protein, zeta polypeptide | ESTs, Highly similar to A Chain A, 14-3-3 ZetaPHOSPHOPEPTIDE COMPLEX [*H. sapiens*], tyrosine 3-monooxygenase/tryptophan 5-monooxygenase activation protein, zeta polypeptide |
| 3103 | 24825 | NM_012668 | x, ee, ss | tyrosine aminotransferase | ESTs, Highly similar to S560718 tat protein [*H. sapiens*], Homo sapiens, Similar to tyrosine aminotransferase, clone MGC:22474 IMAGE:4710626, mRNA, complete cds, *Mus musculus*, Similar to Tyrosine aminotransferase, clone MGC:37790 IMAGE:5097591, mRNA, complete cds, tyrosine aminotransferase |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4041 | 15376 | NM_053747 | x, General, kk | ubiquilin 1 | ESTs, Highly similar to ataxin-1 ubiquitin-like interacting protein; A1U protein; chromosome 1 open reading frame 6 jHomo sapiens] [*H. sapiens*], RIKEN cDNA 1110046H03 gene, ataxin-1 ubiquitin-like interacting protein. ubiquilin 1. ubiquilin 2 |
| 1305 | 22056 | AI008066 | p, mm | ubiquinol-cytochrome c reductase hinge protein | ubiquinol-cytochrome c reductase hinge protein |
| 1919 | 15050 | AI103911 | r | ubiquinol-cytochrome c reductase, Rieske iron-sulfur polypeptide 1 | EST, Weakly similar to UCRI_HUMAN UBIQUINOL-CYTOCHROME C REDUCTASE IRON-SULFUR SUBUNIT, MITOCHONDRIAL PRECURSOR [*H. sapiens*], ESTs, Moderately similar to UCRI_HUMAN UBIQUINOL-CYTOCHROME C REDUCTASE IRON-SULFUR SUBUNIT, MITOCHONDRIAL PRECURSOR [*H. sapiens*], RIKEN cDNA 4430402G14 gene, ubiquinol-cytochrome c reductase, Rieske iron:sulfur polypeptide 1 |
| 3859 | 19727 | NM_031687 | h, ff | ubiquitin A-52 residue ribosomal protein fusion product 1 | EST, Highly similar to S66575 ubiquitin/ribosomal protein CEPS2 - rat (fragment) [*R. norvegicus*], EST, Moderately similar to ubiquitin A-52 residue ribosomal protein fusion product 1; ubiquitin/60S ribosomal fusion protein [*Mus musculus*] [*M. musculus*], ESTs, Moderately similar to ubiquitin A-52 residue ribosomal protein fusion product 1; ubiquitin/60S ribosomal fusion protein [*Mus musculus*] [*M. musculus*], ESTs, Weakly similar to UQHUR ubiquitin/ribosomal protein CEP52 [*H. sapiens*], Neural precursor cell expressed, developmentally down-regulated gene 8, *Rattus norvegicus* RSD-7 mRNA, complete cds, neural precursor cell expressed, developmentally down-regulated gene 8, ubiquitin A-52 residue ribosomal protein fusion product 1 |
| 3374 | 10427 | NM_017237 | bb | ubiquitin carboxy-terminal hydrolase L1, ubiquitin carboxyl-terminal esterase L1 (ubiquitin thiolesterase) | EST, Highly similar to UBLi_RAT Ubiquitin carboxyl-terminal hydrolase isozyme L1 (UCH-L1) (Ubiquitin thiolesterase L1) (Neuron cytoplasmic protein 9.5) (PGP 9.5) (PGP9.5) [*R. norvegicus*], ESTs, Highly similar to UBL1_MOUSE Ubiquitin carboxyl-terminal hydrolase isozyme L1 (UCH-L1) (Ubiquitin thiolesterase L1) (Neuron cytoplasmic protein 9.5) (PGP 9.5) (PGP9.5) [*M. musculus*], Homo sapiens cDNA FLJ30687 fis, clone FCBBF2000379, ubiquitin carboxyl-terminal esterase L1 (ubiquitin thiolesterase), ubiquitin carboxyl-terminal esterase L3 (ubiquitin thiolesterase) |
| 3374 | 10429 | NM_017237 | cc | ubiquitin carboxy-terminal hydrolase L1, ubiquitin carboxyl-terminal esterase L1 (ubiquitin thiolesterase) | EST, Highly similar to UBL1_RAT Ubiquitin carboxyl-terminal hydrolase isozyme L1 (UCH-L1) (Ubiquitin thiolesterase L1) (Neuron cytoplasmic protein 9.5) (PGP 9.5) (PGP9.5) [*R. norvegicus*], ESTs, Highly similar to UBL1_MOUSE Ubiquitin carboxyl-terminal hydrolase isozyme L1 (UCH-L1) (Ubiquitin thiolesterase L1) (Neuron cytoplasmic protein 9.5) (PGP 9.5) (PGP9.5) [*M. musculus*], Homo sapiens cDNA FLJ30687 fis, clone FCBBF2000379, ubiquitin carboxyl-terminal esterase L1 (ubiquitin thiolesterase), ubiquitin carboxyl-terminal esterase L3 (ubiquitin thiolesterase) |
| 3221 | 12013 | NM_013050 | l, nn | ubiquitin-conjugating enzyme E2I, ubiquitin-conjugating enzyme E2I (UBC9 homolog, yeast) | RIKEN cDNA 5830467E05 gene, ubiquitin-conjugating enzyme E2I, ubiquitin-conjugating enzyme E2I (UBC9 homolog, yeast) |
| 3221 | 12014 | NM_013050 | l, j, y | ubiquitin-conjugating enzyme E2I, ubiquitin-conjugating enzyme E2I (UBC9 homolog, yeast) | RIKEN cDNA 5830467E05 gene, ubiquitin-conjugating enzyme E2I, ubiquitin-conjugating enzyme E2I (UBC9 homolog, yeast) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4112 | 15124 | NM_057105 | jj | UDP glycosyltransferase 1 family, polypeptide A cluster, UDP glycosyltransferase 1 family, polypeptide A6, UDP-glucuronosyltransferase 1 family, member 1 | UDP glycosyltransferase 1 family, polypeptide A6, UDP glycosyltransferase 1 family, polypeptide A8 |
| 4112 | 15126 | NM_057105 | t, jj | UDP glycosyltransferase 1 family, polypeptide A cluster, UDP glycosyltransferase 1 family, polypeptide A6, UDP-glucuronosyltransferase 1 family, member 1 | UDP glycosyltransferase 1 family, polypeptide A6, UDP glycosyltransferase 1 family, polypeptide A8 |
| 4112 | 15127 | NM_057105 | k, t, General, mm | UDP glycosyltransferase 1 family, polypeptide A cluster, UDP glycosyltransferase 1 family, polypeptide A6, UDP-glucuronosyltransferase 1 family, member 1 | UDP glycosyltransferase 1 family, polypeptide A6, UDP glycosyltransferase 1 family, polypeptide A8 |
| 2894 | 15123 | D38066 | j, t, mm, xx | UDP glycosyltransferase 1 family, polypeptide A cluster, UDP-glucuronosyltransferase 1 family, member 1 | |
| 4112 | 5492 | NM_057105 | e | UDP glycosyltransferase 1 family, polypeptide A6 | UDP glycosyltransferase 1 family, polypeptide A6 |
| 4112 | 5493 | NM_057105 | e | UDP glycosyltransferase 1 family, polypeptide A6 | UDP glycosyltransferase 1 family, polypeptide A6 |
| 1890 | 11486 | AI103162 | j | UDP-Gal:betaGlcNAc beta 1,4-galactosyltransferase, polypeptide 1 | |
| 1913 | 23829 | AI103754 | h | UDP-Gal:betaGlcNAc beta 1,4-galactosyltransferase, polypeptide 2 | *Mus musculus*, Similar to xylosylprotein beta1,4-galactosyltransferase, polypeptide 7 (galactosyltransferase I), clone MGC:28643 IMAGE:4224150, mRNA, complete cds, UDP-Gal:betaGlcNAc beta 1,4-galactosyltransferase, polypeptide 1, UDP-Gal:betaGlcNAc beta 1,4-galactoxyltransferase polypeptide 2 |
| 2143 | 17027 | AI170679 | xx | UDP-glucose pyrophosphorylase 2 | UDP-glucose pyrophosphorylase 2 |
| 4044 | 7927 | NM_053765 | e, t | UDP-N-acetylglucosamine-2-epimerase/N-acetylmannosamine kinase | UDP-N-acetylglucosamine-2-epimerase/N-acetylmannosamine kinase |
| 3261 | 24750 | NM_013167 | cc | uncoupling protein 3 (mitochondrial, proton carrier), uncoupling protein 3, mitochondrial | RIKEN cDNA 1810012H11 gene, RIKEN cDNA 3632410G24 gene, peroxisomal integral membrane protein, solute carrier family 25 (mitochondrial carrier; peroxisomal membrane protein, 34 kD), member 17, uncoupling protein 3 (mitochondrial, proton carrier), uncoupling protein 3, mitochondrial |
| 3365 | 317 | NM_017218 | h, General, bb, pp | v-erb-b2 erythroblastic leukemia viral oncogene homolog 3 (avian) | ESTs, Weakly similar to A53183 epidermal growth factor receptor precursor - mouse [*M. musculus*], *Homo sapiens* clone R2 ErbB 3 R2 (c-erbB-3) mRNA, partial cds, *Mus musculus*, clone MGC:38648 IMAGE:5356166, mRNA, complete cds, v-erb-b2 erythroblastic leukemia viral oncogene homolog 3 (avian) |
| 3498 | 20443 | NM_019379 | n, q, dd, oo | vesicle docking protein p115, vesicle docking protein, 115 kDa | vesicle docking protein p115, vesicle docking protein, 115 kDa |
| 3102 | 16198 | NM_012663 | kk, tt | vesicle-associated membrane protein 2, vesicle-associated membrane protein 2 (synaptobrevin 2) | |
| 3102 | 16199 | NM_012663 | bb, kk | vesicle-associated membrane protein 2, vesicle-associated membrane protein 2 (synaptobrevin 2) | |
| 3102 | 16200 | NM_012663 | ii | vesicle-associated membrane protein 2, vesicle-associated membrane protein 2 (synaptobrevin 2) | |
| 4107 | 23250 | NM_057097 | m | vesicle-associated membrane protein 3, vesicle-associated | ESTs, Weakly similar to vesicle-associated membrane protein 3 [*Rattus norvegicus*] |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | membrane protein 3 (cellubrevin) | [R. norvegicus], vesicle-associated membrane protein 3, vesicle-associated membrane protein 3 (cellubrevin), vesicle-associated membrane orotein 4 |
| 3436 | 24362 | NM_019156 | a | vitronectin, vitronectin (serum spreading factor, somatomedin B, complement S-protein) | |
| 3793 | 15608 | NM_031355 | n | voltage-dependent anion channel 3 | voltage-dependent anion channel 3 |
| 3948 | 1423 | NM_052801 | mm | von Hippel-Lindau syndrome, von Hippel-Lindau syndrome, homolog | von Hippel-Lindau syndrome, von Hippel-Lindau syndrome homolog |
| 3948 | 1424 | NM_052801 | ww | von Hippel-Lindau syndrome, von Hippel-Lindau syndrome homolog | von Hippel-Lindau syndrome, von Hippel-Lindau syndrome homolog |
| 3098 | 20798 | NM_012639 | ll | v-raf-1 leukemia viral oncogene 1, v-raf-1 murine leukemia viral oncogene homolog 1 | ESTs, Highly similar to B-raf oncogene [M. musculus], Mouse B-raf oncogene mRNA, complete cds, RIKEN cDNA 4921513O20 gene, v-raf murine sarcoma viral oncogene homolog B1, v-raf-1 leukemia viral oncogene 1, v-raf-1 murine leukemia viral oncogene homolog 1 |
| 3098 | 20799 | NM_012639 | p | v-raf-1 leukemia viral oncogene 1, v-raf-1 murine leukemia viral oncogene homolog 1 | ESTs, Highly similar to B-raf oncogene [M. musculus], Mouse B-rafoncogene mRNA, complete cds, RIKEN cDNA 4921513O20 gene, v-raf murine sarcoma viral oncogene homolog B1, v-raf-1 leukemia viral oncogene 1, v-raf-1 murine leukemia viral oncooene homolog 1 |
| 3342 | 21975 | NM_017154 | l | xanthenedehydrogenase, xanthine dehydrogenase | |
| 3836 | 1925 | NM_031616 | a, g | zinc finger protein 265 | DNA segment, KIST 4, expressed sequence AI227013, zinc finger protein 265 |
| 3350 | 20919 | NM_017172 | v, nn | zinc finger protein 36, C3H type-like 1 | ESTs, Weakly similar to S10471 cMG1 protein - rat [R. norvegicus], zinc finger protein 36, C3H type-like 1, zinc finger protein 36, C3H type-like 2 |
| 4165 | 25730 | NM_133290 | r, t | zinc finger protein 36, zinc finger protein 36, C3H type, homolog (mouse) | zinc finger protein 36, zinc finger protein 36, C3H type, homolog (mouse) |
| 4213 | 8692 | NM_134387 | e | | 2,4-dienoyl CoA reductase 1, mitochondrial, 2,4-dienoyl CoA reductase 2, peroxisomal, 2 4-dienoyl-Coenzyme A reductase 2, peroxisomal, RIKEN cDNA 1810027P18 gene, putative peroxisomal 2,4-dienoyl-CoA reductase |
| 3549 | 20299 | NM_022220 | j | | 24-dehydrocholesterol reductase, Mus musculus, clone MGC:29968 IMAGE:5123684, mRNA, complete cds |
| 260 | 19451 | AA819788 | ll | | 28 kD interferon responsive protein, RIKEN cDNA 5830458K16 gene |
| 2868 | 23220 | AJ000347 | pp | | 3'(2"), 5-bisphosphate nucleotidase 1, ESTs, Moderately similar to INPP MOUSE INOSITOL POLYPHOSPHATE 1-PHOSPHATASE [M. musculus], bisphosphate 3-nucleotidase 1, hypothetical protein FLJ20421, inositol polyphosphate-1-phosphatase |
| 2608 | 15582 | AI232320 | k, o, oo | | 3-hydroxy-3-methylglutaryl-Coenzyme A synthase 2, 3-hydroxy-3-methylglutaryl-Coenzyme A synthase 2 (mitochondrial) |
| 3013 | 15579 | M33648 | d, k, l, o, ff, oo, ss | | 3-hydroxy-3-methylglutaryl-Coenzyme A synthase 2, 3-hydroxy-3-methylglutaryl-Coenzyme A synthase 2 (mitochondrial) |
| 3013 | 15580 | M33648 | k, l, o, ff | | 3-hydroxy-3-methylglutaryl-Coenzyme A synthase 2, 3-hydroxy-3-methylglutaryl-Coenzyme A synthase 2 mitochondrial) |
| 4101 | 17739 | NM_053995 | h, General, qq | | 3-hydroxybutyrate dehydrogenase (heart, mitochondrial), ESTs, Weakly similar to BDH_RAT D-beta-hydroxybutyrate dehydrogenase, mitochondrial precursor (BDH) (3-hydroxybutyrate dehydrogenase) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1476 | 21950 | AI013861 | h | | [*R. norvegicus*], RIKEN cDNA 0610039E24 gene, RIKEN cDNA 2310032J20 gene, retinol dehydrogenase 7, retinol 3-hydroxyisobutyrate dehydrogenase, ESTs, Highly similar to D3HI_HUMAN 3-HYDROXYISOBUTYRATE DEHYDROGENASE, MITOCHONDRIAL PRECURSOR (HIBADH) [*H. sapiens*], RIKEN cDNA 3930401K13 gene |
| 6652 | 2537 | AA892799 | kk | | 3-phosphoglycerate dehydrogenase, EST, Moderately similar to SERA MOUSE D-3-PHOSPHOGLYCERATE DEHYDROGENASE [*M. musculus*], *Mus musculus* adult male testis cDNA, RIKEN full-length enriched library, clone:4930404C15:3-phosphoglycerate dehydrogenase, full insert sequence, glyoxylate reductase/hydroxypyruvate reductase, phosphoglycerate |
| 6652 | 2538 | AA892799 | z | | 3-phosphoglycerate dehydrogenase, EST, Moderately similar to SERA MOUSE D-3-PHOSPHOGLYCERATE DEHYDROGENASE [*M. musculus*], *Mus musculus* adult male testis cDNA, RIKEN full-length enriched library, clone:4930404C15:3-phosphoglycerate dehydrogenase, full insert sequence, glyoxylate reductase/hydroxypyruvate reductase, phosphoglycerate dehydrogenase |
| 850 | 22540 | AA924630 | ff | | 3-phosphoglycerate dehydrogenase, EST, Moderately similar to SERA MOUSE D-3-PHOSPHOGLYCERATE DEHYDROGENASE [*M. musculus*], *Mus musculus* adult male testis cDNA, RIKEN full length enriched library, clone:4930404C15.3-phosphoglycerate dehydrogenase, full insert sequence, glyoxylate reductase/hydroxypyruvate reductase, phosphoglycerate |
| 2591 | 22542 | AI232066 | ff | | 3-phosphoglycerate dehydrogenase, EST, Moderately similar to SERA MOUSE D-3-PHOSPHOGLYCERATE DEHYDROGENASE [*M. musculus*], *Mus musculus* adult male testis cDNA, RIKEN full-length enriched library, clone:4930404C15:3-phosphoglycerate dehydrogenase, full insert sequence, glyoxylate reductase/hydroxypyruvate reductase, phosphoglycerate dehydrogenase |
| 3704 | 135 | NM_031003 | l, General | | 4-aminobutyrate aminotransferase, RIKEN cDNA 1300019H02 gene, RIKEN cDNA 2900006813 gene, ornithine aminotransferase |
| 2017 | 6552 | AI137062 | d | | 6.2 kd protein |
| 3563 | 12082 | NM_022389 | jj | | 7-dehydrocholesterol reductase, expressed sequence AI505894 |
| 3563 | 12083 | NM_022389 | jj | | 7-dehydrocholesterol reductase, expressed sequence AI505894 |
| 3514 | 13485 | NM_020306 | d, bb | | a disintegrin and metalloproteinase domain 17, a disintegrin and metalloproteinase domain 17 (tumor necrosis factor, alpha, converting enzyme) |
| 3514 | 13486 | NM_020306 | s | | a disintegrin and metalloproteinase domain 17, a disintegrin and metalloproteinase domain 17 (tumor necrosis factor, alpha, converting enzyme) |
| 4032 | 15735 | NM_053665 | n, ee | | A kinase (PRKA) anchor protein 1, tudor and KH domain-containing protein, tudor domain containing 1, tudor repeat associator with PCTAIRE 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4032 | 15738 | NM_053665 | cc | | A kinase (PRKA) anchor protein 1, tudor and KH domain-containing protein, tudor domain containing 1, tudor repeat associator with PCTAIRE 2 |
| 4356 | 347 | U01914 | s, t | | A kinase (PRKA) anchor protein 8, ESTs, Weakly similar to A53414 A-kinase anchor protein 95, AKAP95 - rat [*R. norvegicus*], *Mus musculus* 10 days embryo whole body cDNA RIKEN full-length enriched library, clone:2610301AI2:neighbor of A-kinase anchoring protein 95, full insert sequence, expressed sequence AI467606, neighbor of A-kinase anchoring protein 95, zinc finger protein 326 |
| 3434 | 17304 | NM_019144 | d, p, gg, hh | | acid phosphatase 5, tartrate resistant |
| 3410 | 17516 | NM_017321 | o,ii,jj,tt | | aconitase 1, aconitase 1, soluble |
| 3879 | 20724 | NM_031753 | w | | activated leucocyte cell adhesion molecule, activated leukocyte cell adhesion molecule |
| 1223 | 23648 | AA998547 | mm | | AD-012 protein, ESTs, Highly similar to Y144_HUMAN HYPOTHETICAL PROTEIN KIAA0144 [*H. sapiens*], KIAA0144 gene product, KIAA1491 protein |
| 775 | 4636 | AA899491 | m | | adaptor-related protein complex 1, mu 1 subunit |
| 4198 | 1271 | NM_133593 | e | | adaptor-related protein complex 3, mu 1 subunit, adaptor-related protein complex AP-3, mu 1 subunit |
| 3560 | 23980 | NM_022383 | w | | adenylyl cyclase-associated CAP protein homolog 1 (*S. cerevisiae, S. pombe*), adenylyl cyclase-associated protein |
| 4095 | 15325 | NM_053979 | j | | ADP-ribosylation factor 1, ADP-ribosylation factor-like 5, EST, Weakly similar to ADP-ribosylation factor-like 5 [*Rattus norvegicus*] [*R. norvegicus*], ESTs, Weakly similar to ADP-RIBOSYLATION FACTOR 1 [*M. musculus*], *Homo sapiens*, similar to ADP ribosylation factor-like 5, clone MGC:22841 IMAGE:3931095, mRNA, complete cds, expressed sequence T25534 |
| 3584 | 4145 | NM_022518 | j,ii | | ADP-ribosylation factor 1, ADP-ribosylation-like 6, ESTs, Weakly similar to ADP-RIBOSYLATION FACTOR 1 [*M. musculus*], expressed sequence T25534 |
| 3584 | 4153 | NM_022518 | bb | | ADP-ribosylation factor 1, ADP-ribosylation-like 6, ESTs, Weakly similar to ADP-RIBOSYLATION FACTOR 1 [*M. musculus*], expressed sequence T25534 |
| 3659 | 17517 | NM_024151 | q, u, dd | | ADP-ribosylation factor 4 |
| 3658 | 15367 | NM_024149 | r | | ADP ribosylation factor 5, ESTs, Moderately similar to ADP-RIBOSYLATION FACTOR 5 [*M. musculus*], ESTs, Weakly similar to A54022 ADP-ribosylation factor-like 1 - rat [*R. norvegicus*] |
| 1895 | 8919 | AI103388 | dd, kk | | ADP-ribosylation factor 6, ESTs, Moderately similar to S39543 GTP-binding protein - mouse [*M. musculus*], ESTs, Weakly similar to ARF6_HUMAN ADP-ribosylation factor 6 [*R. norvegicus*], GTP-binding protein Sara, RIKEN cDNA 2310075M17 gene, SAR1 protein, SAR1a gene homolog (*S. cerevisaie*), hypothetical protein FLJ22595 |
| 3660 | 21696 | NM_024152 | f, oo | | ADP-ribosylation factor 6, ESTs, Weakly similar to ARF6_HUMAN ADP-RIBOSYLATION FACTOR 6 [*M. musculus*], ESTs, Weakly similar to ARF6_HUMAN ADP-ribosylation factor 6 [*R. norvegicus*], RIKEN cDNA 1110033P22 gene, RIKEN cDNA 2310075M17 gene, RIKEN cDNA 9130014L17 gene, SAR1 protein, SAR1a gene homolog (*S. cerevisiae*), hypothetical protein FLJ22595 |
| 732 | 17858 | AA893741 | c, d, oo | | ADP-ribosylation factor GTPase activating protein 1, EST, Weakly similar to T46305 hypothetical protein DKFZp434D1411.1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | [*H. sapiens*], ESTs, Highly similar to T46305 hypothetical protein DKFZp434D1411.1 [*H. sapiens*], zinc finger protein 289, D1 regulated |
| 1167 | 11928 | M996829 | gg, hh | | ADP-ribosylation factor GTPase activating protein 1, EST, Weakly similar to T46305 hypothetical protein DKFZp434D141 1.1 [*H. sapiens*], ESTs, Highly similar to T46305 hypothetical protein DKFZp434D141 1.1 [*H. sapiens*], zinc finger protein 289,101 regulated |
| 501 | 15933 | AA875253 | q | | ADP-ribosylation factor-like 1, ESTs, Weakly similar to A54022 ADP-ribosylation factor-like 1 - rat [*R. norvegicus*], RIKEN cDNA 2310008022 gene |
| 3561 | 15932 | NM_022385 | q, x, dd | | ADP-ribosylation factor-like 1, ESTs, Weakly similar to A54022 ADP-ribosylation factor-like 1 - rat [*R. norvegicus*], RIKEN cDNA 2310008022 gene |
| 2099 | 16879 | AI169284 | ww | | ADP-ribosylation factor-like 6 interacting protein, ADP-ribosylation-like factor 6 interacting protein |
| 4096 | 1292 | NM_053980 | m | | ADP-ribosylation-like 3, ribosomal protein L35a |
| 3227 | 1859 | NM_013063 | p, y, nn | | ADP-ribosyltransferase (NAD+; poly (ADP-ribose) polymerase), ADP-ribosyltransferase (NAD+; poly (ADP-ribose) polymerase) 1, ADP-ribosyltransferase (NAD+; poly (ADP-ribose) polymerase) 2, ADP-ribosyltransferase (NAD+; poly (ADP-ribose) polymerase)-like 1, ADP-ribosyltransferase (NAD+; poly (ADP-ribose) polymerase)-like 3, *Mus musculus*, clone MGC:11997 IMAGE:3602116, mRNA, complete cds |
| 2194 | 22876 | AI172041 | r, w, z, ee | | adrenal gland protein AD-004 |
| 464 | 16074 | AA874874 | t | | alcohol dehydrogenase 5, alcohol dehydrogenase 5 (class III), chi polypeptide |
| 931 | 21993 | AA943149 | t, ff | | ALEX1 protein, ALEX3 protein, ESTs, Weakly similar to T00084 hypothetical protein KIAA0512 [*H. sapiens*], armadillo repeat protein ALEX2, hypothetical protein MGC3195 |
| 1225 | 26120 | AA998619 | s | | AlgS, *S. cerevisiae*, homolog of |
| 3645 | 8266 | NM_023103 | a, j, r, cc | | alpha-2-macroglobulin, murinoglobulin 1, murinoglobulin 2, murinoglobulin, pseudogene 1 |
| 3645 | 8267 | NM_023103 | r | | alpha-2-macroglobulin, murinoglobulin 1, murinoglobulin 2, murinoglobulin, pseudogene 1 |
| 3645 | 8268 | NM_023103 | r, mm, xx | | alpha-2-macroglobulin, murinoglobulin 1, murinoglobulin 2, murinoglobulin, pseudogene 1 |
| 3645 | 8269 | NM_023103 | r,jj,xx | | alpha-2-macroglobulin, murinoglobulin 1, murinoglobulin 2, murinoglobulin, pseudogene 1 |
| 579 | 17779 | AA891914 | w | | aminoacylase 1 |
| 4291 | 11493 | NM_144755 | f, q, z, dd, oo, qq | | AMP-activated protein kinase, ESTs, Weakly similar to MAP/microtubule affinity-regulating kinase 3; ELKL motif kinase 2 long form [*Mus musculus*] [*M. musculus*], ESTs, Weakly similar to PUTATIVE SERINE/THREONINE-PROTEIN KINASE EMK [*M. musculus*], G-protein-coupled receptor induced protein GIG2, *Mus musculus*, clone IMAGE:4947563, mRNA, partial cds, maternal embryonic leucine zipper kinase, protein kinase, AMP-activated alpha 2 catalytic subunit |
| 4291 | 11494 | NM_144755 | f, l, q, v, z, General, dd, oo | | AMP-activated protein kinase, ESTs, Weakly similar to MAP/microtubule affinity-regulating kinase 3; ELKL motif kinase 2 long form [*Mus musculus*] [*M. musculus*], ESTs, Weakly similar to PUTATIVE SERINE/THREONINE-PROTEIN KINASE |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | EMK [*M. musculus*], G-protein-coupled receptor induced protein GIG2, *Mus musculus*, clone IMAGE:4947563, mRNA, partial cds, maternal embryonic leucine zipper kinase, protein kinase, AMP activated alpha 2 catalytic subunit |
| 3010 | 4224 | M31322 | ff,mm | | amyloid beta (A4) precursor-like protein 2 |
| 3010 | 4225 | M31322 | nn,uu | | amyloid beta (A4) precursor-like protein 2 |
| 4463 | 4223 | X77934 | mm | | amyloid beta (A4) precursor-like protein 2 |
| 746 | 18419 | AA894130 | n, General, ww | | Amyloid protein precursor-like protein 2, ESTs, Weakly similar to EPPI_MOUSE Eppin precursor [*M. musculus*], amyloid beta (A4) precursor-like protein 1, amyloid beta (A4) precursor-like protein 2 |
| 1912 | 3940 | AI103718 | qq | | angio-associated, migratory cell protein |
| 3709 | 25476 | NM_031009 | xx | | angiotensin receptor 1 |
| 3247 | 16650 | NM_013132 | a | | annexin A5 |
| 3243 | 428 | NM_013112 | x | | apolipoprotein A-II |
| 237 | 6329 | AA819259 | i,p | | apolipoprotein C-II, apolipoprotein CII |
| 990 | 16635 | M945171 | k | | apolipoprotein C-IV, apolipoprotein CIV |
| 3496 | 15066 | NM_019373 | cc, rr | | apolipoprotein M |
| 2142 | 2750 | AI170666 | n, g, dd | | arginine-rich, mutated in early stage tumors |
| 3768 | 21624 | NM_031144 | mm | | ARP2 actin-related protein 2 homolog (yeast), ARP3 actin-related protein 3 homolog (yeast), EST, Weakly similar to ACTB_HUMAN Actin, cytoplasmic 1 (Beta-actin) [*R. norvegicus*], ESTs, Highly similar to ACTB_HUMAN ACTIN, CYTOPLASMIC 1 [*M. musculus*], ESTs, Highly similar to ACTB_HUMAN Actin, cytoplasmic 1 (Beta-actin) [*R. norvegicus*], ESTs, Weakly similar to A29861 actin gamma [*H. sapiens*], ESTs, Weakly similar to ACTB_HUMAN ACTIN, CYTOPLASMIC 1 [*M. musculus*], *Homo sapiens* cDNA FLJ31247 fis, clone K1DNE2005296, weakly similar to ACTIN, CYTOPLASMIC 1, *Homo sapiens* cDNA FLJ32120 fis, clone PEBLM1000068, highly similar to ACTIN, CYTOPLASMIC TYPE 5, *Homo sapiens* mRNA; cDNA DKFZp434B2115 (from clone DKFZp434B2115), RIKEN cDNA 1700052K15 gene, actin, beta, actin, beta, cytoplasmic, calcitonin gene-related peptide-receptor component protein, expressed sequence AV259599 |
| 3768 | 21625 | NM_031144 | z | | ARP2 actin-related protein 2 homolog (yeast), ARP3 actin-related protein 3 homolog (yeast), EST, Weakly similar to ACTB_HUMAN Actin, cytoplasmic 1 (Beta-actin) [*R. norvegicus*], ESTs, Highly similar to ACTB_HUMAN ACTIN, CYTOPLASMIC 1 [*M. musculus*], ESTs, Highly similar to ACTB_HUMAN Actin, cytoplasmic I (Beta-actin) [*R. norvegicus*], ESTs, Weakly similar to A29861 actin gamma [*H. sapiens*], ESTs, Weakly similar to ACTB_HUMAN ACTIN, CYTOPLASMIC 1 [*M. musculus*], *Homo sapiens* cDNA FLJ31247 fis, clone KIDNE2005296, weakly similar to ACTIN, CYTOPLASMIC 1, *Homo sapiens* cDNA FLJ32120 fis, clone PEBLM1000068, highly similar to ACTIN, CYTOPLASMIC TYPE 5, *Homo sapiens* mRNA; cDNA DKFZp434B2115 (from clone DKFZp434B2115), RIKEN cDNA 1700052K15 gene, actin, beta, actin, beta, cytoplasmic, calcitonin gene-related peptide-receptor component protein, expressed sequence AV259599 |
| 1935 | 18831 | AI104357 | e | | ARP2 actin-related protein 2 homolog (yeast), ARP3 actin-related protein 3 homolog (yeast), EST, Weakly similar to ACTB_HUMAN Actin, cytoplasmic 1 (Beta- |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | actin) [*R. norvegicus*], ESTs, Highly similar to ACTB_HUMAN ACTIN, CYTOPLASMIC 1 [*M. musculus*], ESTs, Weakly similar to A29861 actin gamma [*H. sapiens*], ESTs, Weakly similar to ACTB_HUMAN ACTIN, CYTOPLASMIC 1 [*M. musculus*], *Homo sapiens* cDNA FLJ31247 fis, clone K1DNE2005296, weakly similar to ACTIN, CYTOPLASMIC 1, *Homo sapiens* cDNA FLJ32120 fis, clone PEBLM1000068, highly similar to ACTIN, CYTOPLASMIC TYPE 5, *Homo sapiens* mRNA; cDNA DKFZp434B2115 (from clone DKFZp434B2115), RIKEN cDNA 1700052K15 gene, actin, beta, actin, beta, cytoplasmic, calcitonin gene-related peptide-receptor component protein, expressed sequence AV259599 |
| 3138 | 721 | NM_012780 | tt | | Aryl hydrocarbon receptor nuclear translocator 2, aryl hydrocarbon receptor nuclear translocator, aryl hydrocarbon receptor nuclear translocator 2, aryl hydrocarbon receptor nuclear translocator-like |
| 1631 | 5866 | AI045751 | y | | asparaginyl-tRNA synthetase, hypothetical protein FLJ23441 |
| 708 | 17900 | AA893353 | gg, hh, rr | | aspartyl aminopeptidase |
| 1795 | 12863 | AI072467 | nn | | AT motif binding factor 1, ESTs, Weakly similar to AT motif-binding factor [*M. musculus*], KIAA1762 protein, RIKEN cDNA 363241 3B07 gene |
| 2381 | 15091 | AI178740 | f | | AT2 receptor-interacting protein 1, *Homo sapiens* cDNA FLJ321 57 fis, clone PLACE6000205, moderately similar to TRANSCRIPTIONAL REPRESSOR PROTEIN YY1, YY1 transcription factor |
| 265 | 19566 | AA819879 | c | | ATP binding protein associated with cell differentiation, phosducin-like 2 |
| 1956 | 15065 | AI105050 | p, ii, ll | | ATP synthase, H+ transporting mitochondrial F1 complex, beta subunit, ATP synthase, H+ transporting, mitochondrial F1 complex, beta polypeptide, ATPase, H+ transporting, lysosomal 70 kD, V1 subunit A, isoform 1, ATPase, H+ transporting, lysosomal 70 kD, V1 subunit A, isoform 2, DNA segment, Chr 17, Wayne State University 164, expressed, EST, Weakly similar to ATPB_RAT ATP synthase beta chain, mitochondrial precursor [*R. norvegicus*] |
| 4043 | 10909 | NM_053756 | o | | ATP synthase, H+ transporting, mitochondrial F0 complex, subunit c (subunit 9) isoform 3, EST, Moderately similar to ATP synthase, H+ transporting, mitochondrial F0 complex, subunit c (subunit 9) isoform 3 [*Rattus norvegicus*] [*R. norvegicus*], ESTs, Moderately similar to AT93 MOUSE ATP SYNTHASE LIPID-BINDING PROTEIN P3 PRECURSOR [*M. musculus*] |
| 3501 | 22726 | NM_019383 | r | | ATP synthase, H+ transporting, mitochondrial F0 complex, subunit d, EST, Weakly similar to ATPQ_HUMAN ATP SYNTHASE D CHAIN, MITOCHONDRIAL [*H. sapiens*], EST, Weakly similar to ATPQ_RAT ATP synthase D chain, mitochondrial [*R. norvegicus*] |
| 4154 | 18810 | NM_130430 | w, ss | | ATP synthase, H+ transporting, mitochondrial F1 complex, alpha subunit, isoform 1, ATP synthase, H+ transporting, mitochondrial F1 complex, alpha subunit, isoform 1, cardiac muscle, EST, Moderately |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4276 | 18450 | NM_139106 | r, ss | | similar to A35730 H+-transporting ATP synthase (EC 3.6.1.34) alpha chain precursor - rat (fragment) [*R. norvegicus*] ATP synthase, H+ transporting, mitochondrial F1 complex, delta subunit, EST, Moderately similar to ATPD_HUMAN ATP SYNTHASE DELTA CHAIN, MITOCHONDRIAL PRECURSO [*H. sapiens*], RIKEN cDNA 0610008F14 gene, RIKEN cDNA 1500000111 gene, expressed sequence AI467246 |
| 4252 | 7395 | NM_138883 | p, ff | | ATP synthase, H+ transporting, mitochondrial F1 complex, 0 subunit, ATP synthase, H+ transporting, mitochondrial F1 complex, O subunit (oligomycin sensitivity conferring protein), EST, Weakly similar to ATPO_HUMAN ATP SYNTHASE OLIGOMYCIN SENSITIVITY CONFERRAL PROTEIN PRECURSOR, MITOCHONDRIAL [*H. sapiens*], ESTs, Highly similar to ATPO_HUMAN ATP SYNTHASE OLIGOMYCIN SENSITIVITY CONFERRAL PROTEIN PRECURSOR, MITOCHONDRIAL [*H. sapiens*], ESTs, Moderately similar to ATPO_HUMAN ATP SYNTHASE OLIGOMYCIN SENSITIVITY CONFERRAL PROTEIN PRECURSOR, MITOCHONDRIAL [*H. sapiens*] |
| 2336 | 8949 | AI177593 | l, General | | ATPase, H+ transporting, lysosomal (vacuolar proton pump) 16 kDa, ATPase, H+ transporting, lysosomal 16 kD, V0 subunit C, ATPase, H+ transporting, lysosomal 16 kD, V0 subunit c, ATPase, H+ transporting, lysosomal 21 kD, V0 subunit c*, ATPase, H+ transporting, lysosomal 21 kDa, V0 subunit B, *Mus musculus*, Similar to ATPase, H+ transporting, lysosomal (vacuolar proton pump) 21 kD, clone MGC:6568 IMAGE:2812497, mRNA, complete cds |
| 4074 | 20939 | NM_053884 | l, m, s, General, bb, qq, uu | | ATPase, H+ transporting, lysosomal 14 kD, V1 subunit F |
| 4160 | 7864 | NM_130823 | c, gg, hh, oo, qq | | ATPase, H+ transporting, lysosomal 16 kD, V0 subunit C, ATPase, H+ transporting, lysosomal 16 kD, V0 subunit c, ATPase, H+ transporting, lysosomal 21 kD, V0 subunit c, ATPase, H+ transporting, lysosomal 21 kDa, V0 subunit B, ESTs, Weakly similar to VATL_MOUSE Vacuolar ATP synthase 16 kDa proteolipid subunit [*R. norvegicus*], *Mus musculus*, Similar to ATPase, H+ transporting, lysosomal (vacuolar proton pump) 21 kD, clone MGC:6568 IMAGE:2812497 mRNA complete cds |
| 705 | 17754 | AA893246 | a, w | | ATPase, H+ transporting, lysosomal 34 kD, V1 subunit D |
| 4129 | 3831 | NM_057213 | e, General, cc, qq | | ATPase, H+ transporting, lysosomal 56/58 kD, V1 subunit B, isoform 1 (Renal tubular acidosis with deafness), ATPase, H+ transporting, lysosomal 56/58 kD, V1 subunit B, isoform 2, ATPase, H+ transporting, lysosomal 56/58 kDa, V1 subunit B, isoform 1, EST, Moderately similar to VAB2_MOUSE Vacuolar ATP synthase subunit B, brain isoform (V-ATPase B2 subunit) (Vacuolar proton pump B isoform 2) (Endomembrane proton pump 58 kDa subunit) [*R. norvegicus*], ESTs, Highly similar to VAB2_MOUSE VACUOLAR ATP SYNTHASE SUBUNIT B, BRAIN ISOFORM (V-ATPASE B2 SUBUNIT) (VACUOLAR PROTON PUMP B ISOFORM 2) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | (ENDOMEMBRANE PROTON PUMP 58 KDA SUBUNIT) [*M. musculus*] |
| 4003 | 22617 | NM_053578 | d | | ATPase, H+ transporting, lysosomal 9 kD V0 subunit E, ATPase, H+ transporting, lysosomal 9 kD V0 subunit e, *Homo sapiens* cDNA FLJ12004 fis, clone HEMBB1001564, moderately similar to VACUOLAR ATP SYNTHASE SUBUNIT H (EC 3.6.1.34), *Homo sapiens,* clone MGC:17890 IMAGE:3908757, mRNA, complete cds, RIKEN cDNA 0610006014 gene |
| 2096 | 22661 | AI169265 | t, mm | | ATPase, H+ transporting, lysosomal interacting protein 1, EST, Weakly similar to 154197 hypothetical protein [*H. sapiens*], ESTs, Weakly similar to VAS1_RAT Vacuolar ATP synthase subunit S1 precursor (V-ATPase Si subunit) (V-ATPase S1 accessory protein) (V-ATPase Ac45 subunit) (C7-1 protein) [*R. norvegicus*], *Homo sapiens* cDNA FLJ12563 fis, clone NT2RM4000820, weakly similar to VACUOLAR ATP SYNTHASE SUBUNIT A045 PRECURSOR (EC 3.6.1.34) expressed sequence AW108110 |
| 3892 | 16178 | NM_031785 | ii | | ATPase, H+ transporting, lysosomal interacting protein 1, EST, Weakly similar to 154197 hypothetical protein [*H. sapiens*], ESTs, Weakly similar to VAS1_RAT Vacuolar ATP synthase subunit S1 precursor (V-ATPase S1 subunit) (V-ATPase S1 accessory protein) (V-ATPase Ac45 subunit) (C7-1 protein) [*R. norvegicus*], *Homo sapiens* cDNA FLJ12563 fis, clone NT2RM4000820, weakly similar to VACUOLAR ATP SYNTHASE SUBUNIT AC45 PRECURSOR (EC 3.6.1.34), expressed sequence AW108110 |
| 3830 | 20840 | NM_031604 | d | | ATPase, H+ transporting, lysosomal V0 subunit A isoform 4, ATPase, H+ transporting, lysosomal V0 subunit a isoform 1, ATPase, H+ transporting, lysosomal V0 subunit a isoform 2, ATPase, H+ transporting, lysosomal V0 subunit a isoform 4, EST, Weakly similar to B38656 vacuolar proton pump 116K chain-rat [*R. norvegicus*], ESTs, Moderately similar to B38656 vacuolar proton pump 116K chain - rat [*R. norvegicus*] |
| 3830 | 20841 | NM_031604 | bb | | ATPase, H+ transporting, lysosomal V0 subunit A isoform 4, ATPase, H+ transporting, lysosomal V0 subunit a isoform 1 ATPase, H+ transporting, lysosomal V0 subunit a isoform 2, ATPase, H+ transporting, lysosomal V0 subunit a isoform 4, EST, Weakly similar to B38656 vacuolar proton pump 116K chain - rat [*R. norvegicus*], ESTs, Moderately similar to B38656 vacuolar proton pump 116K chain - rat [*R. norvegicus*] |
| 3244 | 23709 | NM_013113 | l, w, z | | ATPase, Na+/K+ transporting, beta 1 polypeptide |
| 3244 | 23710 | NM_013113 | ww | | ATPase, Na+/K+ transporting, beta 1 polypeptide |
| 3884 | 4314 | NM_031760 | b, m, dd, uu, vv | | ATP-binding cassette, sub-family B (MDR/TAP), member 11, ATP-binding cassette, sub-family F (GCN20), member 2 |
| 1464 | 4251 | AI013494 | e | | ATP-binding cassette, sub-family F (GCN20), member 2, EST, Highly similar to DVHUCF cystic fibrosis transmembrane conductance regulator [*H. sapiens*], ESTs, Highly similar to MRP4_HUMAN MULTIDRUG RESISTANCE-ASSOCIATED PROTEIN 4 [*H. sapiens*], ESTs, Weakly similar to A40303 cystic fibrosis |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | transmembrane conductance regulator - mouse [*M. musculus*], ESTs, Weakly similar to NFM MOUSE NEUROFILAMENT TRIPLET M PROTEIN [*M. musculus*], *Mus musculus*, Similar to sodium/calcium/potassium exchanger, clone MGC:27617 IMAGE:4504496, mRNA, complete cds, RIKEN cDNA 4930488P18 gene, cystic fibrosis transmembrane conductance regulator homolog, cystic fibrosis transmembrane conductance regulator, ATP-binding cassette (sub-family C, member 7), neurofilament, medium polypeptide |
| 3966 | 2548 | NM_053359 | rr | | ATX1 (antioxidant protein 1) homolog 1 (yeast), ATX1 antioxidant protein 1 homolog (yeast) |
| 2211 | 4193 | AI172274 | dd | | AU RNA binding protein/enoyl-Coenzyme A hydratase, ESTs, Weakly similar to I37195 AU-specific RNA-binding protein/enoyl-CoA hydratase homolog [*H. sapiens*], enoyl coenzyme A hydratase 1, peroxisomal, uncharacterized hypothalamus protein HCDASE |
| 1173 | 2958 | AA996944 | ee | | B-box and SPRY domain containing, ring finger protein (C3HC4 type) 8, ring finger protein 23 |
| 4290 | 15703 | NM_144750 | f, n, gg, hh, pp | | B-cell CLL/lymphoma 3, B-cell leukemia/lymphoma 3, DNA segment, EST 1068184, ESTs, Weakly similar to T42713 ankyrin 3, splice form 1 - mouse [*M. musculus*], *Homo sapiens* cDNA FLJ11375 fis, clone HEMBA1000411, weakly similar to ANKYRIN, *Homo sapiens* clone 24649 mRNA sequence, *Homo sapiens,* similar to RIKEN cDNA 1700007B22, clone MGC:26734 IMAGE:4826296, mRNA, complete cds, KIAA1223 protein, hypothetical protein DKFZp5640043, nuclear factor kappa B p105 subunit, nuclear factor of kappa light chain gene enhancer in B-cells 1, p105, nuclear factor of kappa light polypeptide gene enhancer in B cells 2, p49/p100 |
| 2976 | 13499 | L26267 | s | | B-cell CLL/lymphoma 3, B-cell leukemia/lymphoma 3, ESTs, Weakly similar to NUCLEAR FACTOR NF-KAPPA-B P105 SUBUNIT [*M. musculus*], ESTs, Weakly similar to T42713 ankyrin 3, splice form 1 - mouse [*M. musculus*], *Mus musculus*, clone MGC:7734 IMAGE:3498403, mRNA, complete cds, nuclear factor of kappa light chain gene enhancer in B-cells 1, p105, nuclear factor of kappa light polypeptide gene enhancer in B-cells 2, p49/p100 |
| 2131 | 14938 | AI170362 | qq | | B-cell CLL/lymphoma 3, B-cell leukemia/lymphoma 3, ESTs, Weakly similar to NUCLEAR FACTOR NE-KAPPA-B P105 SUBUNIT [*M. musculus*], *Mus musculus*, clone MGC:7734 IMAGE:3498403, mRNA, complete cds, nuclear factor kappa B p105 subunit, nuclear factor of kappa light chain gene enhancer in B-cells 1, p105, nuclear factor of kappa light polypeptide gene enhancer in B-cells 2, p49/p100 |
| 523 | 18152 | AA875661 | x | | B-cell CLL/lymphoma 7B, B-cell CLL/lymphoma 7C |
| 3511 | 18702 | NM_020080 | oo | | B-cell linker, DKFZP564J0123 protein, RIKEN cDNA4733401H18 gene, hypothetical gene supported by BC007071 |
| 3671 | 771 | NM_024368 | a, qq | | B-cell src-homology tyrosine kinase, chromosome 20 open reading frame 148, fyn-related kinase, protein tyrosine kinase 6, tyrosine kinase, non-receptor, 2, v-abl |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | Abelson murine leukemia viral oncogene homolog 1, v-abl Abelson murine leukemia viral oncogene homolog 2 (arg, Abelson-related gene) |
| 1350 | 22545 | AI009747 | z | | B-cell translocation gene 1, anti-proliferative, ESTs, Highly similar to TOB1_HUMAN TOB1 PROTEIN [*H. sapiens*], transducer of ERBB2, 1, transducer of ERBB2, 2, transducer of ErbB-2.1 |
| 3479 | 23678 | NM_019290 | l, u, General | | B-cell translocation gene 3, BTG family, member 3 |
| 3479 | 23679 | NM_019290 | General, ss | | B-cell translocation gene 3, BTG family, member 3 |
| 2443 | 9821 | AI180114 | ss | | BCL2/adenovirus E1B 19 kDa-interacting protein 1, NIP2, ESTs, Weakly similar to NIP2 MOUSE BCL2/ADENOVIRU5 E1B 19-KDA PROTEIN-INTERACTING PROTEIN 2 [*M. musculus*], KIAA0367 protein, KIAA1872 protein, *Mus musculus*, Similar to Rho GTPase activating protein 1, clone MGC:7050 IMAGE:3156467, mRNA, complete cds, RIKEN cDNA 3110043J09 gene, hypothetical protein MGC8103 |
| 4140 | 23033 | NM_080888 | tt | | BCL2/adenovirus E1B 19 kDa-interacting protein 3-like, BCL2/adenovirus E1B 19 kD interacting protein 3-like |
| 3618 | 17757 | NM_022698 | y | | BCL2-antagonist of cell death, Bcl-associated death promoter |
| 396 | 15172 | AA859362 | p | | BCL2-associated athanogene 3, BCL2-associated athanogene 5, 8c12-associated athanogene 3, RIKEN cDNA 1700081D05 gene |
| 3538 | 20129 | NM_021850 | gg, hh | | BCL2-like 2, Bcl2-like 2 |
| 919 | 22677 | AA942718 | t, ff, pp | | BCL2-related ovarian killer, Bcl2-like |
| 3805 | 444 | NM_031535 | t, mm | | BCL2-related ovarian killer, Bcl2-like |
| 3805 | 445 | NM_031535 | t,mm | | BCL2-related ovarian killer, Bc12-like, ilvB (bacterial acetolactate synthase)-like |
| 3805 | 446 | NM_031535 | t, w, ii, ll, mm | | BCL2-related ovarian killer, Bcl2-like, ilvB (bacterial acetolactate synthase)-like |
| 335 | 17823 | AA851214 | y | | beta-site APP-cleaving enzyme, hypothetical protein MGC7474 |
| 4117 | 1888 | NM_057130 | n,bb | | BH3 interacting (with BCL2 family) domain, apoptosis agonist, ESTs, Weakly similar to HRK MOUSE ACTIVATOR OF APOPTOSIS HARAKIRI [*M. musculus*], harakiri, BCL2 interacting protein (contains only BH3 domain) |
| 2355 | 4979 | AI178133 | ss | | Bmp2-induced gene, ESTs, Highly similar to CIA1_HUMAN WD40-REPEAT CONTAINING PROTEIN CIAO 1 [*H. sapiens*], ESTs, Weakly similar to LIS1_MOUSE Platelet-activating factor acetylhydrolase IB alpha subunit (PAF acetylhydrolase 45 kDa subunit) (PAF-AH 45 kDa subunit) (PAF-AH alpha) (PAFAH alpha) (Lissencephaly-1 protein) (LIS-1) [*R. norvegicus*], F-box and WD-40 domain protein 7 (archipelago homolog, Drosophila), *Homo sapiens* 38 kDa splicing factor mRNA, complete cds, *Homo sapiens* cDNA FLJ31861 fis, clone NT2RP7001319, RIKEN cDNA 2310009C03 gene, platelet-activating factor acetylhydrolase beta subunit (PAF-AH beta), platelet-activating factor acetylhydrolase, isoform 1b, beta1 subunit, platelet-activating factor acetylhydrolase, isoform Ib, alpha subunit (AFD) |
| 4286 | 8717 | NM_139333 | gg, hh | | Bmp2-induced gene, ESTs, Weakly similar to T2D4_HUMAN TRANSCRIPTION INITIATION FACTOR TFIID 100 KDA SUBUNIT [*H. sapiens*], *Mus musculus* F-box WD40 repeat protein 6 (Fbxw6) mRNA, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | complete cds, *Mus musculus*, clone MGC:7934 IMAGE:3583848, mRNA, complete cds, RIKEN cDNA 1500009K01 gene, RIKEN cDNA 2310009C03 gene, RIKEN cDNA 4933429D11 gene, TAF5-like RNA polymerase II, p300/CBP-associated factor (PCAF)-associated factor, 65 kD, WO repeat domain 18, guanine nucleotide binding protein (G protein), beta polypeptide 1, guanine nucleotide binding protein beta subunit 4, guanine nucleotide binding protein, beta 1, guanine nucleotide binding protein, beta 4, hypothetical protein FLJ00012, nuclear matrix protein NMP200 |
| 3695 | 1035 | NM_030851 | y | | bradykinin receptor B1, bradykinin receptor, beta |
| 1089 | 23852 | M956746 | p | | BRAF35/HDAC2 complex (80 kDa), KIAA1416 protein, hypothetical protein FLJ12178, hypothetical protein KIAA1335 |
| 2554 | 22387 | AI230753 | a, tt | | brain protein 13 |
| 668 | 11997 | M892828 | ll | | branched chain ketoacid dehydrogenase E1, beta polypeptide, pyruvate dehydroqenase (lipoamide) beta |
| 1098 | 12000 | AA957319 | bb | | branched chain ketoacid dehydrogenase E1, beta polypeptide, pyruvate dehydroqenase (lipoamide) beta |
| 2259 | 5876 | AI176117 | oo | | branched chain ketoacid dehydrogenase E1, beta polypeptide, pyruvate dehydroqenase (lipoamide) beta |
| 3698 | 21800 | NM_030987 | r, w, z | | BUB3 budding uninhibited by benzimidazoles 3 homolog (yeast), ESTs, Weakly similar to guanine nucleotide-binding protein, beta-1# subunit [*Rattus norvegicus*] [*R. norvegicus*], *Mus musculus*, clone MGC:7934 IMAGE:3583848, mRNA, complete cds, budding uninhibited by benzimidazoles 3 homolog (*S. cerevisiae*), guanine nucleotide binding protein, beta 1, neural precursor cell expressed, developmentally down-regulated gene 1 |
| 3698 | 21801 | NM_030987 | gg, hh | | BUB3 budding uninhibited by benzimidazoles 3 homolog (yeast), ESTs, Weakly similar to guanine nucleotide-binding protein, beta-1# subunit [*Rattus norvegicus*] [*R. norvegicus*], *Mus musculus*, clone MGC:7934 IMAGE:3583848, mRNA, complete cds, budding uninhibited by benzimidazoles 3 homolog (*S. cerevisiae*), guanine nucleotide binding protein, beta 1, neural precursor cell expressed, developmentally down-regulated gene 1 |
| 3698 | 21806 | NM_030987 | s, u | | BUB3 budding uninhibited by benzimidazoles 3 homolog (yeast), ESTs, Weakly similar to guanine nucleotide-binding protein, beta-1#subunit [*Rattus norvegicus*] [*R. norvegicus*], *Mus musculus*, clone MGC:7934 IMAGE:3583848, mRNA, complete cds, budding uninhibited by benzimidazoles 3 homolog (*S. cerevisiae*), guanine nucleotide binding protein, beta 1, neural precursor cell expressed, developmentally down-regulated gene 1 |
| 725 | 17836 | AA893626 | uu | | BUB3 budding uninhibited by benzimidazoles 3 homolog (yeast), Guanine nucleotide-binding protein beta 1, RIKEN cDNA 2700038L12 gene, budding uninhibited by benzimidazoles 3 homolog (*S. cerevisiae*), neural precursor cell expressed, developmentally down-regulated gene 1 |
| 80 | 21042 | AA799814 | p | | Ca++/calmodulin-dependent protein kinase II, delta subunit, ER to nucleus signalling 1, MAP kinase-activated protein kinase 2, *Mus musculus*, clone MGC:18731 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2793 | 21043 | AI237813 | mm | | IMAGE:3980838, mRNA, complete cds, calcium/calmodulin-dependent protein kinase II, delta, expressed sequence AI874665 Ca++/calmodulin-dependent protein kinase II, delta subunit, ER to nucleus signalling 1, MAP kinase-activated protein kinase 2, *Mus musculus*, clone MGC:18731 IMAGE:3980838, mRNA, complete cds, calcium/calmodulin-dependent protein kinase II, delta, expressed sequence AI874665 |
| 3785 | 6671 | NM_031333 | t, General, mm | | cadherin 13, cadherin 2, cadherin 2, type 1, N-cadherin (neuronal), desmocollin 1, desmoglein 2 |
| 3785 | 6672 | NM_031333 | g | | cadherin 13, cadherin 2, cadherin 2, type 1, N-cadherin (neuronal), desmocollin 1, desmoglein 2 |
| 3785 | 6673 | NM_031333 | j | | cadherin 13, cadherin 2, cadherin 2, type 1, N-cadherin (neuronal), desmocollin 1, desmoglein 2 |
| 810 | 12335 | AA901065 | k, cc | | calcium binding atopy-related autoantigen 1 |
| 4151 | 3458 | NM_130412 | ii | | calcium binding protein Cab45 precursor, stromal cell derived factor 4 |
| 3961 | 23211 | NM_053334 | f, nn | | calcium modulating ligand |
| 1221 | 6965 | AA998523 | h | | calmegin, calnexin |
| 2167 | 20905 | AI171273 | t, mm | | capping protein (actin filament) muscle Z-line, beta, capping protein beta 1 |
| 2878 | 14882 | D00362 | w, ll, rr | | carboxylesterase 3 (brain), esterase 1 |
| 2997 | 14881 | M20629 | j, dd, ll | | carboxylesterase 3 (brain), esterase 1 |
| 2555 | 24270 | AI230758 | rr | | cargo selection protein (mannose 6 phohosphate receptor binding protein) |
| 3717 | 1480 | NM_031021 | g | | casein kinase 2, beta polypeptide, casein kinase II, beta subunit |
| 1958 | 6225 | AI105105 | ss | | CasL interacting molecule, DNA segment, EST 573322, KIAA0750 gene product, KIAA0819 protein, KIAA1364 protein, hypothetical protein FLJ14966, tangerin |
| 3587 | 4256 | NM_022522 | oo, uu | | caspase 14, caspase 14, apoptosis-related cysteine protease, caspase 2, caspase 2, apoptosis-related cysteine protease (neural precursor cell expressed, developmentally down-regulated 2) |
| 3587 | 4257 | NM_022522 | k, mm | | caspase 14, caspase 14, apoptosis-related cysteine protease, caspase 2, caspase 2, apoptosis-related cysteine protease (neural precursor cell expressed, developmentally down-regulated 2) |
| 4232 | 24672 | NM_138517 | jj | | cathepsin G, granzyme B, granzyme B (granzyme 2, cytotoxic T-lymphocyte-associated serine esterase 1), granzyme C, similar to granzyme B (granzyme 2, cytotoxic T-lymphocyte-associated serine esterase 1) (*H. sapiens*) |
| 3409 | 1894 | NM_017320 | ii, nn, pp | | cathepsin S |
| 4036 | 16122 | NM_053698 | mm | | Cbp/p300-interacting transactivator with Glu/Asp-rich carboxy-terminal domain 1, Cbp/p300-interacting transactivator, with Glu/Asp-rich carboxy-terminal domain, 1 Cbp/p300-interacting transactivator, with Glu/Asp-rich carboxy-terminal domain, 2, Cbp/p300-interacting transactivator, with Glu/Asp-rich carboxy-terminal domain, 4 |
| 4036 | 16123 | NM_053698 | ee | | Cbp/p300-interacting transactivator with Glu/Asp-rich carboxy-terminal domain 1, Cbp/p300-interacting transactivator, with Glu/Asp-rich carboxy-terminal domain, 1, Cbp/p300-interacting transactivator, with Glu/Asp-rich carboxy-terminal domain, 2, Cbp/p300-interacting transactivator, with Glu/Asn-rich carboxy-terminal domain 4 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2972 | 24518 | L1 9927 | t, y, mm | | CCR4-NOT transcription complex, subunit 7, EST, Highly similar to G Chain G, Rat Liver F1-Atpase [*R. norvegicus*], expressed sequence C80464 |
| 3236 | 8898 | NM_013087 | q, tt | | CD 81 antigen, CD81 antigen (target of antiproliferative antibody 1), ESTs, Weakly similar to CD81 ANTIGEN [*M. musculus*], ESTs, Weakly similar to CD81_RAT CD81 antigen (26 kDa cell surface protein TAPA-1) (Target of the antiproliferative antibody 1) [*R. norvegicus*] |
| 3528 | 19710 | NM_021744 | bb | | CD14 antigen |
| 3588 | 4412 | NM_022523 | j,x | | CD151 antigen, EST AI426782, ESTs, Moderately similar to C151 MOUSE PLATELET-ENDOTHELIAL TETRASPAN ANTIGEN 3 [*M. musculus*], RIKEN cDNA 1110014F12 gene, RIKEN cDNA 2210021G21 gene, RIKEN cDNA 2610042G18 gene, RIKEN cDNA 2700063A19 gene, transmembrane 4 superfamily member 6 |
| 3315 | 1523 | NM_017079 | General | | CD1B antigen, b polypeptide, CD10 antigen, d polypeptide, CD1E antigen, e polypeptide, CD1d1 antigen, CD1d2 antigen, expressed sequence AI747460 |
| 4104 | 21066 | NM_054001 | c, v, ii, rr | | CD36 antigen (collagen type I receptor, thrombospondin receptor)-like 2, CD36 antigen (collagen type I receptor, thrombospondin receptor)-like 2 (lysosomal integral membrane protein II), EST, Moderately similar to LYII_HUMAN LYSOSOME MEMBRANE PROTEIN II [*H. sapiens*] |
| 498 | 15371 | AA875205 | xx | | CDA02 protein, ESTs, Weakly similar to 1F39_HUMAN EUKARYOTIC TRANSLATION INITIATION FACTOR 3 SUBUNIT 9 [*H. sapiens*] |
| 498 | 15372 | AA875205 | y, General, gg, hh, ll | | CDA02 protein, ESTs, Weakly similar to IF39_HUMAN EUKARYOTIC TRANSLATION INITIATION FACTOR 3 SUBUNIT 9 [*H. sapiens*] |
| 786 | 15373 | AA900018 | x | | CDA02 protein, ESTs, Weakly similar to IF39_HUMAN EUKARYOTIC TRANSLATION INITIATION FACTOR 3 SUBUNIT 9 [*H. sapiens*] |
| 44 | 20973 | AA799581 | v, General | | CDA11 protein, *Homo sapiens* cDNA FLJ12997 fis, clone NT2RP3000247, *Homo sapiens,* clone IMAGE:3689276, mRNA, KIAA0218 gene product |
| 921 | 22102 | AA942845 | m | | CDA11 protein, *Homo sapiens* cDNA FLJ12997 fis, clone NT2RP3000247, *Homo sapiens,* clone IMAGE:3689276, mRNA, KIAA0218 gene product |
| 297 | 6635 | AA849786 | bb, ll | | CDC-like kinase 2, CDC-like kinase 3, EST, Highly similar to CLK3_RAT Protein kinase CLK3 (CDC-like kinase 3) [*R. norvegicus*], ESTs, Weakly similar to CLK3_RAT Protein kinase CLK3 (CDC-like kinase 3) [*R. norvegicus*] |
| 2335 | 17773 | AI177513 | y | | CDC-like kinase 3, EST, Highly similar to CLK3_RAT Protein kinase CLK3 (CDC-like kinase 3) [*R. norvegicus*], ESTs, Weakly similar to CLK3_RAT Protein kinase CLK3 (CDC-like kinase 3) [*R. norvegicus*], *Homo sapiens* cDNA: FLJ21653 fis, clone COL08586, highly similar to HUMKINCDC Human protein kinase mRNA |
| 4468 | 463 | X83579 | f, q, u, ww | | CDK-related protein kinase PNQLARE, cyclin-dependent kinase 7 (MO15 homolog, *Xenopus laevis*, cdk-activating kinase), cyclin-dependent kinase 7 (homolog of *Xenopus* MO15 cdk-activating kinase) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1571 | 15240 | AI044241 | General | | cell death-inducing DFFA-like effector b, expressed sequence AI790179 |
| 1644 | 15241 | AI058382 | General | | cell death-inducing DFFA-like effector b, expressed sequence AI790179 |
| 493 | 7875 | AA875127 | x | | cell division cycle 2-like 5 (cholinesterase-related cell division controller) |
| 1585 | 5556 | AI044638 | ii | | cell division cycle associated 4, transcriptional regulator interacting with the PHS-bromodomain 2 |
| 4266 | 16176 | NM_139087 | u | | cell growth regulatory with EF-hand domain |
| 4191 | 745 | NM_133567 | cc | | Centaurin-alpha2 protein, EST, Weakly similar to T42627 ADP-ribosylation factor-directed GTPase activating protein, isoform a - mouse [*M. musculus*], ESTs, Weakly similar to Centaurin-alpha2 protein [*Rattus norvegicus*] [*R. norvegicus*], ESTs, Weakly similar to T42627 ADP-ribosylation factor-directed GTPase activating protein, isoform a - mouse [*M. musculus*], RIKEN cDNA 1700030C10 gene, centaurin, beta 2, centaurin, beta 5, development and differentiation enhancing, hypothetical protein AL133206 |
| 673 | 22872 | AA892859 | g, rr | | cerebral cell adhesion molecule |
| 1080 | 24046 | AA956185 | e | | CGI-10 protein |
| 2136 | 24048 | AI170570 | qq | | CGI-10 protein |
| 2146 | 1923 | AI170754 | r, z, ee | | CGI-127 protein |
| 2391 | 1924 | AI178902 | r, z | | CGI-127 protein |
| 1231 | 3660 | AA998833 | j | | CGI-141 protein, ESTs, Weakly similar to T46908 hypothetical protein DKFZ-761G2423.1 [*H. sapiens*] |
| 2620 | 3662 | AI232506 | o | | CGI-141 protein, ESTs, Weakly similar to T46908 hypothetical protein DKFZ-761G2423.1 [*H. sapiens*] |
| 1207 | 3367 | AA998110 | xx | | CGI-143 protein |
| 2900 | 2744 | D87991 | b, e, q, dd | | CGI-19 protein, ESTs, Weakly similar to JC5026 UDP-galactose transporter related protein 1 - rat [*R. norvegicus*], *Mus musculus*, clone MGC:31031 IMAGE:5137689, mRNA, complete cds, UDP-galactose translocator 2, UDP-galactose transporter related, YEA4 protein, expressed sequence AI428480, hypothetical protein MNCh-4414 |
| 2787 | 14837 | AI237638 | k, mm | | CGI-63 protein, KIAA1576 protein, *Mus musculus*, Similar to vesicle amine transport protein 1, clone MGC:38107 IMAGE:5320239 mRNA, complete cds |
| 4269 | 734 | NM_139094 | d | | CGI-74-like SR-rich, DNA segment, Chr 17, human D6S45, EST, Weakly similar to SRA4_HUMAN CTD-BINDING SR-LIKE PROTEIN RA4 [*H. sapiens*], ESTs, Highly similar to T31420 C-terminal domain-binding protein rA8 - rat [*R. norvegicus*], ESTs, Moderately similar to RD PROTEIN [*M. musculus*], ESTs, Weakly similar to RD PROTEIN [*M. musculus*], ESTs, Weakly similar to T31420 C-terminal domain-binding protein rA8 - rat [*R. norvegicus*], KIAA1116 protein, expressed sequence AI447644, expressed sequence AI448652, hypothetical protein FLJ10290, pre-mRNA splicing SR protein rA4 |
| 481 | 16319 | AA875047 | tt | | chaperonin containing TCP1, subunit 6A (zeta 1), chaperonin subunit 6a (zeta) |
| 3713 | 1024 | NM_031016 | k | | cholinergic receptor, muscarinic 2 |
| 1229 | 20271 | AA998747 | cc, mm | | chromosome 1 open reading frame 17, procollagen lysine, 2-oxoglutarate 5-dioxygenase 2, procollagen-lysine, 2-oxoglutarate 5-dioxygenase (lysine hydroxylase) 2, procollagen-lysine, 2-oxoglutarate 5-dioxygenase (lysine hydroxylase, Ehlers-Danlos syndrome type VI), procollagen-lysine, 2-oxoglutarate 5- |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | dioxygenase 1, procollagen-lysine, 2-oxoglutarate 5-dioxygenase 3 |
| 4062 | 20270 | NM_053827 | bb, mm | | chromosome 1 open reading frame 17, procollagen lysine, 2-oxoglutarate 5-dioxygenase 2, procollagen-lysine, 2-oxoglutarate 5-dioxygenase (lysine hydroxylase) 2, procollagen-lysine, 2-oxoglutarate 5-dioxygenase (lysine hydroxylase, Ehlers-Danlos syndrome type VI), procollagen-lysine, 2-oxoglutarate 5-dioxygenase 1, procollagen-lysine, 2-oxoglutarate 5-dioxygenase 3 |
| 2360 | 23248 | AI178267 | b, f, p, q, General, dd | | chromosome 1 open reading frame 9 |
| 2748 | 23249 | AI236597 | p, ff | | chromosome 1 open reading frame 9 |
| 76 | 18880 | AA799801 | bb, ii | | chromosome 11 open reading frame 17, predicted gene 1CRFP703B1614Q5.6 |
| 95 | 18881 | AA799992 | a, d | | chromosome 11 open reading frame 17, predicted gene ICRFP7O3B1614Q5.6 |
| 95 | 18883 | AA799992 | a | | chromosome 11 open reading frame 17, predicted ene ICRFP703B1614Q5.6 |
| 2402 | 13055 | AI79100 | General, jj | | chromosome 14 open reading frame 1 |
| 1461 | 23444 | AI013448 | rr | | chromosome 20 open reading frame 30 |
| 1603 | 5715 | AI045158 | v | | chromosome 20 open reading frame 55 |
| 1216 | 14379 | AA998415 | rr | | Cip1-interacting zinc finger protein, ESTs, Weakly similar to A40016 matrin 3- rat [*R. norvegicus*], matrin 3, nuclear protein, nuclear orotein 220 |
| 1840 | 16814 | AI101462 | jj | | cisplatin resistance related protein CRR9p |
| 4063 | 17154 | NM_053835 | d | | clathrin, light polypeptide (Lca), clathrin, light polypeptide (Lcb), expressed sequence AV026556 |
| 1064 | 23637 | AA955587 | pp | | cleavage stimulation factor, 3 pre-RNA, subunit 1, 50 kD |
| 4216 | 1557 | NM_134403 | qq, ss, vv | | CLLL7 protein, DKFZP586C1619 protein, ESTs, Weakly similar to T31081 cca3 protein - rat [*R. norvegicus*], *Homo sapiens* cDNA FLJ2S14I fis, clone CBRO71 51, RIKEN cDNA4933432B13 gene, RIKEN cDNA 6330404E1 6 gene, chromosome condensation 1-like, expressed sequence AW539457, gene tran ankyrin repeat |
| 2807 | 17108 | AI639017 | bb | | CLLL8 protein, EST, Highly similar to S30385 G9a protein [*H. sapiens*], ESTs, Weakly similar to T17453 ERG-associated protein ESET - mouse [*M. musculus*], SET domain, bifurcated 1, euchromatic histone methyltransferase 1, suppressor of variegation 3-9 (*Drosophila*) homolog 2; hypothetical protein FLJ23414 |
| 1504 | 7420 | AI029291 | l | | ClpX caseinolytic protease X homolog (*E. coli*) |
| 4144 | 9952 | NM_080902 | xx | | CLST 11240 protein, DKFZP564K247 protein, ESTs, Highly similar to Ti 4766 hypothetical protein DKFZp564K247.1 [*H. sapiens*], ESTs, Weakly similar to hypoxia induced gene 1 [*Rattus norvegicus*] [*R. norvegicus*], *Homo sapiens* mRNA; cDNA DKFZp434A1627 (from clone DKFZp434A1627), RIKEN cDNA 2010110M21 gene, RIKEN cDNA 2310056K19 gene, hypothetical protein MGC2198 hypoxia induced gene 1 |
| 755 | 3908 | AA894259 | j | | CLST 11240 protein, RIKEN cDNA 2010110M21 gene, RIKEN cDNA 2310056K19 gene, hypoxia induced gene 1 |
| 2324 | 16175 | AI177145 | w | | CMP-NeuAC:(beta)-N-acetylgalactosaminide (alpha)2,6-sialyltranslerase member VI, ESTs Weakly similar to CAG7_RAT ALPHA-N ACETYLGALACTOSAMINIDE ALPHA-2,6-SIALYLTRANSFERASE (ST6GALNACIII) (STY) [*R. norvegicus*], sialyltransferase 7D ((alpha-N-acetylneuraminyl-2,3-beta- |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | galactosyl-1,3)-N-acetyl galactosaminide alpha-2,6-sialyltransferase), similar to sialyltransferase 7 ((alpha-N-acetylneuraminyl 2,3-betagalactosyl-1,3)-N-acetyl galactosaminide alpha-2,6-sialyltransferase) E |
| 2964 | 107 | L14001 | General, mm | | CMRF35 leukocyte immunoglobulin-like receptor, EST, Weakly similar to PIGR_RAT Polymeric-immunoglobulin receptor precursor (Poly-IG receptor) (PIGR) [Contains: Secretory component] [*R. norvegicus*], Fc receptor, IgA, IgM, high affinity, *Homo sapiens,* similar to CMRF35 ANTIGEN PRECURSOR, clone MGC:26887 IMAGE:4827737, mRNA, complete cds, *Mus musculus* polymeric immunoglobulin receptor 3 precursor (Pigr3) mRNA, complete cds, RIKEN cDNA 1810037B05 gene, RIKEN cDNA 2310016B05 gene, immunoglobulin superfamily, member 7, polymeric immunoglobulin receptor, regulator of Fas-induced apoptosis |
| 2965 | 108 | L14002 | l, m, u, General, cc, kk, vv | | CMRF35 leukocyte immunoglobulin-like receptor, EST, Weakly similar to PIGR_RAT Polymeric-immunoglobulin receptor precursor (Poly-IG receptor) (PIGR) [Contains: Secretory component] [*R. norvegicus*], Fc receptor, IgA, IgM, high affinity, *Homo sapiens,* similar to CMRF35 ANTIGEN PRECURSOR, clone MGC:26887 IMAGE:4827737, mRNA, complete cds, *Mus musculus* polymeric immunoglobulin receptor 3 precursor (Pigr3) mRNA, complete cds, RIKEN cDNA 1810037B05 gene, RIKEN cDNA 2310016B05 gene, immunoglobulin superfamily, member 7, polymeric immunoglobulin receptor, regulator of Fas-induced apoptosis |
| 2967 | 109 | L14004 | b, General, vv | | CMRF35 leukocyte immunoglobulin-like receptor, EST, Weakly similar to PIGR_RAT Polymeric-immunoglobulin receptor precursor (Poly-IG receptor) (PIGR) [Contains: Secretory component] [*R. norvegicus*], Fc receptor, IgA, IgM, high affinity, *Homo sapiens,* similar to CMRF35 ANTIGEN PRECURSOR, clone MGC:26887 IMAGE:4827737, mRNA, complete cds, *Mus musculus* polymeric immunoglobulin receptor 3 precursor (Pigr3) mRNA, complete cds, RIKEN cDNA 1810037B05 gene, RIKEN cDNA 2310016B05 gene, immunoglobulin superfamily, member 7, polymeric immunoglobulin receptor, regulator of Fas-induced apoptosis |
| 4354 | 110 | U01145 | l, General, kk | | CMRF35 leukocyte immunoglobulin-like receptor, EST, Weakly similar to PIGR_RAT Polymeric-immunoglobulin receptor precursor (Poly-IG receptor) (PIGR) [Contains: Secretory component] [*R. norvegicus*], Fc receptor, IgA, IgM, high affinity, *Homo sapiens,* similar to CMRF35 ANTIGEN PRECURSOR, clone MGC:26887 IMAGE:4827737, mRNA, complete cds, *Mus musculus* polymeric immunoglobulin receptor 3 precursor (Pigr3) mRNA, complete ods, RIKEN cDNA 1810037B05 gene, RIKEN cDNA 2310016B05 gene, immunoglobulin superfamily, member 7, polymeric immunoglobulin receptor, regulator of Fas-induced apoptosis |
| 2967 | 109 | L14004 | b, General, vv | | CMRF35 leukocyte immunoglobulin-like receptor, EST, Weakly similar to PIGR_RAT Polymeric-immunoglobulin receptor precursor (Poly-IG receptor) (PIGR) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4354 | 110 | U01145 | l, General, kk | | [Contains: Secretory component] [*R. norvegicus*], Fc receptor, IgA, IgM, high affinity, *Homo sapiens,* similar to CMRF35 ANTIGEN PRECURSOR, clone MGC:26887 IMAGE:4827737, mRNA, complete cds, *Mus musculus* polymeric immunoglobulin receptor 3 precursor (Pigr3) mRNA, complete cds, RIKEN cDNA 1810037B05 gene, RIKEN cDNA 2310016B05 gene, immunoglobulin superfamily, member 7, polymeric immunoglobulin receptor, regulator of Fas-induced apoptosis CMRF35 leukocyte immunoglobulin-like receptor, EST, Weakly similar to PIGR_RAT Polymeric-immunoglobulin receptor precursor (Poly-IG receptor) (PIGR) |
| 4357 | 111 | U02506 | b, General, kk, vv | | [Contains: Secretory component] [*R. norvegicus*], Fc receptor, IgA, IgM, high affinity, *Homo sapiens,* similar to CMRF35 ANTIGEN PRECURSOR, clone MGC:26887 IMAGE:4827737, mRNA, complete cds, *Mus musculus* polymeric immunoglobulin receptor 3 precursor (Pigr3) mRNA, complete cds, RIKEN cDNA 1810037B05 gene, RIKEN cDNA 2310016B05 gene, immunoglobulin superfamily, member 7, polymeric immunoglobulin receptor, regulator of Fas-induced apoptosis CMRF35 leukocyte immunoglobulin-like receptor, EST, Weakly similar to PIGR_RAT Polymeric-immunoglobulin receptor precursor (Poly-IG receptor) (PIGR) [Contains: Secretory component] [*R. norvegicus*], Fc receptor, IgA, IgM, high affinity, *Homo sapiens,* similar to CMRF35 ANTIGEN PRECURSOR, clone MGC:26887 IMAGE:4827737, mRNA, complete cds, *Mus musculus* polymeric immunoglobulin receptor 3 precursor (Pigr3) mRNA, complete cds, RIKEN cDNA 1810037B05 gene, RIKEN cDNA 2310016B05 gene, immunoglobulin superfamily, member 7, polymeric immunoglobulin receptor, regulator of Fas-induced apoptosis |
| 2446 | 17365 | AI180249 | m | | colon cancer-associated protein Mic1 |
| 3322 | 20653 | NM_017104 | s | | colony stimulating factor 3 (granulocyte) |
| 1270 | 8008 | AF039584 | xx | | Complement component 4 binding protein, alpha, *Mus musculus* decay accelerating factor glycosylphoshatidylinositol-anchored form (DAF) mRNA, partial cds, complement component 4 binding protein, complement component 4 binding protein, alpha, decay accelerating factor 1, expressed sequence AI195242, expressed sequence AI323748, zona pellucida 3 receptor |
| 4124 | 358 | NM_057146 | u,vv | | complement component 9 |
| 3552 | 6585 | NM_022266 | y | | connective tissue growth factor |
| 193 | 2845 | AA818026 | h | | COP9 (constitutive photomorphogenic) homolog, subunit 6 (*Arabidopsis thaliana*), eukaryotic translation initiation factor 3, subunit 5 (epsilon), eukaryotic translation initiation factor 3, subunit 5 (epsilon, 47 kD), expressed sequence AW107203, proteasome (prosome, macropain) 26S subunit, non-ATPase, 7 |
| 715 | 13088 | AA893495 | x | | corticosteroid binding globulin, serine (or cysteine) proteinase inhibitor, clade A (alpha-1 antiproteinase, antitrypsin), member 6 |
| 3625 | 53 | NM_022714 | v, jj | | corticotropin releasing hormone receptor 2 |
| 2479 | 22915 | AI228299 | m. ll | | craniofacial development protein 1 |
| 2261 | 7711 | AI176125 | e | | CS box-containing WD protein, SOCS box-containing WD protein SWiP-1 |
| 1953 | 22957 | AI104897 | u, w | | CTAGE-1 protein, ESTs, Moderately similar to MEA6_HUMAN MENINGIOMA- |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | EXPRESSED ANTIGEN 6/11 (MEA6) (MEA11) [*H. sapiens*], ESTs, Weakly similar to MEA6_HUMAN MENINGIOMA-EXPRESSED ANTIGEN 6/11 (MEA6) (MEA11) [*H. sapiens*], KIAA0268 protein, meningioma expressed antigen 6 (coiled-coil proline-rich) |
| 766 | 15009 | AA899106 | pp | | cyclin D2 |
| 3136 | 17257 | NM_012766 | x, ll, rr, ww | | cyclin D3 |
| 3136 | 17258 | NM_012766 | l, k, nn, ww | | cyclin D3 |
| 4305 | 1448 | NM_145783 | oo | | cytochrome c oxidase subunit Va, cytochrome c oxidase, subunit Va |
| 4005 | 21423 | NM_053586 | r | | cytochrome c oxidase subunit Vb, cytochrome c oxidase, subunit Vb |
| 4005 | 21424 | NM_053586 | e, General | | cytochrome c oxidase subunit Vb, cytochrome c oxidase, subunit Vb |
| 3817 | 15024 | NM_031572 | General, ll, qq | | cytochrome P450, 2c40, cytochrome P450, subfamily IIC (mephenytoin 4-hydroxylase), polypeptide 19, expressed sequence AI662255 |
| 3817 | 15025 | NM_031572 | bb, qq | | cytochrome P450, 2c40, cytochrome P450, subfamily IIC (mephenytoin 4-hydroxylase), polypeptide 19, expressed sequence AI662255 |
| 4270 | 17119 | NM_139098 | p | | DEAD (aspartate-glutamate-alanine-aspartate) box polypeptide 5, ESTs, Moderately similar to A57514 RNA helicase HEL117 - rat [*R. norvegicus*], ESTs, Weakly similar to A57514 RNA helicase HEL117 - rat [*R. norvegicus*], ESTs, Weakly similar to PROBABLE RNA-DEPENDENT HELICASE P68 [*M. musculus*], Homo sapiens cDNA FLJ25329 fis, clone T5T00542, *Mus musculus*, clone MGC:31579 IMAGE:4505095, mRNA, complete cds, RIKEN cDNA 2310061004 gene, RIKEN cDNA 4921506017 gene, RNA helicase, expressed sequence AI325430 |
| 3999 | 4327 | NM_053563 | w, tt | | DEAD/H (Asp-Glu-Ala-Asp/His) box polypeptide 20, DEAD/H (Asp-Glu-Ala Asp/His) box polypeptide 20, 103 kD, DEAD/H (Asp-Glu-Ala-Asp/His) box polypeptide 39, DEAD/H (Asp-Glu-Ala Asp/His) box polypeptide 6 (RNA helicase, 54 kD), DEAD/H (Asp-Glu-Ala-Asp/His) box polypeptide 7 (RNA helicase, 52 kD), EST, Moderately similar to HLA-B-associated transcript 1A; DNA segment, Chr 17, human D6S81E 1; nuclear RNA helicase Bat1 [*Mus musculus*] [*M. musculus*], HLA-B-associated transcript 1A |
| 2515 | 23858 | AI229450 | r | | DEAD-box protein, ESTs, Weakly similar to DDX5 MOUSE PROBABLE RNA-DEPENDENT HELICASE P68 [*M. musculus*], Homo sapiens cDNA FLJ25329 fis, clone T5T00542, *Homo sapiens*, Similar to RIKEN cDNA 2310061004 gene, clone MGC:21583 IMAGE:4479998, mRNA, complete cds, *Mus musculus*, clone MGC:31579 IMAGE:4505095, mRNA, complete cds, RIKEN cDNA 9130430L19 gene, RNA helicase expressed sequence AI325430 |
| 3594 | 12422 | NM_022546 | bb | | death-associated kinase 3, death-associated protein kinase 1, death-associated protein kinase 3, expressed sequence AI120141, serine/threonine kinase 17a (apoptosis-inducing), serine/threonine kinase 17b (apoptosis-inducing) |
| 3898 | 16155 | NM_031810 | bb, ff | | defensin beta 1, defensin beta 2, defensin, beta 1, expressed sequence AW260221 |
| 4040 | 4324 | NM_053744 | cc | | delta-like 1 homolog (*Drosophila*), expressed sequence AW742678 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2328 | 23162 | AI177353 | a, q, x, dd | | dermatopontin |
| 1426 | 12766 | AI012505 | ee | | diacylglycerol O-acyltransferase 2, diacylglycerol O-acyltransferase homolog 2 (mouse) |
| 4146 | 4739 | NM_130400 | ff | | dihydrofolate reductase |
| 1218 | 3558 | M998461 | oo | | DKFZP434F091 protein, gene trap ROSA 26 antisense, Philippe Soriano, hypothetical protein MGC2454 |
| 1460 | 12794 | AI013442 | ee | | DKFZP434J154 protein, ESTs, Moderately similar to T12539 hypothetical protein DKFZp434J154.1 [*H. sapiens*], *Homo sapiens* cDNA FLJ13282 fis, clone OVARC1001092, highly similar to *Homo sapiens* mRNA for JM5 protein, hypothetical protein 628, hypothetical protein FLJ10055 |
| 1007 | 22636 | AA945724 | v | | DKFZP434M154 protein, *Homo sapiens*, clone IMAGE:3882977, mRNA, partial cds, chromosome 14 open reading frame 4 |
| 1583 | 7136 | AI044604 | s | | DKFZP434N093 protein |
| 852 | 5009 | AA924737 | qq | | DKFZP434P106 protein, ESTs, Weakly similar to T17237 hypothetical protein DKFZp434P106.1 [*H. sapiens*], hypothetical protein FLJ14906, hypothetical protein from EUROIMAGE 588495 |
| 303 | 22071 | AA849843 | uu, ww | | DKFZP547E2110 protein, hypothetical protein FLJ10604 |
| 1404 | 14267 | AI011738 | d, o | | DKFZP564B167 protein, RIKEN cDNA 2010002I07 gene, RIKEN cDNA 2610205H19 gene |
| 1718 | 9054 | AI070138 | dd | | DKFZP564C103 protein, RIKEN cDNA 1110028N05 gene |
| 4262 | 17185 | NM_138919 | dd | | DKFZP564G0222 protein, ESTs, Moderately similar to T12451 hypothetical protein DKFZp564G0222.1 [*H. sapiens*], RIKEN cDNA 1110002A21 gene |
| 110 | 15659 | AA800199 | ss | | DKFZP564J157 protein, EST, Weakly similar to B24264 proline-rich protein MP3 - mouse [*M. musculus*], EST, Weakly similar to B36298 proline-rich protein PRB3S [*H. sapiens*], EST, Weakly similar to CGHU3B collagen alpha 3(IV) chain precursor, long splice form [*H. sapiens*], EST, Weakly similar to D40750 proline-rich protein PRB1/2S [*H. sapiens*], EST, Weakly similar to PIHUB6 salivary proline-rich protein precursor PRB1 [*H. sapiens*], EST, Weakly similar to PRP1_HUMAN SALIVARY PROLINE-RICH PROTEIN PRECURSOR [*H. sapiens*], EST, Weakly similar to T34520 hypothetical protein DKFZp564J157.1 [*H. sapiens*], ESTs, Highly similar to T34520 hypothetical protein DKFZp564J157.1 [*H. sapiens*], ESTs, Weakly similar to B24264 proline-rich protein MP3 - mouse [*M. musculus*], ESTs, Weakly similar to T34520 hypothetical protein DKFZp564J157.1 [*H. sapiens*] |
| 2007 | 10780 | AI136555 | j | | DKFZP564O823 protein, ESTs, Weakly similar to S59856 collagen alpha 1(III) chain precursor - mouse [*M. musculus*], hypothetical protein DKFZp547D065, hypothetical protein FLJ13725, mucin and cadherin-like, splicing factor 3a, subunit 2, 66 kD |
| 1406 | 18684 | AI011812 | pp | | DKFZP564O123 protein, putative breast adenocarcinoma marker (32 kD) |
| 2374 | 23456 | AI178665 | p | | DKFZP566B183 protein, ESTs, Highly similar to T08719 hypothetical protein DKFZp566B183.1 [*H. sapiens*], hypothetical protein FLJ10420 |
| 1684 | 8347 | AI059519 | dd | | 0KFZP566D213 protein, EST, Moderately similar to EPIDERMAL GROWTH FACTOR PRECURSOR [*M. musculus*], *Homo sapiens* mRNA; cDNA DKFZp43400213 (from clone |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | DKFZp434O0213); partial cds, hypothetical protein MGC11256, nidogen 2 |
| 1463 | 12795 | AI013482 | y | | DKFZP566F2124 protein, enhancer of polycomb 1 |
| 2606 | 15122 | AI232303 | g, General, dd | | DKFZP566H073 protein, *Homo sapiens*, clone MGC:27006 IMAGE:4828408, mRNA, complete cds, goliath protein, hypothetical protein FLJ12526, hypothetical protein FLJ20315 |
| 1455 | 11969 | AI013273 | rr | | DKFZP56611024 protein, ESTs, Highly similar to A27496 glia-derived nexin I alpha precursor [*H. sapiens*] |
| 2918 | 4360 | H31813 | z, General | | DKFZP586B1621 protein |
| 341 | 3833 | AA851255 | ss | | DKFZP586F1524 protein |
| 4296 | 1949 | NM_145092 | f, l, ii, nn | | DKFZP586G011 protein, ESTs, Moderately similar to 161730 lamina associated polypeptide 1C short splice form - rat [*R. norvegicus*], ESTs, Weakly similar to 161730 lamina associated polypeptide 1C short splice form - rat [*R. norvegicus*], ESTs, Weakly similar to T08767 probable lamina-associated protein DKFZp586G011.1 [*H. sapiens*], *Homo sapiens*, clone IMAGE:4651 703, mRNA, *Mus musculus*, clone MGC:6357 IMAGE:3493883, mRNA, complete cds |
| 2726 | 7307 | AI235935 | g, oo | | DKFZP586G1517 protein, EST, Moderately similar to A Chain A, Human Tetrahydrofolate Dehydrogenase [*H. sapiens*], ESTs, Highly similar to T17244 hypothetical protein DKFZp586G1517.1 [*H. sapiens*], ESTs, Weakly similar to C1TC_RAT C-1-tetrahydrofolate synthase, cytoplasmic (C1-THF synthase) [Includes: Methylenetetrahydrofolate dehydrogenase; Methenyltetrahydrofolate cyclohydrolase; Formyltetrahydrofolate synthetase] [*R. norvegicus*], expressed sequence AI647056, hypothetical protein FLJ13105 |
| 2528 | 4722 | AI230038 | c, ll | | DKFZP586M1523 protein |
| 616 | 4373 | AA892310 | v | | DKFZP586O0120 protein |
| 3811 | 1822 | NM_031553 | c, ww | | DNA polymerase epsilon, subunit 3, ESTs, Moderately similar to CCAAT-BINDING TRANSCRIPTION FACTOR SUBUNIT A [*M. musculus*], ESTs, Weakly similar to A23692 transcription factor, CCAAT-binding, chain A1 - rat [*R. norvegicus*], RIKEN cDNA 1810034K18 gene, down-regulator of transcription 1, down-regulator of transcription 1, TBP-binding (negative cofactor 2), nuclear transcription factor Y, beta, nuclear transcription factor-Y beta, polymerase (DNA directed), epsilon 3 (p17 subunit) |
| 3897 | 1000 | NM_031809 | j | | DNA segment on chromosome X (unique) 9928 expressed sequence, ESTs, Weakly similar to cyclic nucleotide-gated channel beta subunit 1 [*Rattus norvegicus*] [*R. norvegicus*], RIKEN cDNA 1100001D19 gene, 5H3-binding domain glutamic acid-rich protein, cyclic nucleotide gated channel beta 1, cyclic nucleotide gated channel beta 3, protein kinase C substrate 80K-H |
| 1608 | 6241 | AI045321 | bb | | DNA segment, Chr 1, ERATO Doi 309, expressed, EST, Weakly similar to POL1_HUMAN RETROVIRUS-RELATED POL POLYPROTEIN [*H. sapiens*], ESTs, Moderately similar to POL1_HUMAN RETROVIRUS-RELATED POL POLYPROTEIN [*H. sapiens*], HSU18004 *Homo sapiens* cDNA, *Homo sapiens* cDNA: FLJ23457 fis, clone H5107266, Murine (DBA/2) mRNA fragment for gag related peptide, *Mus musculus*, clone |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2170 | 11419 | AI171365 | k | | IMAGE:5068294, mRNA, partial cds, expressed sequence AU022855, intracisternal A particles DNA segment, Chr 1, Pasteur Institute 1, ESTs, Moderately similar to A57514 RNA helicase HEL117 - rat [*R. norvegicus*], ESTs, Weakly similar to PUTATIVE ATP-DEPENDENT RNA HELICASE PL10 [*M. musculus*], *Homo sapiens* cDNA FLJ25329 fis, clone TST00542, *Mus musculus*, Similar to DEAD/H (Asp-Glu-Ala-Asp/His) box polypeptide 27, clone IMAGE:4167383, mRNA, partial cds, *Mus musculus*, clone MGC:31579 IMAGE:4505095, mRNA, complete cds, RNA helicase, expressed sequence AI324246 expressed sequence AI325430 |
| 1161 | 8442 | AA800258 | f, pp, ww | | DNA segment, Chr 11, Wayne State University 99, expressed, hypothetical protein FLJ14775, low density lipoprotein B, low density lipoprotein receptor defect B complementing |
| 1413 | 7104 | AI012103 | oo | | DNA segment, Chr 11, Wayne State University 99, expressed, hypothetical protein FLJ14775, low density lipoprotein B, low density lipoprotein receptor defect B complementing |
| 3763 | 13358 | NM_031135 | xx | | DNA segment, Chr 12, ERATO Doi 427, expressed, RIKEN cDNA 7420700M05 gene, TGFB inducible early growth response, TGFB inducible early growth response 2 |
| 2605 | 8390 | AI232288 | ww | | DNA segment, Chr 12, ERATO Doi 604, expressed, ESTs, Moderately similar to hypothetical protein FLJ10416 similar to constitutive photomorph [*Homo sapiens*] [*H. sapiens*], *Mus musculus*, Similar to glutamate rich WD repeat protein GRWD, clone IMAGE:3498842, mRNA, partial cds, RIKEN cDNA 2610016K01 gene, RIKEN cDNA 2610529I12 gene, constitutive photomorphogenic protein 1 (*Arabidopsis*), retinoblastoma binding protein 4, retinoblastoma binding protein 7 |
| 4460 | 16300 | X70706 | j | | DNA segment, Chr 14, ERATO Doi 426, expressed, ESTs, Highly similar to A34789 T-plastin [*H. sapiens*], ESTs, Highly similar to A56536 plastin, intestinal [*H. sapiens*], *Mus musculus*, clone IMAGE:4216549, mRNA, partial cds, *Mus musculus*, clone MGC:6362 IMAGE:3495462, mRNA, complete cds, calreticulin, expressed sequence AL024105, plastin 1 (I isoform), plastin 2, L, plastin 3 (T isoform) |
| 4345 | 1460 | 576054 | t, General, ll, ww | | DNA segment, Chr 15, Wayne State University 77, expressed, EST, Moderately similar to K2C8_RAT Keratin, type II cytoskeletal 8 (Cytokeratin 8) (Cytokeratin endo A) [*R. norvegicus*], ESTs, Moderately similar to 137982 Keratin 8 [*H. sapiens*], *Homo sapiens* mRNA; cDNA DKFZp434C107 (from clone DKFZp434C107), *Homo sapiens* mRNA; cDNA DKFZp762H106 (from clone DKFZp762H106), keratin 8, keratin complex 2 basic gene 8 |
| 3643 | 1053 | NM_022962 | pp | | DNA segment, Chr 17, ERATO Doi 479, expressed, EGF-like module containing, mucin-like, hormone receptor-like sequence 1, EST, Weakly similar to EMR1 MOUSE CELL SURFACE GLYCOPROTEIN EMR1 PRECURSOR [*M. musculus*], ESTs, Highly similar to lectomedin-2; KIAA0821 protein [*Homo sapiens*] [*H. sapiens*], ESTs, Weakly |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | similar to EMR1 MOUSE CELL SURFACE GLYCOPROTEIN EMR1 PRECURSOR [*M. musculus*] |
| 1028 | 21157 | AA946189 | l | | DNA segment, Chr 17, ERATO Doi 663, expressed, *Homo sapiens* cDNA FLJ25377 fis, clone TST02084 |
| 4155 | 18293 | NM_130433 | o, ii, ss, xx | | DNA segment, Chr 18, ERATO Doi 240, expressed, *Mus musculus*, Similar to hydroxyacyl-Coenzyme A dehydrogenase/3-ketoacyl-Coenzyme A thiolase/enoyl-Coenzyme A hydratase (trifunctional protein), beta subunit, clone MGC:7126 IMAGE:3158015, mRNA, complete cds, RIKEN cDNA 0610011L04 gene, acetyl-Coenzyme A acyltransferase 2 (mitochondrial 3-oxoacyl-Coenzyme A thiolase), t-complex protein 1, related sequence 1 |
| 4343 | 21981 | S75019 | ss, vv | | DNA segment, Chr 18, Wayne State University 181, expressed, aldehyde dehydrogenase 7 family, member A1, aldehyde dehydrogenase family 1, subfamily A2 |
| 2097 | 6732 | AI169269 | kk | | DNA segment, Chr 18, Wayne State University 98, expressed, dim1 (*S. pombe*), expressed sequence AI595343, similar to *S. pombe* dim1+ |
| 1854 | 15080 | AI102045 | l | | DNA segment, Chr 2, ERATO Doi 485, expressed, *Mus musculus*, Similar to conserved gene amplified in osteosarcoma, clone MGC:38258 IMAGE:5324816, mRNA, complete cds, RIKEN cDNA 2610507E10 gene, RIKEN cDNA 2810418J22 gene, conserved gene amplified in osteosarcoma |
| 3690 | 10305 | NM_030835 | ee, ff | | DNA segment, Chr 3, University of California at Los Angeles 1, ESTs, Moderately similar to stress-associated endoplasmic reticulum protein 1; ribosome asso; ribosome associated membrane protein 4 [*Homo sapiens*] [*H. sapiens*] |
| 3690 | 10306 | NM_030835 | b, q, x, General, dd | | DNA segment, Chr 3, University of California at Los Angeles 1, ESTs, Moderately similar to stress-associated endoplasmic reticulum protein 1; ribosome asso; ribosome associated membrane protein 4 [*Homo sapiens*] [*H. sapiens*] |
| 3690 | 10308 | NM_030835 | l, q | | DNA segment, Chr 3, University of California at Los Angeles 1, ESTs, Moderately similar to stress-associated endoplasmic reticulum protein 1; ribosome asso; ribosome associated membrane protein 4 [*Homo sapiens*] [*H. sapiens*] |
| 3747 | 20812 | NM_031100 | y, ee | | DNA segment, Chr 3, University of California at Los Angeles 2, EST, Weakly similar to RL10 MOUSE 60S RIBOSOMAL PROTEIN L10 [*M. musculus*], EST, Weakly similar to RL10_MOUSE 60S ribosomal protein L10 (QM protein homolog) [*R. norvegicus*], ribosomal protein 10, ribosomal protein L10, ribosomal protein l10-like |
| 3754 | 16847 | NM_031109 | h,xx | | DNA segment, Chr 4, ERATO Doi 429, expressed, EST, Weakly similar to 2113200G ribosomal protein S10 [*H. sapiens*], EST, Weakly similar to ribosomal protein S10 [*H. sapiens*], ESTs, Highly similar to 2113200G ribosomal protein S10 [*H. sapiens*], ESTs, Highly similar to RS10 RAT 40S RIBOSOMAL PROTEIN S10 [*R. norvegicus*], ESTs, Moderately similar to RIKEN cDNA 2210402A09 [*Mus musculus*] [*M. musculus*], RIKEN cDNA 2210402A09 gene, ribosomal protein S10 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4225 | 1373 | NM_134468 | n | | DNA segment, Chr 6, ERATO Doi 263, expressed, ESTs, Moderately similar to S50193 Ca2+/calmodulin-dependent protein kinase (EC 2.7.1.123) I - rat [*R. norvegicus*], ESTs, Weakly similar to KCC4 MOUSE CALCIUM/CALMODULIN-DEPENDENT PROTEIN KINASE TYPE IV CATALYTIC CHAIN [*M. musculus*], calcium/calmodulin-dependent protein kinase I, expressed sequence AI505105, pregnancy upregulated non-ubiquitously expressed CaM kinase, serine/threonine kinase PSKH2 |
| 4289 | 23681 | NM_144746 | General, rr | | DNA segment, Chr 7, ERATO Doi 753, expressed, ESTs, Highly similar to A38351 phosphoprotein phosphatase 2-alpha regulatory chain [*H. sapiens*], ESTs, Moderately similar to 2ABA_HUMAN SERINE/THREONINE PROTEIN PHOSPHATASE 2A, 55 KDA REGULATORY SUBUNIT B, ALPHA ISOFORM [*H. sapiens*], RIKEN cDNA 1300017E19 gene, protein phosphatase 2 (formerly 2A), regulatory subunit B (PR 52), alpha isoform, uncharacterized hematopoietic stem/progenitor cells protein MDS026 |
| 3604 | 21115 | NM_022602 | r, z, ss | | DNA segment, ChrX, Celltech Chiroscience 3, *Mus musculus*, serine threonine kinase pim3, clone MGC:27707 IMAGE:4924687, mRNA, complete cds, pim-1 oncogene, pim-2 oncogene, proviral integration site 1 |
| 1741 | 10999 | AI071110 | t | | DNA segment, EST 1068184, EST, Weakly similar to A44437 regenerating liver inhibitory factor RL/IF-1 - rat [*R. norvegicus*], ESTs, Weakly similar to A44437 regenerating liver inhibitory factor RL/IF-1 - rat [*R. norvegicus*], ESTs, Weakly similar to T42713 ankyrin 3, splice form 1 - mouse [*M. musculus*], *Homo sapiens*, Similar to GA binding protein transcription factor, beta subunit 1 (53 kD), clone MGC:29891 IMAGE:5139830, mRNA, complete cds, nuclear factor of kappa light polypeptide gene enhancer in B-cells inhibitor, alpha, testis-specific ankyrin motif containing |
| 3769 | 23097 | NM_031145 | h, bb | | DNA-dependent protein kinase catalytic subunit-interacting protein 3, EST, Moderately similar to A Chain A, Homology-Based Model Of Apo Cib [*H. sapiens*], ESTs, Weakly similar to CIB_HUMAN SNK INTERACTING PROTEIN 2-28 [*H. sapiens*], ESTs, Weakly similar to KIP1_RAT DNA-PKcs interacting protein (Kinase interacting protein) (KIP) (Calcium and integrin-binding protein) (CIB) [*R. norvegicus*], *Mus musculus*, Similar to protein kinase, DNA activated, catalytic polypeptide interacting protein, clone MGC:7098 IMAGE:3157513, mRNA, complete cds, RIKEN cDNA 1700041E20 gene, calcium and integrin binding 1 (calmyrin) |
| 411 | 16318 | AA859648 | c | | DnaJ (Hsp40) homolog, subfamily A, member 1, DnaJ (Hsp40) homolog, subfamily A, member 4, DnaJ (Hsp40) homolog, subfamily B, member 1, DnaJ (Hsp40) homolog, subfamily B, member 12, ESTs, Weakly similar to DJA1_MOUSE DnaJ homolog subfamily A member 1 (Heat shock 40 kDa protein 4) (DnaJ protein homolog 2) (HSJ-2) [*R. norvegicus*], ESTs, Weakly similar to HSJ2_HUMAN DNAJ PROTEIN HOMOLOG 2 [*H. sapiens*], *Homo sapiens* cDNA FLJ13992 fis, clone Y79AA1 002139, weakly similar to DNAJ |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | PROTEIN HOMOLOG 1, RIKEN cDNA 1700014P03 gene, RIKEN cDNA 2010306G19 gene, RIKEN cDNA 5730551F12 gene, similar to MRJ gene for a member of the DNAJ protein family (*H. sapiens*) |
| 126 | 6892 | AA800551 | p | | DnaJ (Hsp40) homolog, subfamily A, member 1, DnaJ (Hsp40) homolog, subfamily A, member 4, ESTs, Highly similar to HS44 MOUSE HEAT SHOCK 40 KDA PROTEIN 4 [*M. musculus*], ESTs, Moderately similar to DJA1_MOUSE DnaJ homolog subfamily A member 1 (Heat shock 40 kDa protein 4) (DnaJ protein homolog 2) (HSJ-2) [*R. norvegicus*], ESTs, Weakly similar to DnaJ-like protein (*Rattus norvegicus*) [*R. norvegicus*], ESTs, Weakly similar to HS44 MOUSE HEAT SHOCK 40 KDA PROTEIN 4 [*M. musculus*], Homo sapiens mRNA full length insert cDNA clone EUROIMAGE 730912, *Mus musculus* SEC63 (Sec63) mRNA, complete cds, similar to DNA I |
| 3631 | 6891 | NM_022934 | t, gg, hh | | DnaJ (Hsp40) homolog, subfamily A, member 1, DnaJ (Hsp40) homolog, subfamily A, member 4, ESTs, Highly similar to HS44 MOUSE HEAT SHOCK 40 KDA PROTEIN 4 [*M. musculus*], ESTs, Moderately similar to DJA1_MOUSE DnaJ homolog subfamily A member 1 (Heat shock 40 kDa protein 4) (DnaJ protein homolog 2) (HSJ-2) [*R. norvegicus*], ESTs, Weakly similar to DnaJ-like protein [*Rattus norvegicus*] [*R. norvegicus*], ESTs, Weakly similar to HS44 MOUSE HEAT SHOCK 40 KDA PROTEIN 4 [*M. musculus*], Homo sapiens mRNA full length insert cDNA clone EUROIMAGE 730912, *Mus musculus* SEC63 (Sec63) mRNA, complete cds, similar to DNA I |
| 855 | 5019 | M924768 | b | | DnaJ (Hsp40) homolog, subfamily A, member 2, DnaJ (Hsp40) homolog, subfamily B, member 2, DnaJ (Hsp40) homolog, subfamily B, member 6, RIKEN cDNA 2810451A06 gene, RIKEN cDNA 4930483N21 gene, RIKEN cDNA 5730496F10 gene, expressed sequence AI506245 |
| 2622 | 8709 | AI232534 | ii | | DnaJ (Hsp40) homolog, subfamily B, member 3, DnaJ (Hsp40) homolog, subfamily B, member 6, RIKEN cDNA 2810451A06 gene, expressed sequence AI506245, expressed sequence AU020082 |
| 3663 | 220 | NM_024161 | c, m | | DnaJ (Hsp40) homolog, subfamily C, member 5, ESTs, Weakly similar to CSP MOUSE CYSTEINE STRING PROTEIN [*M. musculus*], RIKEN cDNA 1700008A05 gene, RIKEN cDNA 1700025B16 gene, beta cysteine string protein |
| 2122 | 18367 | AI170064 | j | | Down syndrome critical region gene 2, Down syndrome critical region homolog 2 (human) |
| 2619 | 14051 | AI232489 | w, z, dd, ee | | dual specificity phosphatase 11 (RNA/RNP complex 1-interacting) |
| 4370 | 399 | U31668 | ww, xx | | E2F transcription factor 4, p107/p130-binding, E2F transcription factor 5, E2F transcription factor 5, p130-binding, ESTs, Moderately similar to E2F5 MOUSE TRANSCRIPTION FACTOR E2F5 [*M. musculus*], ESTs, Moderately similar to E2F5_RAT TRANSCRIPTION FACTOR E2F5 (E2F-5) [*R. norvegicus*], *Mus musculus*, Similar to E2F transcription factor |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | 4, p107/p130-binding, clone MGC:37558 IMAGE:4987691, mRNA, complete cds |
| 1955 | 24375 | AI104979 | q, z, dd, ee | | EBNA1 binding protein 2, ESTs, Moderately similar to EBNA1 binding protein 2; nucleolar protein p40; homolog of yeast EBNA1-binding protein; nuclear FGF3 binding protein; EBNA1-binding protein 2 [*Homo sapiens*] [*H. sapiens*] |
| 3616 | 17586 | NM_022694 | u,ff | | EBNA-2 co-activator (100 kD), ESTs, Moderately similar to I38968 100 kDa coactivator [*H. sapiens*], staphylococcal nuclease domain containing 1 |
| 3616 | 17587 | NM_022694 | u,w | | EBNA-2 co-activator (100 kD), ESTs, Moderately similar to I38968 100 kDa coactivator [*H. sapiens*], staphylococcal nuclease domain containing 1 |
| 3494 | 20057 | NM_019370 | General, nn | | ectonucleotide pyrophosphatase/phosphodiesterase 1, ectonucleotide pyrophosphatase/phosphodiesterase 3 |
| 1012 | 17721 | AA945762 | General | | EHM2 gene, EST, Weakly similar to 2102279A protein Tyr phosphatase [*Rattus norvegicus*] [*R. norvegicus*], ESTs, Weakly similar to NBL4 MOUSE BAND 4.1-LIKE PROTEIN 4 [*M. musculus*], ESTs, Weakly similar to YF48_HUMAN HYPOTHETICAL PROTEIN KIAA1548 [*H. sapiens*], KIAA1548 protein, *Mus musculus*, Similar to EHM2 gene, clone MGC:7330 IMAGE:3486543, mRNA, complete cds, erythrocyte protein band 4.1-like 4a, protein tyrosine phosphatase 2E, protein tyrosine phosphatase, non-receptor type 14, protein tyrosine phosphatase, non-receptor type 21 |
| 623 | 19226 | AA892394 | a | | ELAV (embryonic lethal, abnormal vision, *Drosophila*)-like 2 (Hu antigen B), ELAV (embryonic lethal, abnormal vision, *Drosophila*)-like 3 (Hu antigen C), ELAV (embryonic lethal, abnormal vision, *Drosophila*)-like 4 (Hu antigen D), ESTs, Highly similar to ELV4_RAT ELAV-like protein 4 (Paraneoplastic encephalomyelitis antigen HuD) (Hu-antigen D) [*R. norvegicus*], ESTs, Moderately similar to ELV4_RAT ELAV-like protein 4 (Paraneoplastic encephalomyelitis antigen HuD) (Hu-antigen D) [*R. norvegicus*] |
| 623 | 19227 | AA892394 | a, w | | ELAV (embryonic lethal, abnormal vision, *Drosophila*)-like 2 (Hu antigen B), ELAV (embryonic lethal, abnormal vision, *Drosophila*)-like 3 (Hu antigen C), ELAV (embryonic lethal, abnormal vision, *Drosophila*)-like 4 (Hu antigen D), ESTs, Highly similar to ELV4_RAT ELAV-like protein 4 (Paraneoplastic encephalomyelitis antigen HuD) (Hu-antigen D) [*R. norvegicus*], ESTs, Moderately similar to ELV4_RAT ELAV-like protein 4 (Paraneoplastic encephalomyelitis antigen HuD) (Hu-antigen D) [*R. norvegicus*] |
| 868 | 10666 | AA925212 | kk | | ELAV (embryonic lethal, abnormal vision, *Drosophila*)-like 2 (Hu antigen B), ELAV (embryonic lethal, abnormal vision, *Drosophila*)-like 4 (Hu antigen D), ESTs, Highly similar to ELV4_RAT ELAV-like protein 4 (Paraneoplastic encephalomyelitis antigen HuD) (Hu-antigen D) [*R. norvegicus*], ESTs, Moderately similar to ELV4_RAT ELAV-like protein 4 (Paraneoplastic encephalomyelitis antigen HuD) (Hu-antigen 0) [*R. norvegicus*], ESTs, Moderately similar to PAB1 MOUSE POLYADENYLATE-BINDING PROTEIN 1 [*M. musculus*], ESTs, Weakly similar to PAB1 MOUSE |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | POLYADENYLATE-BINDING PROTEIN 1 [*M. musculus*], RIKEN cDNA 4932702K14 gene, poly A binding protein, cytoplasmic 1, poly(A) binding protein, cytoplasmic 4 (inducible form) |
| 2742 | 10667 | AI236366 | dd | | ELAV (embryonic lethal, abnormal vision, *Drosophila*)-like 2 (Hu antigen B), ELAV (embryonic lethal, abnormal vision, *Drosophila*)-like 4 (Hu antigen D), ESTs, Highly similar to ELV4_RAT ELAV-like protein 4 (Paraneoplastic encephalomyelitis antigen HuD) (Hu-antigen D) [*R. norvegicus*], ESTs, Moderately similar to ELV4_RAT ELAV-like protein 4 (Paraneoplastic encephalomyelitis antigen HuD) (Hu-antigen D) [*R. norvegicus*], ESTs, Moderately similar to PAB1 MOUSE POLYADENYLATE-BINDING PROTEIN 1 [*M. musculus*], ESTs, Weakly similar to PAB1 MOUSE POLYADENYLATE-BINDING PROTEIN 1 [*M. musculus*], RIKEN cDNA 4932702K14 gene, poly A binding protein, cytoplasmic 1, poly(A) binding protein, cytoplasmic 4 (inducible form) |
| 2406 | 17358 | AI179147 | b, ii, pp | | electron-transfer-flavoprotein, beta polypeptide |
| 2277 | 17920 | AI176422 | n, kk, pp | | electron-transferring-flavoprotein dehydrogenase |
| 2277 | 17921 | AI176422 | p, kk | | electron-transferring-flavoprotein dehydrogenase |
| 3525 | 19696 | NM_021699 | l, nn | | ELKL motif kinase, ESTs, Weakly similar to PUTATIVE SERINE/THREONINE-PROTEIN KINASE EMK [*M. musculus*], *Mus musculus* ELKL motif serine-threonine protein kinase 3 (Emk3) mRNA, complete cds, NIMA (never in mitosis gene a)-related expressed kinase 2, NIMA (never in mitosis gene a)-related kinase 2, RIKEN cDNA 2410090P21 gene, Unc-51 like kinase 2 (*C. elegans*), maternal embryonic leucine zipper kinase, serine/threonine kinase 22D (spermiogenesis associated) |
| 1560 | 7913 | AI043849 | ff | | ELL-related RNA polymerase II, elongation factor, ESTs, Weakly similar to ELL MOUSE RNA POLYMERASE II ELONGATION FACTOR ELL [*M. musculus*], *Mus musculus*, clone IMAGE:3583970, mRNA, partial cds, RIKEN cDNA 9430098E02 gene, eleven-nineteen lysine-rich leukemia gene, hypothetical protein FLJ22637 |
| 2669 | 7243 | AI233717 | z, ee | | embryonic ectoderm development |
| 559 | 6535 | AA891746 | r | | endothelial differentiation-related factor 1, expressed sequence AA409425 |
| 3183 | 18694 | NM_012931 | mm | | enhancer of filamentation 1 (cas-like docking; Crk-associated substrate related), expressed sequence AI385681, neural precursor cell expressed, developmentally down-regulated gene 9, signal transduction protein (SH3 containing), v-crk-associated tyrosine kinase substrate |
| 4090 | 16190 | NM_053961 | o | | Enoyl-CoA hydratase, short chain 1, mitochondrial, *Homo sapiens* hepatocellular carcinoma-associated antigen 64 (HCA64) mRNA, complete cds, RIKEN cDNA 1300014E15 gene, RIKEN cDNA 1300017C12 gene, RIKEN cDNA 1810022C23 gene, RIKEN cDNA 2010015A21 gene, RIKEN cDNA 4930453I21 gene, enoyl Coenzyme A hydratase, short chain, 1, mitochondrial, hypothetical protein FLJ10948, peroxisomal delta3, delta2-enoyl-Coenzyme A isomerase |
| 627 | 23194 | AA892417 | c | | ephrin A1, ephrin-A1 |
| 4013 | 1390 | NM_053599 | c, p, v | | ephrin A1, ephrin-A1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3693 | 21509 | NM_030847 | f | | epithelial membrane protein 3 |
| 522 | 11889 | AA875641 | k | | EPS8 related protein 2, epidermal growth factor receptor pathway substrate 8 related protein 1, epidermal growth factor receptor pathway substrate 8 related protein 3 |
| 3592 | 8597 | NM_022538 | h, l | | ER transmembrane protein Dri 42, RIKEN cDNA 1810019D05 gene, phosphatidic acid phosphatase 2a, phosphatidic acid phosphatase type 2A, phosphatidic acid phosphatase type 2B, phosphatidic acid phosphatase type 2C, phosphatidic acid phosphatase type 2c |
| 3592 | 8598 | NM_022538 | d | | ER transmembrane protein Dri 42, RIKEN cDNA 1810019005 gene, phosphatidic acid phosphatase 2a, phosphatidic acid phosphatase type 2A, phosphatidic acid phosphatase type 2B, phosphatidic acid phosphatase type 2C, phosphatidic acid phosphatase type 2c |
| 804 | 18547 | AA900722 | ii | | ERM-binding phosphoprotein, solute carrier family 9 (sodium/hydrogen exchanger), isoform 3 regulator 1, solute carrier family 9 (sodium/hydrogen exchanger), isoform 3 regulator 2, solute carrier family 9 (sodium/hydrogen exchanger), isoform 3 regulatory factor 1, solute carrier family 9 (sodium/hydrogen exchanger), isoform 3 regulatory factor 2 |
| 3503 | 16 | NM_019386 | b, l, q, General, dd, kk | | erythrocyte membrane protein band 4.2, transglutaminase 2 (C polypeptide, protein-glutamine-gamma-glutamyltransferase), transglutaminase 2, C polypeptide, transglutaminase 3 (E polypeptide, protein-glutamine-gamma-glutamyltransferase), transglutaminase 3, E polypeptide, transglutaminase 5, transglutaminase 7 |
| 3740 | 4683 | NM_031083 | d, f | | EST AA437822, *Homo sapiens,* Similar to phosphatidylinositol 4-kinase, catalytic, alpha polypeptide, clone MGC:31920 IMAGE:4565073, mRNA, complete cds, phosphatidylinositol 4-kinase, catalytic, alpha polypeptide, phosphatidylinositol 4-kinase, catalytic, beta polypeptide, phosphoinositide-3-kinase, catalytic, gamma polypdptide |
| 3740 | 4684 | NM_031083 | k | | EST AA437822, *Homo sapiens,* Similar to phosphatidylinositol 4-kinase, catalytic, alpha polypeptide, clone MGC:31920 IMAGE:4565073, mRNA, complete cds, phosphatidylinositol 4-kinase, catalytic, alpha polypeptide, phosphatidylinositol 4-kinase, catalytic, beta polypeptide, phosphoinositide-3-kinase, catalytic, gamma polypeptide |
| 3737 | 24508 | NM_031073 | nn | | EST AI316846, neurotrophin 3 |
| 1415 | 21796 | AI012221 | vv | | EST X83352, ESTs, Weakly similar to intracellular chloride ion channel protein p64H1 [*Rattus norvegicus*] [*R. norvegicus*], RIKEN cDNA 5730531E12 gene, chloride intracellular channel 1, chloride intracellular channel 3, chloride intracellular channel 4 (mitochondrial), intracellular chloride ion channel protein p64H1 |
| 1794 | 21797 | AI072439 | qq | | EST X83352, ESTs, Weakly similar to intracellular chloride ion channel protein p64H1 [*Rattus norvegicus*] [*R. norvegicus*], RIKEN cDNA 5730531 E12 gene, chloride intracellular channel 1, chloride intracellular channel 3, chloride intracellular channel 4 (mitochondrial), intracellular chloride ion channel protein p64H1 |
| 3595 | 12606 | NM_022547 | General, vv | | EST, Highly similar to 10-formyltetrahydrofolate dehydrogenase [*Rattus norvegicus*] [*R. norvegicus*], EST, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | Highly similar to FTDH_HUMAN 10-FORMYLTETRAHYDROFOLATE DEHYDROGENASE [*H. sapiens*], ESTs, Moderately similar to 10-formyltetrahydrofolate dehydrogenase [*Rattus norvegicus*] [*R. norvegicus*], ESTs, Moderately similar to FTDH_HUMAN 10-FORMYLTETRAHYDROFOLATE DEHYDROGENASE [*H. sapiens*], RIKEN cDNA 1810048F20 gene, RIKEN cDNA 2310020P08 gene, aldehyde dehydrogenase family 1, subfamily A7, formyltetrahydrofolate dehydrogenase |
| 3109 | 7101 | NM_012679 | nn | | EST, Highly similar to Clusterin; Testostrone-repressed prostate message 2 [*Rattus norvegicus*] [*R. norvegicus*], clusterin, clusterin (complement lysis inhibitor, SP-40,40, sulfated glycoprotein 2, testosterone-repressed prostate message 2, apolipoprotein J) |
| 3478 | 10016 | NM_019289 | v, x | | EST, Highly similar to AR41_HUMAN ARP2/3 COMPLEX 41 KDA SUBUNIT [*H. sapiens*], actin related protein 2/3 complex, subunit 1B (41 kD), actin related protein 2/3 complex, subunit 1B (41 kDa) |
| 3729 | 15137 | NM_031051 | w, y, ee, tt | | EST, Highly similar to C Chain C, Macrophage Migration Inhibitory Factor [*H. sapiens*], EST, Moderately similar to C Chain C, Macrophage Migration Inhibitory Factor [*H. sapiens*], EST, Moderately similar to MIF_RAT Macrophage migration inhibitory factor (MIF) (Phenylpyruvate tautomerase) (Glutathione-binding 13 kDa protein) [*R. norvegicus*], ESTs, Moderately similar to MIF_HUMAN MACROPHAGE MIGRATION INHIBITORY FACTOR [*H. sapiens*], macrophage migration inhibitory factor, macrophage migration inhibitory factor (glycosylation-inhibiting factor) |
| 1662 | 8584 | AI058911 | cc, ii, rr | | EST, Highly similar to FIBA_RAT Fibrinogen alpha/alpha-E chain precursor [*R. norvegicus*], *Homo sapiens* clone HQ0582, angiopoietin 2, angiopoietin-like 3, expressed sequence AI303526, fibrinogen, A alpha polypeptide, fibrinogen, alpha polypeptide, fibrinogen, gamma polypeptide |
| 3245 | 22582 | NM_013120 | b, kk | | EST, Highly similar to GCKR RAT GLUCOKINASE REGULATORY PROTEIN [*R. norvegicus*], *Mus musculus*, Similar to Glucokinase regulatory protein, clone MGC:19300 IMAGE:4159892, mRNA, complete cds, glucokinase (hexokinase 4) regulatory protein |
| 434 | 22593 | AA859977 | tt | | EST, Highly similar to HS9B MOUSE HEAT SHOCK PROTEIN HSP 90-BETA [*M. musculus*], EST, Weakly similar to HHMS84 heat shock protein 84 - mouse [*M. musculus*], ESTs, Highly similar to HS9A_HUMAN HEAT SHOCK PROTEIN HSP 90-ALPHA [*H. sapiens*], ESTs, Highly similar to T46243 hypothetical protein DKFZp761K0511.1 [*H. sapiens*], expressed sequence C81438, heat shock 90 kD protein 1, beta, heat shock protein, 84 kDa 1, heat shock protein 86 kDa 1 |
| 2764 | 15850 | AI236795 | b, tt | | EST, Highly similar to HS9B MOUSE HEAT SHOCK PROTEIN HSP 90-BETA [*M. musculus*], EST, Weakly similar to HHMS84 heat shock protein 84 - mouse [*M. musculus*], ESTs, Highly similar to HS9A_HUMAN HEAT SHOCK PROTEIN HSP 90-ALPHA [*H. sapiens*], ESTs, Highly similar to T46243 hypothetical protein |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | DKFZp761K0511.1 [*H. sapiens*], expressed sequence C81438, heat shock 90 kD protein 1, beta, heat shock protein, 84 kDa 1, heat shock protein, 86 kDa 1 |
| 1041 | 643 | AA946439 | c, ii, tt | | EST, Highly similar to HSRT4 histone H4 - rat [*R. norvegicus*], EST, Moderately similar to HSHU4 histone H4 [*H. sapiens*], H4 histone family, member E, *Mus musculus* 10 day old male pancreas cDNA, RIKEN full-length enriched library, clone:1810029H14:histone 4 protein, full insert sequence, *Mus musculus* adult male tongue cDNA, RIKEN full-length enriched library, clone:2310067E17:histone 4 protein, full insert sequence |
| 4097 | 19544 | NM_053982 | h, l, qq | | EST, Highly similar to JC2234 ribosomal protein S15a, cytosolic [validated] - rat [*R. norvegicus*], ESTs, Highly similar to RS1A_HUMAN 40S RIBOSOMAL PROTEIN S15A [*H. sapiens*], *Homo sapiens* cDNA FLJ13026 fis, clone NT2RP3000968, moderately similar to 40S RIBOSOMAL PROTEIN S15A |
| 4097 | 15468 | NM_053982 | h, gg, hh | | EST, Highly similar to JC2234 ribosomal protein S15a, cytosolic [validated] - rat [*R. norvegicus*], ESTs, Highly similar to RS1A_HUMAN 40S RIBOSOMAL PROTEIN S15A [*H. sapiens*], ribosomal protein S15a |
| 4313 | 16963 | NM_147214 | r, ee | | EST, Highly similar to JH0628 caldesmon [*H. sapiens*], ESTs, Highly similar to A38351 phosphoprotein phosphatase 2-alpha regulatory chain [*H. sapiens*], ESTs, Weakly similar to JC5314 00028/cdc2-like kinase associating arginine-serine cyclophilin [*H. sapiens*], *Mus musculus*, Similar to Caldesmon 1, clone MGC:30319 IMAGE:5148205, mRNA, complete cds, RIKEN cDNA 2410004D02 gene, RIKEN cDNA 4833423D12 gene, caldesmon 1, major urinary protein 4, protein phosphatase 2 (formerly 2A), regulatory subunit B (PR 52), alpha isoform |
| 2733 | 11465 | AI236084 | q | | EST, Highly similar to JT0752 lymphocyte activation-induced receptor LA precursor [*H. sapiens*], tumor necrosis factor receptor superfamily, member 9 |
| 547 | 2753 | AA891589 | e | | EST, Highly similar to M2GD_HUMAN DIMETHYLGLYCINE DEHYDROGENASE, MITOCHONDRIAL PRECURSOR [*H. sapiens*], ESTs, Weakly similar to DIMETHYLGLYCINE DEHYDROGENASE PRECURSOR [*R. norvegicus*], RIKEN cDNA 1200014D15 gene, dimethylglycine dehydrogenase precursor, expressed sequence AW495222, hypothetical protein FLJ10079 |
| 4274 | 17684 | NM_139102 | d, h, uu | | EST, Highly similar to M2GD_HUMAN DIMETHYLGLYCINE DEHYDROGENASE, MITOCHONDRIAL PRECURSOR [*H. sapiens*], ESTs, Weakly similar to DIMETHYLGLYCINE DEHYDROGENASE PRECURSOR [*R. norvegicus*], RIKEN cDNA 1200014D15 gene, dimethylglycine dehydrogenase precursor, expressed sequence AW495222, hypothetical protein FLJ 10079, sarcosine dehydrogenase |
| 1322 | 21838 | AI009131 | ee, kk | | EST, Highly similar to MYHA_RAT Myosin heavy chain, nonmuscle type B (Cellular myosin heavy chain, type B) (Nonmuscle myosin heavy chain-B) (NMMHC-B) [*R. norvegicus*], ESTs, Highly similar to MYHA_MOUSE Myosin heavy chain, nonmuscle type B (Cellular myosin heavy |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | chain, type B) (Nonmuscle myosin heavy chain-B) (NMMHC-B) [*M. musculus*], *Homo sapiens* cDNA: FLJ23324 fis, clone HEP12482, highly similar to HUMMYOHCB Human nonmuscle myosin heavy chain-B (MYH10) mRNA, Myosin heavy chain 11, RIKEN cDNA 5730504C04 gene, laminin, gamma 1 |
| 1762 | 21839 | AI071644 | f | | EST, Highly similar to MYHA_RAT Myosin heavy chain, nonmuscle type B (Cellular myosin heavy chain, type B) (Nonmuscle myosin heavy chain-B) (NMMHC-B) [*R. norvegicus*], ESTs, Highly similar to MYHA_MOUSE Myosin heavy chain, nonmuscle type B (Cellular myosin heavy chain, type B) (Nonmuscle myosin heavy chain-B) (NMMHC-B) [*M. musculus*], *Homo sapiens* cDNA: FLJ23324 fis, clone HEP12482, highly similar to HUMMYOHCB Human nonmuscle myosin heavy chain-B (MYH10) mRNA, Myosin heavy chain 11, RIKEN cDNA 5730504C04 gene, laminin, gamma 1 |
| 4473 | 18031 | X94551 | y | | EST, Highly similar to MYHA_RAT Myosin heavy chain, nonmuscle type B (Cellular myosin heavy chain, type B) (Nonmuscle myosin heavy chain-B) (NMMHC-B) [*R. norvegicus*], ESTs, Highly similar to MYHA_MOUSE Myosin heavy chain, nonmuscle type B (Cellular myosin heavy chain, type B) (Nonmuscle myosin heavy chain-B) (NMMHC-B) [*M. musculus*], *Homo sapiens* cDNA: FLJ23324 fis, clone HEP12482, highly similar to HUMMYOHCB Human nonmuscle myosin heavy chain-B (MYH10) mRNA, Myosin heavy chain 11, RIKEN cDNA 5730504C04 gene, laminin, gamma 1 |
| 3602 | 21023 | NM_022599 | h, l, General | | EST, Highly similar to OM25_RAT MITOCHONDRIAL OUTER MEMBRANE PROTEIN 25 (NPW16) [*R. norvegicus*], EST, Weakly similar to OM25_RAT Mitochondrial outer membrane protein 25 (NPW16) [*R. norvegicus*], hypothetical protein FLJ11271, synaptojanin 2 binding protein |
| 4455 | 20844 | X65228 | y, ll | | EST, Highly similar to R3RT3A ribosomal protein L23a, cytosolic [validated] - rat [*R. norvegicus*], EST, Weakly similar to E54024 protein kinase [*H. sapiens*], ESTs, Highly similar to 60S RIBOSOMAL PROTEIN L23A [*R. norvegicus*], ESTs, Highly similar to RL2B_HUMAN 60S RIBOSOMAL PROTEIN L23A [*H. sapiens*], *Mus musculus*, ribosomal protein L23a, clone IMAGE:4988735, mRNA, partial cds, ribosomal protein L23a |
| 649 | 15876 | AA892582 | l, General | | EST, Highly similar to RL8_HUMAN 60S ribosomal protein L8 [*R. norvegicus*], EST, Weakly similar to JN0923 ribosomal protein L8, cytosolic [*H. sapiens*], ESTs, Highly similar to R5RTL8 ribosomal protein L8, cytosolic [validated] - rat [*R. norvegicus*], ESTs, Highly similar to RL8_HUMAN 60S RIBOSOMAL PROTEIN L [*M. musculus*], ESTs, Moderately similar to RL8_HUMAN 60S RIBOSOMAL PROTEIN L [*M. musculus*], expressed sequence AL024098 ribosomal protein L8 |
| 117 | 21665 | AA800272 | e, s | | EST, Highly similar to RM03_RAT Mitochondrial 60S ribosomal protein L3 [*R. norvegicus*], mitochondrial ribosomal protein L3 |
| 2337 | 14910 | AI177631 | z | | EST, Highly similar to 520898 titin [*H. sapiens*], ESTs, Weakly similar to |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 316 | 14324 | AA850402 | n | | 2020397A C protein [*M. musculus*], ESTs, Weakly similar to MYPC MOUSE MYOSIN-BINDING PROTEIN C, CARDIAC-TYPE [*M. musculus*], *Homo sapiens* cDNA FLJ32722 fis, clone TEST12000883, highly similar to MYOSIN-BINDING PROTEIN C, SLOW-TYPE, *Mus musculus*, clone IMAGE:5009820 mRNA partial cds EST, Highly similar to S21348 probable pol polyprotein-related protein 4 - rat [*R. norvegicus*], ESTs, Highly similar to POL2 MOUSE RETROVIRUS-RELATED POL POLYPROTEIN [*M. musculus*], ESTs, Highly similar to S21348 probable pol polyprotein-related protein 4 - rat [*R. norvegicus*], ESTs, Moderately similar to S21348 probable Pol polyprotein-related protein 4 - rat [*R. norvegicus*], *Homo sapiens* cDNA: FLJ22714 fis, clone HSI13646, *Homo sapiens* mRNA; cDNA DKFZp5470014 (from clone DKFZp5470014), Human kpni repeat mrna (cdna clone pcd-kpni-8), 3' end, *Mus musculus*, Similar to hypothetical protein FLJ10134, clone MGC:25912 IMAGE:4221959, mRNA, complete cds, RIKEN cDNA 4933411E06 gene, RIKEN cDNA 6820402119 gene, colon and small intestine-specific cysteine-rich protein precursor, smooth muscle cell-expressed and macrophage conditioned medium- |
| 2566 | 21816 | AI231217 | ee | | EST, Highly similar to S611_HUMAN Protein transport protein Sec61 alpha subunit isoform 1 (Sec61 alpha-1) [*R. norvegicus*], ESTs, Highly similar to S611_HUMAN Protein transport protein Sec61 alpha subunit isoform 1 (Sec61 alpha 1) [*R. norvegicus*], SEC61, alpha subunit (*S. cerevisaie*), SEC61, alpha subunit 2 (*S. cerevisaie*), Sec61 alpha form 2, protein transport protein SEC61 alpha subunit isoform 1 |
| 2398 | 12033 | AI179066 | ee | | EST, Highly similar to SL52_RAT SODIUM/GLUCOSE COTRANSPORTER 2 (NA(+)/GLUCOSE COTRANSPORTER 2) (LOW AFFINITY SODIUM-GLUCOSE COTRANSPORTER) [*R. norvegicus*], ESTs, Highly similar to 1909123A Na glucose cotransporter [*H. sapiens*], ESTs, Moderately similar to SL52_HUMAN SODIUM/GLUCOSE COTRANSPORTER 2 [*H. sapiens*], ESTs, Weakly similar to 1909123A Na glucose cotransporter [*H. sapiens*], *Homo sapiens* cDNA FLJ25217 fis, clone REC08938, highly similar to *Oryctolagus cuniculus* Na+/glucose cotransporter-related protein mRNA, *Homo sapiens*, clone IMAGE:4827595, mRNA, hypothetical protein FLJ13868, solute carrier family 5 (choline transporter), member 7 |
| 686 | 3439 | AA893000 | o | | EST, Highly similar to T00335 hypothetical protein KIAA0564 [*H. sapiens*], K1AA0564 protein |
| 3486 | 16697 | NM_019349 | s | | EST, Highly similar to T34021 protein kinase SK2 - rat [*R. norvegicus*], ESTs, Moderately similar to T14157 serine/threonine protein kinase - mouse [*M. musculus*], *Homo sapiens* CTCL tumor antigen se20-9 mRNA, complete cds, *Mus musculus*, clone MGC:29021 IMAGE:3495957, mRNA, complete cds, Ste20-related serine/threonine kinase, serine/threonine kinase 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3486 | 16698 | NM_019349 | u | | EST, Highly similar to T34021 protein kinase SK2 - rat [*R. norvegicus*], ESTs, Moderately similar to T14157 serine/threonine protein kinase - mouse [*M. musculus*], *Homo sapiens* CTCL tumor antigen se20-9 mRNA, complete cds, *Mus musculus*, clone MGC:29021 IMAGE:3495957, mRNA, complete cds, Ste20-related serine/threonine kinase, serine/threonine kinase 2 |
| 1084 | 25112 | AA956437 | d | | EST, Highly similar to TERA_HUMAN [*H. sapiens*], EST, Moderately similar to PEX1__HUMAN PEROXISOME BIOGENESIS FACTOR 1 [*H. sapiens*], EST, Weakly similar to T46437 hypothetical protein DKFZp434K0126.1 [*H. sapiens*], ESTs, Weakly similar to T46437 hypothetical protein DKFZp434K0126.1 [*H. sapiens*], ESTs, Weakly similar to TERA_MOUSE TRANSITIONAL ENDOPLASMIC RETICULUM ATPASE [*M. musculus*], ESTs, Weakly similar to TERA__RAT TRANSITIONAL ENDOPLASMIC RETICULUM ATPASE (TER ATPASE) (15S MG(2+)-ATPASE P97 SUBUNIT) (VALOSIN CONTAINING PROTEIN) (VCP) [CONTAINS: VALOSIN] [*R. norvegicus*] |
| 3730 | 11899 | NM_031052 | rr | | EST, Moderately similar to mitochondrial intermediate peptidase [*Rattus norvegicus*] [*R. norvegicus*], RIKEN cDNA 5730405E07 gene, mitochondrial intermediate peptidase, thimet oligopeptidase 1 |
| 168 | 23115 | AA801165 | d | | EST, Moderately similar to RIKEN cDNA 1700113O17 [*Mus musculus*] [*M. musculus*], H2A histone family, member L, *Homo sapiens*, clone MGC:21597 IMAGE:451 1035, mRNA, complete cds, *Mus musculus*, similar to H2A histone family, member O, clone MGC:36202 IMAGE:5055276, mRNA, complete cds, expressed sequence R75370 |
| 3760 | 16671 | NM_031125 | tt | | EST, Moderately similar to syntaxin 4 [*Rattus norvegicus*] [*R. norvegicus*], syntaxin 4A (placental) |
| 3765 | 15487 | NM_031137 | q, ww | | EST, Moderately similar to tripeptidylpeptidase II [*Rattus norvegicus*] [*R. norvegicus*], ESTs, Highly similar to TRIPEPTIDYL-PEPTIDASE II [*M. musculus*], tripeptidyl peptidase II |
| 3765 | 15489 | NM_031137 | bb, ll, ww | | EST, Moderately similar to tripeptidylpeptidase II [*Rattus norvegicus*] [*R. norvegicus*], ESTs, Highly similar to TRIPEPTIDYL-PEPTIDASE II [*M. musculus*], tripeptidyl peptidase II |
| 1670 | 14984 | AI059174 | h | | EST, Moderately similar to 0806162B cytochrome b [*M. musculus*], EST, Moderately similar to 810024B cytochrome b [*H. sapiens*], EST, Weakly similar to 0806162B cytochrome b [*M. musculus*], EST, Weakly similar to 0812187A cytochrome b [*Rattus norvegicus*] [*R. norvegicus*], EST, Weakly similar to 810024M URF 6 [*H. sapiens*] |
| 1896 | 14981 | AI103396 | ee | | EST, Moderately similar to 0806162B cytochrome b [*M. musculus*], EST, Moderately similar to 810024B cytochrome b [*H. sapiens*], EST, Weakly similar to 0806162B cytochrome b [*M. musculus*], EST, Weakly similar to 0812187A cytochrome b [*Rattus norvegicus*] [*R. norvegicus*], EST, Weakly similar to 810024M URF 6 [*H. sapiens*] |
| 372 | 14987 | AA858640 | o | | EST, Moderately similar to 0806162B cytochrome b [*M. musculus*], EST, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | Moderately similar to 810024B cytochrome b [*H. sapiens*], EST, Weakly similar to 0806162B cytochrome b [*M. musculus*], EST, Weakly similar to 0812187A cytochrome b [*Rattus norvegicus*] [*R. norvegicus*], EST, Weakly similar to 810024M URF 6 [*H. sapiens*], ESTs, Highly similar to CH60 HUMAN 60 KDA HEAT SHOCK PROTEIN, MITOCHONDRIAL PRECURSOR [*H. sapiens*], ESTs, Moderately similar to CH60 MOUSE 60 KDA HEAT SHOCK PROTEIN, MITOCHONDRIAL PRECURSOR [*M. musculus*], ESTs, Weakly similar to CH60_HUMAN 60 KDA HEAT SHOCK PROTEIN, MITOCHONDRIAL PRECURSOR [*H. sapiens*], heat shock 60 kD protein 1 (chaperonin), heat shock protein, 60 kD |
| 323 | 16132 | AA850885 | ee | | EST, Moderately similar to 0806162C protein COI [*M. musculus*], EST, Moderately similar to 810024C cytochrome oxidase I [*H. sapiens*], EST, Weakly similar to 0806162C protein COI [*M. musculus*], ESTs, Moderately similar to 0806162C protein COI [*M. musculus*], ESTs, Moderately similar to 810024C cytochrome oxidase I [*H. sapiens*], ESTs, Weakly similar to 0806162C protein COI [*M. musculus*] |
| 1310 | 4233 | AI008409 | h | | EST, Moderately similar to 0806162C protein COI [*M. musculus*], EST, Moderately similar to 810024C cytochrome oxidase I [*H. sapiens*], EST, Weakly similar to 0806162C protein COI [*M. musculus*], ESTs, Moderately similar to 0806162C protein COI [*M. musculus*], ESTs, Moderately similar to 810024C cytochrome oxidase I [*H. sapiens*], ESTs, Weakly similar to 0806162C protein COI [*M. musculus*] |
| 3987 | 16133 | NM_053516 | dd, jj | | EST, Moderately similar to 0806162C protein COI [*M. musculus*], EST, Moderately similar to 810024C cytochrome oxidase I [*H. sapiens*], EST, Weakly similar to 0806162C protein COI [*M. musculus*], ESTs, Moderately similar to 0806162C protein COI [*M. musculus*], ESTs, Moderately similar to 810024C cytochrome oxidase I [*H. sapiens*], ESTs, Weakly similar to 0806162C protein COI [*M. musculus*] |
| 408 | 17142 | AA859612 | gg, hh | | EST, Moderately similar to 0806162J protein URF4 [*M. musculus*], EST, Moderately similar to 810024J URF 4 [*H. sapiens*], EST, Weakly similar to 0806162J protein URF4 [*M. musculus*], EST, Weakly similar to 810024J URF 4 [*H. sapiens*], ESTs, Moderately similar to 0806162J protein URF4 [*M. musculus*], ESTs, Moderately similar to 810024J URF 4 [*H. sapiens*], ESTs, Weakly similar to 0806162J protein URE4 [*M. musculus*] |
| 2216 | 23325 | AI172405 | bb | | EST, Moderately similar to 2008109A set gene [*Rattus norvegicus*] [*R. norvegicus*], EST, Moderately similar to SET_HUMAN SET PROTEIN [*H. sapiens*], ESTs, Highly similar to SET_HUMAN SET PROTEIN [*H. sapiens*], ESTs, Moderately similar to 2CD8109A set gene [*Rattus norvegicus*] [*R. norvegicus*], ESTs, Weakly similar to 2CD8109A set gene [*Rattus norvegicus*] [*R. norvegicus*], SET translocation, SET translocation (myeloid leukemia-associated), cutaneous T-cell lymphoma-associated tumor antigen se20-4; |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4070 | 1570 | NM_053857 | k, l, m, General | | differentially expressed nucleolar TGF-beta 1 target protein/DENTT) EST, Moderately similar to 2021415A initiation factor 4E-binding protein:ISOTYPE = 1 [*H. sapiens*], ESTs, Weakly similar to A55258 insulin-stimulated phosphoprotein PHAS-I - rat [*R. norvegicus*], RIKEN cDNA 1110004O12 gene, eukaryotic translation initiation factor 4E binding protein 1, eukaryotic translation initiation factor 4E binding protein 2, eukaryotic translation initiation factor 4E binding protein 3 |
| 4070 | 1571 | NM_053857 | l, m, q, General, dd | | EST, Moderately similar to 2021415A initiation factor 4E-binding protein:ISOTYPE = 1 [*H. sapiens*], ESTs, Weakly similar to A55258 insulin-stimulated phosphoprotein PHAS-I - rat [*R. norvegicus*], RIKEN cDNA 1110004O12 gene, eukaryotic translation initiation factor 4E binding protein 1, eukaryotic translation initiation factor 4E binding protein 2, eukaryotic translation initiation factor 4E binding protein 3 |
| 4448 | 15387 | X62482 | h, gg, hh | | EST, Moderately similar to 40S RIBOSOMAL PROTEIN S25 [*R. norvegicus*], EST, Moderately similar to R3RT25 ribosomal protein S25, cytosolic [validated] - rat [*R. norvegicus*], EST, Weakly similar to 40S RIBOSOMAL PROTEIN S25 [*R. norvegicus*], EST, Weakly similar to JQ1347 ribosomal protein S25, cytosolic [*H. sapiens*], ESTs, Highly similar to JQ1347 ribosomal protein S25, cytosolic [*H. sapiens*], ribosomal protein S25 |
| 3767 | 15185 | NM_031140 | s, ii | | EST, Moderately similar to A25074 vimentin [*H. sapiens*], EST, Weakly similar to A25074 vimentin [*H. sapiens*], ESTs, Weakly similar to A25074 vimentin [*H. sapiens*], *Mus musculus*, similar to FLJ00074 protein, clone MGC:36549 IMAGE:4952810, mRNA, complete cds, desmuslin, intermediate filament-like MGC:2625, vimentin |
| 1802 | 1501 | AI072634 | e, l, t, bb, dd, ww | | EST, Moderately similar to A40452 keratin 21, type I, cytoskeletal - rat [*R. norvegicus*], ESTs, Weakly similar to A40452 keratin 21 type I, cytoskeletal - rat [*R. norvegicus*], RIKEN cDNA 9030623O06 gene, Rat cytokeratin 21 mRNA, complete cds, keratin 18, keratin complex 1, acidic, gene 18 |
| 3455 | 1386 | NM_019226 | d | | EST, Moderately similar to A49019 dynein heavy chain, cytosolic [*H. sapiens*], ESTs, Weakly similar to DYHC_MOUSE DYNEIN HEAVY CHAIN, CYTOSOLIC (DYHC) (CYTOPLASMIC DYNEIN HEAVY CHAIN) [*M. musculus*], *Homo sapiens* cDNA FLJ13685fis, clone PLACE2000039, highly similar to DYNEIN HEAVY CHAIN, CYTOSOLIC, *Homo sapiens* cDNA FLJ32360 fis, clone PROST2009022, dynein, axon, heavy chain 11, dynein, axonemal, heavy polypeptide 11, dynein, cytoplasmic, heavy chain 1, dynein, cytoplasmic, heavy polypeptide 1, hypothetical protein FLJ11756 |
| 1548 | 23949 | AI031019 | q | | EST, Moderately similar to A55146 guanine nucleotide exchange factor eIF-2B delta chain, long form - mouse [*M. musculus*], ESTs, Moderately similar to E2BA_HUMAN TRANSLATION INITIATION FACTOR EIF-2B ALPHA SUBUNIT [*H. sapiens*], ESTs, Weakly similar to 2112359A initiation factor eIF-2B [*Rattus norvegicus*] [*R. norvegicus*], *Mus musculus*, Similar to eukaryotic translation initiation factor 2B, subunit 1 (alpha, 26 kD), clone MGC:6458 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | IMAGE:2615801, mRNA, complete cds, *Mus musculus*, Similar to eukaryotic translation initiation factor 2B, subunit 2 (beta, 39 kD), clone MGC:7057 IMAGE:3156632, mRNA, complete cds, RIKEN cDNA 2410018C20 gene, eukaryotic translation initiation factor 2B, subunit 1 (alpha, 26 kD) |
| 1548 | 23950 | AI031019 | n, q, x, ll | | EST, Moderately similar to A55146 guanine nucleotide exchange factor eIF-2B delta chain, long form - mouse [*M. musculus*], ESTs, Moderately similar to E2BAg_HUMAN TRANSLATION INITIATION FACTOR EIF-2B ALPHA SUBUNIT [*H. sapiens*], ESTs, Weakly similar to 2112359A initiation factor eIF-2B [*Rattus norvegicus*] [*R. norvegicus*], *Mus musculus*, Similar to eukaryotic translation initiation factor 2B, subunit 1 (alpha, 26 kD), clone MGC:6458 IMAGE:2615801, mRNA, complete cds, *Mus musculus*, Similar to eukaryotic translation initiation factor 2B, subunit 2 (beta, 39 kD), clone MGC:7057 IMAGE:3156632, mRNA, complete cds, RIKEN cDNA 2410018C20 gene, eukaryotic translation initiation factor 2B, subunit 1 (alpha, 26 kD) |
| 2320 | 14384 | AI177096 | e | | EST, Moderately similar to APT_RAT ADENINE PHOSPHORIBOSYLTRANSFERASE (APRT) [*R. norvegicus*], adenine phosphoribosyl transferase, adenine phosphoribosyltransferase, expressed sequence C85684 |
| 4322 | 7789 | NM_153630 | d | | EST, Moderately similar to CCAD MOUSE VOLTAGE-DEPENDENT L-TYPE CALCIUM CHANNEL ALPHA-1D SUBUNIT [*M. musculus*], ESTs, Moderately similar to T17101 probable voltage-activated cation channel - rat [*R. norvegicus*], ESTs, Weakly similar to CCAD MOUSE VOLTAGE-DEPENDENT L-TYPE CALCIUM CHANNEL ALPHA-1D SUBUNIT [*M. musculus*], *Homo sapiens* cDNA: FLJ22153 fis, clone HRC00149, *Mus musculus* sperm ion channel mRNA, complete cds, RIKEN cDNA 8430418G19 gene, calcium channel, voltage-dependent, L type, alpha 1D subunit, novel protein (ortholog of rat four repeat ion channel) |
| 2229 | 7740 | AI175011 | vv | | EST, Moderately similar to COF1_HUMAN COFILIN, NON-MUSCLE ISOFOR [*H. sapiens*], EST, Weakly similar to COF1 HUMAN COFILIN, NON-MUSCLE ISOFOR [*H. sapiens*], ESTs, Highly similar to DEST_HUMAN DESTRIN [*H. sapiens*], ESTs, Moderately similar to COF1_HUMAN COFILIN, NON-MUSCLE ISOFOR [*H. sapiens*], *Homo sapiens* cDNA FLJ30934 fis, clone FEBRA2007017, moderately similar to *Homo sapiens* TRAF4-associated factor 2 mRNA |
| 3490 | 23226 | NM_019360 | v, y, gg, hh | | EST, Moderately similar to COXI_MOUSE Cytochrome c oxidase polypeptide VIC-2 [*R. norvegicus*], ESTs, Moderately similar to COXH_HUMAN CYTOCHROME C OXIDASE POLYPEPTIDE VIC PRECURSOR [*H. sapiens*], cytochrome c oxidase subunit VIc, cytochrome c oxidase, subunit VIc |
| 4386 | 15516 | U68544 | b | | EST, Moderately similar to CYPM_RAT Peptidyl-prolyl cis-trans isomerase, mitochondrial precursor (PPIase) (Rotamase) (Cyclophilin F) [*R. norvegicus*], |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | ESTs, Highly similar to CYPH MOUSE PEPTIDYL-PROLYL CIS-TRANS ISOMERASE A [*M. musculus*], ESTs, Weakly similar to CYPM__RAT Peptidyl-prolyl cis-trans isomerase, mitochondrial precursor (PPIase) (Rotamase) (Cyclophilin F) [*R. norvegicus*], RIKEN cDNA 2510026K04 gene, RIKEN cDNA 4930520F12 gene, expressed sequence AI256741, expressed sequence AW457192, peptidylprolyl isomerase A, peptidylprolyl isomerase E (cyclophilin E), peptidylprolyl isomerase F (cyclophilin F) |
| 2588 | 24501 | AI232006 | m | | EST, Moderately similar to EF1D__HUMAN ELONGATION FACTOR 1-DELTA [*H. sapiens*], ESTs, Moderately similar to EF1D__HUMAN ELONGATION FACTOR 1-DELTA [*H. sapiens*], hypothetical protein FLJ20897 |
| 3271 | 21396 | NM__013198 | k, jj | | EST, Moderately similar to FIG1 MOUSE FIG-1 PROTEIN PRECURSOR [*M. musculus*], RIKEN cDNA 1110061B18 gene, RIKEN cDNA 4930438A08 gene, expressed sequence AI482520, expressed sequence AW990848, interleukin-four induced gene 1, monoamine oxidase B |
| 3164 | 20945 | NM__012875 | gg, hh | | EST, Moderately similar to G02654 ribosomal protein L39 [*H. sapiens*], EST, Moderately similar to RL39__HUMAN 60S ribosomal protein L39 [*Rnorvegicus*], ESTs, Highly similar to G02654 ribosomal protein L39 [*H. sapiens*], ESTs, Moderately similar to G02654 ribosomal protein L39 [*H. sapiens*], RIKEN cDNA 2810465O16 gene, RIKEN cDNA 3930402I10 gene, RIKEN cDNA 4930517K11 gene, ribosomal protein L39, ribosomal protein L39-like |
| 4348 | 17626 | S78556 | qq | | EST, Moderately similar to GR75__HUMAN MITOCHONDRIAL STRESS-70 PROTEIN PRECURSOR [*H. sapiens*], ESTs, Highly similar to I56581 dnaK-type molecular chaperone grp75 precursor - rat [*R. norvegicus*], ESTs, Moderately similar to GR75__HUMAN MITOCHONDRIAL STRESS 70 PROTEIN PRECURSOR [*H. sapiens*], heat shock 70 kD protein 9B (mortalin-2), heat shock protein 74 kDa A |
| 3231 | 24607 | NM__013075 | n | | EST, Moderately similar to HXA1__RAT Homeobox protein Hox-A1 [*R. norvegicus*], homeo box A1, homeo box B1, homeo box D1 |
| 3278 | 1495 | NM__013221 | f, General, qq, vv | | EST, Moderately similar to I58311 HMG-box containing protein 1 - rat [*R. norvegicus*], ESTs, Highly similar to I58311 HMG-box containing protein 1 - rat [*R. norvegicus*], ESTs, Moderately similar to 158311 HMG-box containing protein 1 - rat [*R. norvegicus*], HMG-box containing protein 1, *Mus musculus*, Similar to protein kinase, lysine deficient 4, clone IMAGE:4973225, mRNA, partial cds, RIKEN cDNA 1200010B10 gene, RIKEN cDNA 1700058O05 gene |
| 3278 | 18230 | NM__013221 | r | | EST, Moderately similar to I58311 HMG-box containing protein 1 - rat [*R. norvegicus*], ESTs, Highly similar to I58311 HMG-box containing protein 1 - rat [*R. norvegicus*], HMG-box containing protein 1, RIKEN cDNA 1700058O05 gene |
| 2785 | 3489 | AI237620 | n | | EST, Moderately similar to I75615 mammary tumor integration site 6 oncogene protein - mouse [*M. musculus*], EST, Weakly similar to IF36__HUMAN EUKARYOTIC TRANSLATION INITIATION FACTOR 3 SUBUNIT 6 [*H. sapiens*], ESTs, Moderately |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | similar to IF36_HUMAN EUKARYOTIC TRANSLATION INITIATION FACTOR 3 SUBUNIT 6 [*H. sapiens*], eukaryotic translation initiation factor 3, subunit 6 (48 kD), mammary tumor integration site 6 |
| 4087 | 1029 | NM_053953 | mm | | EST, Moderately similar to IL1S MOUSE INTERLEUKIN-1 RECEPTOR, TYPE II PRECURSOR [*M. musculus*], interleukin 1 receptor, type II, lymphocyte-activation gene 3 |
| 3426 | 24732 | NM_019130 | g | | EST, Moderately similar to INS2_RAT Insulin 2 precursor [*R. norvegicus*], ESTs, Moderately similar to INS2 MOUSE INSULIN 2 PRECURSOR [*M. musculus*], expressed sequence M986540, insulin, insulin II |
| 710 | 4678 | M893384 | v | | EST, Moderately similar to IRF3_HUMAN INTERFERON REGULATORY FACTOR 3 [*H. sapiens*], ESTs, Moderately similar to IRF3 MOUSE INTERFERON REGULATORY FACTOR 3 [*M. musculus*], ESTs, Weakly similar to IRF3 MOUSE INTERFERON REGULATORY FACTOR 3 [*M. musculus*], interferon regulatory factor 3 |
| 1515 | 4679 | AI029847 | General | | EST, Moderately similar to IRF3_HUMAN INTERFERON REGULATORY FACTOR 3 [*H. sapiens*], ESTs, Moderately similar to IRF3 MOUSE INTERFERON REGULATORY FACTOR 3 [*M. musculus*], ESTs, Weakly similar to IRF3 MOUSE INTERFERON REGULATORY FACTOR 3 [*M. musculus*], interferon regulatory factor 3 |
| 3565 | 22412 | NM_022392 | f, p, s, General, ee, ff | | EST, Moderately similar to ISI1_RAT Insulin-induced protein 1 (Insulin-induced growth response protein CL-6) (Immediate-early protein CL-6) [*R. norvegicus*], RIKEN cDNA 2900053I11 gene, insulin induced gene 1, insulin induced protein 2 |
| 3565 | 22413 | NM_022392 | a, f, p, General, ee, ff, qq | | EST, Moderately similar to ISI1_RAT Insulin-induced protein 1 (Insulin-induced growth response protein CL-6) (Immediate-early protein CL-6) [*R. norvegicus*], RIKEN cDNA 2900053I11 gene, insulin induced gene 1, insulin induced protein 2 |
| 3565 | 22414 | NM_022392 | ff | | EST, Moderately similar to ISI1_RAT Insulin-induced protein 1 (Insulin-induced growth response protein CL-6) (Immediate-early protein CL-6) [*R. norvegicus*], RIKEN cDNA 2900053I11 gene, insulin induced gene 1, insulin induced protein 2 |
| 3565 | 22415 | NM_022392 | p. General, ff | | EST, Moderately similar to ISI1_RAT Insulin induced protein 1 (Insulin-induced growth response protein CL-6) (Immediate-early protein CL-6) [*R. norvegicus*], RIKEN cDNA 2900053I11 gene, insulin induced gene 1, insulin induced protein 2 |
| 1101 | 12479 | AA957557 | a, vv | | EST, Moderately similar to ITH3_RAT Inter-alpha-trypsin inhibitor heavy chain H3 precursor (ITI heavy chain H3) [*R. norvegicus*], hypothetical protein MG010848, inter-alpha trypsin inhibitor, heavy chain 1, inter-alpha trypsin inhibitor, heavy chain 3, pre-alpha (globulin) inhibitor, H3 polypeptide, pre-alpha-1inhibitor, heavy chain 3 |
| 3419 | 537 | NM_017351 | h, ss, uu | | EST, Moderately similar to ITH3_RAT Inter-alpha-trypsin inhibitor heavy chain H3 precursor (ITI heavy chain H3) [*R. norvegicus*], inter-alpha (globulin) inhibitor, H1 polypeptide, inter-alpha (globulin) inhibitor, H2 polypeptide, inter-alpha trypsin inhibitor, heavy chain 1, inter-alpha trypsin inhibitor, heavy chain 3, pre-alpha (globulin) inhibitor H3 polypeptide |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1918 | 4402 | AI103874 | kk | | EST, Moderately similar to JQ1522 peptidylprolyl isomerase [*H. sapiens*], ESTs, Moderately similar to I61 3455A FK506 binding protein FKBP [*H. sapiens*], FK506 binding protein 3 (25 kD), FK506 binding protein 7, FK506 binding protein 9 (63 kD), FK506 binding protein precursor, hypothetical protein FLJ20731 |
| 4257 | 18867 | NM_138900 | b, h, General, dd, rr | | EST, Moderately similar to MAS2_HUMAN MANNAN-BINDING LECTIN SERINE PROTEASE 2 PRECURSOR [*H. sapiens*], ESTs, Moderately similar to CRAR_HUMAN COMPLEMENT-ACTIVATING COMPONENT OF RA-REACTIVE FACTOR PRECURSOR [*H. sapiens*], *Mus musculus*, Similar to complement component 1, s subcomponent, clone MGC:19094 IMAGE:4196654, mRNA, complete cds, *Mus musculus*, Similar to complement component 1, s subcomponent, clone MGC:28492 IMAGE:4166254, mRNA, complete cds, complement component 1, subcomponent, complement component 1, s subcomponent, mannan-binding lectin serine protease 2 |
| 3772 | 164 | NM_031151 | v | | EST, Moderately similar to MDHM_RAT MALATE DEHYDROGENASE, MITOCHONDRIAL PRECURSOR [*R. norvegicus*], EST, Weakly similar to DEMSMM malate dehydrogenase [*M. musculus*], malate dehydrogenase 2, NAD (mitochondrial), malate dehydrogenaase mitochondrial |
| 537 | 16037 | AA891441 | j | | EST, Moderately similar to MPL3 RAT MICROTUBULE-ASSOCIATED PROTEINS 1A/1B LIGHT CHAIN 3 [*R. norvegicus*], ESTs, Highly similar to MPL3_HUMAN Microtubule-associated proteins 1A/1B light chain 3 (MAP1A/MAP1B LC3) [*H. sapiens*], ESTs, Moderately similar to MPL3 RAT MICROTUBULE-ASSOCIATED PROTEINS 1A/1B LIGHT CHAIN 3 [*R. norvegicus*], GABA(A) receptor-associated protein like 1, GABA(A) receptor-associated protein-like 2, GABA(A) receptors associated protein like 3, microtubule-associated protein 1 light chain 3 alpha, microtubule-associated proteins 1A/1B light chain 3 |
| 3986 | 23558 | NM_053507 | General | | EST, Moderately similar to NDK3_MOUSE NUCLEOSIDE DIPHOSPHATE KINASE 3 (NDK 3) (NDP KINASE 3) (NM23-M3) (DR-NM23) [*M. musculus*], expressed in non-metastatic cells 3, expressed in non-metastatic cells 4, protein (NM23-M4)(nucleoside diphosphate kinase), expressed sequence AI413736, non-metastatic cells 3, protein expressed in, non-metastic cells 4, protein expressed in non-matastatic cells 4 |
| 2218 | 18498 | AI172452 | m, ii, ll, uu | | EST, Moderately similar to OSHU7L cytochrome-c oxidase [*H. sapiens*], ESTs, Weakly similar to COXJ_RAT Cytochrome c oxidase polypeptide VIIa-liver/heart, mitochondrial precursor (Cytochrome c oxidase subunit VIIa-L) [*R. norvegicus*] |
| 2607 | 18497 | AI232307 | c | | EST, Moderately similar to OSHU7L cytochrome-c oxidase [*H. sapiens*], ESTs, Weakly similar to COXJ_RAT Cytochrome c oxidase polypeptide VIIa-liver/heart, mitochondrial precursor (Cytochrome c oxidase subunit VIIa-LI [*R. norvegicus*] |
| 3389 | 17715 | NM_017274 | ss, xx | | EST, Moderately similar to PLSB MOUSE GLYCEROL-3-PHOSPHATE ACYLTRANSFERASE, MITOCHONDRIAL |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | PRECURSOR [*M. musculus*], EST, Weakly similar to PLSB_RAT GLYCEROL-3-PHOSPHATE ACYLTRANSFERASE, MITOCHONDRIAL PRECURSOR (GPAT) [*R. norvegicus*], ESTs, Weakly similar to GLYCEROL-3-PHOSPHATE ACYLTRANSFERASE PRECURSOR [*M. musculus*], ESTs, Weakly similar to PLSB MOUSE GLYCEROL-3-PHOSPHATE ACYLTRANSFERASE, MITOCHONDRIAL PRECURSOR [*M. musculus*], KIAA1560 protein, glycerol-3-phosphate acyltransferase, mitochondrial |
| 3389 | 20282 | NM_017274 | y | | EST, Moderately similar to PLSB MOUSE GLYCEROL-3-PHOSPHATE ACYLTRANSFERASE, MITOCHONDRIAL PRECURSOR [*M. musculus*], EST, Weakly similar to PLSB_RAT GLYCEROL-3-PHOSPHATE ACYLTRANSFERASE, MITOCHONDRIAL PRECURSOR (GPAT) [*R. norvegicus*], ESTs, Weakly similar to GLYCEROL-3-PHOSPHATE ACYLTRANSFERASE PRECURSOR [*M. musculus*], ESTs, Weakly similar to PLSB MOUSE GLYCEROL-3-PHOSPHATE ACYLTRANSFERASE, MITOCHONDRIAL PRECURSOR [*M. musculus*], KIAA1560 protein, glycerol-3-phosphate acyltransferase, mitochondrial |
| 189 | 9840 | M817964 | g | | EST, Moderately similar to PON1_RAT Serum paraoxonase/arylesterase 1 (PON 1) (Serum aryldiakylphosphatase 1) (A-esterase 1) (Aromatic esterase 1) [*R. norvegicus*], EST, Weakly similar to PON1_RAT Serum paraoxonase/arylesterase 1 (PON 1) (Serum aryldiakylphosphatase 1) (A-esterase 1) (Aromatic esterase 1) [*R. norvegicus*], *Homo sapiens* cDNA FLJ30126 fis, clone BRACE1000114, paraoxonase 1, paraoxopase 2 |
| 4400 | 9841 | U94856 | w | | EST, Moderately similar to PON1_RAT Serum paraoxonase/arylesterase 1 (PON 1) (Serum aryldiakylphosphatase 1) (A-esterase 1) (Aromatic esterase 1) [*R. norvegicus*], EST, Weakly similar to PON1_RAT Serum paraoxonase/arylesterase 1 (PON 1) (Serum aryldiakylphosphatase 1) (A-esterase 1) (Aromatic esterase 1) [*R. norvegicus*], *Homo sapiens* cDNA FLJ30126 fis, clone BRACE1000114, paraoxonase 1, paraoxopase 2 |
| 4400 | 9842 | U94856 | pp | | EST, Moderately similar to PON1_RAT Serum paraoxonase/arylesterase 1 (RON 1) (Serum aryldiakylphosphatase 1) (A-esterase 1) (Aromatic esterase 1) [*R. norvegicus*], EST, Weakly similar to PON1_RAT Serum paraoxonase/arylesterase 1 (PON 1) (Serum aryldiakylphosphatase 1) (A-esterase 1) (Aromatic esterase 1) [*R. norvegicus*], *Homo sapiens* cDNA FLJ30126 fis, clone BRACE1000114, paraoxonase 1, paraoxopase 2 |
| 2085 | 1335 | AI169105 | ss | | EST, Moderately similar to PON1_RAT Serum paraoxonase/arylesterase 1 (RON 1) (Serum aryldiakylphosphatase 1) (A-esterase 1) (Aromatic esterase 1) [*R. norvegicus*], ESTs, Moderately similar to PON2_HUMAN SERUM PARAOXONASE/ARYLESTERASE 2 [*H. sapiens*], *Homo sapiens* cDNA FLJ30126 fis, clone BRACE1000114, *Mus musculus*, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 201 | 6016 | AA818163 | x | | Similar to paraoxonase 2, clone MGC:11614 IMAGE:3154583, mRNA, complete cds, paraoxonase 1, paraoxonase 2 EST, Moderately similar to PON1_RAT Serum paraoxonase/arylesterase 1 (RON 1) (Serum aryldiakylphosphatase 1) (A-esterase 1) (Aromatic esterase 1) [*R. norvegicus*], *Homo sapiens* cDNA FLJ30126 fis, clone BRACE1000114, expressed sequence AI786302, paraoxonase 1, paraoxopase 2 |
| 533 | 9136 | AA891226 | rr, tt | | EST, Moderately similar to PSB5_RAT Proteasome subunit beta type 5 precursor (Proteasome epsilon chain) (Macropain epsilon chain) (Multicatalytic endopeptidase complex epsilon chain) (Proteasome subunit X) (Proteasome chain 6) [*R. norvegicus*], RIKEN cDNA 5830406J20 gene, proteasome (prosome, macropain) subunit, beta type 5, proteasome (prosome, macropain) subunit beta type 5 |
| 4260 | 18082 | NM_138907 | nn | | EST, Moderately similar to PTE2_HUMAN PEROXISOMAL ACYL COENZYME A THIOESTER HYDROLASE 2 (PEROXISOMAL LONG CHAIN ACYL-COA THIOESTERASE 2) (ZAP128) [*H. sapiens*], ESTs, Weakly similar to MTE1_RAT Acyl coenzyme A thioester hydrolase, mitochondrial precursor (Very-long-chain acyl-CoA thioesterase) (MTE-I) [*R. norvegicus*], ESTs, Weakly similar to PTE2_HUMAN PEROXISOMAL ACYL-COENZYME A THIOESTER HYDROLASE 2 (PEROXISOMAL LONG-CHAIN ACYL-COA THIOESTERASE 2) (ZAP128) [*H. sapiens*], *Homo sapiens* cDNA FLJ31235 fis, clone KIDNE2004681, moderately similar to *Mus musculus* peroxisomal long chain acyl-CoA thioesterase 1b (Pte1b) gene, *Mus musculus*, Similar to bile acid Coenzyme A: amino acid N-acyltransferase (glycine N-choloyltransferase), clone MGC:19156 IMAGE:4220620, mRNA, complete cds, mitochondrial acyl-CoA thioesterase 1, peroxisomal long-chain acyl-coA thioesterase |
| 4260 | 18083 | NM_138907 | m, o, jj, nn, xx | | EST, Moderately similar to PTE2_HUMAN PEROXISOMAL ACYL-COENZYME A THIOESTER HYDROLASE 2 (PEROXISOMAL LONG-CHAIN ACYL-COA THIOESTERASE 2) (ZAP128) [*H. sapiens*], ESTs, Weakly similar to MTE1_RAT Acyl coenzyme A thioester hydrolase, mitochondrial precursor (Very-long-chain acyl-CoA thioesterase) (MTE-I) [*R. norvegicus*], ESTs, Weakly similar to PTE2_HUMAN PEROXISOMAL ACYL-COENZYME A THIOESTER HYDROLASE 2 (PEROXISOMAL LONG-CHAIN ACYL-COATHIOESTERASE 2) (ZAP128) [*H. sapiens*], *Homo sapiens* cDNA FLJ31235 fis, clone KIDNE2004681, moderately similar to *Mus musculus* peroxisomal long chain acyl-CoA thioesterase 1b (Pte1b) gene, *Mus musculus*, Similar to bile acid Coenzyme A: amino acid N-acyltransferase (glycine N-choloyltransferase), clone MGC:19156 IMAGE:4220620, mRNA, complete cds, mitochondrial acyl-CoA thioesterase 1, peroxisomal long-chain acyl-coA thioesterase |
| 2624 | 5602 | AI232611 | o, ff, xx | | EST, Moderately similar to PTE2_HUMAN PEROXISOMAL ACYL-COENZYME A THIOESTER HYDROLASE 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | (PEROXISOMAL LONG-CHAIN ACYL-COA THIOESTERASE 2) (ZAP128) [*H. sapiens*], ESTs, Weakly similar to PTE2_HUMAN PEROXISOMAL ACYL-COENZYME A THIOESTER HYDROLASE 2 (PEROXISOMAL LONG-CHAIN ACYL-COA THIGESTERASE 2) (ZAP128) [*H. sapiens*], *Homo sapiens* CDNA FLJ31235 fis, clone KIDNE2004681, moderately similar to *Mus musculus* peroxisomal long chain acyl-CoA thioesterase 1b (Pte1b) gene, *Mus musculus*, Similar to cytosolic acyl-CoA thioesterase 1, clone MGC:27572 IMAGE:4485973, mRNA, complete cds, RIKEN cDNA 4632408A20 gene, expressed sequence AW108394, mitochondrial acyl-CoA thioesterase 1, peroxisomal acyl-CoA thioesterase 2A, peroxisomal acyl-CoA thioesterase 2B, peroxisomal long-chain acyl-coA thioesterase |
| 3132 | 1478 | NM_012744 | kk | | EST, Moderately similar to PYC_RAT Pyruvate carboxylase, mitochondrial precursor (Pyruvic carboxylase) (PCB) [*R. norvegicus*], *Mus musculus*, Similar to Propionyl Coenzyme A carboxylase, alpha polypeptide, clone MGC:11973 IMAGE:3601148, mRNA, complete cds, pyruvate carboxylase, pyruvate decarboxylase |
| 1591 | 18205 | AI044836 | h | | EST, Moderately similar to RBM8_HUMAN PUTATIVE RNA-BINDING PROTEIN 8 [*H. sapiens*], ESTs, Moderately similar to NUCLEOLIN [*M. musculus*], ESTs, Moderately similar to RBM8_HUMAN PUTATIVE RNA-BINDING PROTEIN 8 [*H. sapiens*], ESTs, Weakly similar to NUCL_HUMAN NUCLEOLIN [*H. sapiens*], *Homo sapiens*, clone MGC:22221 IMAGE:4687764, mRNA, complete cds, *Mus musculus*, Similar to fusion, derived from t(12;16) malignant liposarcoma, clone MGC:18917 IMAGE:3153860, mRNA, complete cds, Nucleolin, RNA binding motif protein 8A, TAFiS RNA polymerase II, TATA box binding protein (TBP)-associated factor, 68 kDa, eukaryotic translation initiation factor 3, subunit 4 (delta, 44 kDa), nucleolin, pigpen |
| 2155 | 18535 | AI170979 | dd, oo | | EST, Moderately similar to REQN_MOUSE ZINC-FINGER PROTEIN NEURO-D4 [*M. musculus*], Neuro-d4 (rat) homolog, PHD zinc finger protein XAP135, isoform b, RIKEN cDNA 1600012H06 gene, RIKEN cDNA 1810055P05 gene, expressed sequence C78788, neuro-d4, neuronal d4 domain family member |
| 2641 | 4442 | AI233163 | gg, hh | | EST, Moderately similar to RL11_HUMAN 60S RIBOSOMAL PROTEIN L11 [*H. sapiens*], EST, Moderately similar to RL11_HUMAN 60S ribosomal protein L11 [*R. norvegicus*], EST, Weakly similar to RL11_HUMAN 60S RIBOSOMAL PROTEIN L11 [*H. sapiens*], ESTs, Highly similar to RIKEN cDNA 20i0203Ji9 [*Mus musculus*] [*M. musculus*], ESTs, Moderately similar to RL11_HUMAN 60S RIBOSOMAL PROTEIN L11 [*H. sapiens*], RIKEN cDNA 2010203J19 gene, ribosomal protein L11 |
| 4446 | 4441 | X62146 | ee | | EST, Moderately similar to RL11_HUMAN 60S RIBOSOMAL PROTEIN L11 [*H. sapiens*], EST, Moderately similar to RL11_HUMAN 60S ribosomal protein L11 [*R. norvegicus*], EST, Weakly similar to RL11 HUMAN 60S RIBOSOMAL PROTEIN |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | L11 [*H. sapiens*], ESTs, Highly similar to RIKEN cDNA 2010203J19 [*Mus musculus*] [*M. musculus*], ESTs, Moderately similar to RL11_HUMAN 60S RIBOSOMAL PROTEIN L11 [*H. sapiens*], RIKEN cDNA 2010203J19 gene, ribosomal protein L11 |
| 3215 | 17174 | NM_013030 | gg, hh | | EST, Moderately similar to RL17_HUMAN 60S RIBOSOMAL PROTEIN L17 [*H. sapiens*], EST, Weakly similar to RL17 RAT 60S RIBOSOMAL PROTEIN L17 [*R. norvegicus*], EST, Weakly similar to RL17_HUMAN 60S RIBOSOMAL PROTEIN L17 [*H. sapiens*], ESTs, Highly similar to R5HU22 ribosomal protein L17, cytosolic [*H. sapiens*], ESTs, Highly similar to RL17 RAT 60S RIBOSOMAL PROTEIN L17 [*R. norvegicus*], ESTs, Weakly similar to R5HU22 ribosomal protein L17, cytosolic [*H. sapiens*], *Mus musculus* adult female placenta cDNA, RIKEN full-length enriched library, clone:1 600029O15:hexokinase 1, full insert sequence, ribosomal protein L17 |
| 4438 | 17175 | X58389 | rr | | EST, Moderately similar to RL17_HUMAN 60S RIBOSOMAL PROTEIN L17 [*H. sapiens*], EST, Weakly similar to RL17 RAT 60S RIBOSOMAL PROTEIN L17 [*R. norvegicus*], EST, Weakly similar to RL17_HUMAN 60S RIBOSOMAL PROTEIN L17 [*H. sapiens*], ESTs, Highly similar to R5HU22 ribosomal protein L17, cytosolic [*H. sapiens*], ESTs, Highly similar to RL17 RAT 60S RIBOSOMAL PROTEIN L17 [*R. norvegicus*], ESTs, Weakly similar to R5HU22 ribosomal protein L17, cytosolic [*H. sapiens*], *Mus musculus* adult female placenta cDNA, RIKEN full-length enriched library, clone:1600029O15:hexokinase i, full insert sequence, ribosomal protein L17 |
| 2094 | 18641 | AI169225 | ee | | EST, Moderately similar to RL35_HUMAN 60S RIBOSOMAL PROTEIN L3 [*H. sapiens*], EST, Moderately similar to RL35_RAT 60S RIBOSOMAL PROTEIN L35 [*R. norvegicus*], *Homo sapiens*, clone IMAGE:4183312, mRNA, partial cds, ribosomal protein L35 |
| 3015 | 17211 | M34331 | ee, ll | | EST, Moderately similar to RL35_HUMAN 60S RIBOSOMAL PROTEIN L3 [*H. sapiens*], EST, Moderately similar to RL35_RAT 60S RIBOSOMAL PROTEIN L35 [*R. norvegicus*], *Homo sapiens*, clone IMAGE:4183312, mRNA, partial cds, ribosomal protein L35 |
| 3015 | 26030 | M34331 | bb, ll | | EST, Moderately similar to RL35_HUMAN 60S RIBOSOMAL PROTEIN L3 [*H. sapiens*], EST, Moderately similar to RL35_RAT 60S RIBOSOMAL PROTEIN L35 [*R. norvegicus*], *Homo sapiens*, clone IMAGE:4183312, mRNA, partial cds, ribosomal protein L35 |
| 3868 | 16918 | NM_031709 | x, z, ee, gg, hh, ll | | EST, Moderately similar to RS12_HUMAN 40S RIBOSOMAL PROTEIN S1 [*H. sapiens*], ESTs, Moderately similar to R3HU12 ribosomal protein S12, cytosolic [*H. sapiens*], ESTs, Moderately similar to RS12 MOUSE 40S RIBOSOMAL PROTEIN S12 [*M. musculus*], ribosomal protein S12 |
| 3908 | 10267 | NM_031838 | h | | EST, Moderately similar to RS2 MOUSE 40S RIBOSOMAL PROTEIN S2 [*M. musculus*], EST, Weakly similar to ribosomal protein S2; 40S ribosomal protein S2 [*Homo sapiens*] [*H. sapiens*], EST, Weakly similar to RS2_HUMAN 40S RIBOSOMAL PROTEIN S2 [*H. sapiens*], EST, Weakly similar to RS2_RAT 40S RIBOSOMAL PROTEIN S2 [*R. norvegicus*], ESTs, Highly similar to ribosomal protein S2; 40S ribosomal protein S2 [*Homo* |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | sapiens] [H. sapiens], ESTs, Highly similar to ribosomal protein S2; repeat family 3 gene [Mus musculus] [M. musculus], Homo sapiens, clone IMAGE:4816496, mRNA, partial cds, ribosomal protein S2 |
| 3908 | 10269 | NM_031838 | w | | EST, Moderately similar to RS2_MOUSE 40S RIBOSOMAL PROTEIN S2 [M. musculus], EST Weakly similar to ribosomal protein S2 40S ribosomal protein S2 [Homo sapiens] [H. sapiens], EST, Weakly similar to RS2_HUMAN 40S RIBOSOMAL PROTEIN S2 [H. sapiens], EST, Weakly similar to RS2_RAT 40S RIBOSOMAL PROTEIN S2 [R. norvegicus], ESTs, Highly similar to ribosomal protein 52; 40S ribosomal protein S2 [Homo sapiens] [H. sapiens], ESTs, Highly similar to ribosomal protein S2; repeat family 3 gene [Mus musculus] [M. musculus], Homo sapiens, clone IMAGE:4816496, mRNA, partial cds, ribosomal protein S2 |
| 3756 | 19161 | NM_031111 | j, ee | | EST, Moderately similar to RS21_RAT 40S RIBOSOMAL PROTEIN S21 [R. norvegicus], ribosomal protein S21 |
| 1333 | 10820 | AI009411 | ee | | EST, Moderately similar to RS3_MOUSE 40S ribosomal protein S3 [R. norvegicus], EST, Weakly similar to RS3_MOUSE 40S ribosomal protein S3 [R. norvegicus], ESTs, Highly similar to RS3_MOUSE 40S ribosomal protein S3 [R. norvegicus], ESTs, Moderately similar to RS3_HUMAN 40S RIBOSOMAL PROTEIN S [H. sapiens], ESTs, Weakly similar to RS3 MOUSE 40S RIBOSOMAL PROTEIN S3 [M. musculus], hypothetical protein FLJ11252, hypothetical protein FLJ23059, myo-inositol 1-phosphate synthase A1, ribosomal protein S3 |
| 621 | 13647 | AA892367 | z, General, ii, rr | | EST, Moderately similar to S34195 ribosomal protein L3, cytosolic [H. sapiens], EST, Weakly similar to S34195 ribosomal protein L3, cytosolic [H. sapiens], ESTs, Highly similar to S34195 ribosomal protein L3, cytosolic [H. sapiens], ESTs, Moderately similar to RL3_RAT 60S RIBOSOMAL PROTEIN L3 (L4) [R. norvegicus], ESTs, Weakly similar to RL3 MOUSE 60S RIBOSOMAL PROTEIN L3 [M. musculus], RIKEN cDNA 1110057H16 gene, ribosomal protein L3, ribosomal protein L3-like |
| 4447 | 13646 | X62166 | l, m, s, z, General, bb, cc, ii, qq, rr | | EST, Moderately similar to S34195 ribosomal protein L3, cytosolic [H. sapiens], EST, Weakly similar to S34195 ribosomal protein L3, cytosolic [H. sapiens], ESTs, Highly similar to S34195 ribosomal protein L3, cytosolic [H. sapiens], ESTs, Moderately similar to RL3_RAT 60S RIBOSOMAL PROTEIN L3 (L4) [R. norvegicus], ESTs, Weakly similar to RL3 MOUSE 603 RIBOSOMAL PROTEIN L3 [M. musculus], RIKEN cDNA 1110057H16 gene, ribosomal protein L3, ribosomal protein L3-like |
| 667 | 6951 | AA892820 | bb | | EST, Moderately similar to S70642 ubiquitin ligase Nedd4 - rat (fragment) [R. norvegicus], ESTs, Highly similar to S70642 ubiquitin ligase Nedd4 - rat (fragment) [R. norvegicus], ESTs, Moderately similar to S70642 ubiquitin ligase Nedd4 - rat (fragment) [R. norvegicus], ESTs, Weakly similar to NED4 MOUSE NEDD-4 PROTEIN [M. musculus], neural precursor cell expressed, developmentally down-regulated 4, neural precursor cell expressed, developmentally down-regulated gene 4a |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2278 | 15191 | AI176456 | t, w | | EST, Moderately similar to SMHU1E metallothionein 1E [*H. sapiens*], ESTs, Highly similar to SMHU1B metallothionein 1B [*H. sapiens*], *H. sapiens*mRNA for metallothionein isoform 1R, *Homo sapiens* metallothionein 1H-like protein mRNA, complete cds, *Homo sapiens* unknown mRNA, *Homo sapiens,* Similar to RNA helicase-related protein, clone MGC:9246 IMAGE:3892441, mRNA, complete cds, *Mus musculus,* metallothionein 2A, clone MGC:30400 IMAGE:4501155, mRNA, complete cds, metallothionein 1H, metallothionein 1X, metallothionein 2 |
| 1281 | 3896 | AF077000 | m | | EST, Moderately similar to T14756 hypothetical protein DKFZp564F0923.1 [*H. sapiens*], ESTs, Weakly similar to S57447 HPBRII-7 protein [*H. sapiens*], ESTs, Weakly similar to T14355 protein-tyrosine-phosphatase (EC 3.1.3.48) TD14 - rat [*R. norvegicus*], ESTs, Weakly similar to T14355 protein-tyrosine-phosphatase [*R. norvegicus*], *Homo sapiens* cDNA FLJ13094 fis, clone NT2RP3002163, RIKEN cDNA 6030468B19 gene, expressed sequence AI462446, guanine nucleotide binding protein 13, gamma, protein tyrosine phosphatase, non-receptor type 2, protein tyrosine phosphatase, non-receptor type 23, tankyrase 1-binding protein of 182 kDa |
| 4281 | 22970 | NM_139254 | c, d, u | | EST, Moderately similar to TBB3_HUMAN TUBULIN BETA-3 CHAIN [*H. sapiens*], ESTs, Highly similar to T08726 tubulin beta chain [*H. sapiens*], ESTs, Highly similar to TBB1_RAT TUBULIN BETA CHAIN (T BETA-15) [*R. norvegicus*], ESTs, Highly similar to TBB2_HUMAN TUBULIN BETA-2 CHAIN [*H. sapiens*], RIKEN cDNA 2410129E14 gene, RIKEN cDNA 4930447K03 gene, RIKEN cDNA 4930542G03 gene, Rat mRNA for beta-tubulin T beta15, expressed sequence AI451582, expressed sequence C79445, tubulin beta 5, tubulin beta 4 |
| 199 | 6526 | AA818118 | gg, hh | | EST, Moderately similar to TIAR_HUMAN NUCLEOLYSIN TIAR [*H. sapiens*], *Mus musculus* adult male tongue cDNA, RIKEN full-length enriched library, clone:2310074E15:RNA binding motif protein 3, full insert sequence, RIKEN cDNA 2310050N03 gene, RIKEN cDNA 3100004P22 gene, RNA binding motif protein 3, TIA1 cytotoxic granule-associated RNA binding protein-like 1, cold inducible RNA binding protein, cold inducible RNA-binding protein, cytotoxic granule-associated RNA binding protein 1 |
| 483 | 21589 | AA875084 | y, nn | | EST, Moderately similar to TLE4_HUMAN TRANSDUCIN-LIKE ENHANCER PROTEIN 4 [*H. sapiens*], ESTs, Highly similar to TLE4 MOUSE TRANSDUCIN-LIKE ENHANCER PROTEIN 4 [*M. musculus*], KIAA1547 protein, RIKEN cDNA 5730411M05 gene, expressed sequence M792082, hypothetical protein FLJ14009, transducin-like enhancer of split 1, homolog of *Drosophila* E(sp1), transducin-like enhancer of split 4 (E(sp1) homolog, *Drosophila*), transducin-like enhancer of split 4, E(sp1) homolog (*Drosophila*) |
| 2006 | 11735 | AI136540 | j | | EST, Moderately similar to TRT3_RAT Troponin T, fast skeletal muscle isoforms beta/alpha (Beta/alpha TnTF) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | [*R. norvegicus*], troponin T1, skeletal, slow, troponin T3, skeletal, fast |
| 4414 | 19584 | X13905 | General, mm | | EST, Moderately similar to TVRTYP GTP-binding protein Rab1 - rat [*R. norvegicus*], ESTs, Moderately similar to RAS-RELATED PROTEIN RAB-1A [*M. musculus*], RAB1B, member RAS oncogene family, RAB33B, member RAS oncogene family |
| 124 | 9089 | AA800389 | d | | EST, Moderately similar to Zfp71 gene [*M. musculus*], ESTs, Moderately similar to S00754 zinc finger protein kox25 [*H. sapiens*], ESTs, Weakly similar to A48157 renal transcription factor Kid-1- rat [*R. norvegicus*], ESTs, Weakly similar to Z189__HUMAN ZINC FINGER PROTEIN 189 [*H. sapiens*], ESTs, Weakly similar to Z225__HUMAN ZINC FINGER PROTEIN 225 [*H. sapiens*], ESTs, Weakly similar to ZINC FINGER PROTEIN ZFP-1 [*M. musculus*], *Homo sapiens* cDNA FLJ11734 fis, clone HEMBA1005443, RIKEN cDNA 9030409018 gene, zinc finger protein 180 |
| 4091 | 16546 | NM__053965 | o, ii | | EST, Weakly similar to carnitine/acylcarnitine translocase; mitochondrial carnitine-acylcarnitine translocase gene [*Mus musculus*] [*M. musculus*], ESTs, Weakly similar to solute carrier family 25 (carnitine/acylcarnitine translocase), member 20 [*Rattus norvegicus*] [*R. norvegicus*], ESTs, Weakly similar to MCAT__HUMAN MITOCHONDRIAL CARNITINE/ACYLCARNITINE CARRIER PROTEIN [*H. sapiens*], *Homo sapiens*, similar to solute carrier family 25 (carnitine/acylcarnitine translocase), member 20, clone MGC:35539 IMAGE:5200129, mRNA, complete cds, *Mus musculus*, Similar to CG4995 gene product, clone MGC:7958 IMAGE:3584570, mRNA, complete cds, expressed sequence AW491445, expressed sequence W51672, ornithine transporter 2, solute carrier family 25 (carnitine/acylcarnitine translocase), member 20, solute carrier family 25 (mitochondrial carnitine/acylcarnitine translocase), member 20, solute carrier family 25 (mitochondrial carrier; adenine nucleotide translocator), member 3, solute carrier family 25 (mitochondrial carrier; ornithine transporter) member 15 |
| 4091 | 16547 | NM__053965 | o | | EST, Weakly similar to carnitine/acylcarnitine translocase; mitochondrial carnitine-acylcarnitine translocase gene [*Mus musculus*] [*M. musculus*], ESTs, Weakly similar to solute carrier family 25 (carnitine/acylcarnitine translocase), member 20 [*Rattus norvegicus*] [*R. norvegicus*], ESTs, Weakly similar to MCAT__HUMAN MITOCHONDRIAL CARNITINE/ACYLCARNITINE CARRIER PROTEIN [*H. sapiens*], *Homo sapiens*, similar to solute carrier family 25 (carnitine/acylcarnitine translocase), member 20, clone MGC:35539 IMAGE:5200129, mRNA, complete cds, *Mus musculus*, Similar to CG4995 gene product, clone MGC:7958 IMAGE:3584570, mRNA, complete cds, expressed sequence AW491445, expressed sequence W51672, ornithine transporter 2, solute carrier family 25 (carnitine/acylcarnitine translocase), |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | member 20, solute carrier family 25 (mitochondrial carnitine/acylcarnitine translocase), member 20, solute carrier family 25 (mitochondrial carrier; adenine nucleotide translocator), member 3, solute carrier family 25 (mitochondrial carrier; ornithine transporter) member 15 |
| 4010 | 20902 | NM_053593 | cc | | EST, Weakly similar to cyclin-dependent kinase 4 [*Rattus norvegicus*] [*R. norvegicus*], ESTs, Moderately similar to cyclin-dependent kinase 4 [*Rattus norvegicus*] [*R. norvegicus*], ESTs, Moderately similar to CDK4 MOUSE CELL DIVISION PROTEIN KINASE 4 [*M. musculus*], cyclin-dependent kinase 4, cyclin-dependent kinase 6 |
| 2469 | 21505 | AI228005 | bb | | EST, Weakly similar to deoxycytidine kinase [*Rattus norvegicus*] [*R. norvegicus*], deoxycytidine kinase, deoxyguanosine kinase |
| 3598 | 20820 | NM_022593 | u | | EST, Weakly similar to elongation factor SIII p15 subunit [*Rattus norvegicus*] [*R. norvegicus*], ESTs, Weakly similar to elongation factor SIII p15 subunit [*Rattus norvegicus*] [*R. norvegicus*], transcription elongation factor B (SIII), polypeptide 1 (15 kD elongin C) |
| 4123 | 15839 | NM_057143 | bb, kk | | EST, Weakly similar to fertility protein SP22 [*Rattus norvegicus*] [*R. norvegicus*], RNA binding protein regulatory subunit, RNA-binding protein regulatory subunit |
| 631 | 9254 | AA892470 | j, q, nn, oo | | EST, Weakly similar to histone H2A.F/Z variant [*Homo sapiens*] [*H. sapiens*], ESTs, Weakly similar to H2AZ_HUMAN HISTONE H2A [*H. sapiens*], H2A histone family, member Z, *Homo sapiens* cDNA FLJ32241 fis, clone PLACE6005231, RIKEN cDNA C530002L11 gene, histone H2A.FIZ variant |
| 34 | 16942 | AA799520 | ee | | EST, Weakly similar to integral membrane protein 2B [*Homo sapiens*] [*H. sapiens*], integral membrane protein 2B |
| 3504 | 904 | NM_019620 | d, n, gg, hh, kk, tt | | EST, Weakly similar to Kruppel associated box (KRAB) zinc finger 1 [*Rattus norvegicus*] [*R. norvegicus*], EST, Weakly similar to ZINC FINGER PROTEIN 91 [*H. sapiens*], ESTs, Moderately similar to DNA-binding protein; zinc finger protein 253 [*Homo sapiens*] [*H. sapiens*], ESTs, Moderately similar to ZINC FINGER PROTEIN 91 [*H. sapiens*], *Mus musculus*, Similar to RIKEN cDNA 2610036F08 gene, clone MGC:28645 IMAGE:4224834, mRNA, complete cds, expressed sequence AI790734, expressed sequence AU021768, zinc finger protein 386 (Kruppel-like), zinc finger protein 91 (HPF7, HTF10) |
| 3639 | 21491 | NM_022951 | tt | | EST, Weakly similar to proline rich protein 2 [*Mus musculus*] [*M. musculus*], EST, Weakly similar to ZAP3_MOUSE Nuclear protein ZAP3 [*M. musculus*], ESTs, Weakly similar to proline rich protein 2 [*Mus musculus*] [*M. musculus*], expressed sequence AA408880, pantothenate kinase, proline rich protein 2, protein phosphatase 1, regulatory subunit 10 |
| 91 | 20811 | AA799899 | ee | | EST, Weakly similar to ribosomal protein L18a; 60S ribosomal protein L18a [*Homo sapiens*] [*H. sapiens*], ESTs, Highly similar to ribosomal protein L18a; 60S ribosomal protein L18a [*Homo sapiens*] [*H. sapiens*] |
| 4415 | 20810 | X14181 | l | | EST, Weakly similar to ribosomal protein L18a; 60S ribosomal protein L18a [*Homo sapiens*] [*H. sapiens*], ESTs, Highly similar to ribosomal protein L18a; 60S ribosomal protein L18a [*Homo sapiens*] [*H. sapiens*] |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 562 | 18269 | AA891769 | z | | EST, Weakly similar to SC65 synaptonemal complex protein [*Rattus norvegicus*] [*R. norvegicus*], ESTs, Weakly similar to SC65 synaptonemal complex protein [*Rattus norvegicus*] [*R. norvegicus*], SC65 synaptonemal complex protein cartilage associated protein, growth suppressor 1, nucleolar autoantigen (55 kD) similar to rat synaptonemal complex protein |
| 1709 | 8590 | AI060207 | nn | | EST, Weakly similar to splicing factor 3b, subunit 1, 155 kDa [*Mus musculus*] [*M. musculus*], ESTs, Weakly similar to S3B1_HUMAN Splicing factor 3B subunit 1 (Spliceosome associated protein 155) (SAP 155) (SF3b155) (Pre-mRNA splicing factor SF3b 155 kDa subunit) [*H. sapiens*], splicing factor 3b, subunit 1, 155 kDa, splicing factor 3b subunit 1, 155 kD |
| 4127 | 18122 | NM_057208 | ee | | EST, Weakly similar to tropomyosin 3, gamma [*Rattus norvegicus*] [*R. norvegicus*], ESTs, Highly similar to TPMN_HUMAN TROPOMYOSIN, CYTOSKELETAL TYPE [*H. sapiens*], ESTs, Moderately similar to TROPOMYOSIN 5, CYTOSKELETAL TYPE [*M. musculus*] |
| 165 | 21415 | AA800948 | l, mm | | EST, Weakly similar to 0812252A tubulin alpha [*Rattus norvegicus*] [*R. norvegicus*], ESTs, Moderately similar to 0812252A tubulin alpha [*Rattus norvegicus*] [*R. norvegicus*], tubulin, alpha 1 (testis specific), tubulin, alpha 4, tubulin, alpha 8 |
| 873 | 21010 | AA925306 | o | | EST, Weakly similar to 1701410A choline acetyltransferase [*Rattus norvegicus*] [*R. norveciicus*], carnitine acetyltransferase |
| 439 | 19332 | AA860014 | e | | EST, Weakly similar to 2206405A hemoglobin:SUBUNIT = zeta [*Rattus norvegicus*] [*R. norvegicus*], ESTs, Highly similar to 2206405A hemoglobin:SUBUNIT = zeta [*Rattus norvegicus*] [*R. norvegicus*], ESTs, Moderately similar to HZHU hemoglobin zeta chain [*H. sapiens*], cytoglobin, hemoglobin X, alpha-like embryonic chain in Hba complex, hemoglobin, zeta |
| 4433 | 24577 | X55153 | h, v, General | | EST, Weakly similar to 60S ACIDIC RIBOSOMAL PROTEIN P2 [*R. norvegicus*], EST, Weakly similar to R6HUP2 acidic ribosomal protein P2, cytosolic [*H. sapiens*], ESTs, Highly similar to MTJ1 MOUSE DNAJ PROTEIN HOMOLOG MTJ1 [*M. musculus*], ESTs, Weakly similar to RLA1 MOUSE 60S ACIDIC RIBOSOMAL PROTEIN P1 [*M. musculus*], *Homo sapiens* cDNA FLJ31504 fis, clone NT2NE2005804, weakly similar to 60S ACIDIC RIBOSOMAL PROTEIN P2, expressed sequence AI255964, ribosomal protein, large, P1 |
| 4092 | 15135 | NM_053971 | w | | EST, Weakly similar to 60S RIBOSOMAL PROTEIN L6 [*M. musculus*], ESTs, Weakly similar to 60S RIBOSOMAL PROTEIN L6 [*M. musculus*], ribosomal protein L6 |
| 4092 | 15136 | NM_053971 | h | | EST, Weakly similar to 60S RIBOSOMAL PROTEIN L6 [*M. musculus*], ESTs, Weakly similar to 60S RIBOSOMAL PROTEIN L6 [*M. musculus*], ribosomal protein L6 |
| 158 | 22025 | AA800849 | ss | | EST, Weakly similar to 810024L URF 5 [*H. sapiens*], *Homo sapiens* cDNA FLJ10784 fis, clone NT2RP4000448, highly similar to *Homo sapiens* mRNA; cDNA DKFZp566G0746, RIKEN cDNA 3830414F09 gene |
| 461 | 16029 | AA874803 | ss | | EST, Weakly similar to 810024L URF 5 [*H. sapiens*], *Homo sapiens* cDNA FLJ10784 fis, clone NT2RP4000448, highly similar to |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 995 | 22029 | AA945284 | dd | | *Homo sapiens* mRNA; cDNA DKFZp566G0746, RIKEN cDNA 3830414F09 gene EST, Weakly similar to 810024L URF 5 [*H. sapiens*], *Homo sapiens* cDNA FLJ10784 fis, clone NT2RP4000448, highly similar to *Homo sapiens* mRNA; cDNA DKFZp566G0746, RIKEN cDNA 3830414F09 gene |
| 1388 | 22030 | AI011177 | n | | EST, Weakly similar to 810024L URF 5 [*H. sapiens*], *Homo sapiens* cDNA FLJ10784 fis, clone NT2RP4000448, highly similar to *Homo sapiens* mRNA; cDNA DKFZp566G0746, RIKEN cDNA 3830414F09 gene |
| 2028 | 11270 | AI137480 | nn | | EST, Weakly similar to A29149 proline-rich protein - mouse [*M. musculus*], EST, Weakly similar to B Chain B, Solution Structure Of Cdc42 In Complex With The Gtpase Binding Domain Of Wasp {SUB 230-288 [*H. sapiens*], EST, Weakly similar to PRP1_HUMAN SALIVARY PROLINE-RICH PROTEIN PRECURSOR [*H. sapiens*], EST, Weakly similar to S10889 proline-rich protein [*H. sapiens*], EST, Weakly similar to S22373 proline-rich protein - mouse [*M. musculus*], *Homo sapiens* cDNA FLJ30428 fis, clone BRACE2008941, Kruppel-like factor 2 (lung) |
| 3711 | 1538 | NM_031012 | k, mm | | EST, Weakly similar to A32852 membrane alanyl aminopeptidase (EC 3.4.11.2) - rat [*R. norvegicus*], ESTs, Weakly similar to AMPN MOUSE AMINOPEPTIDASE N [*M. musculus*], RIKEN cDNA 2010111I01 gene, RIKEN cDNA 4833403I15 gene, alanyl (membrane) aminopeptidase, alanyl (membrane) aminopeptidase (aminopeptidase N, aminopeptidase M, microsomal aminopeptidase CD13, p150) |
| 3711 | 1540 | NM_031012 | n, dd, ee | | EST, Weakly similar to A32852 membrane alanyl aminopeptidase (EC 3.4.11.2) - rat [*R. norvegicus*], ESTs, Weakly similar to AMPN MOUSE AMINOPEPTIDASE N [*M. musculus*], RIKEN cDNA 2010111I01 gene, RIKEN cDNA 4833403I15 gene, alanyl (membrane) aminopeptidase, alanyl (membrane) aminopeptidase (aminopeptidase N, aminopeptidase M, microsomal aminopeptidase CD13, p150) |
| 1400 | 3995 | AI011678 | l, jj | | EST Weakly similar to A33880 syndecan 2 [*H. sapiens*], *Mus musculus*, clone IMAGE:4983756, mRNA, partial cds, syndecan 2, syndecan 2 (heparan sulfate proteoglycan 1, cell surface-associated, fibroglycan) |
| 3234 | 1529 | NM_013082 | b, e, h, l, General | | EST, Weakly similar to A33880 syndecan 2 [*H. sapiens*], *Mus musculus*, clone IMAGE:4983756, mRNA, partial cds, syndecan 2, syndecan 2 (heparan sulfate proteoglycan 1, cell surface-associated, fibroglycan) |
| 1072 | 17540 | AA955914 | f, pp | | EST, Weakly similar to A38712 fibrillarin [*H. sapiens*], EST, Weakly similar to FBRL MOUSE FIBRILLARIN [*M. musculus*], ESTs, Moderately similar to FIBRILLARIN [*M. musculus*], expressed sequence AL022665, fibrillarin |
| 3610 | 24442 | NM_022667 | u, General, rr | | EST, Weakly similar to A41120 prostaglandin transporter - rat [*R. norvegicus*], ESTs, Weakly similar to JC7286 liver-specific organic anion transporter-1 - mouse [*M. musculus*], ESTs, Weakly similar to PGT_HUMAN PROSTAGLANDIN TRANSPORTER |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1017 | 22680 | AA945883 | j | | [H. sapiens], expressed sequence AI060904, solute carrier family 21 (organic anion transporter), member 11, solute carrier family 21 (organic anion transporter), member 12, solute carrier family 21 (prostaglandin transporter), member 2 |
| 1871 | 7379 | AI102643 | d, dd, rr | | EST, Weakly similar to A43932 mucin 2 precursor, intestinal [H. sapiens], ESTs, Weakly similar to A43932 mucin 2 precursor, intestinal [H. sapiens], Homo sapiens mRNA for FLJ00219 protein, hepatitis A virus cellular receptor 1, mucin 5, subtype B, tracheobronchial, mucin 5, subtypes A and C, tracheobronchial/nastric |
| 3682 | 13633 | NM_024403 | w | | EST, Weakly similar to A45017 transcription factor ISGF3 gamma chain [H. sapiens], ESTs, Moderately similar to A45017 transcription factor ISGF3 gamma chain [H. sapiens] |
| 3682 | 13634 | NM_024403 | r, w, z, General, ee, rr | | EST, Weakly similar to A45377 transcription factor ATF4 [H. sapiens], ESTs, Highly similar to A45377 transcription factor ATF4 [H. sapiens], activating transcription factor 4, activating transcription factor 4 (tax-responsive enhancer element B67), activating transcription factor 5 |
| 4034 | 6784 | NM_053671 | v | | EST, Weakly similar to A45377 transcription factor ATF4 [H. sapiens], ESTs, Highly similar to A45377 transcription factor ATF4 [H. sapiens], activating transcription factor 4, activating transcription factor 4 (tax-responsive enhancer element B67), activating transcription factor 5 |
| 882 | 22125 | AA925503 | ss | | EST, Weakly similar to A47212 transcription factor TMF, TATA element modulatory factor [H. sapiens], ESTs, Highly similar to MYHA_MOUSE Myosin heavy chain, nonmuscle type B (Cellular myosin heavy chain, type B) (Nonmuscle myosin heavy chain-B) (NMMHC-B) [M. musculus], ESTs, Weakly similar to MYHA_MOUSE Myosin heavy chain, nonmuscle type B (Cellular myosin heavy chain, type B) (Nonmuscle myosin heavy chain-B) (NMMHC-B) [M. musculus], RIKEN cDNA 2400004E04 gene, RIKEN cDNA 5730504C04 gene, TATA element modulatory factor 1, myosin heavy chain IX |
| 4170 | 505 | NM_133309 | ss | | EST, Weakly similar to A48045 ribosomal protein S27, cytosolic [H. sapiens], ESTs, Highly similar to A48045 ribosomal protein S27, cytosolic [H. sapiens], ribosomal protein S27 (metallopanstimulin 1), ribosomal protein 527-like |
| 1255 | 18192 | AF000899 | s, tt | | EST, Weakly similar to A48764 calpain (EC 3.4.22.17) large chain 2, tissue-specific - rat [R. norvegicus], ESTs, Moderately similar to A Chain A, The Crystal Structure Of Calcium Free Human M-Calpain [H. sapiens], ESTs, Weakly similar to A Chain A, The Crystal Structure Of Calcium-Free Human M-Calpain [H. sapiens], ESTs, Weakly similar to A31218 calpain [H. sapiens], calpain 2, (m/II) large subunit, grancalcin, EF-hand calcium binding protein, stomach-specific calpain (nCL-2) |
| | | | | | EST, Weakly similar to A56573 nuclear pore complex glycoprotein p62 - mouse [M. musculus], Mus musculus, clone IMAGE:5148310, mRNA, RIKEN cDNA 1700017F11 gene, melanoma antigen, family D, 3, nucleoporin 98, nucleoporin 98 kD, nucleoporin p45, plasma membrane associated protein, S3-12 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4459 | 588 | X69834 | a, ii, rr | | EST, Weakly similar to AACT_HUMAN ALPHA-1-ANTICHYMOTRYPSIN PRECURSOR [*H. sapiens*], *Mus musculus* adult male pituitary gland cDNA, RIKEN full-length enriched library, clone:5330437D01:serine protease inhibitor 2-1, full insert sequence, kallikrein binding protein |
| 3803 | 3292 | NM_031531 | dd | | EST, Weakly similar to MCT_HUMAN ALPHA-1-ANTICHYMOTRYPSIN PRECURSOR [*H. sapiens*], RIKEN cDNA 4833409F13 gene, serine protease inhibitor 2-2 |
| 3018 | 17145 | M38566 | b, qq | | EST, Weakly similar to AACT_HUMAN ALPHA-1-ANTICHYMOTRYPSIN PRECURSOR [*H. sapiens*], serine (or cysteine) proteinase inhibitor, clade F (alpha-2 antiplasmin, pigment epithelium derived factor), member 2, serine protease inhibitor 2-2 |
| 3101 | 17147 | NM_012657 | e, n, r, ii | | EST, Weakly similar to AACT_HUMAN ALPHA-1-ANTICHYMOTRYPSIN PRECURSOR [*H. sapiens*], serine (or cysteine) proteinase inhibitor, clade F (alpha 2 antiplasmin, pigment epithelium derived factor), member 2, serine protease inhibitor 2-2 |
| 3101 | 17148 | NM_012657 | r, ii | | EST, Weakly similar to AACT_HUMAN ALPHA-1-ANTICHYMOTRYPSIN PRECURSOR [*H. sapiens*], serine (or cysteine) proteinase inhibitor, clade F (alpha 2 antiplasmin, pigment epithelium derived factor), member 2, serine protease inhibitor 2-2 |
| 4478 | 17146 | Y07534 | b, qq | | EST, Weakly similar to AACT_HUMAN ALPHA-1-ANTICHYMOTRYPSIN PRECURSOR [*H. sapiens*], serine (or cysteine) proteinase inhibitor, clade F (alpha 2 antiplasmin, pigment epithelium derived factor), member 2, serine protease inhibitor 2-2 |
| 1020 | 18110 | AA945932 | u | | EST, Weakly similar to ANXA_HUMAN ANNEXIN XI [*H. sapiens*], annexin A10, annexin A3 |
| 1294 | 22332 | AI007748 | ff | | EST, Weakly similar to B32891 finger protein 2, placental [*H. sapiens*], ESTs, Highly similar to OZF_HUMAN ZINC FINGER PROTEIN OZF [*H. sapiens*], ESTs, Weakly similar to B32891 finger protein 2, placental [*H. sapiens*], ESTs, Weakly similar to MKR2 PROTEIN [*M. musculus*], ESTs, Weakly similar to OZF_HUMAN ZINC FINGER PROTEIN OZF [*H. sapiens*], Pancreas zinc finger protein, see also D1Bda10\2, zinc finger protein 260, zinc finger protein 63 |
| 639 | 13160 | AA892531 | f, pp | | EST, Weakly similar to B36298 proline-rich protein PRB3S [*H. sapiens*], EST, Weakly similar to CGHU3B collagen alpha 3(IV) chain precursor, long splice form [*H. sapiens*], EST, Weakly similar to D40750 proline-rich protein PRB1/2S [*H. sapiens*], EST, Weakly similar to PIHUB6 salivary proline-rich protein precursor PRB1 [*H. sapiens*], EST, Weakly similar to PRP1_HUMAN SALIVARY PROLINE-RICH PROTEIN PRECURSOR [*H. sapiens*], EST, Weakly similar to PRP2 MOUSE PROLINE-RICH PROTEIN MP-2 PRECURSOR [*M. musculus*], EST, Weakly similar to PRPL_HUMAN SALIVARY PROLINE-RICH PROTEIN PO [*H. sapiens*], ESTs, Weakly similar to PRP2 MOUSE PROLINE-RICH PROTEIN MP-2 PRECURSOR |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2873 | 9866 | AJ005424 | ss | | [*M. musculus*], *Mus musculus* brain cDNA, clone MNCb-3966, RIKEN cDNA 1110020C13 gene, proline rich protein, proline-rich protein BstNI subfamily 1 EST, Weakly similar to B36298 proline-rich protein PRB3S [*H. sapiens*], EST, Weakly similar to CGHU3B collagen alpha 3(IV) chain precursor, long splice form [*H. sapiens*], EST, Weakly similar to D40750 proline-rich protein PRB1/2S [*H. sapiens*], EST, Weakly similar to PIHUB6 salivary proline-rich protein precursor PRB1 [*H. sapiens*], EST, Weakly similar to PRP1_HUMAN SALIVARY PROLINE-RICH PROTEIN PRECURSOR [*H. sapiens*], mitogen-activated protein kinase 7 |
| 2873 | 9867 | AJ005424 | tt | | EST, Weakly similar to 636298 proline-rich protein PRB3S [*H. sapiens*], EST, Weakly similar to CGHU3B collagen alpha 3(IV) chain precursor, long splice form [*H. sapiens*], EST, Weakly similar to D40750 proline-rich protein PRB1/2S [*H. sapiens*], EST, Weakly similar to PIHUB6 salivary proline-rich protein precursor PRB1 [*H. sapiens*], EST, Weakly similar to PRP1_HUMAN SALIVARY PROLINE-RICH PROTEIN PRECURSOR [*H. sapiens*], mitogen-activated protein kinase 7 |
| 3766 | 17378 | NM_031138 | q | | EST, Weakly similar to 841222 ubiquitin--protein ligase [*H. sapiens*], ESTs, Highly similar to ubiquitin conjugating enzyme [*Rattus norvegicus*] [*R. norvegicus*], ESTs, Highly similar to A41222 ubiquitin--protein ligase [*H. sapiens*], ESTs, Moderately similar to 841222 ubiquitin--protein ligase [*H. sapiens*], ESTs, Weakly similar to UBC2_HUMAN UBIQUITIN-CONJUGATING ENZYME E2-17 KD [*M. musculus*], RIKEN cDNA 2610301N02 gene, expressed sequence AI327276, ubiquitin-conjugating enzyme E2A (RAD6 homolog), ubiquitin-conjugating enzyme E2A, RAD6 homolog (*S. cerevisiae*), ubiquitin-conjugating enzyme E2B (RAD6 homolog), ubiquitin-conjugating enzyme E2B, RAD6 homology (*S. cerevisiae*), ubiquitin-conjugating enzyme E2B |
| 3766 | 17379 | NM_031138 | General | | EST, Weakly similar to B41222 ubiquitin--protein ligase [*H. sapiens*], ESTs, Highly similar to ubiquitin conjugating enzyme [*Rattus norvegicus*] [*R. norvegicus*], ESTs, Highly similar to A41 222 ubiquitin--protein ligase [*H. sapiens*], ESTs, Moderately similar to 841222 ubiquitin--protein ligase [*H. sapiens*], ESTs, Weakly similar to UBC2_HUMAN UBIQUITIN-CONJUGATING ENZYME E2-17 KD [*M. musculus*], RIKEN cDNA 2610301N02 gene, expressed sequence AI327276, ubiquitin-conjugating enzyme E2A (RAD6 homolog), ubiquitin-conjugating enzyme E2A, RAD6 homolog (*S. cerevisiae*), ubiquitin-conjugating enzyme E2B (RAD6 homolog), ubiquitin-conjugating enzyme E2B, RAD6 homology (*S. cerevisiae*), E2B, RAD6 homology (*S. cerevisiae*), |
| 1120 | 2205 | AA963808 | t | | EST, Weakly similar to B54857 transcription factor NF-AT 90K chain [*H. sapiens*], ESTs, Moderately similar to zinc finger RNA binding protein [*Mus musculus*] [*M. musculus*], KIAA1086 protein, expressed sequence AW045600, interleukin enhancer binding factor 3, 90 kD, spermatid |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4358 | 2010 | U05675 | y, vv | | perinuclear RNA binding protein, zinc finger RNA binding protein EST, Weakly similar to beta-fibrinogen precursor [*H. sapiens*], ESTs, Moderately similar to ANL2__MOUSE Angiopoietin-related protein 2 precursor (Angiopoietin-like 2) [*M. musculus*], ESTs, Weakly similar to FIBB__RAT Fibrinogen beta chain precursor [Contains: Fibrinopeptide B] [*R. norvegicus*], *Mus musculus*, Similar to angiopoietin-related protein 5, clone MGC:32467 IMAGE:5049765, mRNA, complete cds, *Mus musculus*, Similar to fibrinogen-like 1, clone MGC:37822 IMAGE:5098805, mRNA, complete cds, angiopoietin-like 2, expressed sequence AI593246 |
| 946 | 2762 | AA944165 | c | | EST, Weakly similar to C10 MOUSE PUTATIVE C10 PROTEIN [*M. musculus*], hypothetical protein BC009925 |
| 1145 | 2326 | M964892 | ii | | EST, Weakly similar to CA14__HUMAN COLLAGEN ALPHA 1(IV) CHAIN PRECURSO [*H. sapiens*], procollagen, type IV, alpha 1, procollagen, type IV, alpha 5 |
| 2851 | 18338 | AI639422 | g | | EST, Weakly similar to CAQC__RAT CALSEQUESTRIN, CARDIAC MUSCLE ISOFORM PRECURSOR [*R. norvegicus*], ESTs, Highly similar to CAQS MOUSE CALSEQUESTRIN, SKELETAL MUSCLE ISOFORM PRECURSOR [*M. musculus*], calsequestrin 1, calsequestrin 1 (fast-twitch, skeletal muscle), calsequestrin 2, calsequestrin 2 (cardiac muscle) |
| 358 | 14292 | AA851791 | c | | EST, Weakly similar to CBP MOUSE CREB-BINDING PROTEIN [*M. musculus*], ESTs, Highly similar to CBP MOUSE CREB-BINDING PROTEIN [*M. musculus*], ESTs, Moderately similar to CBP MOUSE CREB-BINDING PROTEIN [*M. musculus*], ESTs, Weakly similar to CBP MOUSE CREB-BINDING PROTEIN [*M. musculus*], bromodomain containing 2 |
| 1032 | 18280 | AA946361 | c | | EST, Weakly similar to CBP MOUSE CREB-BINDING PROTEIN [*M. musculus*], ESTs, Highly similar to CBP MOUSE CREB-BINDING PROTEIN [*M. musculus*], ESTs, Moderately similar to CBP MOUSE CREB-BINDING PROTEIN [*M. musculus*], ESTs, Weakly similar to CBP MOUSE CREB-BINDING PROTEIN [*M. musculus*], bromodomain containing 2 |
| 2886 | 5082 | D14015 | ii, ww | | EST, Weakly similar to CGE1__RAT G1/S-specific cyclin E1 [*R. norvegicus*], ESTs, Weakly similar to CGE1__RAT G1/S-specific cyclin E1 [*R. norvegicus*], cyclin E1, cyclin E2 |
| 1979 | 11192 | AI111986 | g | | EST, Weakly similar to CGHU1B collagen alpha 4(IV) chain precursor [*H. sapiens*], ESTs, Highly similar to CGHU1B collagen alpha 4(IV) chain precursor [*H. sapiens*], ESTs, Weakly similar to S41067 collagen alpha 1(III) chain - rat [*R. norvegicus*], *Mus musculus*, Similar to putative protein phosphatase 1 nuclear targeting subunit, clone IMAGE:3157989, mRNA, partial cds, collagen type V, alpha 2, collagen, type IV, alpha 4, procollagen, type III, alpha 1, procollagen, type IV, alpha 2, procollagen, type IV, alpha 4 |
| 2383 | 2825 | AI178752 | l, nn | | EST, Weakly similar to CLN3__HUMAN CLN3 PROTEIN [*H. sapiens*], *Homo sapiens* clone 319 CLN3 protein (CLN3) mRNA, complete cds, expressed sequence AI323623 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3753 | 16929 | NM_031108 | h, l, w, z, General, ee, ii, ll | | EST, Weakly similar to COLLAGEN ALPHA 2(VI) CHAIN PRECURSOR [*M. musculus*], *Mus musculus*, Similar to splicing factor, arginine/serine-rich 8 (suppressor-of-white-apricot homolog, *Drosophila*), clone MGC:31019 IMAGE:5006904, mRNA, complete cds, RIKEN cDNA 3010033P07 gene, expressed sequence AL022771, expressed sequence AL022885, ribosomal protein S9 |
| 1825 | 11183 | AI100768 | b | | EST, Weakly similar to CRMS2 carbonate dehydratase [*M. musculus*], carbonic anhydrase 2, carbonic anhydrase I, carbonic anhydrase II, carbonic anhydrase-like sequence 1 |
| 363 | 16409 | AA852027 | pp | | EST, Weakly similar to DIA1_HUMAN DIAPHANOUS PROTEIN HOMOLOG 1 [*H. sapiens*], *Homo sapiens* cDNA: FLJ22382 fis. clone HRC07514 |
| 1339 | 9746 | AI009555 | d, g | | EST, Weakly similar to DYJ2_HUMAN DYNEIN LIGHT INTERMEDIATE CHAIN 2, CYTOSOLIC [*H. sapiens*], LIC-2 dynein light intermediate chain 53/55, RIKEN cDNA 1110053F02 gene, dynein light chain-A, dynein, cytoplasmic, light intermediate polypeptide 2, expressed sequence AA409702 |
| 2919 | 9745 | H31847 | c, h | | EST, Weakly similar to DYJ2_HUMAN DYNEIN LIGHT INTERMEDIATE CHAIN 2, CYTOSOLIC [*H. sapiens*], LIC-2 dynein light intermediate chain 53/55, RIKEN cDNA 1110053F02 gene, dynein light chain-A, dynein, cytoplasmic, light intermediate polypeptide 2, expressed sequence AA409702 |
| 3719 | 16210 | NM_031026 | r, w | | EST, Weakly similar to DYJ2_HUMAN DYNEIN LIGHT INTERMEDIATE CHAIN 2, CYTOSOLIC [*H. sapiens*], RIKEN cDNA 1110053F02 gene, *Rattus norvegicus* dynein light intermediate chain 1 mRNA, complete cds, dynein light chain-A, dynein, cytoplasmic, light intermediate polypeptide 2. expressed sequence AA409702 |
| 4416 | 15653 | X14210 | ee, ll | | EST, Weakly similar to G02526 NADH dehydrogenase [*H. sapiens*], NADH dehydrogenase (ubiquinone) 1 alpha subcomplex, 5 (13 kD, B13), RIKEN cDNA 2900002J19 gene |
| 3696 | 15186 | NM_030861 | g, p, General, rr | | EST, Weakly similar to GNT1_RAT Alpha-1,3-mannosyl-glycoprotein beta-1,2-N-acetylglucosaminyltransferase (N-glycosyl-oligosaccharide-glycoprotein N-acetylglucosaminyltransferase I) (GNT-I) (GlcNAc-T I) [*R. norvegicus*], RIKEN cDNA 4930467VB06 gene, mannoside acetylglucosaminyltransferase 1, mannosyl (alpha-1,3-)-glycoprotein beta-1,2-N-acetylglucosaminyltransferase |
| 3696 | 15187 | NM_030861 | n, z, General, rr | | EST, Weakly similar to GNT1_RAT Alpha-1,3-mannosyl-glycoprotein beta-1,2-N-acetylglucosaminyltransferase (N-glycosyl-oligosaccharide-glycoprotein N-acetylglucosaminyltransferase I) (GNT-I) (GlcNAc-T I) [*R. norvegicus*], RIKEN cDNA 4930467B06 gene, mannoside acetylglucosaminyltransferase 1, mannosyl (alpha-1,3-)-glycoprotein beta-1,2-N- |
| 3696 | 15188 | NM_030861 | d, s, General | | EST, Weakly similar to GNT1_RAT Alpha-1,3-mannosyl-glycoprotein beta-1,2-N-acetylglucosaminyltransferase (N-glycosyl-oligosaccharide-glycoprotein N-acetylglucosaminyltransferase I) (GNT-I) (GlcNAc-T I) [*R. norvegicus*], RIKEN cDNA 4930467B06 gene, mannoside |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | acetylglucosaminyltransferase i, mannosyl (alpha-1,3-)-glycoprotein beta-1,2-N-acetylglucosaminyltransferase |
| 2351 | 1978 | AA819129 | b | | EST, Weakly similar to GTT1_HUMAN GLUTATHIONE S-TRANSFERASE THETA [*H. sapiens*], *Homo sapiens* mRNA; cDNA DKFZp762N226 (from clone DKFZp762N226), RIKEN cDNA 4930583C14 gene, hypothetical protein HS322B1A |
| 988 | 23813 | AA945149 | b, vv | | EST, Weakly similar to GTT1_HUMAN GLUTATHIONE S-TRANSFERASE THETA [*H. sapiens*], *Homo sapiens* mRNA; cDNA DKFZp762N226 (from clone DKFZp762N226), RIKEN cDNA 4930583C14 gene, hypothetical protein HS322B1A |
| 1937 | 18395 | AI104388 | nn | | EST, Weakly similar to HHHU27 heat shock protein 27 [*H. sapiens*], ESTs, Highly similar to HHHU27 heat shock protein 27 [*H. sapiens*], ESTs, Moderately similar to HHHU27 heat shock protein 27 [*H. sapiens*], heat shock 27 kD protein 1 |
| 4054 | 156i5 | NM_053800 | u | | EST, Weakly similar to Human Thioredoxin [*H. sapiens*], RIKEN cDNA 4930429J24 gene, thioredoxin, thioredoxin 1 |
| 3542 | 17100 | NM_022179 | d, h, l, ee | | EST, Weakly similar to HXK2 MOUSE HEXOKINASE TYPE II [*M. musculus*], ESTs, Moderately similar to HXK3_HUMAN HEXOKINASE TYPE III [*H. sapiens*], ESTs, Weakly similar to HXK2 MOUSE HEXOKINASE TYPE II [*M. musculus*], hexokinase 2, hexokinase 3 (white cell) |
| 3542 | 17101 | NM_022179 | b, General, ii, kk, ss | | EST, Weakly similar to HXK2 MOUSE HEXOKINASE TYPE II [*M. musculus*], ESTs, Moderately similar to HXK3_HUMAN HEXOKINASE TYPE III [*H. sapiens*], ESTs, Weakly similar to HXK2 MOUSE HEXOKINASE TYPE II [*M. musculus*], hexokinase 2, hexokinase 3 (white cell) |
| 4086 | 1288 | NM_053949 | l, s | | EST, Weakly similar to I38465 probable potassium channel subunit [*H. sapiens*], potassium voltage-gated channel, subfamily H (eag-related), member 2 |
| 542 | 17225 | AA891553 | l, nn | | EST, Weakly similar to IF37 MOUSE EUKARYOTIC TRANSLATION INITIATION FACTOR 3 SUBUNIT 7 [*M. musculus*], eukaryotic translation initiation factor 3, subunit 7 (zeta, 66/67 kDa), eukaryotic translation initiation factor 3, subunit 7 (zeta, 66/67 kD) |
| 1228 | 22210 | AA998690 | p | | EST, Weakly similar to IF6_HUMAN EUKARYOTIC TRANSLATION INITIATION FACTOR 6 [*H. sapiens*], ESTs, Highly similar to IF6_HUMAN EUKARYOTIC TRANSLATION INITIATION FACTOR 6 [*H. sapiens*], *Mus musculus* 10 days neonate cerebellum cDNA, RIKEN full-length enriched library, clone:6530402L05:integrin beta 4 binding protein, full insert sequence, integrin beta 4 binding protein |
| 1931 | 22211 | AI104279 | tt | | EST, Weakly similar to IF6_HUMAN EUKARYOTIC TRANSLATION INITIATION FACTOR 6 [*H. sapiens*], ESTs, Highly similar to IF6_HUMAN EUKARYOTIC TRANSLATION INITIATION FACTOR 6 [*H. sapiens*], *Mus musculus* 10 days neonate cerebellum cDNA, RIKEN full-length enriched library, clone:6530402L05:integrin beta 4 binding protein, full insert sequence, integrin beta 4 binding protein |
| 2032 | 7414 | AI137586 | n, p, z, General | | EST, Weakly similar to IMB3_HUMAN IMPORTIN BETA-3 SUBUNIT [*H. sapiens*], *Homo sapiens* cDNA FLJ12978 fis, clone |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | NT2RP2006321, RAN binding protein 6, importin 4 |
| 1219 | 26118 | PA998471 | d | | EST, Weakly similar to JC1365 FK506/rapamycin-binding protein FKBP13 precursor [*H. sapiens*], FK506 binding protein 7, FK506 binding protein precursor |
| 962 | 19480 | AA944442 | oo | | EST, Weakly similar to JC2324 LIM protein [*H. sapiens*], ESTs, Weakly similar to JG0164 LIM protein, FHL4 - mouse [*M. musculus*], *Homo sapiens* cDNA FLJ13238 fis, clone OVARC1000440, *Homo sapiens* cDNA FLJ31627 fis, clone NT2R12003338, RIKEN cDNA 2410002J21 gene, activator of cAMP-responsive element modulator (CREM) in testis, expressed sequence AI481106, expressed sequence AV278559, expressed sequence AW123232, hypothetical protein FLJ10044, paxillin, testis derived transcript (3 LIM domains), transforming growth factor beta 1 induced transcript 1 |
| 52 | 20093 | AA799637 | u | | EST, Weakly similar to JC2324 LIM protein [*H. sapiens*], *Homo sapiens* cDNA FLJ13238 fis, clone OVARC1000440, RIKEN cDNA 2410002J21 gene, expressed sequence AV278559, expressed sequence AW123232, hypothetical protein FLJ10044, paxillin, transforming growth factor beta 1 induced transcript 1 |
| 4278 | 15239 | NM_139114 | h, l, v, General | | EST, Weakly similar to JC2369 ribosomal protein L15, cytosolic [validated] - rat [*R. norvegicus*], ESTs, Highly similar to RL15_HUMAN 60S RIBOSOMAL PROTEIN L15 [*H. sapiens*], *Homo sapiens*, clone MGC:2392 IMAGE:2961444, mRNA, complete cds, RIKEN cDNA 2510008H07 gene ribosomal protein L15 |
| 3739 | 6348 | NM_031077 | mm | | EST, Weakly similar to JC5111 cyclin dependent kinase-related protein 1b - rat [*R. norvegicus*], EST, Weakly similar to S10889 proline-rich protein [*H. sapiens*], ESTs, Highly similar to KPT1 MOUSE SERINE/THREONINE-PROTEIN KINASE PCTAIRE-1 [*M. musculus*], ESTs, Weakly similar to KPT1 MOUSE SERINE/THREONINE-PROTEIN KINASE PCTAIRE-1 [*M. musculus*], PCTAIRE protein kinase 1, PCTAIRE-motif protein kinase 1 |
| 482 | 16327 | AA875050 | c, oo | | EST, Weakly similar to KICE MOUSE CHOLINE/ETHANOLAMINE KINASE [*M. musculus*], RIKEN cDNA 4930555L11 gene, choline kinase-like, expressed sequence A1197444, hypothetical protein FLJ10761 |
| 2181 | 6879 | AI171674 | t | | EST, Weakly similar to LDVR_RAT Very low density lipoprotein receptor precursor (VLDL receptor) [*R. norvegicus*], ESTs, Weakly similar to LDVR MOUSE VERY LOW-DENSITY LIPOPROTEIN RECEPTOR PRECURSOR [*M. musculus*], ESTs, Weakly similar to LDVR_RAT Very low-density lipoprotein receptor precursor (VLDL receptor) [*R. norvegicus*], low density lipoprotein receptor-related protein 8, apolipoprotein e receptor, very low density lipoprotein receptor |
| 3255 | 24867 | NM_013155 | t, mm | | EST, Weakly similar to LDVR_RAT Very low density lipoprotein receptor precursor (VLDL receptor) [*R. norvegicus*], ESTs, Weakly similar to LDVR MOUSE VERY LOW-DENSITY LIPOPROTEIN RECEPTOR PRECURSOR [*M. musculus*], ESTs, Weakly similar to LDVR_RAT Very low-density lipoprotein receptor precursor (VLDL |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | receptor) [*R. norvegicus*], low density lipoprotein receptor-related protein 8, apolipoprotein e receptor, very low density lipoprotein receptor |
| 2736 | 9543 | AI236164 | k | | EST, Weakly similar to MAN2__HUMAN ALPHA-MANNOSIDASE II [*H. sapiens*], mannosidase 2, alpha 1 |
| 2984 | 17883 | M11851 | ss | | EST, Weakly similar to MLRV__RAT Myosin regulatory light chain 2, ventricular/cardiac muscle isoform (MLC-2) [*R. norvegicusj*, ESTs, Weakly similar to MLRV__RAT Myosin regulatory light chain 2, ventricular/cardiac muscle isoform (MLC-2) [*R. norvegicus*], myosin light chain 2, precursor lymphocyte-specific, myosin light chain, phosphorylatable, cardiac ventricles, myosin, light polypeptide 2, regulatory, cardiac, slow, myosin, light polypeptide 5, |
| 514 | 24470 | AA875523 | jj | | EST, Weakly similar to MOHU6N myosin alkali light chain 6, nonmuscle form [*H. sapiens*], myosin light chain, alkali, nonmuscle, myosin, light polypeptide 6, alkali, smooth muscle and non-muscle |
| 514 | 24471 | M875523 | y | | EST, Weakly similar to MOHU6N myosin alkali light chain 6, nonmuscle form [*H. sapiens*], myosin light chain, alkali, nonmuscle, myosin, light polypeptide 6, alkali, smooth muscle and non-muscle |
| 750 | 24473 | AA894200 | y | | EST, Weakly similar to MOHU6N myosin alkali light chain 6, nonmuscle form [*H. sapiens*], myosin light chain, aikali, nonmuscle, myosin, light polypeptide 6, alkali, smooth muscle and non-muscle |
| 4347 | 24469 | S77858 | m, rr | | EST, Weakly similar to MOHU6N myosin alkali light chain 6, nonmuscle form [*H. sapiens*], myosin light chain, alkali, nonmuscle, myosin, light polypeptide 6, alkali, smooth muscle and non-muscle |
| 4189 | 1558 | NM__133554 | e, pp | | EST, Weakly similar to NPT1__RAT RENAL SODIUM-DEPENDENT PHOSPHATE TRANSPORT PROTEIN 1 (SODIUM/PHOSPHATE COTRANSPORTER 1) (NA(+)/PI COTRANSPORTER 1) (RENAL SODIUM-PHOSPHATE TRANSPORT PROTEIN 1) (RENAL NA+-DEPENDENT PHOSPHATE COTRANSPORTER 1) [*R. norvegicus*], ESTs, Weakly similar to RENAL SODIUM-DEPENDENT PHOSPHATE TRANSPORT PROTEIN 1 [*M. musculus*], Mus musculus, Similar to solute carrier family 17 (sodium phosphate), member 2, clone MGC:19073 IMAGE:4193755, mRNA, complete cds, expressed sequence AW261723, solute carrier family 17 (sodium phosphate), member 1, solute carrier family 17 (sodium phosphate), member 2, solute carrier family 17 (sodium phosphate), member 3, solute carrier family 17 (sodium phosphate), member 4, solute carrier family 17 vesicular glutamate transporter), member 1 |
| 4189 | 1559 | NM__133554 | e | | EST, Weakly similar to NPT1__RAT RENAL SODIUM-DEPENDENT PHOSPHATE TRANSPORT PROTEIN 1 (SODIUM/PHOSPHATE COTRANSPORTER 1) (NA(+)/PI COTRANSPORTER 1) (RENAL SODIUM-PHOSPHATE TRANSPORT PROTEIN 1) (RENAL NA+-DEPENDENT PHOSPHATE COTRANSPORTER 1) [*R. norvegicus*], ESTs, Weakly similar to RENAL SODIUM-DEPENDENT PHOSPHATE TRANSPORT PROTEIN 1 [*M. musculus*], Mus musculus, Similar to solute carrier family 17 (sodium |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | phosphate), member 2, clone MGC:19073 IMAGE:4193755, mRNA, complete cds, expressed sequence AW261723, solute carrier family 17 (sodium phosphate), member 1, solute carrier family 17 (sodium phosphate), member 2, solute carrier family 17 (sodium phosphate), member 3, solute carrier family 17 (sodium phosphate), member 4, solute carrier family 17 vesicular glutamate transporter), member 1 |
| 4028 | 7228 | NM_053654 | jj | | EST, Weakly similar to PA1G MOUSE PLATELET-ACTIVATING FACTOR ACETYLHYDROLASE IB GAMMA SUBUNIT [*M. musculus*], platelet-activating factor acetylhydrolase, isoform 1b, alpha1 subunit, platelet-activating factor acetylhydrolase, isoform Ib, gamma subunit (29 kD) |
| 416 | 14138 | AA859700 | p, General | | EST, Weakly similar to PPOX MOUSE PROTOPORPHYRINOGEN OXIDASE [*M. musculus*], protoporphyrinogen oxidase |
| 4008 | 20842 | NM_053590 | mm | | EST, Weakly similar to PRC5 MOUSE PROTEASOME COMPONENT C5 [*M. musculus*], ESTs, Weakly similar to PRC5 MOUSE PROTEASOME COMPONENT C5 [*M. musculus*], proteasome (prosome, macropain) subunit, beta type 1, proteasome (prosome, macropain) subunit beta type 1 |
| 4215 | 3074 | NM_134399 | kk | | EST, Weakly similar to PRO1 MOUSE PROFILIN I [*M. musculus*], EST, Weakly similar to PRO2 HUMAN PROFILIN II [*H. sapiens*], ESTs, Weakly similar to PRO2_HUMAN PROFILIN II [*H. sapiens*], profilin, profilin 1 |
| 4227 | 5208 | NM_138504 | w, rr | | EST, Weakly similar to PRP3 MOUSE PROLINE-RICH PROTEIN MP-3 [*M. musculus*], ESTs, Weakly similar to PRP3 MOUSE PROLINE-RICH PROTEIN MP-3 [*M. musculus*], *Mus musculus*, clone IMAGE:5251262, mRNA, partial cds, expressed sequence C78515, pregnancy-induced growth inhibitor |
| 3942 | 2577 | NM_033236 | u, bb | | EST, Weakly similar to PRS7 MOUSE 26S PROTEASE REGULATORY SUBUNIT 7 [*M. musculus*], RIKEN cDNA 2300001E01 gene, proteasome (prosome, macropain) 26S subunit, ATPase 2, syntaxin 8 |
| 3770 | 1291 | NM_031149 | w | | EST, Weakly similar to PRS8 MOUSE 26S PROTEASE REGULATORY SUBUNIT 8 [*M. musculus*], *Homo sapiens* mRNA; cDNA DKFZp58611420 (from clone DKFZp58611420); partial cds, YME1-like 1 (*S. cerevisiae*), hypothetical protein DKFZp687C165, protease (prosome, macropain) 26S subunit, ATPase 5, proteasome (prosome, macropain) 26S subunit, ATPase, 5, proteasome (prosome, |
| 3784 | 18373 | NM_031331 | ii, ww | | EST, Weakly similar to PSD4_HUMAN 26S PROTEASOME REGULATORY SUBUNIT S5A [*H. sapiens*], proteasome (prosome, macropain) 26S subunit, non-ATPase, 4 |
| 3784 | 18375 | NM_031331 | h | | EST, Weakly similar to PSD4_HUMAN 26S PROTEASOME REGULATORY SUBUNIT S5A [*H. sapiens*], proteasome (prosome, macropain) 26S subunit, non-ATPase, 4 |
| 3743 | 15201 | NM_031093 | gg, hh | | EST, Weakly similar to RALA MOUSE RAS-RELATED PROTEIN RAL-A [*M. musculus*], ESTs, Weakly similar to Crystal Structure Of The Small G Protein Rap2a With Gdp {SUB 1-167 [*H. sapiens*], ESTs, Weakly similar to RALA MOUSE RAS-RELATED PROTEIN RAL-A [*M. musculus*], v-ral simian leukemia viral oncogene homolog A (ras related) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3743 | 15203 | NM_031093 | l, m, s, w, General, tt | | EST, Weakly similar to RALA MOUSE RAS-RELATED PROTEIN RAL-A [*M. musculus*], ESTs, Weakly similar to Crystal Structure Of The Small G Protein Rap2a With Gdp {SUB 1-167 [*H. sapiens*], ESTs, Weakly similar to RALA MOUSE RAS-RELATED PROTEIN RAL-A [*M. musculus*], v-ral simian leukemia viral oncogene homolog A (ras related) |
| 4181 | 16736 | NM_133427 | j | | EST, Weakly similar to RDRTB5 cytochrome-b5 reductase (EC 1.6.2.2), microsomal form - rat [*R. norvegicus*], ESTs, Weakly similar to RDRTB5 cytochrome-b5 reductase (EC 1.6.2.2), microsomal form-rat [*R. norvegicus*], *Mus musculus*, clone MGC:30933 IMAGE:4018387, mRNA, complete cds, RIKEN cDNA 1810044O22 gene, RIKEN cDNA 2810034J18 gene, hypothetical protein BC008322 |
| 1886 | 18607 | AI103105 | z | | EST, Weakly similar to RL12_HUMAN 60S RIBOSOMAL PROTEIN L12 [*H. sapiens*], ESTs, Weakly similar to RL12_HUMAN 60S RIBOSOMAL PROTEIN L12 [*H. sapiens*], ribosomal protein L12 |
| 4430 | 18606 | X53504 | h, j, General, gg, hh, ll | | EST, Weakly similar to RL12_HUMAN 60S RIBOSOMAL PROTEIN L12 [*H. sapiens*], ESTs, Weakly similar to RL12_HUMAN 60S RIBOSOMAL PROTEIN L12 [*H. sapiens*], ribosomal protein L12 |
| 4419 | 19244 | X15013 | h, gg, hh | | EST, Weakly similar to RL7A MOUSE 60S RIBOSOMAL PROTEIN L7A [*M. musculus*], RIKEN cDNA 4632404N19 gene, ribosomal protein L7a |
| 1106 | 24156 | AA957803 | k | | EST, Weakly similar to RNP_HUMAN RIBONUCLEASE PANCREATIC PRECURSOR [*H. sapiens*], ESTs, Weakly similar to RNP_HUMAN RIBONUCLEASE PANCREATIC PRECURSOR [*H. sapiens*], RIKEN cDNA 4930474F22 gene, ribonuclease 1, pancreatic, ribonuclease, RNase A family 1 (pancreatic) |
| 3787 | 15360 | NM_031335 | p, v | | EST, Weakly similar to RPB6_RAT DNA-directed RNA polymerase II 14.4 kDa polypeptide (RPB6) (RPB14.4) [*R. norvegicus*], *Mus musculus* E2F1-inducible (Eig4) mRNA, complete sequence, RIKEN cDNA 1810060D16 gene, polymerase (RNA) II (DNA directed) polypeptide F |
| 3755 | 10878 | NM_031110 | j, General | | EST, Weakly similar to RS11_HUMAN 40S ribosomal protein S11 [*R. norvegicus*], *Homo sapiens* mRNA; cDNA DKFZp434A0326 (from clone DKFZp434A0326), RAD21 homolog (*S. pombe*), ribosomal protein S11 |
| 3909 | 10949 | NM_031839 | rr | | EST, Weakly similar to S13101 cytochrome P450 c117 - rat [*R. norvegicus*], *Mus musculus*, clone MGC:25860 IMAGE:4195655, mRNA, complete cds, RIKEN cDNA 2010301M18 gene, RIKEN cDNA 2210009K14 gene, cytochrome P450, 2c29, cytochrome P450, subfamily IIC (mephenytoin 4-hydroxylase), polypeptide 19, expressed sequence AI159681, expressed sequence AW107714 |
| 1402 | 23768 | AI011709 | ii | | EST, Weakly similar to S21977 PmS protein [*H. sapiens*], *Homo sapiens* cDNA: FLJ23491 fis, clone LNG00825, highly similar to HSPM5 Human mRNA for pM5 protein. pM5 protein |
| 1894 | 2364 | AI103379 | General | | EST, Weakly similar to S23770 ubiquitin-activating enzyme E1 [*H. sapiens*], ESTs, Highly similar to I63168 gene Ube1x protein rat (fragment) [*R. norvegicus*], ESTs, Weakly similar to I63168 gene Ube1x protein - rat (fragment) [*R. norvegicus*], ESTs, Weakly |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | similar to UBIQUITIN-ACTIVATING ENZYME E1 1 [*M. musculus*], *Homo sapiens* PP3895 mRNA, complete cds, RIKEN cDNA 1300004C08 gene, RIKEN cDNA 5730469D23 gene, ubiquitin-activating enzyme E1 (A1 S9T and BN75 temperature sensitivity complementing), ubiquitin-activating enzyme E1, Chr X, ubiquitin-activating enzyme E1, Chr Y 1, ubiquitin-activating enzyme E1-like |
| 6 | 6049 | AA685178 | a, General, cc, rr | | EST, Weakly similar to S49326 nascent polypeptide-associated complex alpha chain [*H. sapiens*], EST, Weakly similar to T30827 nascent polypeptide-associated complex alpha chain, non-muscle splice form - mouse [*M. musculus*], FKSG17, KIAA0363 protein, expressed sequence AL022831, nascent-polypeptide-associated complex alpha polypeptide |
| 694 | 13856 | AA893183 | gg, hh | | EST, Weakly similar to S57447 HPBRII-7 protein [*H. sapiens*], cleavage and polyadenylation specific factor 6, 68 kD subunit, hypothetical protein FLJ12529 |
| 694 | 13857 | AA893183 | bb | | EST, Weakly similar to S57447 HPBRII-7 protein [*H. sapiens*], cleavage and polyadenylation specific factor 6, 68 kD subunit, hypothetical protein FLJ12529 |
| 2107 | 11550 | AI169591 | a | | EST, Weakly similar to S57447 HPBRII-7 protein [*H. sapiens*], cleavage and polyadenylation specific factor 6, 68 kD subunit, hypothetical protein FLJ12529 |
| 2225 | 13098 | AI172610 | c, ii | | EST, Weakly similar to S70029 probable transmembrane protein TMC [*H. sapiens*], *Homo sapiens* cDNA FLJ14883 fis, clone PLACE1003596, moderately similar to OLIGOSACOHARYL TRANSFERASE STT3 SUBUNIT, RIKEN cDNA 1300006C19 gene, intergral membrane protein 1 |
| 3008 | 11956 | M28255 | ff | | EST, Weakly similar to S71929 cytochrome-c oxidase (EC 1.9.3.1) chain VIII precursor, hepatic - mouse [*M. musculus*], cytochrome c oxidase, subunit VIIIa, heme-regulated initiation factor 2-alpha kinase |
| 3591 | 8097 | NM_022536 | j, q, w, x | | EST, Weakly similar to secreted cyclophilin-like protein [*H. sapiens*], ESTs, Weakly similar to cyclophilin B [*Rattus norvegicus*] [*R. norvegicus*], RIKEN cDNA 3732410E19 gene, peptidylprolyl isomerase (cyclophilin)-like 1, peptidylprolyl isomerase B, peptidylprolyl isomerase B (cyclophilin B), peptidylprolyl isomerase C, peptidylprolyl isomerase C (cyclophilin C) |
| 1235 | 2526 | AA998979 | bb | | EST, Weakly similar to T00051 hypothetical protein KIAA0404 [*H. sapiens*], *Homo sapiens*, clone IMAGE:4657824, mRNA, KIAA0404 protein, hypothetical protein FLJ10242 |
| 1136 | 24166 | AA964630 | d, n | | EST, Weakly similar to T02345 hypothetical protein KIAA0324 [*H. sapiens*], ESTs, Weakly similar to T02345 hypothetical protein KIAA0324 [*H. sapiens*], *Homo sapiens* cDNA FLJ31094 fis, clone IMR321000165, polymerase I and transcript release factor, serine/arginine repetitive matrix 2 |
| 1095 | 22357 | AA957264 | k | | EST, Weakly similar to T12456 hypothetical protein DKFZp564M2423. 1 [*H. sapiens*], ESTs, Highly similar to T12456 hypothetical protein DkFZp564M2423. 1 [*H. sapiens*], PAI-1 mRNA-binding protein, RIKEN cDNA 1200009K13 gene, intracellular hyaluronan-binding protein |
| 4105 | 616566 | NM_054004 | u | | EST, Weakly similar to T42735 TBP-interacting protein TIP120 - rat |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | [*R. norvegicus*], *Homo sapiens* cDNA FLJ14877 fis, clone PLACE1003044, TBP-interacting protein, expressed sequence AI195005 |
| 12 | 21815 | AA686423 | o | | EST, Weakly similar to T46390 hypothetical protein DKFZp434C1920.1 [*H. sapiens*], hepatocellular carcinoma-associated antigen 59 |
| 3557 | 17158 | NM_022298 | c, f, vv, xx | | EST, Weakly similar to TBA1 MOUSE TUBULIN ALPHA-i CHAIN [*M. musculus*], tubulin, alpha 1, tubulin, alpha 2, tubulin, alpha 3, tubulin, alpha 6, tubulin, alpha 7, tubulin alpha, ubiquitous |
| 3557 | 17160 | NM_022298 | nn | | EST, Weakly similar to TBA1 MOUSE TUBULIN ALPHA-1 CHAIN [*M. musculus*], tubulin, alpha 1, tubulin, alpha 2, tubulin, alpha 3, tubulin, alpha 6, tubulin, alpha 7, tubulin, aloha, ubiquitous |
| 3557 | 17161 | NM_022298 | y, nn, tt | | EST, Weakly similar to TBA1 MOUSE TUBULIN ALPHA-1 CHAIN [*M. musculus*], tubulin, alpha 1, tubulin, alpha 2, tubulin, alpha 3, tubulin, alpha 6, tubulin, alpha 7, tubulin. alpha. ubiquitous |
| 317 | 1397S | AA850450 | xx | | EST, Weakly similar to TBB5 MOUSE TUBULIN BETA-5 CHAIN [*M. musculus*], RIKEN cDNA 2310061K05 gene, RIKEN cDNA 2410129E14 gene, RIKEN cDNA 4930542G03 gene, tubulin, beta S, tubulin, beta polypeptide, tubulin, beta, 2, tubulin, beta 5 |
| 442 | 13974 | AA860030 | n, qq, ss | | EST, Weakly similar to TBB5 MOUSE TUBULIN BETA-5 CHAIN [*M. musculus*], RIKEN cDNA 2310061K05 gene, RIKEN cDNA 2410129E14 gene, RIKEN cDNA 4930542G03 gene, tubulin, beta 5, tubulin, beta polypeptide, tubulin, beta, 2, tubulin, beta, 5 |
| 1248 | 13973 | AB011679 | y, ee | | EST, Weakly similar to TBB5 MOUSE TUBULIN BETA-5 CHAIN [*M. musculus*], RIKEN cDNA 2310061K05 gene, RIKEN cDNA 2410129E14 gene, RIKEN cDNA 4930542G03 gene, tubulin, beta 5, tubulin, beta polypeptide, tubulin, beta, 2, tubulin, beta, 5 |
| 2521 | 13977 | AI229707 | j, bb, nn | | EST, Weakly similar to TBB5 MOUSE TUBULIN BETA-5 CHAIN [*M. musculus*], RIKEN cDNA 2310061K05 gene, RIKEN cDNA 2410129E14 gene, RIKEN cDNA 4930542G03 gene, tubulin, beta 5, tubulin, beta polypeptide, tubulin, beta, 2, tubulin, beta, 5 |
| 1079 | 11050 | AA956164 | ii | | EST, Weakly similar to TCPE MOUSE T-COMPLEX PROTEIN 1, EPSILON SUBUNIT [*M. musculus*], ESTs, Weakly similar to JQ0866 T-complex protein 1 - rat [*R. norvegicus*], T-complex 1, chaperonin containing TCP1, subunit 5 (epsilon), chaperonin containing TCP1, subunit 7 (eta), chaperonin subunit 5 (epsilon), chaperonin subunit 7 (eta), t-complex protein 1 |
| 874 | 23159 | AA925318 | l, q, x, dd | | EST, Weakly similar to TRI9_HUMAN THYROID RECEPTOR INTERACTING PROTEIN 9 [*H. sapiens*], nuclear factor of kappa light chain gene enhancer in B-cells inhibitor, beta, nuclear factor of kappa light polypeptide gene enhancer in B-cells inhibitor, beta |
| 754 | 15274 | AA894258 | General, kk | | EST, Weakly similar to UB5C_HUMAN Ubiquitin-conjugating enzyme E2-17 kDa 3 (Ubiquitin-protein ligase) (Ubiquitin carrier protein) (E2(17)KB 3) [*R. norvegicus*], ESTs, Weakly similar to S53358 ubiquitin-conjugating enzyme E2.17kB - rat |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | [*R. norvegicus*], *Homo sapiens* EST from clone 37208, full insert, RIKEN cDNA 1100001F19 gene, RIKEN cDNA 1600028I17 gene, prefoldin 5, ubiquitin-conjugating enzyme E2D 3 (UBC4/5 homolog yeast) |
| 3777 | 15277 | NM_031237 | n | | EST, Weakly similar to UB5C_HUMAN Ubiquitin-conjugating enzyme E2-17 kDa 3 (Ubiquitin-protein ligase) (Ubiquitin carrier protein) (E2(17)KB 3) [*R. norvegicus*], ESTs, Weakly similar to S53358 ubiquitin-conjugating enzyme E2.17kB - rat [*R. norvegicus*], *Homo sapiens* EST from clone 37208, full insert, RIKEN cDNA 1100001F19 gene, RIKEN cDNA 1600028I17 gene, prefoldin 5, ubiquitin-conjugating enzyme E2D 3 (UBC4/5 homolog yeast) |
| 4292 | 1623 | NM_144757 | s | | EST, Weakly similar to ZF37_RAT Zinc finger protein 37 (Zfp-37) [*R. norvegicus*], ESTs, Weakly similar to ZF29 MOUSE ZINC FINGER PROTEIN 29 [*M. musculus*], ESTs, Weakly similar to ZF93_MOUSE ZINC FINGER PROTEIN 93 (ZFP-93) [*M. musculus*], expressed sequence AW557864, zinc finger protein 29, zinc finger protein 37, zinc finger protein 37 homolog (mouse) |
| 410 | 11317 | AA859631 | oo | | EST, Weakly similar to ZF37_RAT Zinc finger protein 37 (Zfp-37) [*R. norvegicus*], ESTs, Weakly similar to ZF90 MOUSE ZINC FINGER PROTEIN 90 [*M. musculus*], ESTs, Weakly similar to ZF93_MOUSE ZINC FINGER PROTEIN 93 (ZFP-93) [*M. musculus*], *Homo sapiens* cDNA FLJ31413 fis, clone NT2NE2000259, moderately similar to OOCYTE ZINC FINGER PROTEIN XLCOF6.1, *Homo sapiens* mRNA for HKR1, partial cds, *Homo sapiens*, clone IMAGE:3546283, mRNA, partial cds, RIKEN cDNA 2610008E11 gene, RIKEN cDNA 9030409O18 gene, zinc finger protein 37, zinc finger protein 37 homolog (mouse) |
| 4302 | 16343 | NM_145724 | uu | | EST, Weakly similar to ZF94_RAT Zinc finger protein 94 (Zfp-94) (Zinc finger protein Y1) (RLZF-Y) [*R. norvegicus*], ESTs, Moderately similar to I37956 zinc finger protein kox17 [*H. sapiens*], ESTs, Weakly similar to ZF94_MOUSE ZINC FINGER PROTEIN 94 (ZFP-94) [*M. musculus*], ESTs, Weakly similar to ZF94_RAT Zinc finger protein 94 (Zfp-94) (Zinc finger protein Y1) (RLZF-Y) [*R. norvegicus*], *Homo sapiens* cDNA FLJ30551 fis, clone BRAWH2001503, KIAA0426 gene product, hypothetical protein FLJ12298, zinc finger protein 99 |
| 4302 | 16345 | NM_145724 | j, uu | | EST, Weakly similar to ZF94_RAT Zinc finger protein 94 (Zfp-94) (Zinc finger protein Y1) (RLZF-Y) [*R. norvegicus*], ESTs, Moderately similar to I37956 zinc finger protein kox17 [*H. sapiens*], ESTs, Weakly similar to ZF94_MOUSE ZINC FINGER PROTEIN 94 (ZFP-94) [*M. musculus*], ESTs, Weakly similar to ZF94_RAT Zinc finger protein 94 (Zfp-94) (Zinc finger protein Y1) (RLZF-Y) [*R. norvegicus*], *Homo sapiens* cDNA FLJ30551 fis, clone BRAWH2001503, KIAA0426 gene product, hypothetical protein FLJ12298, zinc finger protein 99 |
| 1427 | 1263 | AI012567 | bb | | EST, Weakly similar to ZF94_RAT Zinc finger protein 94 (Zfp-94) (Zinc finger protein Y1) (RLZF-Y) [*R. norvegicus*], ESTs, Moderately similar to I37956 zinc finger |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | protein kox17 [*H. sapiens*], *Rattus norvegicus* zinc finger protein Y1 (RLZF-Y) mRNA, complete cds, SCAN domain containing 1, SCAN domain-containing 1, zinc finger protein 99 |
| 3432 | 20351 | NM_019142 | kk | | ESTs, Highly similar to 5'-AMP-activated protein kinase alpha-1 catalytic subunit [*Rattus norvegicus*] [*R. norvegicus*], RIKEN cDNA 1200013B22 gene, SNF related kinase, SNF1-like kinase, expressed sequence AI194361, protein kinase, AMP-activated, alpha 1 catalytic subunit, serine/threonine kinase 11, serine/threonine kinase 11 (Peutz-Jeghers syndrome) |
| 1091 | 6174 | AA957063 | tt | | ESTs, Highly similar to basic leucine-zipper protein BZAP45; KIAA0005 gene product [*Homo sapiens*] [*H. sapiens*], ESTs, Highly similar to E2BE RAT TRANSLATION INITIATION FACTOR EIF-2B EPSILON SUBUNIT [*R. norvegicus*], *Homo sapiens* cDNA FLJ31838 fis, clone NT2RP7000076, weakly similar to TRANSLATION INITIATION FACTOR EIF-2B EPSILON SUBUNIT, RIKEN cDNA 1200015E15 gene, eukaryotic translation initiation factor 2B, subunit 5 (epsilon, 82 kD), expressed sequence C81315, initiation factor eIF-2Be |
| 1764 | 7092 | AI071668 | c | | ESTs, Highly similar to basic leucine-zipper protein BZAP45; KIAA0005 gene product [*Homo sapiens*] [*H. sapiens*], ESTs, Highly similar to E2BE RAT TRANSLATION INITIATION FACTOR EIF-2B EPSILON SUBUNIT [*R. norvegicus*], *Homo sapiens* cDNA FLJ31838 fis, clone NT2RP7000076, weakly similar to TRANSLATION INITIATION FACTOR EIF-2B EPSILON SUBUNIT, RIKEN cDNA 1200015E15 gene, eukaryotic translation initiation factor 2B, subunit 5 (epsilon, 82 kD), expressed sequence C81315, initiation factor eIF-2Be |
| 4033 | 24204 | NM_053670 | b, General, uu | | ESTs, Highly similar to calcitonin gene-related peptide-receptor component protein [*Homo sapiens*] [*H. sapiens*], calcitonin gene related peptide-receptor component protein |
| 4060 | 6110 | NM_053824 | x | | ESTs, Highly similar to casein kinase II, alpha 1 polypeptide [*Rattus norvegicus*] [*R. norvegicus*], ESTs, Moderately similar to casein kinase II, alpha 1 polypeptide [*Rattus norvegicus*] [*R. norvegicus*], casein kinase 2, alpha 1 polypeptide, casein kinase 2, alpha prime polypeptide, casein kinase II, alpha 1 polypeptide, casein kinase II, alpha 1 related sequence 4, casein kinase II, alpha 2, polypeptide |
| 3933 | 1573 | NM_032083 | bb, ss | | ESTs, Highly similar to chimerin (chimaerin) 1 [*Rattus norvegicus*] [*R. norvegicus*], ESTs, Weakly similar to chimerin (chimaerin) 1 [*Rattus norvegicus*] [*R. norvegicus*], *Mus musculus*, Similar to hypothetical protein DKFZp564B1162, clone MGC:32510 IMAGE:5064885, mRNA, complete cds, *Mus musculus*, clone MGC:28436 IMAGE:4038635, mRNA, complete cds, RIKEN cDNA 1700112L09 gene, RIKEN cDNA 2310069I04 gene, RIKEN cDNA 5133400C09 gene, Rho GTPase activating protein 4, breakpoint cluster region |
| 2243 | 18507 | AI175551 | z | | ESTs, Highly similar to eukaryotic translation elongation factor 1 beta 2; eukaryotic translation elongation factor 1 beta 1 [*Homo sapiens*] [*H. sapiens*], eukaryotic translation elongation factor 1 beta 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2915 | 4352 | H31692 | x | | ESTs, Highly similar to GERp95 [*Rattus norvegicus*] [*R. norvegicus*], ESTs, Moderately similar to I2C1__HUMAN EUKARYOTIC TRANSLATION INITIATION FACTOR 2C 1 [*H. sapiens*], ESTs, Moderately similar to I2C2__HUMAN EUKARYOTIC TRANSLATION INITIATION FACTOR 2C 2 [*H. sapiens*], ESTs, Weakly similar to GERp95 [*Rattus norvegicus*] [*R. norvegicus*], *Mus musculus*, eukaryotic translation initiation factor 2C, 2, clone MGC:38662 IMAGE:5356426, mRNA, complete cds, RIKEN cDNA 5730550L01 gene, eukaryotic translation initiation factor 2C, 1, eukaryotic translation initiation factor 2C, 2, expressed sequence AW048688, hypothetical protein FLJ12765, piwi like homolog 1 (*Drosophila*) |
| 4235 | 5283 | NM_138535 | xx | | ESTs, Highly similar to Glutamate receptor interacting protein [*Rattus norvegicus*] [*R. norvegicus*], Glutamate receptor interacting protein, RIKEN cDNA 4931400F03 gene, channel-interacting PDZ domain protein, multiple PDZ domain protein, syntrophin, alpha 1 (dystrophin-associated protein A1, 59 kD, acidic component) |
| 1677 | 965 | AI059340 | l | | ESTs, Highly similar to huntingtin-associated protein interacting protein (duo) [*Rattus norvegicus*] [*R. norvegicus*], death-associated kinase 3, expressed sequence AA408740, expressed sequence AI120141, faciogenital dysplasia (Aarskog-Scott syndrome), faciogenital dysplasia homolog, serine/threonine kinase with Dbl- and pleckstrin homology domains, triple functional domain (PTPRE-interacting) |
| 3929 | 964 | NM_032062 | v | | ESTs, Highly similar to huntingtin-associated protein interacting protein (duo) [*Rattus norvegicus*] [*R. norvegicus*], death-associated kinase 3, expressed sequence M408740, expressed sequence AI120141, faciogenital dysplasia (Aarskog-Scott syndrome), faciogenital dysplasia homolog, serine/threonine kinase with Dbl- and pleckstrin homology domains, triple functional domain (PTPRE-interacting) |
| 42 | 16576 | AA799570 | c, u | | ESTs, Highly similar to hypothetical protein FLJ13725; KIAA1930 protein [*Homo sapiens*] [*H. sapiens*] |
| 1960 | 18742 | AI105131 | bb, qq | | ESTs, Highly similar to lung alpha/beta hydrolase 1; alpha/beta hydrolase-1 [*Mus musculus*] [*M. musculus*], lung alpha/beta hydrolase 1, lunci alpha/beta hydrolase 3 |
| 38 | 17599 | AA799539 | o | | ESTs, Highly similar to lymphocyte activation-associated protein [*Homo sapiens*] [*H. sapiens*], ESTs, Weakly similar to KEAP_RAT Kelch-like ECH-associated protein 1 (Cytosolic inhibitor of Nrf2) (INrf2) [*R. norvegicus*], Kelch-like ECH-associated protein 1, *Mus musculus*, Similar to KIAA0952 protein, clone MGC:25591 IMAGE:4011475, mRNA, complete cds, RIKEN cDNA 2700038B03 gene, kelch-like ECH-associated protein 1 |
| 1190 | 13330 | AA997716 | ll | | ESTs, Highly similar to lymphocyte activation-associated protein [*Homo sapiens*] [*H. sapiens*], ESTs, Weakly similar to KEAP_RAT Kelch-like ECH-associated protein 1 (Cytosolic inhibitor of Nrf2) (INrf2) [*R. norvegicus*], Kelch-like ECH-associated protein 1, *Mus musculus*, Similar to KIAA0952 protein, clone MGC:25591 IMAGE:4011475, mRNA, complete cds, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | RIKEN cDNA 2700038B03 gene, kelch-like ECH-associated protein 1 |
| 3702 | 1991 | NM_030995 | xx | | ESTs, Highly similar to microtubule-associated protein 1a [*Rattus norvegicus*] [*R. norvegicus*], ESTs, Moderately similar to microtubule-associated protein 1a [*Rattus norvegicus*] [*R. norvegicus*], ESTs, Weakly similar to microtubule-associated protein 1a [*Rattus norvegicus*] [*R. norvegicus*], ESTs, Weakly similar to MAPA_MOUSE Microtubule-associated protein 1A (MAP 1A) [*M. musculus*], chromatin assembly factor 1, subunit A (p150), expressed sequence AI853608, microtubule-associated protein 1A |
| 2403 | 17890 | AI179123 | j, mm | | ESTs, Highly similar to NF-E2-related factor 2 [*Rattus norvegicus*] [*R. norvegicus*], ESTs, Weakly similar to NF-E2-related factor 2 [*Rattus norvegicus*] [*R. norvegicus*], N F-E2-related factor 2, nuclear factor (erythroid derived 2)-like 1, nuclear factor (erythroid derived 2)-like 2, nuclear factor, erythroid derived 2,-like 1, nuclear, factor, erythroid derived 2 like 9 |
| 3893 | 1169 | NM_031789 | d, w, bb, ll | | ESTs, Highly similar to NF-E2-related factor 2 [*Rattus norvegicus*] [*R. norvegicus*], ESTs, Weakly similar to NF-E2-related factor 2 [*Rattus norvegicus*] [*R. norvegicus*], nuclear factor (erythroid-derived 2)-like 2, nuclear factor, erythroid derived 2, like 3, nuclear, factor, erythroid derived 2, like 2 |
| 3893 | 1170 | NM_031789 | d, ll | | ESTs, Highly similar to NF-E2-related factor 2 [*Rattus norvegicus*] [*R. norvegicus*], ESTs, Weakly similar to NF-E2-related factor 2 [*Rattus norvegicus*] [*R. norvegicus*], nuclear factor (erythroid-derived 2)-like 2, nuclear factor, erythroid derived 2, like 3, nuclear, factor, erythroid derived 2, like 2 |
| 4115 | 20254 | NM_057116 | ii | | ESTs, Highly similar to protein phosphatase 2 (formerly 2A), regulatory subunit B (PR 52), gamma isoform [*Rattus norvegicus*] [*R. norvegicus*], ESTs, Highly similar to JC7153 phosphoprotein phosphatase [*H. sapiens*], protein phosphatase 2 (formerly 2A), regulatory subunit B (PR 52), gamma isoform |
| 474 | 16215 | AA874999 | j | | ESTs, Highly similar to protein translocation complex beta; protein transport protein SEC61 beta subunit [*Homo sapiens*] [*H. sapiens*], protein translocation complex beta |
| 133 | 16463 | AA800663 | k | | ESTs, Highly similar to RAN binding protein 16 [*Mus musculus*] [*M. musculus*], ESTs, Moderately similar to RAN binding protein 16 [*Homo sapiens*] [*H. sapiens*], RAN binding protein 16 |
| 4116 | 23310 | NM_057119 | w | | ESTs, Highly similar to TLS-associated serine-arginine protein 1, isoform 1; TLS-associated serine-arginine protein 1; TLS-associated protein TASR [*Homo sapiens*] [*H. sapiens*], ESTs, Weakly similar to splicing factor, arginine/serine-rich (transformer 2 *Drosophila* homolog) 10 [*Rattus norvegicus*] [*R. norvegicus*], *Mus musculus* hexaribonucleotide binding protein 3 (Hrnbp3) mRNA, partial cds, RIKEN cDNA 1500010G04 gene, neural-salient serine/arginine-rich, silica-induced gene 41, splicing factor, arginine/serine-rich 10 (transformer 2 homolog, *Drosophila*) |
| 1889 | 15981 | AI103150 | nn | | ESTs, Highly similar to ubiquitin conjugating enzyme [*Rattus norvegicus*] [*R. norvegicus*], ESTs, Highly similar to A41222 ubiquitin--protein ligase [*H. sapiens*], ESTs, Weakly |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | similar to UBC2_HUMAN UBIQUITIN-CONJUGATING ENZYME E2-17 KD [*M. musculus*], RIKEN cDNA 2610301N02 gene, expressed sequence AI327276, ubiquitin conjugating enzyme, ubiquitin-conjugating enzyme E2A, RAD6 homolog (*S. cerevisiae*), ubiquitin-conjugating enzyme E2B (RAD6 homolog), ubiquitin-conjugating enzyme E2B, RAD6 homology (*S. cerevisiae*), ubiquitin-conjugating enzyme E2C |
| 1363 | 8047 | AI010100 | e | | ESTs, Highly similar to vacuolar protein sorting 18 (yeast), isoform 1; vacuolar protein sorting protein 18 [*Homo sapiens*] [*H. sapiens*], vacuolar protein sorting protein 18 |
| 4061 | 1601 | NM_053826 | t | | ESTs, Highly similar to [PYRUVATE DEHYDROGENASE(LIPOAMIDE)] KINASE ISOZYME 1 PRECURSOR [*R. norvegicus*], ESTs, Weakly similar to A49686 [pyruvate dehydrogenase (lipoamide)] kinase (EC 2.7.1.99) precursor - rat [*R. norvegicus*], ESTs, Weakly similar to PDK4_MOUSE [PYRUVATE DEHYDROGENASE [LIPOAMIDE]] KINASE ISOZYME 4, MITOCHONDRIAL PRECURSOR (PYRUVATE DEHYDROGENASE KINASE ISOFORM 4) [*M. musculus*], *Mus musculus*, Similar to pyruvate dehydrogenase kinase, isoenzyme 1, clone MGC:28719 IMAGE:4458562, mRNA, complete cds, *Mus musculus*, Similar to pyruvate dehydrogenase kinase, isoenzyme 3, clone MGC:6383 IMAGE:3500763, mRNA, complete cds, pyruvate dehydrogenase 2, pyruvate dehydrogenase kinase, isoenzyme 3 |
| 3609 | 12542 | NM_022647 | c, d, qq | | ESTs, Highly similar to 0506206A histone H2B [*Rattus norvegicus*] [*R. norvegicus*], ESTs, Weakly similar to I48401 histone H2b - mouse [*M. musculus*], H2B histone family, member A, H2B histone family, member D, H2B histone family, member G, H2B histone family, member K, *Mus musculus*, Similar to H2B histone family, member J, clone MGC:29103 IMAGE:5003093, mRNA, complete cds |
| 3608 | 2250 | NM_022643 | c, d, m, cc, kk, qq, vv | | ESTs, Highly similar to 0506206A histone H2B [*Rattus norvegicus*] [*R. norvegicus*], H2B histone family, member A, H2B histone family, member B, H2B histone family, member D, H2B histone family, member G, H2B histone family, member H, H2B histone family, member K, histone family member |
| 513 | 17314 | AA875509 | r | | ESTs, Highly similar to I814460A p53-associated protein [*H. sapiens*], Mdm2, transformed 3T3 cell double minute 2, p53 binding protein (mouse) |
| 2860 | 20082 | AI639488 | h, r, General, ii | | ESTs, Highly similar to I814460A p53-associated protein [*H. sapiens*], Mdm2, transformed 3T3 cell double minute 2, p53 binding protein (mouse), transformed mouse 3T3 cell double minute 2 |
| 606 | 17350 | AA892240 | k | | ESTs, Highly similar to 2008109A set gene [*Rattus norvegicus*] [*R. norvegicus*], ESTs, Highly similar to SET HUMAN SET PROTEIN [*H. sapiens*] SET translocation, SET translocation (myeloid leukemia-associated) |
| 3449 | 2933 | NM_019204 | e, m | | ESTs, Highly similar to A Chain A, Structure Of Beta-Secretase Complexed With Inhibitor {SUB 56-446 [*H. sapiens*], ESTs, Moderately similar to BACE_RAT Beta-secretase precursor (Beta-site APP cleaving enzyme) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | (Beta-site amyloid precursor protein cleaving enzyme) (Aspartyl protease 2) (Asp 2) (ASP2) (Membrane-associated aspartic protease 2) (Memapsin-2) [*R. norvegicus*], ESTs, Weakly similar to BACE_RAT Beta-secretase precursor (Beta-site APP cleaving enzyme) (Beta-site amyloid precursor protein cleaving enzyme) (Aspartyl protease 2) (Asp 2) (ASP2) (Membrane-associated aspartic protease 2) (Memapsin-2) [*R. norvegicus*], beta-site APP cleaving enzyme, beta-site APP-cleaving enzyme 2 |
| 2988 | 24554 | M13749 | m | | ESTs, Highly similar to A25951 placental lactogen II - rat [*R. norvegicus*], *Rattus norvegicus* PLP-H mRNA for prolactin-like protein H, complete cds, placental lactogen 2. prolactin |
| 3417 | 20848 | NM_017343 | x | | ESTs, Highly similar to A37100 myosin regulatory light chain A, smooth muscle - rat [*R. norvegicus*], RIKEN cDNA 2900073G15 gene, myosin light chain, phosphorylatable, cardiac ventricles, myosin regulatory light chain, myosin, light polypeptide, regulatory, non-sarcomeric (20 kD) |
| 3417 | 20849 | NM_017343 | r, ff | | ESTs, Highly similar to A37100 myosin regulatory light chain A, smooth muscle - rat [*R. norvegicus*], RIKEN cDNA 2900073G15 gene, myosin light chain, phosphorylatable, cardiac ventricles, myosin regulatory light chain, myosin, light polypeptide, regulatory, non-sarcomeric (20 kD) |
| 2472 | 16970 | AI228112 | tt | | ESTs, Highly similar to A38351 phosphoprotein phosphatase 2-alpha regulatory chain [*H. sapiens*], RIKEN cDNA 2410004D02 gene, protein phosphatase 2 (formerly 2A), regulatory subunit B (PR 52), alpha isoform |
| 4103 | 16965 | NM_053999 | v | | ESTs, Highly similar to A38351 phosphoprotein phosphatase 2-alpha regulatory chain [*H. sapiens*], RIKEN cDNA 2410004D02 gene, protein phosphatase 2 (formerly 2A), regulatory subunit B (PR 52), alpha isoform |
| 4110 | 17709 | NM_057101 | y | | ESTs, Highly similar to A45445 janusin precursor, long form - rat [*R. norvegicus*], ESTs, Weakly similar to JQ1322 tenascin precursor - mouse [*M. musculus*], Tenascin-R (Restrictin, janusin, J1-160/180), tenascin R (restrictin. janusin), tenascin XB |
| 3099 | 18726 | NM_012645 | b, q, v, General, dd, oo, rr | | ESTs, Highly similar to A45840 MHC class I histocompatibility antigen RT-BM1 alpha chain - rat (fragment) [*R. norvegicus*], *Homo sapiens*, clone IMAGE:4694038, mRNA, partial cds, histocompatibility 2, T region locus 23 |
| 3518 | 18724 | NM_021585 | b,ss | | ESTs, Highly similar to A45840 MHC class I histocompatibility antigen RT-BM1 alpha chain - rat (fragment) [*R. norvegicus*], *Homo sapiens*, clone IMAGE:4694038, mRNA, partial cds, histocompatibility 2, T region locus 23 |
| 1605 | 11763 | AI045196 | tt | | ESTs, Highly similar to A47328 natural killer cell tumor-recognition protein [H. sapiens] |
| 4186 | 1791 | NM_133541 | ww | | ESTs, Highly similar to A56011 transcription factor IIIC alpha chain - rat [*R. norvegicus*], ESTs, Moderately similar to A56011 transcription factor IIIC alpha chain - rat [*R. norvegicus*], ESTs, Weakly similar to A56011 transcription factor IIIC alpha chain rat [*R. norvegicus*], general transcription factor III C 1, general transcription factor IIIC, polypeptide 1 (alpha subunit, 220 kD) |
| 1099 | 24050 | AA957449 | v | | ESTs, Highly similar to A57286 probable serine/threonine protein kinase |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | [*M. musculus*], ESTs, Highly similar to SNK_RAT Serine/threonine-protein kinase SNK (Serum inducible kinase) [*R. norvegicus*], ESTs, Weakly similar to A57286 probable serine/threonine protein kinase [*M. musculus*], ESTs, Weakly similar to SNK_RAT Serine/threonine-protein kinase SNK (Serum inducible kinase) [*R. norvegicus*], *Homo sapiens* cDNA FLJ30246 fis, clone BRACE2002202, weakly similar to SERINE/THREONINE PROTEIN KINASE SNK (EC 2.7.1.-), NIMA (never in mitosis gene a)-related expressed kinase 1, serum-inducible kinase |
| 4214 | 1530 | NM_134397 | h, vv | | ESTs, Highly similar to A59252 myosin heavy chain, nonmuscle, form IIB [*H. sapiens*], ESTs, Weakly similar to neuronal thread protein [*Homo sapiens*] [*H. sapiens*], ESTs, Weakly similar to LORICRIN [*M. musculus*], *Homo sapiens* mRNA; cDNA DKFZp434G227 (from clone DKFZp434G227), *Homo sapiens*, clone IMAGE:4111094, mRNA, partial cds, KIAA0638 protein, *Mus musculus*, Similar to hypothetical protein MG02705, clone MGC:36471 IMAGE:5359433, mRNA, complete cds, *Mus musculus*, clone MGC:32394 IMAGE:5037534, mRNA, complete cds, expressed sequence AI036317, expressed sequence AV253284, expressed sequence C77080, loricrin |
| 4050 | 6290 | NM_053795 | tt | | ESTs, Highly similar to ANK1 MOUSE ANKYRIN 1 [*M. musculus*], ESTs, Weakly similar to ANK1 MOUSE ANKYRIN 1 [*M. musculus*], GASZ, Gasz, *Homo sapiens* cDNA FLJ25053 fis, clone CBL04266, *Mus musculus* ankyrin repeat domain-containing SOCS box protein Asb-16 mRNA, complete cds, *Mus musculus*, Similar to hypothetical protein DKFZp5640043, clone MGC:36949 IMAGE:4946879, mRNA, complete cds, RIKEN cDNA 1110058D09 gene, RIKEN cDNA 4933400N19 gene, hypothetical protein similar to ankyrin repeat-containing priotein AKR1, likely homolog of rat kinase D-interacting substance of 220 kDa, regulatory factor X-associated ankyrin-containing protein |
| 3640 | 20681 | NM_022952 | u | | ESTs, Highly similar to AP19_HUMAN CLATHRIN COAT ASSEMBLY PROTEIN AP19 [*H. sapiens*], ESTs, Highly similar to clathrin-associated protein APi 7 delta [*H. sapiens*], ESTs, Weakly similar to A2S1_MOUSE Clathrin coat assembly protein AP17 (Clathrin coat associated protein AP17) (Plasma membrane adaptor AP-2 17 kDa protein) (HA2 17 kDa subunit) (Clathrin assembly protein 2 small chain) [*R. norvegicus*], *Homo sapiens*, clone MGC:17284 IMAGE:4340257, mRNA, complete cds, adaptor-related protein complex 2, sigma 1 subunit, expressed sequence AI043088 |
| 999 | 22607 | AA945580 | b | | ESTs, Highly similar to ARG2_RAT Arginase II, mitochondrial precursor (Non-hepatic arginase) (Kidney-type arginase) [*R. norvegicus*], RIKEN cDNA 5033405N08 gene, agmatine ureohydrolase (agmatinase), arginase type II, arginase, type II |
| 3481 | 17507 | NM_019299 | w | | ESTs, Highly similar to B Chain B, Peptide-In-Groove Interactions Link Target Proteins To The B-Propeller Of Clathrin [*R. norvegicus*], RIKEN cDNA 1700034F02 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | gene, clathrin, heavy polypeptide (Hc), clathrin, heavy polypeptide-like 1, expressed sequence R74732 |
| 2236 | 6454 | AI175342 | p, kk | | ESTs, Highly similar to BIR6_HUMAN BACULOVIRAL IAP REPEAT-CONTAINING PROTEIN 6 (UBIQUITIN-CONJUGATING BIR-DOMAIN ENZYME APOLLON) [*H. sapiens*], baculoviral IAP repeat-containing 6 (apollon), hypothetical protein FLJ13855, likely ortholog of mouse ubiquitin conjugating enzyme E2-230K |
| 4440 | 18924 | X58830 | g | | ESTs, Highly similar to BMHU6 bone morphogenetic protein 6 precursor [*H. sapiens*], ESTs, Moderately similar to S37618 vgr protein - rat (fragment) [*R. norvegicus*], bone morphogenetic protein 5, bone morphogenetic protein 6, bone morphogenetic protein 7, bone morphogenetic protein 7 (osteogenic protein 1), bone morphogenetic protein 8 (osteogenic protein 2) |
| 1295 | 21563 | AI007750 | gg, hh | | ESTs, Highly similar to C Chain C, Structure Of A Cbl-Ubch7 Complex: Ring Domain Function In Ubiquitin-Protein Ligases [*H. sapiens*], ESTs, Weakly similar to ubiquitin-conjugating enzyme E2D 2 [*Rattus norvegicus*] [*R. norvegicus*], RIKEN cDNA 1700013N18 gene, ubiquitin-conjugating enzyme 8, ubiquitin-conjugating enzyme E2D 2, ubiquitin-conjugating enzyme E2L 3, ubiquitin-conjugating enzyme E2L 6 |
| 3988 | 19199 | NM_053522 | u | | ESTs, Highly similar to Cdc42 From Human, Nmr, 20 Structures [*H. sapiens*], *Mus musculus* mRNA for small GTPase Tc10, complete cds, cell division cycle 42 (GTP binding protein, 25 kD), cell division cycle 42 homolog (*S. cerevisiae*), ras homolog gene family, member J, ras-related C3 botulinum toxin substrate 1 (rho family, small GTP binding protein Rac1) |
| 3988 | 19200 | NM_053522 | k, l, s, cc | | ESTs, Highly similar to Cdc42 From Human, Nmr, 20 Structures [*H. sapiens*], *Mus musculus* mRNA for small GTPase Tc10, complete cds, cell division cycle 42 (GTP binding protein, 25 kD), cell division cycle 42 homolog (*S. cerevisiae*), ras homolog gene family, member J, ras-related C3 botulinum toxin substrate 1 (rho family, small GTP binding protein Rac1) |
| 3988 | 19205 | NM_053522 | cc, pp | | ESTs, Highly similar to Cdc42 From Human, Nmr, 20 Structures [*H. sapiens*], *Mus musculus* mRNA for small GTPase Tc10, complete cds, cell division cycle 42 (GTP binding protein, 25 kD), cell division cycle 42 homolog (*S. cerevisiae*), ras homolog gene family, member J, ras-related C3 botulinum toxin substrate 1 (rho family, small GTP binding protein Rac1) |
| 3988 | 19206 | NM_053522 | a, cc | | ESTs, Highly similar to Cdc42 From Human, Nmr, 20 Structures [*H. sapiens*], *Mus musculus* mRNA for small GTPase Tc10, complete cds, cell division cycle 42 (GTP binding protein, 25 kD), cell division cycle 42 homolog (*S. cerevisiae*), ras homolog gene family, member J, ras-related C3 botulinum toxin substrate 1 (rho family, small GTP binding protein Rac1) |
| 2300 | 23403 | AI176714 | bb | | ESTs, Highly similar to CHD1_HUMAN CHROMODOMAIN-HELICASE-DNA BINDING PROTEIN 1 [*H. sapiens*], ESTs, Weakly similar to CHD1 MOUSE CHROMODOMAIN-HELICASE-DNA BINDING PROTEIN 1 [*M. musculus*], ESTs, Weakly similar to CHD1_HUMAN |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3885 | 20752 | NM_031763 | ii | | CHROMODOMAIN-HELICASE-ONA BINDING PROTEIN 1 [*H. sapiens*], *Mus musculus* 13 days embryo head cDNA, RIKEN full-length enriched library, clone:3110010F13:helicase, lymphoid specific, full insert sequence, chromodomain helicase DNA binding protein 1<br>ESTs, Highly similar to CIA1_HUMAN WD40-REPEAT CONTAINING PROTEIN CIAO 1 [*H. sapiens*], ESTs, Weakly similar to LIS1_HUMAN PLATELET-ACTIVATING FACTOR ACETYLHYDROLASE IB ALPHA SUBUNIT [*H. sapiens*], ESTs, Weakly similar to LIS1_MOUSE Platelet-activating factor acetylhydrolase 1B alpha subunit (PAF acetylhydrolase 45 kDa subunit) (PAF-AH 45 kDa subunit) (PAF-AH alpha) (PAFAH alpha) (Lissencephaly-1 protein) (LIS-1) [*R. norvegicus*], F-box and WD-40 domain protein 7 (archipelago homolog, *Drosophila*), *Homo sapiens* cDNA FLJ31861 fis, clone NT2RP7001319, KIAA0007 protein, MEP50 protein, *Mus musculus* F-box-WD40 repeat protein 6 (Fbxw6) mRNA, complete cds, *Mus musculus*, Similar to RIKEN cDNA 1500041N16 gene, clone MGC:12066 IMAGE:3708188, mRNA, complete cds, hypothetical protein FLJ11848, hypothetical protein similar to beta-transducin family, platelet-activating factor acetylhydrolase, isoform 1b, beta1 subunit, platelet-activating factor acetylhydrolase, isoform Ib, alpha subunit (45 kD) |
| 3885 | 20753 | NM_031763 | l, General, dd, pp | | ESTs, Highly similar to CIA1_HUMAN WD40-REPEAT CONTAINING PROTEIN CIAO 1 [*H. sapiens*] ESTs Weakly similar to LIS1_HUMAN PLATELET ACTIVATING FACTOR ACETYLHYDROLASE 1B ALPHA SUBUNIT [*H. sapiens*], ESTs, Weakly similar to LIS1_MOUSE Platelet-activating factor acetylhydrolase 1B alpha subunit (PAF acetylhydrolase 45 kDa subunit) (PAF-AH 45 kDa subunit) (PAF-AH alpha) (PAFAH alpha) (Lissencephaly-1 protein) (LIS-1) [*R. norvegicus*], F-box and WD-40 domain protein 7 (archipelago homolog, *Drosophila*), *Homo sapiens* cDNA FLJ31861 fis, clone NT2RP7001319, KIAA0007 protein, MEP50 protein, *Mus musculus* F-box-WD40 repeat protein 6 (Fbxw6) mRNA, complete cds, *Mus musculus*, Similar to RIKEN cDNA 1500041N16 gene, clone MGC:12066 IMAGE:3708188, mRNA, complete cds, hypothetical protein FLJ11848, hypothetical protein similar to beta-transducin family, platelet-activating factor acetylhydrolase, isoform 1b, beta1 subunit, platelet-activating factor acetylhydrolase, isoform Ib, alpha subunit (45 kD) |
| 4158 | 18846 | NM_130755 | b, dd | | ESTs, Highly similar to citrate synthase [*H. sapiens*], RIKEN cDNA 1700007H16 gene, citrate synthase |
| 4194 | 1164 | NM_133584 | g | | ESTs, Highly similar to CN5A RAT CGMP-SPECIFIC 3',5'-CYCLIC PHOSPHODIESTERASE [*R. norvegicus*], ESTs, Weakly similar to I617166A rod cGMP phosphodiesterase beta [*M. musculus*], ESTs, Weakly similar to CN5A_RAT CGMP-SPECIFIC 3',5'-CYCLIC PHOSPHODIESTERASE (CGB-PDE) (CGMP-BINDING CGMP-SPECIFIC PHOSPHODIESTERASE) [*R. norvegicus*], |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | phosphodiesterase 11A, phosphodiesterase 5A cGMP-specific |
| 3969 | 12223 | NM_053370 | nn, qq | | ESTs, Highly similar to DDP_HUMAN X-LINKED DEAFNESS DYSTONIA PROTEIN [H. sapiens], ESTs, Moderately similar to JC7322 deafness dystonia peptide 1 - mouse [M. musculus], hypothetical protein MG012262, translocase of inner mitochondrial membrane 8 homolog A (yeast), translocase of inner mitochondrial membrane 8 homolog a (yeast) |
| 33 | 17613 | AA799511 | ww | | ESTs, Highly similar to DDRT helix-destabilizing protein - rat [R. norvegicus], ESTs, Highly similar to S12520 core protein A1 [H. sapiens], ESTs, Highly similar to heterogeneous ribonuclear particle protein A1 [H. sapiens], ESTs, Moderately similar to heterogeneous ribonuclear particle protein A1 [H. sapiens], ESTs, Weakly similar to ROA2 MOUSE HETEROGENEOUS NUCLEAR RIBONUCLEOPROTEINS A2/B1 [M. musculus], Mus musculus, similar to heterogeneous nuclear ribonucleoprotein A3 (H. sapiens), clone MGC:37309 IMAGE:4975085, mRNA, complete cds, RIKEN cDNA 2610510D13 gene, RIKEN cDNA 3010025E17 gene, heterogeneous nuclear ribonucleoprotein A1, heterogeneous nuclear ribonucleoprotein A2/B1 |
| 269 | 17614 | AA848306 | t, ll, tt | | ESTs, Highly similar to DDRT helix-destabilizing protein - rat [R. norvegicus], ESTs, Highly similar to S12520 core protein A1 [H. sapiens], ESTs, Highly similar to heterogeneous ribonuclear particle protein A1 [H. sapiens], ESTs, Moderately similar to heterogeneous ribonuclear particle protein A1 [H. sapiens], ESTs, Weakly similar to ROA2 MOUSE HETEROGENEOUS NUCLEAR RIBONUCLEOPROTEINS A2/B1 [M. musculus], Mus musculus, similar to heterogeneous nuclear ribonucleoprotein A3 (H. sapiens), clone MGC:37309 IMAGE:4975085, mRNA, complete cds, RIKEN cDNA 2610510D13 gene, RIKEN cDNA 3010025E17 gene, heterogeneous nuclear ribonucleoprotein A1, heterogeneous nuclear ribonucleoprotein A2/B1 |
| 2134 | 23966 | AI170442 | t, mm | | ESTs, Highly similar to DEST_HUMAN DESTRIN [H. sapiens], Homo sapiens cDNA FLJ31388 fis, clone NT2NE1000023, cofilin 1, non-muscle, destrin, destrin (actin depolymerizing factor), destrin-2 pseudogene, expressed sequence AW987265 |
| 331 | 14963 | AA851161 | ii | | ESTs, Highly similar to DYNC_HUMAN DYNACTIN, 50 KD ISOFORM [H. sapiens], dynactin 2 (p50) |
| 680 | 16482 | AA892940 | x | | ESTs, Highly similar to EF2_RAT Elongation factor 2 (EF-2) [R. norvegicus], ESTs, Weakly similar to EF2_MOUSE Elongation factor 2 (EF-2) [M. musculus], U5 small nuclear ribonucleoprotein 116 kDa, eukaryotic translation elongation factor 2 |
| 22 | 6581 | AA799412 | v | | ESTs, Highly similar to ERR3_HUMAN ESTROGEN-RELATED RECEPTOR GAMMA [H. sapiens], estrogen related receptor, alpha, estrogen-related receptor alpha, estrogen-related receptor gamma |
| 2183 | 6582 | AI171726 | bb | | ESTs, Highly similar to ERR3_HUMAN ESTROGEN-RELATED RECEPTOR GAMMA [H. sapiens], estrogen related |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | receptor, alpha, estrogen-related receptor alpha, estrogen-related receptor gamma |
| 3977 | 2242 | NM_053433 | l | | ESTs, Highly similar to FMO3_HUMAN DIMETHYLANILINE MONOOXYGENASE [*H. sapiens*], ESTs, Weakly similar to FMO3_HUMAN DIMETHYLANILINE MONOOXYGENASE [*H. sapiens*], *Mus musculus* flavin-containing monooxygenase 4 mRNA, complete cds, flavin containing monooxygenase 2, flavin containing monooxygenase 3, flavin containing monooxygenase 5 |
| 4199 | 1546 | NM_133595 | a, s, uu, vv | | ESTs, Highly similar to GFRP RAT GTP CYCLOHYDROLASE I FEEDBACK REGULATORY PROTEIN [*R. norvegicus*], GTP cyclohydrolase I feedback regulatory protein |
| 2084 | 17812 | AI169075 | uu | | ESTs, Highly similar to GTO1_RAT Glutathione transferase omega 1 (GSTO 1-1) (Glutathione-dependent dehydroascorbate reductase) [*R. norvegicus*], ESTs, Weakly similar to GTXH_HUMAN GLUTATHIONE-S-TRANSFERASE HOMOLO [*H. sapiens*], RIKEN cDNA 1700020F09 gene, glutathione S-transferase omega 1, glutathione transferase zeta 1 (maleylacetoacetate isomerase), glutathione S-transferase like; glutathione transferase |
| 1368 | 15644 | AI010256 | a, d, n, kk | | ESTs, Highly similar to H33_HUMAN HISTONE H3.3 [*H. sapiens*], H3 histone, family 3A, H3 histone, family 3B, H3 histone, family 3B (H3.3B), RIKEN cDNA 1810027O10 gene |
| 2013 | 24212 | AI136747 | c | | ESTs, Highly similar to H33_HUMAN HISTONE H3.3 [*H. sapiens*], H3 histone, family 3A, H3 histone, family 3B, H3 histone, family 3B (H3.3B), RIKEN cDNA 1810027O10 gene |
| 2101 | 24213 | AI169289 | c | | ESTs, Highly similar to H33_HUMAN HISTONE H3.3 [*H. sapiens*], H3 histone, family 3A, H3 histone, family 3B, H3 histone, family 3B (H3.3B), RIKEN cDNA 1810027O10 gene |
| 2251 | 24214 | AI175794 | s | | ESTs, Highly similar to H33_HUMAN HISTONE H3.3 [*H. sapiens*], H3 histone, family 3A, H3 histone, family 3B, H3 histone, family 38 (H3.3B), RIKEN cDNA 1810027O10 gene |
| 4098 | 15642 | NM_053985 | d, r, kk, rr | | ESTs, Highly similar to H33_HUMAN HISTONE H3.3 [*H. sapiens*], H3 histone, family 3A, H3 histone, family 3B, H3 histone, family 3B (H3.3B), RIKEN cDNA 1810027O10 gene |
| 4098 | 15645 | NM_053985 | n, rr | | ESTs, Highly similar to H33_HUMAN HISTONE H3.3 [*H. sapiens*], H3 histone, family 3A, H3 histone, family 3B, H3 histone, family 3B (H3.3B), RIKEN cDNA 1810027O10 gene |
| 390 | 19105 | AA859230 | v, x | | ESTs, Highly similar to HG14_HUMAN NONHISTONE CHROMOSOMAL PROTEIN HMG-1 [*H. sapiens*], ESTs, Highly similar to HG17_RAT NONHISTONE CHROMOSOMAL PROTEIN HMG-17 [*R. norvegicus*], ESTs, Weakly similar to HG17_RAT NONHISTONE CHROMOSOMAL PROTEIN HMG-17 [*R. norvegicus*], high mobility group nucleosomal binding domain 2, high-mobility group (nonhistone chromosomal) protein 17, thyroid hormone receptor interactor 7 |
| 3421 | 24428 | NM_017356 | nn | | ESTs, Highly similar to HIPP_HUMAN Neuron specific calcium-binding protein hippocalcin (P23K) (Calcium-binding protein |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | BDR-2) [*R. norvegicus*], ESTs, Moderately similar to VIS3 MOUSE VISININ-LIKE PROTEIN 3 [*M. musculus*], *Mus musculus*, clone MGC:21424 IMAGE:4500919, mRNA, complete cds, expressed sequence AI848120, guanylate cyclase activator 1A (retina), guanylate cyclase activator 1B (retina), guanylate cyclase activator 1C, guanylate cyclase activator 1a (retina), hippocalcin-like 1, hypothetical protein FLJ11767, neurocalcin delta |
| 2740 | 13911 | AI236262 | ww | | ESTs, Highly similar to HMG1_HUMAN HIGH MOBILITY GROUP PROTEIN HMG1 [*H. sapiens*], ESTs, Moderately similar to HMG1 MOUSE HIGH MOBILITY GROUP PROTEIN HMG1 [*M. musculus*], ESTs, Moderately similar to high mobility group protein homolog HMG4 [*M. musculus*], ESTs, Weakly similar to HMG1_HUMAN HIGH MOBILITY GROUP PROTEIN HMG1 [*H. sapiens*], High mobility group 1, *Mus musculus* thymus high mobility group box protein TOX (Tox) mRNA, complete cds, RIKEN cDNA 4932431 P20 gene, high mobility group box 1, high mobility group box 3, high-mobility group (nonhistone chromosomal) protein 1, high-mobility group (nonhistone chromosomal) protein 4 |
| 3191 | 19106 | NM_012963 | ss | | ESTs, Highly similar to HMG1_HUMAN HIGH MOBILITY GROUP PROTEIN HMG1 [*H. sapiens*], ESTs, Moderately similar to HMG1 MOUSE HIGH MOBILITY GROUP PROTEIN HMG1 [*M. musculus*], ESTs, Moderately similar to high mobility group protein homolog HMG4 [*M. musculus*], ESTs, Weakly similar to HMG1_HUMAN HIGH MOBILITY GROUP PROTEIN HMG1 [*H. sapiens*], RIKEN cDNA 4932431P20 gene, *Rattus norvegicus* epidermal Langerhans cell protein LCP1 mRNA, complete cds, high mobility group 20A, high mobility group box 1, high-mobility group (nonhistone chromosomal) protein 1, high-mobility group 20A |
| 3191 | 19107 | NM_012963 | cc | | ESTs, Highly similar to HMG1_HUMAN HIGH MOBILITY GROUP PROTEIN HMG1 [*H. sapiens*], ESTs, Moderately similar to HMG1 MOUSE HIGH MOBILITY GROUP PROTEIN HMG1 [*M. musculus*], ESTs, Moderately similar to high mobility group protein homolog HMG4 [*M. musculus*], ESTs, Weakly similar to HMG1_HUMAN HIGH MOBILITY GROUP PROTEIN HMG1 [*H. sapiens*], RIKEN cDNA 4932431P20 gene, *Rattus norvegicus* epidermal Langerhans cell protein LCP1 mRNA, complete cds, high mobility group 20A, high mobility group box 1, high-mobility group (nonhistone chromosomal) protein 1, high-mobility group 20A |
| 3191 | 19108 | NM_012963 | ii | | ESTs, Highly similar to HMG1_HUMAN HIGH MOBILITY GROUP PROTEIN HMG1 [*H. sapiens*], ESTs, Moderately similar to HMG1 MOUSE HIGH MOBILITY GROUP PROTEIN HMG1 [*M. musculus*], ESTs, Moderately similar to high mobility group protein homolog HMG4 [*M. musculus*], ESTs, Weakly similar to HMG1_HUMAN HIGH MOBILITY GROUP PROTEIN HMG1 [*H. sapiens*], RIKEN cDNA 4932431P20 gene, *Rattus norvegicus* epidermal Langerhans cell protein LCP1 mRNA, complete cds, high mobility group 20A, high mobility group box 1, high-mobility group |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | (nonhistone chromosomal) protein 1, high-mobility group 20A |
| 3191 | 19109 | NM_012963 | ee | | ESTs, Highly similar to HMG1_HUMAN HIGH MOBILITY GROUP PROTEIN HMG1 [*H. sapiens*], ESTs, Moderately similar to HMG1 MOUSE HIGH MOBILITY GROUP PROTEIN HMG1 [*M. musculus*], ESTs, Moderately similar to high mobility group protein homolog HMG4 [*M. musculus*], ESTs, Weakly similar to HMG1_HUMAN HIGH MOBILITY GROUP PROTEIN HMG1 [*H. sapiens*], RIKEN cDNA 4932431P20 gene, *Rattus norvegicus* epidermal Langerhans cell protein LCP1 mRNA, complete cds, high mobility group 20A, high mobility group box 1 high-mobility group (nonhistone chromosomal) protein 1 high-mobility group 20A |
| 3191 | 19110 | NM_012963 | jj | | ESTs, Highly similar to HMG1_HUMAN HIGH MOBILITY GROUP PROTEIN HMG1 [*H. sapiens*], ESTs, Moderately similar to HMG1 MOUSE HIGH MOBILITY GROUP PROTEIN HMG1 [*M. musculus*], ESTs, Moderately similar to high mobility group protein homolog HMG4 [*M. musculus*], ESTs, Weakly similar to HMG1_HUMAN HIGH MOBILITY GROUP PROTEIN HMG1 [*H. sapiens*], RIKEN cDNA4932431P20 gene, *Rattus norvegicus* epidermal Langerhans cell protein LCP1 mRNA, complete cds, high mobility group 20A, high mobility group box 1, high-mobility group (nonhistone chromosomal) protein 1, high-mobility group 20A |
| 1851 | 18649 | AI101926 | q | | ESTs, Highly similar to HS9B_RAT Heat shock protein HSP 90-beta (HSP 84) [*R. norvegicus*], ESTs, Highly similar to T46243 hypothetical protein DKFZp761K0511.1 [*H. sapiens*], RIKEN cDNA 1810014B01 gene, expressed sequence 081438, heat shock 90 kD protein 1, beta, heat shock protein, 84 kDa 1, tumor rejection antigen (gp96) 1, tumor rejection antigen gp96 |
| 2530 | 18650 | AI230121 | q, ii, ll | | ESTs, Highly similar to HS9B_RAT Heat shock protein HSP 90-beta (HSP 84) [*R. norvegicus*], ESTs, Highly similar to T46243 hypothetical protein DKFZp761K0511.1 [*H. sapiens*], RIKEN cDNA 1810014B01 gene, expressed sequence 081438, heat shock 90 kD protein 1, beta, heat shock protein, 84 kDa 1, tumor rejection antigen (gp96) 1, tumor rejection antigen gp96 |
| 4338 | 18647 | 569316 | q, dd | | ESTs, Highly similar to HS9B_RAT Heat shock protein HSP 90-beta (HSP 84) [*R. norvegicus*], ESTs, Highly similar to T46243 hypothetical protein DKFZp761K0511.1 [*H. sapiens*], RIKEN cDNA 1810014B01 gene, expressed sequence 081438, heat shock 90 kD protein 1, beta, heat shock protein, 84 kDa 1, tumor rejection antigen (gp96) 1, tumor rejection antigen gp96 |
| 1338 | 19092 | AI009501 | h, w | | ESTs, Highly similar to Human Translation Initiation Factor Eif1, Nmr, 29 Structures [*H. sapiens*], putative translation initiation factor, suppressor of initiator codon mutations, related sequence 1 (*S. cerevisiae*) |
| 349 | 21489 | AA851443 | e | | ESTs, Highly similar to I49523 Mouse primary response gene B94 mRNA, 3' end - mouse [*M. musculus*], RIKEN cDNA 1600013K19 gene, similar to *S. cerevisiae* |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1633 | 21490 | AI045764 | jj | | Sec6p and *R. norvegicus* rsec6, tumor necrosis factor. alpha-induced protein 2 ESTs, Highly similar to I49523 Mouse primary response gene B94 mRNA, 3′ end - mouse [*M. musculus*], RIKEN cDNA 1600013K19 gene, similar to *S. cerevisiae* Sec6p and *R. norvegicus* rsec6, tumor necrosis factor, alpha-induced protein 2 |
| 4371 | 21488 | U32575 | e, xx | | ESTs, Highly similar to I49523 Mouse primary response gene B94 mRNA, 3′ end - mouse [*M. musculus*], RIKEN cDNA 1600013K19 gene, similar to *S. cerevisiae* Sec6p and *R. norvegicus* rsec6, tumor necrosis factor alpha-induced protein 2 |
| 2636 | 12873 | AI232984 | tt | | ESTs, Highly similar to I49636 DNA-binding protein - mouse [*M. musculus*], ESTs, Highly similar to OZF__HUMAN ZINC FINGER PROTEIN OZF [*H. sapiens*], ESTs, Moderately similar to I49636 DNA-binding protein - mouse [*M. musculus*], ESTs, Weakly similar to I38616 zinc finger protein ZNF139 [*H. sapiens*], ESTs, Weakly similar to OZF__HUMAN ZINC FINGER PROTEIN OZF [*H. sapiens*], *Mus musculus*, Similar to zinc finger protein 97, clone MGC:6111 IMAGE:3494875, mRNA, complete cds, Pancreas zinc finger protein, see also D1Bda10\2, zinc finger protein 260, zinc finger protein 63, zinc finger protein 97 |
| 4055 | 19827 | NM_053806 | oo | | ESTs, Highly similar to I49636 DNA-binding protein - mouse [*M. musculus*], ESTs, Highly similar to OZF__HUMAN ZINC FINGER PROTEIN OZF [*H. sapiens*], ESTs, Moderately similar to I49636 DNA-binding protein - mouse [*M. musculus*], ESTs, Weakly similar to OZF__HUMAN ZINC FINGER PROTEIN OZF [*H. sapiens*], ESTs, Weakly similar to Z177__HUMAN ZINC FINGER PROTEIN 177 [*H. sapiens*], *Homo sapiens* mRNA; cDNA DKFZp547C146 (from clone DKFZp547C146), *Mus musculus*, Similar to zinc finger protein 97, clone MGC:6111 IMAGE:3494875, mRNA, complete cds, Pancreas zinc finger protein, see also D1Bda10\2, zinc finger protein 177, zinc finger protein 260, zinc finger protein 63, zinc finger protein 97 |
| 1733 | 26184 | AI070784 | m | | ESTs, Highly similar to I49636 DNA-binding protein - mouse [*M. musculus*], ESTs, Highly similar to OZF__HUMAN ZINC FINGER PROTEIN OZF [*H. sapiens*], ESTs, Moderately similar to I49636 DNA-binding protein - mouse [*M. musculus*], ESTs, Weakly similar to OZF__HUMAN ZINC FINGER PROTEIN OZF [*H. sapiens*], *Mus musculus*, Similar to zinc finger protein 97, clone MGC:6111 IMAGE:3494875, mRNA, complete cds, Pancreas zinc finger protein, see also D1Bda10\2, zinc finger protein 136 (clone pHZ-20), zinc finger protein 260, zinc finger protein 63, zinc finger protein 97 |
| 3831 | 67 | NM_031605 | cc | | ESTs, Highly similar to I65981 fatty acid omega-hydroxylase [*H. sapiens*], *Homo sapiens*, Similar to cytochrome P450, subfamily VA, polypeptide 11, clone MGC:22151 IMAGE:4072062, mRNA, complete cds, *Mus musculus*, Similar to cytochrome P450, 4a10, clone MGC:18880 IMAGE:4237837, mRNA, complete cds, *Mus musculus*, Similar to cytochrome P450, 4a10, clone MGC:25972 IMAGE:4240359, mRNA, complete cds, RIKEN cDNA A230105L22 gene, cytochrome P450, 4a10, expressed sequence AI314743 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1048 | 23584 | AA955071 | ff | | ESTs, Highly similar to I67428 retinoic acid receptor homolog - rat (fragment) [*R. norvegicus*], retinoid X receptor gamma, retinoid X receptor, gamma |
| 1260 | 19649 | AF016387 | pp | | ESTs, Highly similar to I67428 retinoic acid receptor homolog - rat (fragment) [*R. norvegicus*], retinoid X receptor gamma, retinoid X receptor, gamma |
| 1260 | 19650 | AF016387 | s | | ESTs, Highly similar to I67428 retinoic acid receptor homolog - rat (fragment) [*R. norvegicus*], retinoid X receptor gamma, retinoid X receptor, gamma |
| 4093 | 1764 | NM_053974 | ff, pp | | ESTs, Highly similar to IF4E_HUMAN EUKARYOTIC TRANSLATION INITIATION FACTOR 4E [*H. sapiens*], RIKEN cDNA 1300018P11 gene, RIKEN cDNA 2700069E09 gene, eukaryotic translation initiation factor 4E, eukaryotic translation initiation factor 4E-like 3 |
| 2114 | 21660 | AI169751 | b, dd | | ESTs, Highly similar to IFM3_HUMAN INTERFERON-INDUCED TRANSMEMBRANE PROTEIN 3 [*H. sapiens*], ESTs, Highly similar to S17182 interferon-induced protein 1-8U [*H. sapiens*], RIKEN cDNA 1110004C05 gene, interferon induced transmembrane protein 1 (9-27), interferon induced transmembrane protein 3 (1-8U) |
| 2281 | 21661 | AI176479 | y, nn | | ESTs, Highly similar to IFM3_HUMAN INTERFERON-INDUCED TRANSMEMBRANE PROTEIN 3 [*H. sapiens*], ESTs, Highly similar to S17182 interferon-induced protein 1-8U [*H. sapiens*], RIKEN cDNA 1110004C05 gene, interferon induced transmembrane protein 1 (9-27), interferon induced transmembrane protein 3 (1-8U) |
| 4444 | 21657 | X61381 | b, x, General, bb, dd, ll, nn, qq | | ESTs, Highly similar to IFM3_HUMAN INTERFERON-INDUCED TRANSMEMBRANE PROTEIN 3 [*H. sapiens*], ESTs, Highly similar to S17182 interferon-induced protein 1-8U [*H. sapiens*], RIKEN cDNA 1110004C05 gene, interferon induced transmembrane protein 1 (9-27), interferon induced transmembrane protein 3 (1-8U) |
| 3297 | 80 | NM_017021 | cc | | ESTs, Highly similar to IL9R MOUSE INTERLEUKIN-9 RECEPTOR PRECURSOR [*M. musculus*], interleukan 9 receptor |
| 2839 | 25942 | AI639291 | cc | | ESTs, Highly similar to ITA8_HUMAN INTEGRIN ALPHA-8 [*H. sapiens*], integrin, alpha 8, integrin, alpha 9 |
| 2400 | 4587 | AI179092 | ff | | ESTs, Highly similar to JC2120 heparin-binding protein 15 [*H. sapiens*], *Homo sapiens* mRNA; cDNA DKFZp586E0524 (from clone DKFZp586E0524) |
| 2210 | 2140 | AI172272 | gg, hh | | ESTs, Highly similar to JC4577 transcription elongation factor T1 [*H. sapiens*], ESTs, Highly similar to Transcriptional Elongation Factor Sii [*H. sapiens*], ESTs, Weakly similar to J05430 transcription elongation factor 5-II-T1,testis-specific - mouse [*M. musculus*], *Homo sapiens* cDNA: FLJ23371 fis, clone HEP16068, highly similar to HSTFIISH *Homo sapiens* mRNA for transcription elongation factor TFIIS, PHD finger protein 3, transcription elongation factor A (SII), 3 |
| 3407 | 18142 | NM_017314 | r | | ESTs, Highly similar to JE0190 polyubiquitin unit [*H. sapiens*], ESTs, Highly similar to UQHUC polyubiquitin 9 [*H. sapiens*], *Homo sapiens*, Similar to orosomucoid 1, clone MGC:24263 IMAGE:3934516, mRNA, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4255 | 3015 | NM_138895 | h, w | | complete cds, expressed sequence AL033289, ubiquitin B, ubiquitin C ESTs, Highly similar to JE0190 polyubiquitin unit [*H. sapiens*], ESTs, Highly similar to UQHUC polyubiquitin 9 [*H. sapiens*], *Homo sapiens*, Similar to orosomucoid 1, clone MGC:24263 IMAGE:3934516, mRNA, complete cds, expressed sequence AL033289, ubiquitin B, ubiquitin C |
| 2468 | 12413 | AI227953 | t, mm | | ESTs, Highly similar to K6A1_RAT Ribosomal protein S6 kinase alpha 1 (56K-alpha 1) (90 kDa ribosomal protein S6 kinase 1) (p90-RSK 1) (Ribosomal S6 kinase 1) (RSK-1) (pp90RSK1) [*R. norvegicus*], *Mus musculus*, clone IMAGE:3156601, mRNA, S6 protein kinase (Rsk-1), ribonuclease P1, ribosomal protein S6 kinase polypeptide 1, ribosomal protein S6 kinase, 90 kD, polypeptide 1 |
| 327 | 2847 | AA850919 | cc | | ESTs, Highly similar to LB4D_HUMAN NADP-DEPENDENT LEUKOTRIENE B4 12-HYDROXYDEHYDROGENASE [*H. sapiens*], ESTs, Weakly similar to LB4D_HUMAN NADP-DEPENDENT LEUKOTRIENE B4 12-HYDROXYDEHYDROGENASE [*H. sapiens*], *Homo sapiens*, clone IMAGE:4793702, mRNA, *Mus musculus*, clone MGC:32469 IMAGE:5050433, mRNA, complete cds, crystallin, zeta, fatty acid synthase, quinone oxidoreductase homolog |
| 521 | 2846 | PA875639 | bb, ll, rr | | ESTs, Highly similar to LB4DHUMAN NADP-DEPENDENT LEUKOTRIENE B4 12-HYDROXYDEHYDROGENASE [*H. sapiens*], ESTs, Weakly similar to LB4D_HUMAN NADP-DEPENDENT LEUKOTRIENE B4 12-HYDROXYDEHYDROGENASE [*H. sapiens*], *Homo sapiens*, clone IMAGE:4793702, mRNA, *Mus musculus*, clone MGC:32469 IMAGE:5050433, mRNA, complete cds, crystallin, zeta, fatty acid synthase, quinone oxidoreductase homolog |
| 4247 | 891 | NM_138863 | x, bb | | ESTs, Highly similar to LB4D_HUMAN NADP-DEPENDENT LEUKOTRIENE B4 12-HYDROXYDEHYDROGENASE [*H. sapiens*], ESTs, Weakly similar to LB4D_HUMAN NADP-DEPENDENT LEUKOTRIENE B4 12-HYDROXYDEHYDROGENASE [*H. sapiens*], *Homo sapiens*, clone IMAGE:4793702, mRNA, *Mus musculus*, Similar to vesicle amine transport protein 1, clone MGC:38107 IMAGE:5320239, mRNA, complete cds, RIKEN cDNA 2510002C21 gene, nuclear receptor binding factor 1, vesicle amine transport protein 1 |
| 3267 | 1258 | NM_013185 | o | | ESTs, Highly similar to LCK MOUSE PROTO-ONCOGENE TYROSINE-PROTEIN KINASE LCK [*M. musculus*], RIKEN cDNA 8430404F20 gene, hemopoietic cell kinase, lymphocyte protein tyrosine kinase, lymphocyte-specific protein tyrosine kinase, src-related kinase lacking C-terminal regulatory tyrosine and N-terminal myrstylation sites |
| 3258 | 3465 | NM_013160 | ww | | ESTs, Highly similar to MXI1_RAT MAX interacting protein 1 (MXI1 protein) [*R. norvegicus*], ESTs, Weakly similar to MXI1_RAT MAX interacting protein 1 (MXI1 protein) [*R. norvegicus*], MAX dimerization protein, MAX interacting protein 1, Max interacting protein 1 |
| 3270 | 1969 | NM_013194 | k, t, mm | | ESTs, Highly similar to MYH9_RAT Myosin heavy chain, nonmuscle type A (Cellular myosin heavy chain, type A) (Nonmuscle myosin heavy chain-A) (NMMHC-A) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | [*R. norvegicus*], ESTs, Highly similar to MYHA_MOUSE Myosin heavy chain, nonmuscle type B (Cellular myosin heavy chain, type B) (Nonmuscle myosin heavy chain-B) (NMMHC-B) [*M. musculus*], ESTs, Weakly similar to MYH9_RAT Myosin heavy chain, nonmuscle type A (Cellular myosin heavy chain, type A) (Nonmuscle myosin heavy chain-A) (NMMHC-A) [*R. norvegicus*], ESTs, Weakly similar to MYHA_MOUSE Myosin heavy chain, nonmuscle type B (Cellular myosin heavy chain, type B) (Nonmuscle myosin heavy chain-B) (NMMHC-B) [*M. musculus*], RIKEN cDNA 2400004E04 gene, RIKEN cDNA 5730504C04 gene, TGFB1-induced anti-apoptotic factor 1, myosin heavy chain IX, myosin, heavy polypeptide 9, non-muscle, protein tyrosine phosphatase, receptor-type, F interacting protein, binding protein 2 |
| 3270 | 1970 | NM_013194 | t, mm | | ESTs, Highly similar to MYH9_RAT Myosin heavy chain, nonmuscle type A (Cellular myosin heavy chain type A) (Nonmuscle myosin heavy chain A) (NMMHC-A) [*R. norvegicus*], ESTs, Highly similar to MYHA_MOUSE Myosin heavy chain, nonmuscle type B (Cellular myosin heavy chain, type B) (Nonmuscle myosin heavy chain-B) (NMMHC-B) [*M. musculus*], ESTs, Weakly similar to MYH9_RAT Myosin heavy chain, nonmuscle type A (Cellular myosin heavy chain, type A) (Nonmuscle myosin heavy chain-A) (NMMHC-A) [*R. norvegicus*], ESTs, Weakly similar to MYHA_MOUSE Myosin heavy chain, nonmuscle type B (Cellular myosin heavy chain, type B) (Nonmuscle myosin heavy chain-B) (NMMHC-B) [*M. musculus*], RIKEN cDNA 2400004E04 gene, RIKEN cDNA 5730504C04 gene, TGFB1-induced anti-apoptotic factor 1, myosin heavy chain IX, myosin, heavy polypeptide 9, non-muscle, protein tyrosine phosphatase, receptor-type, F interacting protein, binding protein 2 |
| 4254 | 5655 | NM_138885 | f, q, ff | | ESTs, Highly similar to MYHA_MOUSE Myosin heavy chain, nonmuscle type B (Cellular myosin heavy chain, type B) (Nonmuscle myosin heavy chain-B) (NMMHC-B) [*M. musculus*], ESTs, Weakly similar to JC5837 364K Golgi complex-associated protein - rat [*R. norvegicus*], ESTs, Weakly similar to MYHA_MOUSE Myosin heavy chain, nonmuscle type B (Cellular myosin heavy chain, type B) (Nonmuscle myosin heavy chain-B) (NMMHC-B) [*M. musculus*], ESTs, Weakly similar to T42722 male-enhanced antigen-2 mouse [*M. musculus*], RB1-inducible coiled-coil 1 RIKEN cDNA 2400004E04 gene, RIKEN cDNA 4930428L02 gene, RIKEN cDNA 5730504C04 gene, coiled-coil protein BICD2, expressed sequence AL022610, expressed sequence AU042952, golgi autoantigen, golgin subfamily b, macrogolgin (with transmembrane signal), 1, hypothetical protein FLJ13031, myosin heavy chain IX, similar to rat myomegalin |
| 4254 | 5656 | NM_138885 | d, q | | ESTs, Highly similar to MYHA_MOUSE Myosin heavy chain, nonmuscle type B (Cellular myosin heavy chain, type B) (Nonmuscle myosin heavy chain-B) (NMMHC-B) [*M. musculus*], ESTs,Weakly similar to JC5837 364K Golgi complex-associated protein - rat [*R. norvegicus*], |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | ESTs, Weakly similar to MYHA_MOUSE Myosin heavy chain, nonmuscle type B (Cellular myosin heavy chain, type B) (Nonmuscle myosin heavy chain-B) (NMMHC-B) [*M. musculus*], ESTs, Weakly similar to T42722 male-enhanced antigen-2 mouse [*M. musculus*], RB1-inducible coiled-coil 1, RIKEN cDNA 2400004E04 gene, RIKEN cDNA 4930428L02 gene, RIKEN cDNA 5730504C04 gene, coiled-coil protein BICD2, expressed sequence AL022610, expressed sequence AU042952, golgi autoantigen, golgin subfamily b, macrogolgin (with transmembrane signal), 1, hypothetical protein FLJ13031, myosin heavy chain IX, similar to rat myomegalin |
| 3823 | 18005 | NM_031588 | j | | ESTs, Highly similar to NRG2_MOUSE PRO NEUREGULIN-2 PRECURSOR (PRO-NRG2) [CONTAINS: NEUREGULIN-2 (NRG 2) (DIVERGENT OF NEUREGULIN 1) (DON-1)] [*M. musculus*], ESTs, Weakly similar to NRG2_MOUSE PRO-NEUREGULIN-2 PRECURSOR (PRO-NRG2) [CONTAINS: NEUREGULIN-2 (NRG 2) (DIVERGENT OF NEUREGULIN 1) (DON-1)] [*M. musculus*], neuregulin 1 |
| 3823 | 18011 | NM_031588 | dd | | ESTs, Highly similar to NRG2_MOUSE PRO NEUREGULIN-2 PRECURSOR (PRO-NRG2) [CONTAINS: NEUREGULIN-2 (NRG 2) (DIVERGENT OF NEUREGULIN 1) (DON-1)] [*M. musculus*], ESTs, Weakly similar to NRG2_MOUSE PRO-NEUREGULIN-2 PRECURSOR (PRO-NRG2) [CONTAINS: NEUREGULIN-2 (NRG 2) (DIVERGENT OF NEUREGULIN 1) (DON-1)] [*M. musculus*], neuregulin 1 |
| 3939 | 19148 | NM_033096 | oo | | ESTs, Highly similar to P2CB_HUMAN PROTEIN PHOSPHATASE 2C BETA ISOFORM [*H. sapiens*], ESTs, Weakly similar to P2CB HUMAN PROTEIN PHOSPHATASE 2C BETA ISOFORM [*H. sapiens*], *Homo sapiens* cDNA FLJ30553 fis, clone BRAWH2003689, highly similar to *Mus musculus* clone mouse1-9 putative protein phosphatase type 2C mRNA, protein phosphatase 1B (formerly 2C), magnesium-dependent, beta isoform, protein phosphatase 1B, magnesium dependent, beta isoform |
| 4099 | 18025 | NM_053989 | vv | | ESTs, Highly similar to PAB1_HUMAN POLYADENYLATE-BINDING PROTEIN 1 [*H. sapiens*], RIKEN cDNA 2810411E22 gene, RIKEN cDNA 4432411E13 gene, RIKEN cDNA 4930431E10 gene |
| 3746 | 12639 | NM_031099 | l, General, ee, ll | | ESTs, Highly similar to PC4210 ribosomal protein L5 [*H. sapiens*], ribosomal protein L5 |
| 3568 | 1141 | NM_022401 | f, n, r, z | | ESTs, Highly similar to PLE1_MOUSE PLECTIN 1 (PLTN) (PCN) [*M. musculus*], ESTs, Weakly similar to plectin [*Rattus norvegicus*] [*R. norvegicus*], KIAA1009 protein, *Mus musculus*, clone IMAGE:4188338, mRNA, partial cds, desmoplakin (DPI, DPII), expressed sequence AA407888, plectin 1, intermediate filament binding protein, 500 kD |
| 949 | 22017 | AA944209 | d | | ESTs, Highly similar to PROTO-ONCOGENE SERINE/THREONINE-PROTEIN KINASE PIM-1 [*M. musculus*], PAS domain containing serine/threonine kinase |
| 4417 | 18541 | X14671 | h, gg, hh | | ESTs, Highly similar to RL26_HUMAN 60S RIBOSOMAL PROTEIN L26 [*H. sapiens*], ESTs, Highly similar to S33713 ribosomal protein L26, cytosolic [*H. sapiens*], ESTs, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | Moderately similar to RL26__HUMAN 60S RIBOSOMAL PROTEIN L26 [*H. sapiens*], ribosomal protein L26, ribosomal protein L26-like 1 |
| 3280 | 815 | NM_013224 | h, l, ll, oo | | ESTs, Highly similar to RS26__HUMAN 40S RIBOSOMAL PROTEIN S26 [*H. sapiens*], *Homo sapiens,* clone IMAGE:4100953, mRNA, polymerase (RNA) II (DNA directed) polypeptide D, ribosomal protein 326 |
| 1647 | 10533 | AI058430 | qq | | ESTs, Highly similar to S03700 nonhistone chromosomal protein HMG-17 [*H. sapiens*], ESTs, Weakly similar to HG17__RAT NONHISTONE CHROMOSOMAL PROTEIN HMG-17 [*R. norvegicus*], high mobility group nucleosomal binding domain 2, high mobility group nucleosomal binding domain 3, high-mobility group (nonhistone chromosomal) protein 14, high-mobility group (nonhistone chromosomal) protein 17, thyroid hormone receptor interactor 7 |
| 90 | 15011 | AA799893 | l, s, z, kk, nn | | ESTs, Highly similar to S12520 core protein A1 [*H. sapiens*], ESTs, Highly similar to heterogeneous ribonuclear particle protein A1 [*H. sapiens*], ESTs, Moderately similar to heterogeneous ribonuclear particle protein A1 [*H. sapiens*], *Mus musculus,* Similar to TAR DNA binding protein, clone MGC:19284 IMAGE:4016437, mRNA, complete cds, RIKEN cDNA 2610510D13 gene, RIKEN cDNA 4930547K05 gene, heterogeneous nuclear ribonucleoprotein A1, heterogeneous nuclear ribonucleoprotein A3 |
| 1742 | 11596 | AI071194 | pp | | ESTs, Highly similar to S16506 hypothetical protein [*H. sapiens*], ESTs, Weakly similar to S16506 hypothetical protein [*H. sapiens*], *Homo sapiens,* similar to putative, clone MGC:22793 IMAGE:4773899, mRNA, complete cds, hypothetical protein FLJ12748 |
| 2508 | 11527 | AI229307 | rr, uu | | ESTs, Highly similar to S27958 transcription factor BTF2 62K chain [*H. sapiens*], general transcription factor IIH, polypeptide 1 (62 kD subunit) |
| 2921 | 3815 | H31907 | u | | ESTs, Highly similar to S57449 fusca protein homolog - rat [*R. norvegicus*], ESTs, Weakly similar to S57449 fusca protein homolog - rat [*R. norvegicus*], G protein pathway suppressor 1, *Mus musculus,* Similar to G protein pathway suppressor 1, clone MGC:7191 IMAGE:3481979, mRNA, complete cds, RIKEN cDNA 2400006A19 gene |
| 1811 | 15308 | AI072896 | nn | | ESTs, Highly similar to S60712 band-6-protein [*H. sapiens*], RIKEN cDNA 5031422I09 gene, catenin delta 2 |
| 3300 | 18139 | NM_017033 | General | | ESTs, Highly similar to S62628 phosphoglucomutase-related protein - mouse [*M. musculus*], ESTs, Moderately similar to S62628 phosphoglucomutase-related protein - mouse [*M. musculus*], Phosphoglucomutase 1, RIKEN cDNA 2610020G18 gene, phosphoglucomutase 1 |
| 4315 | 10544 | NM_152935 | m | | ESTs, Highly similar to S68215 Mas 20 protein [*H. sapiens*], *Homo sapiens* cDNA FLJ30361 fis, clone BRACE2007764, RIKEN cDNA 1810060K07 gene, RIKEN cDNA 4930553D19 gene, translocase of outer mitochondrial membrane 20 (yeast) homolog |
| 4315 | 10545 | NM_152935 | cc | | ESTs, Highly similar to S68215 Mas 20 protein [*H. sapiens*], *Homo sapiens* cDNA FLJ30361 fis, clone BRACE2007764, RIKEN cDNA 1810060K07 gene, RIKEN |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | cDNA 4930553D19 gene, translocase of outer mitochondrial membrane 20 (yeast) homolog |
| 56 | 20982 | AA799657 | x, qq | | ESTs, Highly similar to S68418 protein phosphatase iM chain Mi10 isoform - rat [*R. norvegicus*], ESTs, Weakly similar to S68418 protein phosphatase 1M chain M110 isoform - rat (fragment) [*R. norvegicus*], expressed sequence AI449786, expressed sequence AI746547, leukocyte receptor cluster (LRC) member 3, myosin phosphatase, target subunit 1, protein phosphatase 1, regulatory (inhibitor) subunit 12A |
| 140 | 12072 | AA800680 | g | | ESTs, Highly similar to S68418 protein phosphatase 1 M chain M110 isoform - rat [*R. norvegicus*], ESTs, Weakly similar to 568418 protein phosphatase 1M chain M110 isoform - rat (fragment) [*R. norvegicus*], leukocyte receptor cluster (LRC) member 3, myosin phosphatase, target subunit 1, protein phosphatase 1, regulatory (inhibitor) subunit 12A |
| 2395 | 23043 | AI178968 | nn | | ESTs, Highly similar to S70642 ubiquitin ligase Nedd4 - rat (fragment) [*R. norvegicus*], ESTs Moderately similar to S70642 ubiquitin ligase Nedd4 rat (fragment) [*R. norvegicus*] *Mus musculus*, clone MGC:12070 IMAGE:3708271, mRNA, complete cds, RIKEN cDNA 1700056O17 gene, RIKEN cDNA 5830462N02 gene, expressed sequence AW212605, neural precursor cell expressed, developmentally down-regulated 4, neural precursor cell expressed, developmentally down-regulated gene 4a, thyroid hormone receptor interactor 12, ubiquitin protein ligase E3A |
| 1365 | 23540 | AI010110 | xx | | ESTs, Highly similar to SH31_RAT SH3-containing GRB2-like protein 1 (SH3 domain protein 2B) (SH3p8) [*R. norvegicus*], ESTs, Moderately similar to SH31_HUMAN SH3-CONTAINING GRB2-LIKE PROTEIN 1 (SH3 DOMAIN PROTEIN 2B) (EXTRA ELEVEN-NINETEEN LEUKEMIA FUSION GENE) (EEN) (EEN FUSION PARTNER OF MLL) [*H. sapiens*], ESTs, Moderately similar to SH31_RAT SH3-containing GRB2-like protein 1 (SH3 domain protein 2B) (SH3p8) [*R. norvegicus*], SH3 domain protein 2A, SH3 domain protein 2B, SH3-domain GRB2-like 1, SH3-domain GRB2-like 2, SH3-domain GRB2-like endophilin B1, SH3-domain GRB2-like endophilin B2 |
| 2282 | 13678 | AI176490 | u | | ESTs, Highly similar to T00065 hypothetical protein KIAA0442 [*H. sapiens*], *Homo sapiens* cDNA FLJ12396 fis, clone MAMMA1 002758, KIAA1545 protein, hypothetical protein FLJ11618 |
| 202 | 17771 | 4A818224 | l | | ESTs, Highly similar to 708726 tubulin beta chain [*H. sapiens*], ESTs, Highly similar to TBB1_RAT TUBULIN BETA CHAIN (T BETA-15) [*R. norvegicus*], ESTs, Highly similar to TBB2_HUMAN TUBULIN BETA-2 CHAIN [*H. sapiens*], RIKEN cDNA 2410129E14 gene, RIKEN cDNA 4930447K03 gene, RIKEN cDNA 4930542G03 gene, expressed sequence AI451582, expressed sequence C79445, tubulin beta-5, tubutlin beta 3 |
| 45 | 18361 | AA799591 | j, tt | | ESTs, Highly similar to T08726 tubulin beta chain [*H. sapiens*], ESTs, Highly similar to TBB1_RAT TUBULIN BETA CHAIN (T BETA-15) [*R. norvegicus*], ESTs, Highly similar to TBB2_HUMAN TUBULIN BETA-2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | CHAIN [*H. sapiens*], RIKEN cDNA 2410129E14 gene, RIKEN cDNA 4930447K03 gene, RIKEN cDNA 4930542G03 gene, Rat mRNA for beta-tubulin T beta15, expressed sequence AI451582, expressed sequence C79445, tubulin beta-5, tubulin, beta 3, tubulin, beta, 2 |
| 4303 | 22975 | NM_145778 | jj | | ESTs, Highly similar to T08726 tubulin beta chain [*H. sapiens*], ESTs, Highly similar to TBB1_RAT TUBULIN BETA CHAIN (T BETA-15) [*R. norvegicus*], RIKEN cDNA 2410129E14 gene, RIKEN cDNA 4930447K03 gene, RIKEN cDNA 4930542G03 gene, Rat mRNA for beta-tubulin T beta15, expressed sequence AI451582, expressed sequence C79445, tubulin beta-3, butulin, gamma 1 |
| 4242 | 2100 | NM_138829 | ll | | ESTs, Highly similar to T17229 hypothetical protein DKFZp434D156.1 [*H. sapiens*], ESTs, Weakly similar to FMN2_MOUSE Formin 2 [*M. musculus*], expressed sequence AI854843, expressed sequence AW742646, formin 2, golgi peripheral membrane protein p65, golgi phosphoprotein 5, likely ortholog of rat golgi stacking protein homolog GRASP55 |
| 2357 | 16739 | AI178151 | cc | | ESTs, Highly similar to T46366 hypothetical protein DKFZp434C0118.1 [*H. sapiens*], F-box only protein 9, Homo sapiens cDNA FLJ32209 fis, clone PLACE6003372 |
| 287 | 19412 | AA849222 | jj | | ESTs, Highly similar to T46904 hypothetical protein DKFZp76i CD81.1 [*H. sapiens*], Homo sapiens cDNA: FLJ21587 fis, clone COL06946, likely ortholog of mouse Arkadia |
| 728 | 19411 | AA893667 | r | | ESTs, Highly similar to T46904 hypothetical protein DKFZp761D081.1 [*H. sapiens*], Homo sapiens cDNA: FLJ21587 fis, clone COL06946, likely ortholog of mouse Arkadia |
| 4048 | 3828 | NM_053785 | b, ss | | ESTs, Highly similar to T4S4_HUMAN TRANSMEMBRANE 4 SUPERFAMILY, MEMBER 4 [*H. sapiens*], *Mus musculus*, clone MGC:19127 IMAGE:4211816, mRNA, complete cds, transmembrane 4 superfamily member 1, transmembrane 4 superfamily member 4, transmembrane 4 superfamily member 5 |
| 797 | 16754 | AA900474 | d | | ESTs, Highly similar to T50619 hypothetical protein DKFZp762M136.1 [*H. sapiens*], hypothetical protein DKFZp762M136 |
| 860 | 2462 | AA924913 | d | | ESTs, Highly similar to T50619 hypothetical protein DKFZp762M136.1 [*H. sapiens*], hypothetical protein DKFZp762M136 |
| 689 | 3865 | AA893065 | k, p | | ESTs, Highly similar to THDE_RAT Thyrotropin-releasing hormone degrading ectoenzyme (TRH-degrading ectoenzyme) (TRH-DE) (TRH-specific aminopeptidase) (Thyroliberinase) (Pyroglutamyl-peptidase II) (PAP-II) [*R. norvegicus*], ESTs, Weakly similar to AMPE MOUSE GLUTAMYL AMINOPEPTIDASE [*M. musculus*], ESTs, Weakly similar to PUROMYCIN-SENSITIVE AMINOPEPTIDASE [*M. musculus*], aminopeptidase puromycin sensitive, puromycin-sensitive aminopeptidase |
| 213 | 14123 | M818554 | g | | ESTs, Highly similar to TPMN_HUMAN TROPOMYOSIN, CYTOSKELETAL TYPE [*H. sapiens*], ESTs, Moderately similar to TROPOMYOSIN 5, CYTOSKELETAL TYPE [*M. musculus*] |
| 4208 | 16456 | NM_134346 | w | | ESTs, Highly similar to TVHUR1 transforming protein rap1b [*H. sapiens*], ESTs, Weakly similar to GTP-binding protein ROC2 [*M. musculus*], *Mus musculus*, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4208 | 16457 | NM_134346 | u | | Similar to RAS-like, estrogen-regulated, growth-inhibitor, clone MGC:31467 IMAGE:4483442, mRNA, complete cds, RAP1B, member of RAS oncogene family, RAP2B, member of RAS oncogene family, RAS-like, estrogen-regulated, growth-inhibitor ESTs, Highly similar to TVHUR1 transforming protein rap1b [*H. sapiens*], ESTs, Weakly similar to GTP-binding protein ROC2 [*M. musculus*], *Mus musculus*, Similar to RAS-like, estrogen-regulated, growth-inhibitor, clone MGC:31467 IMAGE:4483442, mRNA, complete cds, RAP1B, member of RAS oncogene family, RAP2B, member of RAS oncogene family, RAS-like, estrogen-regulated, growth-inhibitor |
| 3764 | 15052 | NM_031136 | s | | ESTs, Highly similar to TYB4 MOUSE THYMOSIN BETA-4 [*M. musculus*], ESTs, Moderately similar to PC4259 ferritin associated protein [*H. sapiens*], *Homo sapiens* cDNA FLJ31414 fis, clone NT2NE2000260, weakly similar to THYMOSIN BETA-4, thymosin, beta 4, X chromosome |
| 338 | 19189 | AA851237 | dd | | ESTs, Highly similar to UBPI_HUMAN UBIQUITIN CARBOXYL-TERMINAL HYDROLASE 18 [*H. sapiens*], ubiquitin specific protease 18 |
| 4234 | 13563 | NM_138530 | m, ff | | ESTs, Highly similar to ULA4_HUMAN MAWD binding protein (Unknown protein 32 from 2D-page of liver tissue) [*H. sapiens*], MAWD binding protein |
| 1789 | 8856 | AI072402 | b, h, u | | ESTs, Highly similar to Z208_HUMAN ZINC FINGER PROTEIN 208 [*H. sapiens*], ESTs, Moderately similar to Z208_HUMAN ZINC FINGER PROTEIN 208 [*H. sapiens*], ESTs, Moderately similar to zinc finger protein 30 [*M. musculus*], ESTs, Weakly similar to zinc finger protein 30 [*M. musculus*], *Homo sapiens* cDNA FLJ20562 fis, clone KAT11992, KRAB zinc finger protein KR18, zinc finger protein 208 |
| 4047 | 14015 | NM_053770 | n, w | | ESTs, Moderately similar to Arg/Abl-interacting protein ArgBP2 [*Rattus norvegicus*] [*R. norvegicus*], ESTs, Weakly similar to Arg/Abl-interacting protein ArgBP2 [*Rattus norvegicus*] [*R. norvegicus*], RIKEN cDNA 2010203O03 gene, SH3-domain protein 5 (ponsin), sorbin and SH3 domain containing 1 |
| 4047 | 14016 | NM_053770 | xx | | ESTs, Moderately similar to Arg/Abl-interacting protein ArgBP2 [*Rattus norvegicus*] [*R. norvegicus*], ESTs, Weakly similar to Arg/Abl-interacting protein ArgBP2 [*Rattus norvegicus*] [*R. norvegicus*], RIKEN cDNA 2010203O03 gene, SH3-domain protein 5 (ponsin), sorbin and SH3 domain containing 1 |
| 3726 | 17726 | NM_031043 | jj | | ESTs, Moderately similar to glycogenin 2 [*Homo sapiens*] [*H. sapiens*], glycogenin, glycogenin 1, glycogenin 2 |
| 3726 | 17727 | NM_031043 | pp, uu | | ESTs, Moderately similar to glycogenin 2 [*Homo sapiens*] [*H. sapiens*], glycogenin, glycogenin 1, glycogenin 2 |
| 3726 | 25328 | NM_031043 | e, bb | | ESTs, Moderately similar to glycogenin 2 [*Homo sapiens*] [*H. sapiens*], glycogenin, glycogenin 1, glycogenin 2 |
| 3947 | 1410 | NM_052798 | o | | ESTs, Moderately similar to hypothetical protein MGC2663 [*Homo sapiens*] [*H. sapiens*], ESTs, Moderately similar to 547073 finger protein HZF2, Krueppel-related [*H. sapiens*], ESTs, Weakly similar to |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | TC17 MOUSE TRANSCRIPTION FACTOR 17 [*M. musculus*], ESTs, Weakly similar to TC17_RAT Zinc finger protein 354A (Transcription factor 17) (Renal transcription factor Kid-1) (Kidney, schemia, and developmentally regulated protein-1) [*R. norvegicus*], expressed sequence AI875089, hypermethylated in cancer 2, zinc finger protein 354A, zinc finger protein 354R |
| 613 | 4486 | AA892298 | w | | ESTs, Moderately similar to peptidylprolyl isomerase-like protein 3, isoform PPIL3a; cyclophilin-like protein 3; peptidylprolyl cis-trans isomerase-like protein 3; PPlase-like protein 3 [*Homo sapiens*] [*H. sapiens*], expressed sequence AU019516, matrin cyclophilin (matrin-cyp), natural killer-tumor recognition sequence, peptidyl-prolyl isomerase G (cyclophilin G), peptidylprolyl isomerase D (cyclophilin D) |
| 658 | 4487 | AA892680 | e, p | | ESTs, Moderately similar to peptidylprolyl isomerase-like protein 3, isoform PPIL3a; cyclophilin-like protein 3; peptidylprolyl cis-trans isomerase-like protein 3; PPlase-like protein 3 [*Homo sapiens*] [*H. sapiens*], expressed sequence AU019516, matrin cyclophilin (matrin-cyp), natural killer-tumor recognition sequence, peptidyl-prolyl isomerase G (cyclophilin G), peptidylprolyl isomerase D (cyclophilin D) |
| 1987 | 9575 | AI112250 | General, kk, nn | | ESTs, Moderately similar to protein tyrosine phosphatase type IVA, member 2, isoform 1; protein tyrosine phosphatase IVA; protein tyrosine phosphatase IVA2; phosphatase of regenerating liver 2 [*Homo sapiens*] [*H. sapiens*], protein tyrosine phosphatase 4a2, protein tyrosine phosphatase type IVA, member 2 |
| 3980 | 14670 | NM_053439 | ee | | ESTs, Moderately similar to RAN, member RAS oncogene family [*Rattus norvegicus*] [*R. norvegicus*], F-box and WD-40 domain protein 7, archipelago homolog (*Drosophila*), RAN, member RAS oncogene family, RAS-like, family 2, locus 9, RIKEN cDNA 1700009N14 gene |
| 3925 | 18898 | NM_031985 | pp | | ESTs, Moderately similar to ribosomal protein S6 kinase, 70 kD, polypeptide 2; S6 kinase 2 [*Mus musculus*] [*M. musculus*], RIKEN cDNA 2610318I15 gene, ribosomal protein S6 kinase, 70 kD, polypeptide 1, ribosomal protein S6 kinase, 70 kD, polypeptide 2 |
| 1316 | 16701 | AI008838 | ff | | ESTs, Moderately similar to RIKEN cDNA 1300002A08 [*Mus musculus*] [*M. musculus*], RIKEN cDNA 1300002A08 gene, methylene tetrahydrofolate dehydrogenase (NAD+ dependent), methenyltetrahydrofolate cyclohydrolase, protease, serine, 15 |
| 1393 | 16702 | AI011436 | ss | | ESTs, Moderately similar to RIKEN cDNA 1300002A08 [*Mus musculus*] [*M. musculus*], RIKEN cDNA 1300002A08 gene, methylene tetrahydrofolate dehydrogenase (NAD+ dependent), methenyltetrahydrofolate cyclohydrolase, protease, serine, 15 |
| 2411 | 16703 | AI179300 | ff | | ESTs, Moderately similar to RIKEN cDNA 1300002A08 [*Mus musculus*] [*M. musculus*], RIKEN cDNA 1300002A08 gene, methylene tetrahydrofolate dehydrogenase (NAD+ dependent), methenyltetrahydrofolate cyclohydrolase, protease, serine, 15 |
| 355 | 6687 | AA851739 | General | | ESTs, Moderately similar to tousled-like kinase 2; serine/threonine kinase; tousled-like kinase [*Homo sapiens*] [*H. sapiens*], tousled-like kinase 2 (*Arabidorsis*) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3628 | 194 | NM_022861 | s | | ESTs, Moderately similar to UNC-13 homolog (*C. elegans*) 1 [*Mus musculus*] [*M. musculus*], unc-13-like (*C. elegans*), unc13 homolog (*C. elegans*) 1 |
| 743 | 7637 | AA894089 | k, x | | ESTs, Moderately similar to 2118320A neurodegeneration-associated protein 1 [*Rattus norvegicus*] [*R. norvegicus*], KIAA0438 gene product, *Mus musculus*, clone IMAGE:3499845, mRNA, partial cds, g1-related zinc finger protein, goliath protein, hypothetical protein FLJ20552, hypothetical protein LOC51255, praja 1, praja1, RING-H2 motif containing, similar to RIKEN cDNA 1300002C13, zinc finger protein 364 |
| 4256 | 7636 | NM_138896 | s | | ESTs, Moderately similar to 2118320A neurodegeneration-associated protein 1 [*Rattus norvegicus*] [*R. norvegicus*], KIAA0438 gene product, *Mus musculus*, clone IMAGE:3499845, mRNA, partial cds, g1-related zinc finger protein, goliath protein, hypothetical protein FLJ20552, hypothetical protein LOC51255, praja 1, praja1, RING-H2 motif containing, similar to RIKEN cDNA 1300002C13, zinc finger protein 364 |
| 2160 | 17783 | AI171206 | vv | | ESTs, Moderately similar to 2118320A neurodegeneration-associated protein 1 [*Rattus norvegicus*] [*R. norvegicus*], KIAA0438 gene product, *Mus musculus*, clone IMAGE:3499845, mRNA, partial cds, hypothetical protein FLJ20552, hypothetical protein LOC51255, praja 1, praja1, RING-H2 motif containing, rotein carrying the RING-H2 sequence motif, similar to RIKEN cDNA 1300002C13, zinc finger protein 364 |
| 2898 | 1041 | D78610 | x | | ESTs, Moderately similar to A36065 protein-tyrosine-phosphatase [*H. sapiens*], Protein tyrosine phosphatase, receptor type, A, protein tyrosine phosphatase, receptor type, A, protein tyrosine phosphatase, receptor type E |
| 3348 | 20702 | NM_017166 | General, dd, oo, pp | | ESTs, Moderately similar to A40936 stathmin [*H. sapiens*], expressed sequence AI131641, leukemia-associated gene, stathmin 1/oncoprotein 18 |
| 1289 | 12932 | AF102552 | x | | ESTs, Moderately similar to A55575 ankyrin 3, long splice form [*H. sapiens*], ESTs, Weakly similar to A55575 ankyrin 3, long splice form [*H. sapiens*], *Homo sapiens* cDNA FLJ10428 fis, clone NT2RP1000376, highly similar to *Homo sapiens* mRNA; cDNA DKFZp434A102, RIKEN cDNA 2310026G15 gene, RIKEN cDNA 2410197A17 gene, ankyrin 3, node of Ranvier (ankyrin G), hypothetical protein FLJ20189, hypothetical protein FLJ22551, phospholipase A2, group VI, phospholipase A2, group VI (cytosolic, calcium-independent) |
| 4178 | 17634 | NM_133418 | q, z, General, uu | | ESTs, Moderately similar to BMCP_HUMAN BRAIN MITOCHONDRIAL CARRIER PROTEIN-i [*H. sapiens*], ESTs, Weakly similar to M2OM_HUMAN MITOCHONDRIAL 2-OXOGLUTARATE/MALATE CARRIER PROTEIN [*H. sapiens*], solute carrier family 25 (mitochondrial carrier; adenine nucleotide translocator), member 10, solute carrier family 25 (mitochondrial carrier; dicarboxylate transporter), member 10, solute carrier family 25 (mitochondrial carrier: oxoglutarate carrier) member 11 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4178 | 17635 | NM_133418 | l, x | | ESTs, Moderately similar to BMCP_HUMAN BRAIN MITOCHONDRIAL CARRIER PROTEIN-1 [*H. sapiens*], ESTs, Weakly similar to M2OM_HUMAN MITOCHONDRIAL 2-OXOGLUTARATE/MALATE CARRIER PROTEIN [*H. sapiens*], solute carrier family 25 (mitochondrial carrier; adenine nucleotide translocator), member 10, solute carrier family 25 (mitochondrial carrier; dicarboxylate transporter), member 10, solute carrier family 25 (mitochondrial carrier: oxoglutarate carrier) member 11 |
| 4178 | 17636 | NM_133418 | pp | | ESTs, Moderately similar to BMCP_HUMAN BRAIN MITOCHONDRIAL CARRIER PROTEIN-1 [*H. sapiens*], ESTs, Weakly similar to M2OM_HUMAN MITOCHONDRIAL 2-OXOGLUTARATE/MALATE CARRIER PROTEIN [*H. sapiens*], solute carrier family 25 (mitochondrial carrier; adenine nucleotide translocator), member 10, solute carrier family 25 (mitochondrial carrier; dicarboxylate transporter), member 10, solute carrier family 25 (mitochondrial carrier: oxoglutarate carrier) member 11 |
| 671 | 7148 | AA892842 | gg, hh | | ESTs, Moderately similar to CAZ3_MOUSE F-ACTIN CAPPING PROTEIN ALPHA-3 SUBUNIT (CAPZ ALPHA-3) (GERM CELL-SPECIFIC PROTEIN 3) [*M. musculus*], capping protein (actin filament) muscle Z-line, alpha 2, capping protein alpha 2, capping protein alpha 3 |
| 4077 | 1660 | NM_053891 | bb, ll, ww | | ESTs, Moderately similar to CD5R_MOUSE CYCLIN-DEPENDENT KINASE 5 ACTIVATOR 1 PRECURSOR (CDK5 ACTIVATOR 1) (CYCLIN-DEPENDENT KINASE 5 REGULATORY SUBUNIT 1) (TAU PROTEIN KINASE II 23 KD SUBUNIT) (TPKII REGULATORY SUBUNIT) (P23) (P25) (P35) [*R. norvegicus*], ESTs, Weakly similar to cyclin-dependent kinase 5, regulatory subunit 1 (p35) [*Rattus norvegicus*] [*R. norvegicus*], cyclin-dependent kinase 5, regulatory subunit (p35), cyclin-dependent kinase 5, regulatory subunit 1 (p35), cyclin-dependent kinase 5, regulatory subunit 2 (p30) |
| 2786 | 18854 | AI237636 | l | | ESTs, Moderately similar to CNE6_MOUSE COPINE VI (NEURONAL-COPINE) (N-COPINE) [*M. musculus*], ESTs, Weakly similar to CNE3_HUMAN COPINE III [*H. sapiens*], RIKEN cDNA3632411M23 gene, copine 6, copine II, copine III, expressed sequence AU067659, expressed sequence AW047065 |
| 2271 | 13339 | AI176308 | r | | ESTs, Moderately similar to CO1B_RAT Coronin 1B (Coronin 2) [*R. norvegicus*], *Mus musculus*, Similar to coronin, actin binding protein, 2A, clone IMAGE:4984475, mRNA, partial cds, coronin, actin binding protein 18, coronin, actin binding protein 1C, hypothetical protein DKFZp7621166 |
| 2596 | 19274 | AI232135 | ii | | ESTs, Moderately similar to COG2_MOUSE Coatomer gamma-2 subunit (Gamma-2 coat protein) (Gamma-2 COP) [*M. musculus*], *Mus musculus* 0 day neonate skin cDNA, RIKEN full-length enriched library, clone:4632427M03:coatomer protein complex, subunit gamma 1, full insert sequence, coatomer protein complex, subunit gamma 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4376 | 18038 | U39943 | x | | ESTs, Moderately similar to CPJ3_RAT CYTOCHROME P450 2J3 (CYPIIJ3) [*R. norvegicus*], ESTs, Weakly similar to CPJ6 MOUSE CYTOCHROME P450 2J6 [*M. musculus*], *Homo sapiens* cDNA FLJ14042 fis, clone HEMBA1006038, weakly similar to LAMININ ALPHA-5 CHAIN, *Mus musculus*, Similar to CYP2J4, clone MGC:25927 IMAGE:4235131, mRNA, complete cds, RIKEN cDNA 8430436A10 gene, cytochrome P450, 2j6, cytochrome P450, 2j9, expressed sequence AI314783 |
| 4480 | 20695 | Y09000 | gg, hh | | ESTs, Moderately similar to DEND RAT DENDRIN [*R. norvegicus*], KIAA0749 protein |
| 3678 | 713 | NM_024391 | pp | | ESTs, Moderately similar to DHB2 MOUSE ESTRADIOL 17 BETA-DEHYDROGENASE 2 [*M. musculus*], ESTs, Weakly similar to 17-beta hydroxysteroid dehydrogenase type 2 [*Rattus norvegicus*] [*R. norvegicus*], *Mus musculus* cis-retinol/androgen dehydrogenase type 3 mRNA, complete cds, *Mus musculus*, Similar to retinol dehydrogenase type 6, clone MGC:25965 IMAGE:4239862, mRNA, complete cds, cell line MC/9.1L4 derived transcript 1, expressed sequence AI194836, expressed sequence AI255511, hydroxysteroid (17-beta) dehydrogenase 2 |
| 4398 | 1153 | U89280 | h, n | | ESTs, Moderately similar to DHB2 MOUSE ESTRADIOL 17 BETA-DEHYDROGENASE 2 [*M. musculus*], ESTs, Weakly similar to A55884 retinol dehydrogenase (EC 1.1.1.105) - rat [*R. norvegicus*], *Mus musculus* cis-retinol/androgen dehydrogenase type 3 mRNA, complete cds, *Mus musculus*, Similar to retinol dehydrogenase type 6, clone MGC:25965 IMAGE:4239862, mRNA, complete cds, expressed sequence AI194836, expressed sequence AI255511, retinol dehydrogenase 5 (11-cis and 9-cis), retinol dehydrogenase 7, retinol dehydrogenase type 5 |
| 4277 | 15023 | NM_139113 | n, z, General, kk, pp | | ESTs, Moderately similar to EAR2_RAT Orphan nuclear receptor EAR-2 (V-erbA related protein EAR-2) (Ovalbumin upstream promoter gamma nuclear receptor rCOUPg) [*R. norvegicus*], nuclear receptor subfamily 2, group F, member 6 |
| 4428 | 16716 | X53054 | c | | ESTs, Moderately similar to HB2D_RAT RT1 CLASS II HISTOCOMPATIBILITY ANTIGEN, D-1 BETA CHAIN PRECURSOR [*R. norvegicus*], ESTs, Weakly similar to HB2D_RAT RT1 CLASS II HISTOCOMPATIBILITY ANTIGEN, D-1 BETA CHAIN PRECURSOR [*R. norvegicus*], *Rattus norvegicus* Class II MHC RT1.D(a) beta chain precursor (RT1.D(a)) mRNA, complete cds, *Rattus norvegicus* Class II MHC RT1.D(n) beta chain precursor (RT1.D(n)) mRNA, complete cds, major histocompatibility complex, class II, DR beta 5 |
| 3262 | 1451 | NM_013168 | tt | | ESTs, Moderately similar to HEM3 MOUSE PORPHOBILINOGEN DEAMINASE [*M. musculus*], hydroxymethylbilane synthase |
| 3262 | 1452 | NM_013168 | ii | | ESTs, Moderately similar to HEM3 MOUSE PORPHOBILINOGEN DEAMINASE [*M. musculus*], hydroxymethylbilane synthase |
| 1773 | 17673 | AI071895 | ii | | ESTs, Moderately similar to I38937 DNA/RNA-binding protein [*H. sapiens*] |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1809 | 9421 | AI072885 | pp | | ESTs, Moderately similar to INPP MOUSE INOSITOL POLYPHOSPHATE 1-PHOSPHATASE [*M. musculus*], inositol polyphosphate-1-phosphatase |
| 670 | 17581 | AA892835 | f | | ESTs, Moderately similar to JC1235 transcription factor BTF3a [*H. sapiens*], Homo sapiens cDNA FLJ14844 fis, clone PLACE1000133, highly similar to TRANSCRIPTION FACTOR BTF3, *Mus musculus*, basic transcription factor 3, clone MGC:6799 IMAGE:2648048, mRNA, complete cds, RIKEN cDNA 1700054E11 gene, RIKEN cDNA 5730434I03 gene, basic transcription factor 3 |
| 1030 | 22753 | AA946300 | l, General | | ESTs, Moderately similar to JC4702 cytochrome P450 3A9 - rat [*R. norvegicus*], ESTs, Weakly similar to cytochrome P450 3A13 [*M. musculus*], Homo sapiens cDNA FLJ31317 fis, clone LIVER1000421, moderately similar to CYTOCHROME P450 3A5 (EC 1.14.14.1), cytochrome P450, steroid inducible 3a13, cytochrome P450, subfamily IIIA (niphedipine oxidase), polypeptide 3, cytochrome P450, subfamily IIIA (niphedipine oxidase), polypeptide 4, cytochrome P450, subfamily IIIA (niphedipine oxidase) polypeptide 5 |
| 4340 | 24351 | 574257 | ii, kk, ll, ww | | ESTs, Moderately similar to JC5604 ABC-transporting peroxisomal membrane protein 69 [*H. sapiens*] |
| 106 | 21064 | AA800175 | m, ww | | ESTs, Moderately similar to JC7136 peptidylprolyl isomerase (EC 5.2.1.8) - mouse [*M. musculus*], protein (peptidyl-prolyl cis/trans isomerase) NIMA-interacting 1, protein (peptidyl-prolyl cis/trans isomerase) NIMA-interacting, 4 (parvulin) |
| 618 | 18208 | AA892318 | gg, hh | | ESTs, Moderately similar to JC7220 nuclear protein SR-25 [*H. sapiens*], HSVI binding protein, SRp25 nuclear protein, expressed sequence AA408210, expressed sequence AA408365 |
| 618 | 18209 | AA892318 | r, bb | | ESTs, Moderately similar to JC7220 nuclear protein SR-25 [*H. sapiens*], HSVI binding protein, SRp25 nuclear protein, expressed sequence AA408210, expressed sequence AA408365 |
| 3133 | 8829 | NM_012749 | q, xx | | ESTs, Moderately similar to NUCLEOLIN [*M. musculus*], ESTs, Weakly similar to A35804 nucleolin [*H. sapiens*], ESTs, Weakly similar to NUCL_HUMAN NUCLEOLIN [*H. sapiens*], ESTs, Weakly similar to NUCKRAT Nucleolin (Protein C23) [*R. norvegicus*], RIKEN cDNA 1200009A02 gene, eukaryotic translation initiation factor 3, subunit 4 (delta, 44 kDa), nucleolin pigpen |
| 3133 | 8831 | NM_012749 | g | | ESTs, Moderately similar to NUCLEOLIN [*M. musculus*], ESTs, Weakly similar to A35804 nucleolin [*H. sapiens*], ESTs, Weakly similar to NUCL_HUMAN NUCLEOLIN [*H. sapiens*], ESTs, Weakly similar to NUCL_RAT Nucleolin (Protein C23) [*R. norvegicus*], RIKEN cDNA 1200009A02 gene, eukaryotic translation initiation factor 3, subunit 4 (delta, 44 kDa), nucleolin pigpen |
| 4464 | 23302 | X78949 | ff, xx | | ESTs, Moderately similar to P4H1_RAT Prolyl 4-hydroxylase alpha-1 subunit precursor (4-PH alpha-1) (Procollagen-proline,2-oxoglutarate-4-dioxygenase alpha-1 subunit) [*R. norvegicus*], Homo sapiens, clone IMAGE:3162218, mRNA, partial cds, RIKEN cDNA 4933406E20 gene, procollagen-proline, 2-oxoglutarate 4- |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | dioxygenase (proline 4-hydroxylase), alpha 1 polypeptide, procollagen-proline, 2-oxoglutarate 4-dioxygenase (proline 4-hydroxylase), alpha II polypeptide, procollagen-proline, 2-oxoglutarate 4-dioxygenase (proline 4-hydroxylase), alpha polypeptide I, procollagen-proline, 2-oxoglutarate 4-dioxygenase (proline 4-hydroxylase) alpha-polypeptide II |
| 2175 | 15684 | AI171535 | n, General | | ESTs, Moderately similar to PAB1 MOUSE POLYADENYLATE-BINDING PROTEIN 1 [*M. musculus*], ESTs, Weakly similar to PAB1 MOUSE POLYADENYLATE-BINDING PROTEIN 1 [*M. musculus*], RIKEN cDNA 4932702K14 gene, poly A binding protein, cytoplasmic 1, poly(A) binding protein, cytoplasmic 4 (inducible form) |
| 2676 | 15685 | AI233870 | m | | ESTs, Moderately similar to PAB1 MOUSE POLYADENYLATE-BINDING PROTEIN 1 [*M. musculus*], ESTs, Weakly similar to PAB1 MOUSE POLYADENYLATE-BINDING PROTEIN 1 [*M. musculus*], RIKEN cDNA 4932702K14 gene, poly A binding protein, cytoplasmic 1, poly(A) binding protein, cytoplasmic 4 (inducible form) |
| 248 | 5169 | AA819488 | l, General | | ESTs, Moderately similar to PCD6_HUMAN PROGRAMED CELL DEATH PROTEIN 6 (PROBABLE CALCIUM-BINDING PROTEIN ALG-2) [*H. sapiens*], ESTs, Weakly similar to CAN1_MOUSE CALPAIN 1, LARGE [CATALYTIC] SUBUNIT (CALCIUM-ACTIVATED NEUTRAL PROTEINASE) (CANP) (MU-TYPE) [*M. musculus*], Homo sapiens, clone IMAGE:4823101, mRNA, partial cds, Homo sapiens, clone MGC:20576 IMAGE:4300206, mRNA, complete cds, PEF protein with a long N-terminal hydrophobic domain (peflin), calpain 13, calpain 6, programmed cell death 6 |
| 2747 | 19035 | AI236576 | pp, rr | | ESTs, Moderately similar to RAS-RELATED PROTEIN RAB-1A [*M. musculus*], ESTs, Weakly similar to A49647 GTP-binding protein Rab13 [*H. sapiens*], ESTs, Weakly similar to RB30_HUMAN RAS-RELATED PROTEIN RAB-3 [*H. sapiens*], RAB, member of RAS oncogene family-like 4, RAB1B, member RAS oncogene family, RAB30, member RAS oncogene family |
| 1434 | 6489 | AI012636 | d | | ESTs, Moderately similar to RBMA_RAT RNA-BINDING PROTEIN 10 (RNA BINDING MOTIF PROTEIN 10) (S1-1 PROTEIN) [*R. norvegicus*], Homo sapiens cDNA FLJ10100 fis, clone HEMBA1002469, moderately similar to DX58237E PROTEIN, Mus musculus, Similar to RNA binding motif protein 10, clone MGC:7826 IMAGE:3500403, mRNA, complete cds, RNA binding motif protein 10, S1-1 protein from liver |
| 2952 | 14968 | K02815 | f | | ESTs, Moderately similar to S04363 class II histocompatibility antigen RT1-B alpha chain precursor - rat [*R. norvegicus*], histocompatibility 2, O region alpha locus, major histocompatibility complex, class II, DO alpha |
| 1832 | 6321 | AI101256 | ii, ll | | ESTs, Moderately similar to S09017 heterogeneous ribonuclear particle protein type C - rat (fragment) [*R. norvegicus*], Homo sapiens cDNA FLJ32918 fis, clone TESTI2006588, Homo sapiens, clone IMAGE:3450973, mRNA, Mus musculus, clone MGC:36467 IMAGE:5359082, mRNA, complete cds, heterogeneous nuclear |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | ribonucleoprotein D, high-glycine/tyrosine protein type I E5, musashi homolog 2 (*Drosophila*) |
| 3708 | 17302 | NM_031008 | tt | | ESTs, Moderately similar to S11276 alpha-adaptin c - rat [*R. norvegicus*], *Mus musculus* adult male testis cDNA, RIKEN full-length enriched library, clone:4932434L04:adaptor protein complex AP-2, alpha 2 subunit, full insert sequence, adaptor protein complex AP-2, alpha 1 subunit, adaptor protein complex AP-2, alpha 2 subunit, adaptor-related protein complex 1, gamma 1 subunit, adaptor-related protein complex 2, alpha 2 subunit |
| 4076 | 1453 | NM_053887 | ff | | ESTs, Moderately similar to S12207 hypothetical protein [*M. musculus*], ESTs, Weakly similar to mitogen activated protein kinase kinase kinase 1 [*Rattus norvegicus*] [*R. norvegicus*], mitogen activated protein kinase kinase kinase 1, mitogen activated protein kinase kinase kinase 2, mitogen activated protein kinase kinase kinase 3, mitogen-activated protein kinase kinase kinase 1, mitogen-activated protein kinase kinase kinase 3 |
| 4076 | 1454 | NM_053887 | gg, hh | | ESTs, Moderately similar to S12207 hypothetical protein [*M. musculus*], ESTs, Weakly similar to mitogen activated protein kinase kinase kinase 1 [*Rattus norvegicus*] [*R. norvegicus*], mitogen activated protein kinase kinase kinase 1, mitogen activated protein kinase kinase kinase 2, mitogen activated protein kinase kinase kinase 3, mitogen-activated protein kinase kinase kinase 1, mitogen-activated protein kinase kinase kinase 3 |
| 3583 | 3902 | NM_022516 | ss | | ESTs, Moderately similar to S15552 polypyrimidine tract-binding protein 1 - rat [*R. norvegicus*], ESTs, Weakly similar to S15552 polypyrimidine tract-binding protein 1 - rat [*R. norvegicus*], *Mus musculus*, Similar to regulator of differentiation (in *S. pombe*) 1, clone MGC:11742 IMAGE:3969488, mRNA, complete cds, RIKEN cDNA 2810036L13 gene, heterogeneous nuclear ribonucleoprotein L, polypyrimidine tract binding protein 1, polypyrimidine tract binding protein 2 |
| 1472 | 24239 | AI013781 | d | | ESTs, Moderately similar to S19586 N-methyl-D-aspartate receptor glutamate-binding chain - rat [*R. norvegicus*], ESTs, Weakly similar to S19586 N-methyl-D-aspartate receptor glutamate-binding chain - rat [*R. norvegicus*], RIKEN cDNA 1110025J15 gene, RIKEN cDNA 2310061B02 gene, RIKEN cDNA 2900002L20 gene, RIKEN cDNA 4930500J03 gene, *Rattus norvegicus* neural membrane protein 35 mRNA, complete cds, testis enhanced gene transcript (BAX inhibitor 1) |
| 2738 | 14879 | AI236200 | ee | | ESTs, Moderately similar to S38965 mannosyl-oligosaccharide 1,2-alpha-mannosidase [*H. sapiens*] |
| 4173 | 252 | NM_133323 | d | | ESTs, Moderately similar to S47073 finger protein HZF2, Krueppel-related [*H. sapiens*], ESTs, Weakly similar to zinc finger protein 93 homolog; zinc finger protein homologous to Zfp93 in mouse; zinc finger protein homologous to mouse Zfp93 [*Homo sapiens*] [*H. sapiens*], KRAB zinc finger protein (Mzf22), zinc finger protein 111, zinc finger protein 354A, zinc finger protein |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 691 | 24179 | M893091 | nn, tt | | 354B, zinc finger protein 93 homolog (mouse)<br>ESTs, Moderately similar to S47073 finger protein HZF2, Krueppel-related [*H. sapiens*], ESTs, Weakly similar to A48830 probable transcription regulator NT fin12 - mouse [*M. musculus*], expressed sequence AI467481, zinc finger protein 354A, zinc finger protein 354B, zinc finger protein 40, zinc finger protein 43 (HTF6) |
| 2023 | 8924 | AI137283 | z | | ESTs, Moderately similar to S47073 finger protein HZF2, Krueppel-related [*H. sapiens*], ESTs, Weakly similar to TC17 MOUSE TRANSCRIPTION FACTOR 17 [*M. musculus*], expressed sequence AI875089, hypermethylated in cancer 2, zinc finger protein 354A, zinc finger protein 354B |
| 2670 | 17210 | AI233746 | pp | | ESTs, Moderately similar to SC14_HUMAN SEC14-LIKE PROTEIN [*H. sapiens*], KIAA0420 gene product, SEC14-like 1 (*S. cerevisaie*), 5EC14-like 2 (*S. cerevisaie*), chromosome 20 open reading frame 45 |
| 2527 | 13879 | AI230004 | oo | | ESTs, Moderately similar to T00374 hypothetical protein KIAA0648 [*H. sapiens*], KIAA0648 protein, androgen-induced prostate proliferative shutoff associated protein |
| 939 | 21911 | AA943610 | s | | ESTs, Moderately similar to T08795 hypothetical protein DKFZp586J1822.1 [*H. sapiens*] |
| 3475 | 2439 | NM_019277 | m, ss | | ESTs, Moderately similar to T09221 exocyst complex protein Se15 - rat [*R. norvegicus*], *Homo sapiens* rsec15-like protein mRNA, partial cds, *Mus musculus*, Similar to SEC15 (*S. cerevisiae*)-like, clone MGC:30428 IMAGE:2631201, mRNA, complete cds, RIKEN cDNA 4930569O18 gene, SEC15 (*S. cerevisiae*)-like, SEC15 homolog (*S. cerevisiae*) Sec15B protein |
| 1052 | 22596 | AA955298 | c | | ESTs, Moderately similar to T46637 transcription factor 1, neural - rat [*R. norvegicus*], ESTs, Weakly similar to A35804 nucleolin [*H. sapiens*], *Homo sapiens* mRNA; cDNA DKFZp434E0922 (from clone DKFZp434E0922), *Mus musculus* 10, 11 days embryo whole body cDNA, RIKEN full-length enriched library, clone:2810003I18: myelin transcription factor 1-like, full insert sequence, myelin transcription factor 1-like nucleolin |
| 4180 | 10660 | NM_133423 | r, w | | ESTs, Moderately similar to T46637 transcription factor 1, neural - rat [*R. norvegicus*], *Homo sapiens* mRNA; cDNA DKFZp434E0922 (from clone DKFZp434E0922), *Mus musculus* 10, 11 days embryo whole body cDNA, RIKEN full-length enriched library, clone:2810003I18:myelin transcription factor 1-like, full insert sequence, myelin transcritpion factor 1-like |
| 4456 | 22424 | X67788 | z, gg, hh | | ESTs, Moderately similar to T47177 hypothetical protein DKFZp762H157.1 [*H. sapiens*], villin 2, villin 2 (ezrin) |
| 4237 | 16922 | NM_138549 | x | | ESTs, Moderately similar to T50638 synaptic glycoprotein SC2 [*H. sapiens*], ESTs, Weakly similar to T50638 synaptic glycoprotein SC2 [*H. sapiens*], expressed sequence AI173355, glycoprotein, synaptic 2, steroid 5 alpha-reductase 2, steroid 5 alpha-reductase 2-like, steroid 5-alpha-reductase 2, steroid-5-alpha-reductase, alpha polypeptide 2 (3-oxo-5 alpha-steroid delta 4-dehydrogenase alpha 2) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4237 | 25479 | NM_138549 | e, x | | ESTs, Moderately similar to T50638 synaptic glycoprotein SC2 [*H. sapiens*], ESTs, Weakly similar to T50638 synaptic glycoprotein SC2 [*H. sapiens*], expressed sequence AI 173355, glycoprotein, synaptic 2, steroid 5 alpha-reductase 2, steroid 5 alpha-reductase 2-like, steroid 5-alpha-reductase 2, steroid-5-alpha-reductase, alpha polypeptide 2 (3-oxo-5 alpha-steroid delta 4-dehydrogenase alpha 2) |
| 3108 | 1514 | NM_012678 | b, t | | ESTs, Moderately similar to TROPOMYOSIN 5, CYTOSKELETAL TYPE [*M. musculus*],_tropomyosin 4 |
| 3804 | 14633 | NM_031533 | b, l, s, General, vv | | ESTs, Moderately similar to UDB5 MOUSE UDP-GLUCURONOSYLTRANSFERASE 2B5 PRECURSOR, MICROSOMAL [*M. musculus*], *Mus musculus*, Similar to UDP glycosyltransferase 2 family, polypeptide B4, clone MGC:37823 IMAGE:5098890, mRNA, complete cds, RIKEN cDNA 1300012D20 gene, UDP glycosyltransferase 2 family, polypeptide B17, UDP-glucuronosyltransferase 2 family, member 5, expressed sequence AA986709 |
| 3922 | 17805 | NM_031980 | b, General, gg, hh, vv | | ESTs, Moderately similar to UDB5 MOUSE UDP-GLUCURONOSYLTRANSFERASE 2B5 PRECURSOR, MICROSOMAL [*M. musculus*], *Mus musculus*, Similar to UDP glycosyltransferase 2 family, polypeptide B4, clone MGC:37823 IMAGE:5098890, mRNA, complete cds, RIKEN cDNA 1300012D20 gene, UDP glycosyltransferase 2 family, polypeptide B17, UDP-glucuronosyltransferase 2 family, member 5, expressed sequence AA986709 |
| 3922 | 17806 | NM_031980 | General, ii, ll | | ESTs, Moderately similar to UDB5 MOUSE UDP-GLUCURONOSYLTRANSFERASE 2B5 PRECURSOR, MICROSOMAL [*M. musculus*], *Mus musculus*, Similar to UDP glycosyltransferase 2 family, polypeptide B4, clone MGC:37823 IMAGE:5098890, mRNA, complete cds, RIKEN cDNA 1300012D20 gene, UDP glycosyltransferase 2 family, polypeptide B17, UDP-glucuronosyltransferase 2 family, member 5, expressed sequence AA986709 |
| 4321 | 14632 | NM_153314 | f, uu | | ESTs, Moderately similar to UDB5 MOUSE UDP-GLUCURON OSYLTRANSFERASE 2B5 PRECURSOR, MICROSOMAL [*M. musculus*], *Mus musculus*, Similar to UDP glycosyltransferase 2 family, polypeptide B4, clone MGC:37823 IMAGE:5098890, mRNA, complete cds, RIKEN cDNA 1300012D20 gene, UDP glycosyltransferase 2 family, polypeptide Bi 7, UDP-glucuronosyltransferase 2 family, member 5, expressed sequence AA986709 |
| 4321 | 14346 | NM_153314 | b, l, j, General, qq, vv, ww | | ESTs, Moderately similar to UDB5 MOUSE UDP-GLUCURONOSYLTRANSFERASE 2B5 PRECURSOR, MICROSOMAL [*M. musculus*], *Mus musculus*, Similar to UDP glycosyltransferase 2 family, polypeptide B4, clone MGC:37823 IMAGE:5098890, mRNA, complete cds, RIKEN cDNA 1300012D20 gene, UDP glycosyltransferase 2 family, polypeptide B17, UDP-glucuronosyltransferase 2 family, member 5, expressed sequence AA986709 |
| 4321 | 14347 | NM_153314 | b, General, vv | | ESTs, Moderately similar to UDB5 MOUSE UDP-GLUCURONOSYLTRANSFERASE 2B5 PRECURSOR, MICROSOMAL [*M. musculus*], *Mus musculus*, Similar to UDP glycosyltransferase 2 family, polypeptide B4, clone MGC:37823 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | IMAGE:5098890, mRNA, complete cds, RIKEN cDNA 1300012D20 gene, UDP glycosyltransferase 2 family, polypeptide B17, UDP-glucuronosyltransferase 2 family, member 5, expressed sequence AA986709 |
| 4368 | 1537 | U27518 | ss | | ESTs, Moderately similar to UDB5 MOUSE UDP-GLUCURONOSYLTRANSFERASE 2B5 PRECURSOR, MICROSOMAL [*M. musculus*], *Mus musculus*, Similar to UDP glycosyltransferase 2 family, polypeptide B4, clone MGC:37823 IMAGE:5098890, mRNA, complete cds, RIKEN cDNA 1300012D20 gene, UDP glycosyltransferase 2 family, polypeptide B17, UDP-glucuronosyltransferase 2 family, member 5, expressed sequence AA986709 |
| 1975 | 18466 | AI111828 | oo | | ESTs, Moderately similar to Y196_HUMAN HYPOTHETICAL PROTEIN KIAA0196 [*H. sapiens*], *Homo sapiens* cDNA FLJ32440 fis, clohe SKMUS2001492, KIAA0196 gene product |
| 433 | 23301 | M859975 | w | | ESTs, Weakly similar to 2-oxoglutarate carrier [*Rattus norvegicus*] [*R. norvegicus*], solute carrier family 25 (mitochondrial carrier; adenine nucleotide translocator), member 10, solute carrier family 25 (mitochondrial carrier; oxoglutarate carrier), member 11 |
| 3646 | 23976 | NM_023104 | jj | | ESTs, Weakly similar to acetyl-CoA synthetase [*Homo sapiens*] [*H. sapiens*], RIKEN cDNA 2210408B16 gene, acetyl-Coenzyme A synthetase 1 (AMP forming) |
| 3517 | 18727 | NM_021577 | g, m | | ESTs, Weakly similar to argininosuccinate lyase [*Rattus norvegicus*] [*R. norvegicus*], argininosuccinate lyase |
| 3694 | 1995 | NM_030850 | d, h, uu | | ESTs, Weakly similar to betaine-homocysteine methyltransferase [*Rattus norvegicus*] [*R. norvegicus*], *Mus musculus* adult male testis cDNA, RIKEN full-length enriched library, clone:4930572N12:betaine-homocysteine methyltransferase, full insert sequence, betaine-homocysteine methyltransferase, betaine-homocysteine methyltransferase 2 |
| 4094 | 17279 | NM_053977 | t, mm | | ESTs, Weakly similar to cadherin 17 [*Rattus norvegicus*] [*R. norvegicus*], cadherin 16, cadherin 16, KSP-cadherin, cadherin 17, cadherin 17, LI cadherin (liver-intestine) |
| 4094 | 17280 | NM_053977 | mm | | ESTs, Weakly similar to cadherin 17 [*Rattus norvegicus*] [*R. norvegicus*], cadherin 16, cadherin 16, KSP-cadherin, cadherin 17, cadherin 17, LI cadherin (liver-intestine) |
| 2982 | 25389 | L41684 | ll | | ESTs, Weakly similar to cadherin EGF LAG seven-pass G-type receptor [*Mus musculus*] [*M. musculus*], FAT tumor suppressor homolog 1 (*Drosophila*), Fta3 protein, cadherin 23 (otocadherin), calsyntenin 1, calsyntenin 2 |
| 4218 | 2641 | NM_134408 | w, General | | ESTs, Weakly similar to cadherin EGF LAG seven-pass G-type receptor [*Mus musculus*] [*M. musculus*], KIAA1828 protein, cadherin EGF LAG seven-pass G-type receptor 1, cadherin EGF LAG seven-pass G-type receptor 3 |
| 3547 | 20248 | NM_022205 | y | | ESTs, Weakly similar to CXC chemokine receptor [*Rattus norvegicus*] [*R. norvegicus*], G protein-coupled receptor, chemokine (C-X-C motif), receptor 4 (fusin), chemokine (C-X-C) receptor 4 |
| 3547 | 20249 | NM_022205 | tt | | ESTs, Weakly similar to CXC chemokine receptor [*Rattus norvegicus*] [*R. norvegicus*], G protein-coupled receptor, chemokine (C-X-C motif), receptor 4 (fusin), chemokine (C-X-C) receptor 4 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1082 | 23747 | AA956329 | gg, hh | | ESTs, Weakly similar to delta-6 fatty acid desaturase [Rattus norvegicus] [R. norvegicus], delta-6 fatty acid desaturase, expressed sequence AI464531, fatty acid desaturase 2, fatty acid desaturase 3 |
| 2384 | 12408 | AI178762 | qq | | ESTs, Weakly similar to delta-6 fatty acid desaturase [Rattus norvegicus] [R. norvegicus], delta-6 fatty acid desaturase, expressed sequence AI464531, fatty acid desaturase 2, fatty acid desaturase 3 |
| 3914 | 22301 | NM_031967 | d | | ESTs, Weakly similar to development-related protein [Rattus norvegicus] [R. norvegicus], Mus musculus, Similar to NDRG family, member 4, clone MGC:7067 IMAGE:3156802, mRNA, complete cds, N-myc downstream regulated 1, N-myc downstream regulated 2, N-myc downstream regulated 3, N-myc downstream regulated gene 1 |
| 4193 | 16993 | NM_133583 | a, d, m | | ESTs, Weakly similar to development-related protein [Rattus norvegicus] [R. norvegicus], Mus musculus, Similar to NDRG family, member 4, clone MGC:7067 IMAGE:3156802, mRNA, complete cds, N-myc downstream regulated 2, N-myc downstream regulated 3, N-myc downstream regulated gene 1, RIKEN cDNA 1110025J03 gene, development-related protein |
| 4193 | 15029 | NM_133583 | oo | | ESTs, Weakly similar to development-related protein [Rattus norvegicus] [R. norvegicus], Mus musculus, Similar to NDRG family, member 4, clone MGC:7067 IMAGE:3156802, mRNA, complete cds, N-myc downstream regulated 2, N-myc downstream regulated 3, N-myc downstream regulated gene 1, RIKEN cDNA 1110025J03 gene, development-related protein |
| 3523 | 19173 | NM_021661 | n | | ESTs, Weakly similar to G alpha interacting protein [Rattus norvegicus] [R. norvegicus], regulator of G-protein signaling 17, regulator of G-protein signaling 19, regulator of G-protein signaling 20, regulator of G-protein signalling 19, regulator of G-protein signalling 20 |
| 567 | 6967 | AA891810 | pp | | ESTs, Weakly similar to g1-related zinc finger protein [Mus musculus] [M. musculus], Homo sapiens, clone IMAGE:3956746, mRNA, partial cds, g1-related zinc finger protein, similar to RIKEN cDNA 1300002C13 |
| 567 | 6968 | M891810 | q, x, ss | | ESTs, Weakly similar to g1-related zinc finger protein [Mus musculus] [M. musculus], Homo sapiens, clone IMAGE:3956746, mRNA, partial cds, g1-related zinc finger protein, similar to RIKEN cIDNA 1300002C13 |
| 3623 | 24458 | NM_022706 | b | | ESTs, Weakly similar to GABA(A) receptor-associated protein like 2; ganglioside expression factor 2 [Rattus norvegicus] [R. norvegicus], GABA(A) receptor-associated protein, GABA(A) receptor-associated protein like 1, GABA(A) receptor-associated protein like 2, GABA(A) receptor-associated protein-like 2, GABA(A) receptors associated protein like 3, gamma-aminobutyric acid (GABA(A)) receptor-associated protein-like 1, gamma-aminobutyric acid receptor associated protein |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 1337 | 11322 | AI009492 | j | | ESTs, Weakly similar to hypothetical protein [*Homo sapiens*] [*H. sapiens*] |
| 2752 | 7691 | AI236611 | v, x, bb | | ESTs, Weakly similar to isopentenyl-diphosphate delta isomerase [*Rattus norvegicus*] [*R. norvegicus*], *Mus musculus*, Similar to isopentenyl-diphosphate delta isomerase, clone MGC:8139 IMAGE:3589498, mRNA, complete cds, diphosphate dimethylallyl diphosphate isomerase 2, isopentenyl-diphosphate delta isomerase |
| 3993 | 1058 | NM_053539 | d, o, q, v, jj, pp | | ESTs, Weakly similar to isopentenyl-diphosphate delta isomerase [*Rattus norvegicusi* [*R. norvegicus*], *Mus musculus*, Similar to isopentenyl-diphosphate delta isomerase, clone MGC:8139 IMAGE:3589498, mRNA, complete cds, diphosphate dimethylallyl diphosphate isomerase 2, isopentenyl-diphosphate delta isomerase |
| 4157 | 3880 | NM_130749 | bb | | ESTs, Weakly similar to MAP/microtubule affinity-regulating kinase 3; ELKL motif kinase 2 long form [*Mus musculus*] [*M. musculus*], MAP/microtubule affinity regulating kinase 3, *Mus musculus*, clone MGC:36574 IMAGE:5098034, mRNA, complete cds, PAS domain containing serine/threonine kinase, serine/threonine kinase 22C (spermiogenesis associated) |
| 4026 | 20951 | NM_053651 | nn | | ESTs, Weakly similar to NK2 transcription factor related, locus 5 (*Drosophila*) [*Rattus norvegicus*] [*R. norvegicus*] H6 homeo box 1, NK2 transcription factor related, locus 3 (*Drosophila*), NK2 transcription factor related, locus 5 (*Drosophila*), bagpipe homeobox gene 1 homolog (*Drosophila*), bagpipe homeobox homolog 1 (*Drosophila*), cardiac-specific homeo box |
| 3716 | 16560 | NM_031020 | t | | ESTs, Weakly similar to p38 mitogen activated protein kinase [*Rattus norvegicus*] [*R. norvegicus*], mitogen activated protein kinase 14, mitogen-activated protein kinase 11, mitogen-activated protein kinase 14 |
| 3716 | 16562 | NM_031020 | l, p, ss, uu | | ESTs, Weakly similar to p38 mitogen activated protein kinase [*Rattus norvegicus*] [*R. norvegicus*], mitogen activated protein kinase 14, mitogen-activated protein kinase 11, mitogen-activated protein kinase 14 |
| 3716 | 16564 | NM_031020 | k, l | | ESTs, Weakly similar to p38 mitogen activated protein kinase [*Rattus norvegicus*] [*R. norvegicus*], mitogen activated protein kinase 14, mitogen-activated protein kinase 11, mitogen-activated protein kinase 14 |
| 3716 | 16565 | NM_031020 | t | | ESTs, Weakly similar to p38 mitogen activated protein kinase [*Rattus norvegicus*] [*R. norvegicus*], mitogen activated protein kinase 14, mitogen-activated protein kinase 11, mitogen-activated protein kinase 14 |
| 3923 | 15265 | NM_031981 | p, w, ff | | ESTs, Weakly similar to p47 [*Homo sapiens*] [*H. sapiens*], RIKEN cDNA 3110003A22 gene |
| 4259 | 17115 | NM_138905 | l, m, General, kk | | ESTs, Weakly similar to phosphatidic acid phosphatase type 2B [*Mus musculus*] [*Minusculus*], phosphatidate phosphohydrolase type 2a, phosphatidic acid phosphatase 2a, phosphatidic acid phosphatase type 2A, phosphatidic acid phosphatase type 2B, phosphatidic acid phosphatase type 2C, phosphatidic acid phosphatase type 2c |
| 478 | 14951 | AA875037 | y | | ESTs, Weakly similar to plasminogen activator inhibitor 2 type A [*Rattus norvegicus*] [*R. norvegicus*], *Mus musculus* SPI3C (Serpinb6c) mRNA, complete cds, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | expressed sequence AI876477, expressed sequence C76171, plasminogen activator inhibitor 2 type A, serine (or cysteine) proteinase inhibitor, clade B (ovalbumin), member 2, serine (or cysteine) proteinase inhibitor, clade B (ovalbumin), member 6, serine (or cysteine) proteinase inhibitor, clade B (ovalbumin), member 9, serine protease inhibitor 16 |
| 3502 | 24066 | NM_019384 | d, kk | | ESTs, Weakly similar to Ser/Arg-related nuclear matrix protein; plenty-of-prolines-101; serine/arginine repetitive matrix protein 1 [*Mus musculus*] [*M. musculus*], ESTs, Weakly similar to A35938 profilaggrin [*H. sapiens*], ESTs, Weakly similar to A55817 cyclin-dependent kinase p130-PITSLRE - mouse [*M. musculus*], *Mus musculus*, Similar to hypothetical protein MGC13125, clone MGC:38070 IMAGE:5252666, mRNA, complete cds, expressed sequence AI480556, expressed sequence AW742389, glucocorticoid-induced gene 1, serine arginine-rich pre-mRNA splicing factor SR-A1, serine/arginine repetitive matrix 1, serine/arginine repetitive matrix 2, splicing factor, arginine/serine-rich 2, interacting protein |
| 3878 | 16624 | NM_031751 | k | | ESTs, Weakly similar to SH3/ankyrin domain gene 3; Shank3b protein [*Mus musculus*] [*M. musculus*], ESTs, Weakly similar to PRP3 MOUSE PROLINE-RICH PROTEIN MP-3 [*M. musculus*], HLA-B associated transcript 8, SH3/ankyrin domain gene 3, ankyrin repeat and SOCS box-containing 16, hypothetical protein FLJ192497 |
| 4152 | 6909 | NM_130413 | qq | | ESTs, Weakly similar to SKAP55 homologue; Src-associated adaptor protein [*Mus musculus*] [*M. musculus*], SH3-domain binding protein 2, src family associated phosphoprotein 1, src family associated phosphoroprotein 2 |
| 3622 | 24423 | NM_022703 | m, r, gg, hh, pp | | ESTs, Weakly similar to small glutamine-rich tetratricopeptide repeat (TPR) containing protein (SGT) [*Rattus norvegicus*] [*R. norvegicus*], ESTs, Weakly similar to PPP5 MOUSE SERINE/THREONINE PROTEIN PHOSPHATASE 5 [*M. musculus*], ESTs, Weakly similar to T08782 hypothetical protein DKFZp586N1020.1 [*H. sapiens*], *Mus musculus*, clone MGC:27660 IMAGE:4527683, mRNA, complete cds, RIKEN cDNA 2310015L07 gene, RIKEN cDNA 5330427H01 gene, STIP1 homology and U-Box containing protein 1, protein phosphatase 5, catalytic subunit, small glutamine-rich tetratricopeptide repeat (TPR)-containing, sperm associated antigen 1, stress-induced-phosphoprotein 1 |
| 3926 | 19768 | NM_031986 | pp | | ESTs, Weakly similar to syntenin [*Rattus norvegicus*] [*R. norvegicus*], syndecan binding protein, syndecan binding protein (syntenin), syndecan binding protein (syntenin) 2 |
| 1373 | 12310 | AI010362 | gg, hh | | ESTs, Weakly similar to vasopressin-activated calcium-mobilizing receptor protein [*Rattus norvegicus*] [*R. norvegicus*], RIKEN cDNA 4921514I20 gene, cullin 1, cullin 2, cullin 4B, cullin 5, vasopressin-activated calcium-mobilizing receptor protein |
| 4059 | 20421 | NM_053821 | a, vv | | ESTs, Weakly similar to v-ral simian leukemia viral oncogene homolog B (ras |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | related) [*Rattus norvegicus*] [*R. norvegicus*], v-ral simian leukemia viral oncogene homolog B (ras related), v-ral simian leukemia viral oncogene homolog B (ras related: GTP binding protein) |
| 3418 | 520 | NM_017345 | n | | ESTs, Weakly similar to 1411301A neural adhesion mol L1 [*M. musculus*], cell adhesion molecule with homology to L1CAM (close homolog of L1), close homolog of L1 |
| 282 | 7749 | AA848804 | jj | | ESTs, Weakly similar to 1607338A transcription factor BTF3a [*H. sapiens*], *Mus musculus*, basic transcription factor 3, clone MGC:6799 IMAGE:2648048, mRNA, complete cds, RIKEN cDNA 1700054E11 gene, RIKEN cDNA 5730434I03 gene, basic transcription factor 3 |
| 3249 | 20150 | NM_013135 | oo | | ESTs, Weakly similar to I615347A ras p21 GTPase activating protein [*M. musculus*], ESTs, Weakly similar to SH2/SH3 adaptor protein [*M. musculus*], *Mus musculus*, Similar to RAS p21 protein activator, clone MGC:7759 IMAGE:3498774, mRNA, complete cds, RAS p21 protein activator (GTPase activating protein) 1, dual adaptor for phosphotyrosine and 3-phosphoinositides 1 |
| 3701 | 8815 | NM_030991 | ff | | ESTs, Weakly similar to 2122252A Lasp-1 protein [*H. sapiens*], LIM and SH3 protein 1, RIKEN cDNA 1200007O21 gene |
| 470 | 16146 | AA874934 | y | | ESTs, Weakly similar to A Chain A, The C2b Domain Of Rabphilin: Structural Variations In A Janus-Faced Domain [*R. norvegicus*], *Homo sapiens* mRNA for FLJ00210 protein, double C2, beta, double C2-like domains, alpha, expressed sequence AI854876, likely ortholog of mouse rabphilin 3A |
| 3366 | 18445 | NM_017220 | y | | ESTs, Weakly similar to A26882 pIL2 hypothetical protein - rat [*R. norvegicus*], ESTs, Weakly similar to AF191020 1 E2IG5 [*H. sapiens*], RIKEN cDNA 2310056P07 gene, RIKEN cDNA 9430073N08 gene, hypothetical protein, estradiol-induced |
| 4304 | 1798 | NM_145779 | a, d, m, uu, vv | | ESTs, Weakly similar to A2MG MOUSE ALPHA-2-MACROGLOBULIN PRECURSOR [*M. musculus*], *Mus musculus* GPI-anchored alpha-2 marcoglobulin-related protein mRNA, complete cds, alpha-2-macroglobulin |
| 3030 | 1138 | M76740 | cc | | ESTs, Weakly similar to A39321 mucin - rat [*R. norvegiucs*], mucin 17, mucin 3, intestinal, mucin 3B, silver |
| 2145 | 15403 | AI170714 | m, dd | | ESTs, Weakly similar to A40389 translation elongation factor eEF-1 alpha chain (clone pS1) - rat [*R. norvegicus*], HBS1 -like (*S. cerevisaie*), Hbs1-like (*S. cerevisiae*), *Homo sapiens* mRNA full length insert cDNA clone EUROIMAGE 1657957, RIKEN cDNA 4930594C11 gene, Tu translation elongation factor, mitochondrial, eukaryotic translation elongation factor 1 alpha 2 |
| 2247 | 15404 | AI175760 | dd | | ESTs, Weakly similar to A40389 translation elongation factor eEF-1 alpha chain (clone pS1) - rat [*R. norvegicus*], HBS1 -like (*S. cerevisaie*), Hbs1-like (*S. cerevisiae*), *Homo sapiens* mRNA full length insert cDNA clone EUROIMAGE 1657957, RIKEN cDNA 4930594C11 gene, Tu translation elongation factor, mitochondrial, eukaryotic translation elongation factor 1 alpha 2 |
| 3040 | 2694 | M92340 | rr | | ESTs, Weakly similar to A44257 interleukin-6 signal transducing molecule gp130 - rat [*R. norvegicus*], *Mus musculus* mRNA for cytokine receptor NR10, complete cds, colony stimulating factor 3 receptor |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | (granulocyte), cytokine receptor-like factor 1, interleukin 12 receptor, beta 2, interleukin 6 signal transducer, interleukin 6 signal transducer (gp130, oncostatin M receptor) |
| 834 | 4931 | AA924261 | oo | | ESTs, Weakly similar to A44468 26S proteasome regulatory chain 4 [*H. sapiens*] |
| 2556 | 20055 | AI230762 | rr | | ESTs, Weakly similar to A53742 calponin, acidic - rat [*R. norvegicus*], *Homo sapiens*, clone IMAGE:4669781, mRNA, partial cds |
| 1122 | 8430 | M964033 | t | | ESTs, Weakly similar to A54691 octamer-binding protein NonO - mouse [*M. musculus*], ESTs, Weakly similar to PSF_HUMAN PTB-ASSOCIATED SPLICING FACTOR [*H. sapiens*], RIKEN cDNA 9030402K04 gene, non-POU-domain-containing, octamer binding protein, splicing factor proline/glutamine rich (polypyrimidine tract binding protein associated) |
| 1269 | 8426 | AF036335 | pp | | ESTs, Weakly similar to A54691 octamer-binding protein NonO - mouse [*M. musculus*], ESTs, Weakly similar to PSF_HUMAN PTB-ASSOCIATED SPLICING FACTOR [*H. sapiens*], RIKEN cDNA 9030402K04 gene, non-POU-domain-containing, octamer binding protein, splicing factor proline/glutamine rich (polypyrimidine tract binding protein associated) |
| 1269 | 8427 | AF036335 | pp | | ESTs, Weakly similar to A54691 octamer-binding protein NonO - mouse [*M. musculus*], ESTs, Weakly similar to PSF_HUMAN PTB-ASSOCIATED SPLICING FACTOR [*H. sapiens*], RIKEN cDNA 9030402K04 gene, non-POU-domain-containing, octamer binding protein, splicing factor proline/glutamine rich (polypyrimidine tract binding protein associated) |
| 1352 | 8431 | AI009761 | y | | ESTs, Weakly similar to A54691 octamer-binding protein NonO - mouse [*M. musculus*], ESTs, Weakly similar to PSF_HUMAN PTB-ASSOCIATED SPLICING FACTOR [*H. sapiens*], RIKEN cDNA 9030402K04 gene, non-POU-domain-containing, octamer binding protein, splicing factor proline/glutamine rich (polypyrimidine tract binding protein associated) |
| 136 | 17997 | AA800671 | h, p, w, General | | ESTs, Weakly similar to A54854 Ras GTPase activating protein-related protein [*H. sapiens*] |
| 3425 | 14979 | NM_019126 | u, bb, jj | | ESTs, Weakly similar to A54879 pregnancy-specific glycoprotein mCGM3 - rat [*R. norvegicus*], RIKEN cDNA 1600019C01 gene, carcinoembryonic antigen-related cell adhesion molecule 1 (biliary glycoprotein), expressed sequence AA408604, pregnancy specific glycoprotein 16, pregnancy specific glycoprotein 18, pregnancy specific glycoprotein 19, pregnancy specific glycoprotein pseudogene 1 |
| 679 | 3438 | AA892921 | r | | ESTs, Weakly similar to A55143 calpain (EC 3.4.22.17) light chain - rat (fragment) [*R. norvegicus*], *Mus musculus*, Similar to grancalcin, EF-hand calcium binding protein, clone MGC:29240 IMAGE:5044040, mRNA, complete cds, RIKEN cDNA 2310005G05 gene, calpain, small subunit 1, programmed cell death 6, sorcin |
| 4071 | 18358 | NM_053864 | x | | ESTs, Weakly similar to A55190 transitional endoplasmic reticulum ATPase (EC 3.6.1.-) [validated] - rat [*R. norvegicus*], ESTs, Weakly similar to TRANSITIONAL ENDOPLASMIC RETICULUM ATPASE [*M. musculus*], *Homo sapiens* spermatogenesis associated factor (SPAF) mRNA, complete cds, RIKEN cDNA |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | 4833413G10 gene, RIKEN cDNA 4933439B08 gene, expressed sequence AI195026, katanin p60 (ATPase-containing) subunit A1, nuclear VCP-like, peroxisome biogenesis factor 1, spermatogenesis associated factor, valosin containing protein, valosin-containing protein |
| 3562 | 695 | NM_022388 | y | | ESTs, Weakly similar to A55571 chloride conductance inducer Mat-8 [*H. sapiens*], FXYD domain-containing ion transport regulator 3, FXYD domain-containing ion transport regulator 4 |
| 3566 | 23060 | NM_022394 | u | | ESTs, Weakly similar to A55817 cyclin-dependent kinase p130-PITSLRE - mouse [*M. musculus*], RIKEN cDNA 2600011L02 gene, RIKEN cDNA A930036K24 gene, aldehyde dehydrogenase family 5, subfamily A1, cell division cycle 2 homolog (*S. pombe*)-like 2, expressed sequence AI255170, scaffold attachment factor B |
| 2065 | 19034 | AI145768 | u | | ESTs, Weakly similar to A55817 cyclin-dependent kinase p130-PITSLRE - mouse [*M. musculus*], RIKEN cDNA 2600011L02 gene, RIKEN cDNA A930036K24 gene, aldehyde dehydrogenase family 5, subfamily A1, cell division cycle 2 homolog (*S. pombe*)-like 2, splicing factor, arginine/serine-rich 11 |
| 2883 | 19053 | 012770 | j, o | | ESTs, Weakly similar to ADT1 MOUSE ADP,ATP CARRIER PROTEIN, HEART/SKELETAL MUSCLE ISOFORM T1 [*M. musculus*], *Mus musculus*, Similar to RIKEN cDNA 1700066C05 gene, clone MGC:28125 IMAGE:3980327, mRNA, complete cds, RIKEN cDNA 1700034J06 gene, solute carrier family 25 (mitochondrial carrier, Aralar), member 12, solute carrier family 25 (mitochondrial carrier; adenine nucleotide translocator), member 4 |
| 1011 | 21334 | AA945753 | pp | | ESTs, Weakly similar to ANM2_HUMAN PROTEIN ARGININE N-METHYLTRANSFERASE 2 [*H. sapiens*], protein arginine N-methyltransferase 6 |
| 4064 | 16590 | NM_053838 | v | | ESTs, Weakly similar to ATRIAL NATRIURETIC PEPTIDE RECEPTOR A PRECURSOR [*M. musculus*], *Mus musculus*, Similar to natriuretic peptide receptor 2, clone IMAGE:5052434, mRNA, partial cds, natriuretic peptide receptor 1, natriuretic peptide receptor B/guanylate cyclase B (atrionatriuretic peptide receptor B), receptor-interacting serine-threonine kinase 2 |
| 4263 | 287 | NM_139042 | xx | | ESTs, Weakly similar to ATRIAL NATRIURETIC PEPTIDE RECEPTOR A PRECURSOR [*M. musculus*], *Mus musculus*, Similar to natriuretic peptide receptor 2, clone IMAGE:5052434, mRNA, partial cds, RIKEN cDNA 2410077I05 gene, natriuretic peptide receptor 1, natriuretic peptide receptor A|guanylate cyclase A (atrionatriuretic peptide receptor A) |
| 2867 | 8107 | AI639534 | pp | | ESTs, Weakly similar to ATS4_RAT ADAMTS-4 precursor (A disintegrin and metalloproteinase with thrombospondin motifs 4) (ADAM-TS 4) (ADAM-TS4) (Aggrecanase 1) [*R. norvegicus*], RIKEN cDNA 2010109H09 gene, a disintegrin-like and metalloprotease (reprolysin type) with thrombospondin type 1 motif, 4, properdin factor, complement |
| 164 | 19440 | AA800946 | ll | | ESTs, Weakly similar to B Chain B, Crystal Structure Of The D1d2 Sub-Complex From The Human Snrnp Core Domain [*H. sapiens*] |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4179 | 19326 | NM_133419 | q, ss | | ESTs, Weakly similar to B41182 collagen alpha 1(11) chain precursor [*M. musculus*], PUMA/JFY1 protein, RIKEN cDNA 4933407C03 gene, RIKEN cDNA 5730512J02 gene, dyskeratosis congenita 1. dyskerin |
| 3715 | 24658 | NM_031018 | ff | | ESTs, Weakly similar to B42026 cyclic AMP response element DNA-binding protein isoform 1 - mouse [*M. musculus*], *Mus musculus*, Similar to activating transcription factor 7, clone MGC:31554 IMAGE:4503463, mRNA, complete cds, activating transcription factor 2, activating transcription factor 7, cAMP response element-binding protein CRF-RPa |
| 3482 | 1099 | NM_019303 | y | | ESTs, Weakly similar to C2F1_HUMAN CYTOCHROME P450 2F1 [*H. sapiens*], cytochrome P450 monooxygenase CYP2T1, cytochrome P450, 2f2, cytochrome P450, subfamily IIE, polypeptide 1 |
| 4185 | 1394 | NM_133536 | l, v, xx | | ESTs, Weakly similar to D34323 GTP-binding protein Rab3A [*H. sapiens*], RAB23, member RAS oncogene family, RAB3A, member RAS oncogene family, RAB3C, member RAS oncogene family, hypothetical orotein BC013033 |
| 3972 | 16017 | NM_053401 | a | | ESTs, Weakly similar to D35826 hypothetical 13K protein A [*H. sapiens*], X-linked protein, brain expressed X-linked 2, nerve growth factor receptor (TNFRSF 16) associated protein 1, reduced expression 3 |
| 3972 | 16018 | NM_053401 | a, j | | ESTs, Weakly similar to C35826 hypothetical 13K protein A [*H. sapiens*], X-linked protein, brain expressed X-linked 2, nerve growth factor receptor (TNFRSF16) associated protein 1, reduced expression 3 |
| 3480 | 24883 | NM_019293 | e, k, u | | ESTs, Weakly similar to CAH5_RAT Carbonic anhydrase VA, mitochondrial precursor (Carbonate dehydratase VA) (CA-VA) [*R. norvegicus*], carbonic anhydrase 11, carbonic anhydrase 5a, mitochondrial, carbonic anhydrase 5b, mitochondrial, carbonic anhydrase VA, mitochondrial, carbonic anhydrase VB, mitochondrial |
| 3600 | 20944 | NM_022597 | m, ff, ii | | ESTs, Weakly similar to CATB MOUSE CATHEPSIN B PRECURSOR [*M. musculus*], cathepsin B |
| 225 | 4491 | AA818798 | xx | | ESTs, Weakly similar to CATZ_HUMAN Cathepsin Z precursor (Cathepsin X) (Cathepsin P) [*H. sapiens*], cathepsin Z, expressed sequence AU019819 |
| 332 | 4490 | AA851184 | ii | | ESTs, Weakly similar to CATZ_HUMAN Cathepsin Z precursor (Cathepsin X) (Cathepsin P) [*H. sapiens*], cathepsin Z, expressed sequence AU019819 |
| 2652 | 10378 | AI233300 | l | | ESTs, Weakly similar to CO5 MOUSE COMPLEMENT CS PRECURSOR [*M. musculus*], complement component 5, hemolytic complement |
| 264 | 230 | AA819870 | uu | | ESTs, Weakly similar to CO9 MOUSE COMPLEMENT COMPONENT C9 [*M. musculus*], *Mus musculus*, Similar to complement component 8, alpha polypeptide, clone MGC:29381 IMAGE:5052412, mRNA, complete cds, RIKEN cDNA 4930439B20 gene, complement component 8, beta polypeptide |
| 4366 | 228 | U20194 | uu | | ESTs, Weakly similar to CO9 MOUSE COMPLEMENT COMPONENT C9 [*M. musculus*], *Mus musculus*, Similar to complement component 8, alpha polypeptide, clone MGC:29381 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4366 | 229 | U20194 | General | | IMAGE:5052412, mRNA, complete cds, RIKEN cDNA 4930439B20 gene, complement component 8, beta polypeptide ESTs, Weakly similar to CO9 MOUSE COMPLEMENT COMPONENT C9 [*M. musculus*], *Mus musculus*, Similar to complement component 8, alpha polypeptide, clone MGC:29381 IMAGE:5052412, mRNA, complete cds, RIKEN cDNA 4930439B20 gene, complement component 8, beta polypeptide |
| 1864 | 13892 | AI102438 | gg, hh | | ESTs, Weakly similar to cornichon [*H. sapiens*], *Homo sapiens* clone 24453 mRNA sequence, RIKEN cDNA D530030D03 gene, cornichon homolog (*Drosophila*), cornichon-like |
| 1922 | 20833 | AI104035 | mm | | ESTs, Weakly similar to COXG MOUSE CYTOCHROME C OXIDASE POLYPEPTIDE VIB [*M. musculus*], *Homo sapiens*, hypothetical gene L0C125965, clone MGC:33640 IMAGE:4827471, mRNA, complete cds |
| 4298 | 1562 | NM_145097 | j, o, x, uu | | ESTs, Weakly similar to CPI3__RAT CONTRAPSIN-LIKE PROTEASE INHIBITOR 3 PRECURSOR (CPI-23) (SERINE PROTEASE INHIBITOR 1) (SPI-1) [*R. norvegicus*], serine (or cysteine) proteinase inhibitor, clade A (alpha-1 antiproteinase, antitrypsin), member 4, serine (or cysteine) proteinase inhibitor, clade F (alpha-2 antiplasmin, pigment epithelium derived factor), member 1, serine protease inhibitor 2, serine protease inhibitor 2, related sequence 1 |
| 3505 | 20716 | NM_019623 | b, l, General, gg, hh, ll, uu | | ESTs, Weakly similar to CYP4B1 [*M. musculus*], RIKEN cDNA 1810054N16 gene, cytochrome P450, subfamily IVF, polypeptide 14 (leukotriene B4 omega hydroxylase), cytochrome P450, subfamily IVF, polypeptide 2, cytochrome P450, subfamily IVF, polypeptide 8, expressed sequence AW108534, expressed sequence AW111961 |
| 3241 | 1797 | NM_013105 | j, r, jj | | ESTs, Weakly similar to cytochrome P450 3AI3 [*M. musculus*], *Mus musculus* mRNA for cytochrome P450, CYP3A, complete cds, cytochrome P450, steroid inducible 3a11, cytochrome P450, subfamily IIIA (niphedipine oxidase), polypeptide 3 |
| 4261 | 21915 | NM_138910 | dd | | ESTs, Weakly similar to DAD1__HUMAN Defender against cell death 1 (DAD-1) [*R. norvegicus*], defender against cell death 1 |
| 4261 | 21916 | NM_138910 | ll | | ESTs, Weakly similar to DAD1__HUMAN Defender against cell death 1 (DAD-1) [*R. norvegicus*], defender against cell death 1 |
| 3679 | 25070 | NM_024392 | o, General | | ESTs, Weakly similar to DHB4 MOUSE ESTRADIOL 17 BETA-DEHYDROGENASE 4 [*M. musculus*], ESTs, Weakly similar to DHB4__HUMAN ESTRADIOL 17 BETA-DEHYDROGENASE 4 [*H. sapiens*], RIKEN cDNA 1110029G07 gene, RIKEN cDNA 1700010M22 gene, RIKEN cDNA 3110069K09 gene, hydroxysteroid (17-beta) dehydrogenase 4 |
| 3679 | 9929 | NM_024392 | p, w, ss | | ESTs, Weakly similar to DHB4 MOUSE ESTRADIOL 17 BETA-DEHYDROGENASE 4 [*M. musculus*], ESTs, Weakly similar to DHB4__HUMAN ESTRADIOL 17 BETA-DEHYDROGENASE 4 [*H. sapiens*], RIKEN cDNA 1110029G07 gene, RIKEN cDNA 1700010M22 gene, RIKEN cDNA 3110069K09 gene, hydroxysteroid (17-beta) dehydrogenase 4 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3679 | 9931 | NM_024392 | o, xx | | ESTs, Weakly similar to DHB4 MOUSE ESTRADIOL 17 BETA-DEHYDROGENASE 4 [*M. musculus*], ESTs, Weakly similar to DHB4_HUMAN ESTRADIOL 17 BETA-DEHYDROGENASE 4 [*H. sapiens*], RIKEN cDNA 1110029G07 gene, RIKEN cDNA 1700010M22 gene, RIKEN cDNA 3110069K09 gene, hydroxysteroid (17-beta) dehydrogenase 4 |
| 4024 | 857 | NM_053633 | tt | | ESTs, Weakly similar to EGR2 MOUSE EARLY GROWTH RESPONSE PROTEIN 2 [*M. musculus*], MYC-associated zinc finger protein (purine-binding transcription factor), early growth response 2, early growth response 2 (Krox-20 homolog, *Drosophila*) |
| 2505 | 6604 | AI229192 | xx | | ESTs, Weakly similar to FA7 MOUSE COAGULATION FACTOR VII PRECURSOR [*M. musculus*], coagulation factor IX, coagulation factor X, proline-rich Gla (G-carboxyglutamic acid) polypeptide 1, protein Z, vitamin K-dependent plasma glycoprotein |
| 460 | 16013 | AA866482 | r, x | | ESTs, Weakly similar to FGD1 MOUSE PUTATIVE RHO/RAC GUANINE NUCLEOTIDE EXCHANGE FACTOR [*M. musculus*], *Mus musculus* actin-binding protein frabin-alpha mRNA, complete cds, RIKEN cDNA 5830461L01 gene, faciogenital dysplasia (Aarskog-Scott syndrome), faciogential dysplasia homolog |
| 486 | 20701 | AA875097 | b, m, General | | ESTs, Weakly similar to FIBA_RAT Fibrinogen alpha/alpha-E chain precursor [*R. norvegicus*], *Homo sapiens* clone HQ0582, expressed sequence AI303526, fibrinogen, A alpha polypeptide, fibrinogen, alpha polypeptide, fibrinogen, gamma polypeptide |
| 4135 | 23550 | NM_080698 | f | | ESTs, Weakly similar to FMOD_HUMAN FIBROMODULIN PRECURSOR [*H. sapiens*], fibromodulin, fibronectin leucine rich transmembrane protein 1, fibronectin leucine rich transmembrane protein 2, fibronectin leucine rich transmembrane protein 3, hypothetical protein FLJ23447 |
| 1375 | 15624 | AI010449 | qq | | ESTs, Weakly similar to FRP MOUSE FOLLISTATIN-RELATED PROTEIN PRECURSOR [*M. musculus*], follistatin-like, follistatin-like 1 |
| 2325 | 14083 | AI177181 | n | | ESTs, Weakly similar to FYV1 MOUSE FYVE FINGER-CONTAINING PHOSPHOINOSITIDE KINASE [*M. musculus*], MAD, mothers against decapentaplegic homolog (*Drosophila*) interacting protein, receptor activation anchor, RIKEN cDNA 1110013H04 gene, myotubularin related protein 3, phosphatidylinositol-4-phosphate 5-kinase, type III |
| 1429 | 20817 | AI012589 | c | | ESTs, Weakly similar to GTP_RAT Glutathione S-transferase P (GST 7-7) (Chain 7) (GST class-pi) [*R. norvegicus*], *Mus musculus*, clone MGC:37914 IMAGE:5102505, mRNA, complete cds, glutathione S-transferase pi, glutathione S-transferase pi 2 |
| 1944 | 12342 | AI104658 | oo | | ESTs, Weakly similar to I48724 zinc finger protein PZF - mouse [*M. musculus*], Growth factor independent-1 expressed sequence AA415813, expressed sequence AI839920, expressed sequence AL024263, growth factor independent 1, growth factor independent 1B, growth factor independent 1B (potential regulator of CDKN1A, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | translocated in CML), zinc finger protein 91, zinc finger protein 91 homolog (mouse) |
| 4202 | 25200 | NM_133610 | cc | | ESTs, Weakly similar to I48912 potassium channel subunit - mouse [*M. musculus*], potassium channel protein erg3, potassium voltage-gated channel, subfamily H (eag-related), member 1 |
| 4147 | 11421 | NM_130405 | w, tt | | ESTs, Weakly similar to I49140 p62 ras-GAP associated phosphoprotein - mouse [*M. musculus*], *Homo sapiens* Sam68-like mammalian protein 1 (SLM1) mRNA, complete cds, KH domain containing, RNA binding, signal transduction associated 1, homolog of mouse quaking QKI (KH domain RNA binding protein) quaking |
| 1213 | 3746 | AA998268 | b, bb | | ESTs, Weakly similar to I53171 pantophysin [*H. sapiens*], RIKEN cDNA 1500003F20 gene, Synaptophysin, mitsugumin 29, pantophysin, synaptophysin, synaptophysin-like protein |
| 2204 | 6630 | AI172184 | b | | ESTs, Weakly similar to I53171 pantophysin [*H. sapiens*], RIKEN cDNA 1500003F20 gene, Synaptophysin, mitsugumin 29, pantophysin, synaptophysin, synaptophysin-like protein |
| 2730 | 7604 | AI236039 | ll | | ESTs, Weakly similar to I56519 taipoxin-associated calcium binding protein-49 precursor - rat [*R. norvegicus*], *Homo sapiens* cDNA FLJ14474 fis, clone MAMMA1001256, calumenin, reticulocalbin 1, EF-hand calcium binding domain, reticulocalbin 2, reticulocalbin 2, EF-hand calcium binding domain |
| 2872 | 7602 | AJ001929 | b, q, v, ii, ll, xx | | ESTs, Weakly similar to I56519 taipoxin associated calcium binding protein-49 precursor - rat [*R. norvegicus*], *Homo sapiens* cDNA FLJ14474 fis, clone MAMMA1001256, calumenin, reticulocalbin 1, EF-hand calcium binding domain, reticulocalbin 2, reticulocalbin 2, EF-hand calcium binding domain |
| 1505 | 2699 | AI029306 | ii | | ESTs, Weakly similar to I58376 hypothetical protein unp - mouse [*M. musculus*], *Homo sapiens* cDNA FLJ30626 fis, clone CTONG2001911, weakly similar to UBIQUITIN CARBOXYL-TERMINAL HYDROLASE 4 (EC 3.1.2.15), kIAA1203 protein, *Mus musculus*, clone IMAGE:3711168, mRNA, partial cds, RIKEN cDNA 4930550B20 gene |
| 1244 | 11745 | AB006450 | gg, hh | | ESTs, Weakly similar to IM7A_RAT Mitochondrial import inner membrane translocase subunit TIM17 A [*R. norvegicus*], translocase of inner mitochondrial membrane 17 homolog A (yeast), translocase of inner mitochondrial membrane 17 homolog B (yeast), translocator of inner mitochondrial membrane 17 kDa, a |
| 1292 | 11251 | AI007666 | ii | | ESTs, Weakly similar to JC4647 KW8 protein - rat [*R. norvegicus*], ESTs, Weakly similar to JC4688 neuro D-related factor - mouse [*M. musculus*], basic helix-loop-helix domain containing, class B, 4, hypothetical protein FLJ14708, neurogenic differentiation 2, neurogenic differentiation 4, oligodendrocyte lineage transcription factor 2 |
| 3860 | 16664 | NM_031695 | v | | ESTs, Weakly similar to JC5251 beta-galactoside alpha-2,3-sialyltransferase [*H. sapiens*], sialyltransferase, sialyltransferase 4A (beta-galactosidase alpha-2,3-sialyltransferase), sialyltransferase 4B (beta-galactosidase alpha-2,3-sialyltransferase), sialyltransferase 5, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | sialyltransferase 7 ((alpha-N-acetylneuraminyl 2,3-beta-galactosyl-1,3)-N-acetyl galactosaminde alpha-2,6-sialyltransferase) A, sialyltransferase 7 ((alpha-N-acetylneuraminyl 2,3-beta-galactosyl-1,3)-N-acetyl galactosaminde alpha-2,6-sialyltransferase) B, sialyltransferase 7D ((alpha-N-acetylneuraminyl-2,3-beta-galactosyl-1,3)-N-acetyl galactosaminide alpha-2,6-sialytransferase) |
| 1208 | 12628 | AA998123 | General | | ESTs, Weakly similar to JC5707 HYA22 protein [H. sapiens], hypothetical protein BC010736 |
| 3361 | 18050 | NM_017204 | nn | | ESTs, Weakly similar to JC5963 stable tubule only polypeptide - mouse [M. musculus], KIAA1878 protein, RIKEN cDNA 1700041N15 gene, hypothetical protein FLJ1 2748, microtubule-associated protein 6, proteoglycan 4, (megakaryocyte stimulating factor, articular superficial zone protein, camptodactyly, arthropathy, coxa vara pericarditis syndrome) |
| 1112 | 5952 | AA963102 | r | | ESTs, Weakly similar to JC7328 amino acid transporter A1 [H. sapiens], Homo sapiens clone 24674 mRNA sequence, solute carrier family 38, member 1, solute carrier family 38, member 2 |
| 2162 | 5953 | AI171231 | r, y, z, tt | | ESTs, Weakly similar to JC7328 amino acid transporter A1 [H. sapiens], Homo sapiens clone 24674 mRNA sequence, solute carrier family 38, member 1, solute carrier family 38, member 2 |
| 1276 | 15801 | AF061443 | p | | ESTs, Weakly similar to JG0193 G protein-coupled receptor FEX - mouse [M. musculus], G protein-coupled receptor 106, G protein-coupled receptor 49, Mus musculus, clone IMAGE:3982506, mRNA, partial cds, RIKEN cDNA 4921529O18 gene, RIKEN cDNAA330106J01 gene, follicle stimulation hormone receptor |
| 1110 | 23541 | M957999 | f, l, nn | | ESTs, Weakly similar to MCAT_HUMAN MITOCHONDRIAL CARNITINE/ACYLCARNITINE CARRIER PROTEIN [H. sapiens], ESTs, Weakly similar to PM34_MOUSE PEROXISOMAL MEMBRANE PROTEIN PMP34 (34 KDA PEROXISOMAL MEMBRANE PROTEIN) (SOLUTE CARRIER FAMILY 25, MEMBER 17) [M. musculus], ESTs, Weakly similar to TXTP_HUMAN TRICARBOXYLATE TRANSPORT PROTEIN PRECURSOR [H. sapiens], Homo sapiens, similar to solute carrier family 25 (carnitine/acylcarnitine translocase), member 20, clone MGC:35539 IMAGE:5200129, mRNA, complete cds, Mus musculus, Similar to hypothetical protein FLJ20551, clone MGC:18873 IMAGE:4235245, mRNA, complete cds, RIKEN cDNA 1300019P08 gene, expressed sequence AI194714, expressed sequence AW108044, ornithine transporter 2, solute carrier family 25 (carnitine/acylcarnitine translocase), member 20, solute carrier family 25 (mitochondrial carrier), member 18, solute carrier family 25 (mitochondrial carrier; citrate transporter) member 1, solute carrier family 25 (mitochondrial carrier; ornithine transporter) member 15, uncoupling protein 2, mitochondrial |
| 315 | 19042 | AA850378 | t | | ESTs, Weakly similar to methyl-CpG binding protein MBD2 [H. sapiens], methyl-CpG binding domain protein 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3882 | 16003 | NM_031757 | j | | ESTs, Weakly similar to MM24_MOUSE MATRIX METALLCPROTEINASE-24 PRECURSOR (MMP-24) (MEMBRANE-TYPE MATRIX METALLOPROTEINASE 5) (MT-MMP 5) (MEMBRANE-TYPE-5 MATRIX METALLOPROTEINASE) (MT5-MMP) (MMP-21) [*M. musculus*], matrix metalloproteinase 17, matrix metalloproteinase 19, matrix metalloproteinase 24, matrix metalloproteinase 24 (membrane-inserted) |
| 1729 | 17871 | AI070601 | ii | | ESTs, Weakly similar to MYOC_MOUSE MYOCILIN PRECURSOR (TRABECULAR MESHWORK-INDUCED GLUCOCORTICOID RESPONSE PROTEIN) [*M. musculus*], HNOEL-iso protein. myocilin. olfactomedin 3 |
| 1422 | 3417 | AI012337 | h,w | | ESTs, Weakly similar to NHPX_RAT NHP2-like protein 1 (High mobility group-like nuclear protein 2 homolog 1) ([U4/U6.U5] tri-snRNP 15.5 kDa protein) (OTK27) [*R. norvegicus*], NHP2 non-histone chromosome protein 2-like 1 (*S. cerevisaie*), RIKEN cDNA 2410130M07 gene, nucleolar protein family A, member 2 (H/ACA small nucleolar RNPs), sperm specific antigen 1 |
| 3513 | 20635 | NM_020099 | ee | | ESTs, Weakly similar to OBRG_RAT Leptin receptor gene-related protein (OB-R gene related protein) (OB-RGRP) [*R. norvegicus*], RIKEN cDNA 1520402O14 gene, leptin receptor gene-related protein, leptin receptor overlapping transcript-like 1 |
| 1266 | 4292 | AF034896 | e,h | | ESTs, Weakly similar to OL15 MOUSE OLFACTORY RECEPTOR 15 [*M. musculus*], *Homo sapiens* cDNA FLJ32992 fis, clone THYMU1000098, *Homo sapiens* olfactory-like receptor mRNA, complete cds, RIKEN cDNA 4933431I19 gene, RIKEN cDNA 4933433E02 gene, oifactory receptor 15 |
| 4030 | 1318 | NM_053656 | g | | ESTs, Weakly similar to P2X6 MOUSE P2X PURINOCEPTOR 6 [*M. musculus*], purinergic receptor P2X, ligand-gated ion channel, 2, purinergic receptor P2X, ligand-gated ion channel, 5 |
| 4078 | 16147 | NM_053892 | y | | ESTs, Weakly similar to PA26_RAT 85 kDa calcium-independent phospholipase A2 (iPLA2) (Cal-PLA2) (Group VI phospholipase A2) (GVI PLA2) [*R. norvegicus*], *Homo sapiens* cDNA FLJ10428 fis, clone NT2RP1000376, highly similar to *Homo sapiens* mRNA; cDNA DKFZp434A102, RIKEN cDNA 2310026G15 gene, ankyrin repeat and SOCS box-containing 13, ankyrin repeat and SOCS box-containing protein 1, chromosome 20 open reading frame 86, phospholipase A2, group VI, phospholipase A2, group VI (cytosolic, calcium-independent) |
| 2858 | 26012 | AI639478 | pp | | ESTs, Weakly similar to PDI_RAT Protein disulfide isomerase precursor (PDI) (Prolyl 4-hydroxylase beta subunit) (Cellular thyroid hormone binding protein) (Thyroxine deiodinase) (Iodothyronine 5'-monodeiodinase) (5'-MD) [*R. norvegicus*], *Homo sapiens* cDNA FLJ32115 fis, clone PANCR1000021, weakly similar to PROTEIN DISULFIDE ISOMERASE PRECURSOR (PDI) (EC 5.3.4.1), Human DNA sequence from cDNA 16pHQG;19 from chromosome 16p13.3, RIKEN cDNA 1700007B13 gene, RIKEN cDNA 1810033M07 gene, RIKEN cDNA 1810041F13 gene, RIKEN cDNA |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | 1810047B09 gene, procollagen-proline, 2-oxoglutarate 4-dioxygenase (proline 4-hydroxylase), beta polypeptide (protein disulfade isomerase; thyroid hormone binding protein p55), prolyl 4-hydroxylase, beta polypeptide, protein disulfide |
| 3995 | 15829 | NM_053551 | y, nn, xx | | ESTs, Weakly similar to PDK4_MOUSE [PYRUVATE DEHYDROGENASE [LIPOAMIDE]] KINASE ISOZYME 4, MITOCHONDRIAL PRECURSOR (PYRUVATE DEHYDROGENASE KINASE ISOFORM 4) [*M. musculus*], pyruvate dehydrogenase kinase 4, pyruvate dehydrogenase kinase, isoenzyme 4 |
| 4229 | 61 | NM_138510 | u | | ESTs, Weakly similar to PE2R_RAT 20-alpha-hydroxysteroid dehydrogenase (20-alpha-HSD) (HSD1) [*R. norvegicus*], *Mus musculus*, Similar to hydroxysteroid (17-beta) dehydrogenase 5, clone MGC:37825 IMAGE: 5098938, mRNA, complete cds, aldo-keto reductase family 1, member C1 (dihydrodiol dehydrogenase 1; 20-alpha (3-alpha)-hydroxysteroid dehydrogenase), aldo-keto reductase family 1, member C2 (dihydrodiol dehydrogenase 2; bile acid binding protein; 3-alpha hydroxysteroid dehydrogenase, type III), aldo-keto reductase family 1, member C3 (3-alpha hydroxysteroid dehydrogenase, type II), expressed sequence AW146047, expressed sequence AW557061, hydroxysteroid (17-beta) dehydrogenase 5 |
| 2072 | 1358 | AI146154 | mm | | ESTs, Weakly similar to PK3G_RAT Phosphatidylinositol 3-kinase C2 domain-containing gamma polypeptide (Phosphoinositide 3-Kinase-C2-gamma) (PtdIns-3-kinase C2 gamma) (PI3K-C2gamma) [*R. norvegicus*], *Homo sapiens* cDNA FLJ12591 fis, clone NT2RM4001313, moderately similar to PHOSPHATIDYLINOSITOL 3-KINASE VPS34-LIKE (EC 2.7.1.137), phosphatidylinositol 3-kinase, C2 domain containing, gamma polypeptide, phosphatidylinositol 3-kinase, catalytic, alpha polypeptide, phosphatidylinositol 4-kinase, catalytic, beta polypeptide, phosphoinositide-3-kinase, class 2, gamma polypeptide |
| 2899 | 1356 | 083538 | y | | ESTs, Weakly similar to PK3G_RAT Phosphatidylinositol 3-kinase C2 domain-containing gamma polypeptide (Phosphoinositide 3-Kinase-C2-gamma) (PtdIns-3-kinase C2 gamma) (PI3K-C2gamma) [*R. norvegicus*], *Homo sapiens* cDNA FLJ12591 fis, clone NT2RM4001313, moderately similar to PHOSPHATIDYLINOSITOL 3-KINASE VP534-LIKE (EC 2.7.1.137), phosphatidylinositol 3-kinase, C2 domain containing, gamma polypeptide, phosphatidylinositol 3-kinase, catalytic, alpha polypeptide, phosphatidylinositol 4-kinase, catalytic, beta polypeptide, phosphoinositide-3-kinase, class 2, gamma polypeptide |
| 4375 | 1357 | U39572 | mm | | ESTs, Weakly similar to PK3G_RAT Phosphatidylinositol 3-kinase C2 domain-containing gamma polypeptide (Phosphoinositide 3-Kinase-C2-gamma) (PtdIns-3-kinase C2 gamma) (PI3K-C2gamma) [*R. norvegicus*], *Homo sapiens* cDNA FLJ12591 fis, clone NT2RM4001313, moderately similar to |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | PHOSPHATIDYLINOSITOL 3-KINASE VPS34-LIKE (EC 2.7.1.137), phosphatidylinositol 3-kinase, C2 domain containing, gamma polypeptide, phosphatidylinositol 3-kinase, catalytic, alpha polypeptide, phosphatidylinositol 4-kinase, catalytic, beta polypeptide, phosphoinositide-3-kinase, class 2, gamma polypeptide |
| 4316 | 12700 | NM_152936 | w | | ESTs, Weakly similar to PSG1 MOUSE PROSTATIC SECRETORY GLYCOPROTEIN PRECURSOR [*M. musculus*], RIKEN cDNA 2310065D10 gene, serine protease inhibitor, Kazal type 1. serine orotease inhibitor. Kazal type 3 |
| 3773 | 238 | NM_031152 | ee | | ESTs, Weakly similar to R11A_HUMAN Ras related protein Rab-11A (RAB-11) (24KG) (YL8) [*R. norvegicus*], RAB11A, member RAS oncogene family, RAB11a, member RAS oncogene family, RAB25, member RAS oncogene family, expressed sequence AW496496 |
| 3773 | 240 | NM_031152 | x | | ESTs, Weakly similar to R11A_HUMAN Ras related protein Rab-11A (RAB-11) (24KG) (YL8) [*R. norvegicus*], RAB11A, member RAS oncogene family, RAB11a, member RAS oncogene family, RAB25, member RAS oncogene family, expressed sequence AW496496 |
| 3752 | 20807 | NM_031106 | h | | ESTs, Weakly similar to R6RT37 ribosomal protein L37, cytosolic [validated] - rat [*R. norvegicus*], RIKEN cDNA 1500002F19 gene, RIKEN cDNA 3110005M08 gene, ribosomal Protein L37 |
| 3034 | 1379 | M83676 | qq, vv | | ESTs, Weakly similar to RAB8_HUMAN RAS-RELATED PROTEIN RAB-8 [*H. sapiens*], RAB10, member RAS oncogene family, RAB12, member RAS oncogene family, RAB38, member RAS oncogene family, expressed sequence AW107754 |
| 1885 | 15026 | AI103094 | General | | ESTs, Weakly similar to RB1A_RAT Ras-related protein Rab-1A [*R. norvegicus*], *Homo sapiens,* Similar to RAB, member of RAS oncogene family-like 2B, clone MGC:10130 IMAGE:3902486, mRNA, complete cds, RAB1, member RAS oncogene family, RAB19, member RAS oncogene family, RAB1A, member RAS oncogene family, RAB33A, member RAS oncogene family, RAB33B, member of RAS oncogene family, RAB35, member RAS oncogene family, RIKEN cDNA 1110011F09 gene, RIKEN cDNA 2500004H21 gene, RIKEN cDNA 2600013G09 gene, RIKEN cDNA 5033421K01 gene, RIKEN cDNA 9530019H02 gene |
| 3742 | 17173 | NM_031090 | u, cc | | ESTs, Weakly similar to RB1A_RAT Ras-related protein Rab-1A [*R. norvegicus*], *Homo sapiens,* Similar to RAB, member of RAS oncogene family-like 2B, clone MGC:10130 IMAGE:3902486, mRNA, complete cds, RAB1, member RAS oncogene family, RAB1g, member RAS oncogene family, RAB1A, member RAS oncogene family, RAB33A, member RAS oncogene family, RAB33B, member of RAS oncogene family, RAB35, member RAS oncogene family, RIKEN cDNA 1110011F09 gene, RIKEN cDNA 2500004H21 gene, RIKEN cDNA 2600013G09 gene, RIKEN cDNA 5033421K01 gene, RIKEN cDNA 9530019H02 gene |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 347 | 11221 | AA851352 | ll | | ESTs, Weakly similar to RIR1_HUMAN RIBONUCLEOSIDE-DIPHOSPHATE REDUCTASE M1 CHAIN [*H. sapiens*] |
| 1087 | 23800 | AA956534 | j | | ESTs, Weakly similar to RNG1_HUMAN RING1 PROTEIN [*H. sapiens*] |
| 3683 | 23386 | NM_024404 | gg, hh | | ESTs, Weakly similar to ROD_RAT Heterogeneous nuclear ribonucleoprotein D0 (hnRNP D0) (AU-rich element RNA-binding protein 1) [*R. norvegicus*], *Mus musculus*, clone MGC:36467 IMAGE:5359082, mRNA, complete cds, RIKEN cDNA 4933434H11 gene, heterogeneous nuclear ribonucleoprotein D, heterogeneous nuclear ribonucleoprotein D (AU-rich element RNA binding protein 1, 37 kD), heterogeneous nuclear ribonucleoprotein D-like, high-glycine/tyrosine protein type I E5, musashi homolog 2 (*Drosophila*) |
| 3683 | 25682 | NM_024404 | c, w | | ESTs, Weakly similar to ROD_RAT Heterogeneous nuclear ribonucleoprotein D0 (hnRNP D0) (AU-rich element RNA-binding protein 1) [*R. norvegicus*], *Mus musculus*, clone MGC:36467 IMAGE:5359082, mRNA, complete cds, RIKEN cDNA 4933434H11 gene, heterogeneous nuclear ribonucleoprotein D, heterogeneous nuclear ribonucleoprotein D (AU-rich element RNA binding protein 1, 37 kD), heterogeneous nuclear ribonucleoprotein D-like, high-glycine/tyrosine protein type I E5, musashi homolog 2 (*Drosophila*) |
| 4197 | 1308 | NM_133591 | e | | ESTs, Weakly similar to RP3A_RAT Rabphilin-3A [*R. norvegicus*], *Mus musculus*, clone IMAGE:3963643, mRNA, partial cds, RIKEN cDNA 6530413F01 gene, cDNA sequence AJ430384, membrane bound C2 domain containing protein, rabphilin 3A, rabphilin 3A-like (without C2 domains) |
| 3916 | 1475 | NM_031971 | ee | | ESTs, Weakly similar to S10A_MOUSE S-100 PROTEIN, ALPHA CHAIN [*M. musculus*], S100 calcium binding protein A1, S100 calcium binding protein A11 (calizzarin), S100 calcium binding protein P, S100Z protein, expressed sequence AI266795 |
| 632 | 11992 | AA892485 | kk | | ESTs, Weakly similar to S21766 dihydrolipoamide S-acetyltransferase (EC 2.3.1.12) - rat (fragment) [*R. norvegicus*], *Mus musculus*, clone IMAGE:3586777, mRNA, partial cds, Pyruvate dehydrogenase complex, lipoyl-containing component X; E3-binding protein, RIKEN cDNA 1600017E01 gene, RIKEN cDNA 4930529O08 gene, dihydrolipoamide branched chain transacylase (E2 component of branched chain keto acid dehydrogenase complex; maple syrup urine disease), dihydrolipoamide branched chain transacylase E2, pyruvate dehydrogenase complex component X |
| 2877 | 5048 | D00092 | oo | | ESTs, Weakly similar to S21766 dihydrolipoamide S-acetyltransferase (EC 2.3.1.12) - rat (fragment) [*R. norvegicus*], *Mus musculus*, clone IMAGE:3586777, mRNA, partial cds, Pyruvate dehydrogenase complex, lipoyl-containing component X; E3-binding protein, RIKEN cDNA 1600017E01 gene, RIKEN cDNA 4930529O08 gene, dihydrolipoamide branched chain transacylase (E2 component of branched chain keto acid dehydrogenase complex; maple syrup urine disease), |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | dihydrolipoamide branched chain transacylase E2, pyruvate dehydrogenase complex component X |
| 2881 | 5049 | D10655 | m | | ESTs, Weakly similar to S21766 dihydrolipoamide 5-acetyltransferase (EC 2.3.1.12) - rat (fragment) [*R. norvegicus*], *Mus musculus*, clone IMAGE:3586777, mRNA, partial cds, Pyruvate dehydrogenase complex, lipoyl-containing component X; E3-binding protein, RIKEN cDNA 1600017E01 gene, RIKEN cDNA 4930529O08 gene, dihydrolipoamide branched chain transacylase (E2 component of branched chain keto acid dehydrogenase complex; maple syrup urine disease), dihydrolipoamide branched chain transacylase E2, pyruvate dehydrogenase complex component X |
| 3994 | 12496 | NM_053541 | kk | | ESTs, Weakly similar to S25111 alpha-2-macroglobulin receptor precursor - mouse [*M. musculus*], expressed sequence AI848829, expressed sequence AL024237, low density lipoprotein receptor-related protein 3, low-density lipoprotein receptor-related protein 10 |
| 1288 | 2947 | AF099093 | f, kk | | ESTs, Weakly similar to S53358 ubiquitin-conjugating enzyme E2.17kB - rat [*R. norvegicus*], RIKEN cDNA 1100001F19 gene, RIKEN cDNA 1600028I17 gene, prefoldin 5, ubiquitin-conjugating enzyme E2D 3 (UBC4/5 homolog, yeast), ubiquitin-conjugating enzyme E2D 3 (homologous to yeast UBC4/5), ubiquitin-conjugating enzyme E2G 1 (UBC7 homolog, *C. elegans*) |
| 2317 | 3862 | AI177052 | nn, tt | | ESTs, Weakly similar to S57968 Ran-binding protein 2 - mouse [*M. musculus*], *Mus musculus*, clone IMAGE:4949762, mRNA, partial cds, RAN binding protein 2, nucleoporin 153 kD |
| 2338 | 6315 | AI177645 | bb | | ESTs, Weakly similar to S69890 mitogen inducible gene mig-2 [*H. sapiens*], *Homo sapiens* cDNA: FLJ21712 fis, clone COL10231, chromosome 20 open reading frame 42, lysosomal amino acid transporter 1, mitogen inducible 2 |
| 4268 | 737 | NM_139093 | e, tt | | ESTs, Weakly similar to SFR2_MOUSE Splicing factor, arginine/serine-rich 2 (Splicing factor SC35) (SC-35) (Splicing component, 35 kDa) (PR264 protein) [*M. musculus*], ESTs, Weakly similar to T12483 hypothetical protein DKFZp564B0769. 1 [*H. sapiens*], KIAA1542 protein, RIKEN cDNA 1500011J06 gene, RIKEN cDNA 2610510E10 gene, expressed sequence AA673488, splicing factor, arginine/serine-rich 2, interacting protein |
| 2755 | 6207 | AI236681 | gg, hh | | ESTs, Weakly similar to SUIS_RAT Sucrase isomaltase, intestinal [Contains: Sucrase Isomaltase] [*R. norvegicus*], *Homo sapiens* cDNA FLJ20638 fis, clone KAT02982, highly similar to SUIS_RABIT SUCRASE-ISOMALTASE, *Homo sapiens* mRNA for FLJ00088 protein, alpha glucosidase 2, alpha neutral subunit, glucosidase, alpha, acid, maltase-glucoamylase (alpha-glucosidase), sucrase-isomaltase |
| 2695 | 14745 | AI234919 | bb, mm | | ESTs, Weakly similar to SYHUQT multifunctional aminoacyl-tRNA ligase [*H. sapiens*] |
| 1550 | 5346 | AI043601 | gg, hh | | ESTs, Weakly similar to T08680 hypothetical protein DKFZp564P0622.1 [*H. sapiens*], F-box and leucine-rich repeat protein 2, F-box and leucine-rich repeat protein 4, hypothetical protein MGC15482 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2732 | 6976 | AI236072 | qq | | ESTs, Weakly similar to T08680 hypothetical protein DKFZp564P0622.1 [*H. sapiens*], F-box and leucine-rich repeat protein 2, F-box and leucine-rich repeat protein 4, hypothetical protein MGC15482 |
| 53 | 18226 | AA799641 | u, rr, ss | | ESTs, Weakly similar to T46332 hypothetical protein DKFZp434H0413.1 [*H. sapiens*], *Homo sapiens*, clone MGC:9709 IMAGE:3850147, mRNA, complete cds, KIAA1253 protein, expressed sequence AW121759, expressed sequence C86123 |
| 1238 | 3710 | AA999064 | s,t | | ESTs, Weakly similar to T47142 hypothetical protein DKFZp761P0724.1 [*H. sapiens*], KIAA0601 protein, chromosome 20 open reading frame 16 |
| 1439 | 9386 | AI012785 | c | | ESTs, Weakly similar to T47142 hypothetical protein DKFZp761P0724.1 [*H. sapiens*], KIAA0601 protein, chromosome 20 open reading frame 16 |
| 1706 | 10304 | AI060149 | b | | ESTs, Weakly similar to T48687 hypothetical protein DKFZp761G1923.1 [*H. sapiens*], phosphatidylinositol 4-kinase type II, phosphatidylinositol 4-kinase type-II beta |
| 965 | 2175 | AA944528 | ii | | ESTs, Weakly similar to T9S2_MOUSE Transmembrane 9 superfamily protein member 2 precursor [*M. musculus*], KIAA0255 gene product, chromosome 20 open reading frame 111, expressed sequence AA986553, expressed sequence AU045326, transmembrane 9 superfamily member 2 |
| 3597 | 20803 | NM_022592 | d, q | | ESTs, Weakly similar to TKT_HUMAN TRANSKETOLASE [*H. sapiens*], RIKEN cDNA 4933401I19 gene, hypothetical protein DKFZp434L1717, transketolase, transketolase (Wernicke-Korsakoff syndrome), transketolase-like 1 |
| 2618 | 14547 | AI232431 | z, ww | | ESTs, Weakly similar to TLP1_MOUSE TATA BOX BINDING PROTEIN-LIKE PROTEIN 1 (TBP-LIKE PROTEIN 1) (21-KDA TBP-LIKE PROTEIN) [*M. musculus*], TATA box binding protein-like protein, TBP-like 1 |
| 1771 | 16376 | AI071866 | a, u | | ESTs, Weakly similar to TRFL MOUSE LACTOTRANSFERRIN PRECURSOR [*M. musculus*], Transferrin, transferrin |
| 4106 | 17431 | NM_054006 | rr | | ESTs, Weakly similar to UNR PROTEIN [*R. norvegicus*], *Mus musculus*, clone MGC:19174 IMAGE:4224466, mRNA, complete cds. NRAS-related gene |
| 3997 | 11843 | NM_053555 | General | | ESTs, Weakly similar to VAM5_HUMAN VESICLE-ASSOCIATED MEMBRANE PROTEIN 5 (VAMP-5) (MYOBREVIN) (HSPC191) [*H. sapiens*], vesicle-associated membrane protein 5, vesicle-associated membrane protein 5 (myobrevin) |
| 3997 | 11844 | NM_053555 | v | | ESTs, Weakly similar to VAM5_HUMAN VESICLE-ASSOCIATED MEMBRANE PROTEIN 5 (VAMP-5) (MYOBREVIN) (HSPC191) [*H. sapiens*], vesicle-associated membrane protein 5, vesicle-associated membrane protein 5 (myobrevin) |
| 3484 | 51 | NM_019335 | u | | ESTs, Weakly similar to WEE1 MOUSE WEE1-LIKE PROTEIN KINASE [*M. musculus*], NIMA (never in mitosis gene a)-related expressed kinase 4, eukaryotic translation initiation factor 2 alpha kinase 2, protein kinase, interferon-inducible double stranded RNA dependent |
| 3484 | 52 | NM_019335 | u | | ESTs, Weakly similar to WEE1 MOUSE WEE1-LIKE PROTEIN KINASE [*M. musculus*], NIMA (never in mitosis gene |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | a)-related expressed kinase 4, eukaryotic translation initiation factor 2 alpha kinase 2, protein kinase, interferon-inducible double stranded RNA dependent |
| 1034 | 21410 | M946408 | c | | eukaryotic translation elongation factor 1 epsilon 1 |
| 3488 | 4592 | NM_019356 | h | | eukaryotic translation initiation factor 2, subunit 1 (alpha, 35 kD), eukaryotic translation initiation factor 2A |
| 2283 | 2993 | AI176492 | j, ll | | eukaryotic translation initiation factor 3; subunit 2 (beta, 36 kD) |
| 2404 | 21631 | AI179125 | s | | eukaryotic translation initiation factor 3, subunit 3 (gamma, 40 kD) |
| 357 | 19269 | M851785 | General | | eukaryotic translation initiation factor 3, subunit 8 (110 kD) |
| 3976 | 6186 | NM_053430 | ii | | excision repair cross-complementing rodent repair deficiency, complementation group 5 (xeroderma pigmentosum, complementation group G (Cockayne syndrome)), excision repair cross-complementing rodent repair deficiency, complementation group 5, exonuclease 1, flap structure specific endonuclease 1, flap structure-specific endonuclease 1 |
| 1273 | 17597 | AF051943 | oo | | expressed in non-metastatic cells 6, protein (nucleoside diphosphate kinase), non-metastatic cells 5, protein expressed in (nucleoside-diphosphate kinase), nucleoside diphosphate kinase type 6 (inhibitor of p53-induced apoptosis-alpha) |
| 1273 | 17598 | AF051943 | oo | | expressed in non-metastatic cells 6, protein (nucleoside diphosphate kinase), non-metastatic cells 5, protein expressed in (nucleoside-diphosphate kinase), nucleoside diphosphate kinase type 6 (inhibitor of p53-induced apoptosis-alpha) |
| 1590 | 18422 | AI044827 | e | | expressed sequence AI195023, nitrilase 1 |
| 3207 | 24718 | NM_013003 | tt | | expressed sequence AI255394, phosphatidylethanolamine N-methyltransferase |
| 1010 | 22639 | AA945746 | t | | expressed sequence AI314760, expressed sequence AL022777, suppressor of Ty 4 homolog (S. cerevisiae), suppressor of Ty 4 homolog 1 (S. cerevisiae), suppressor of Ty 4 homolog 2 (S. cerevisiae) |
| 2994 | 19256 | M15562 | xx | | expressed sequence AI323765, histocompatibility 2, class II antigen E alpha, major histocompatibility complex, class II, DR alpha |
| 2578 | 4703 | AI231606 | k, r | | expressed sequence AI413471, hypothetical protein FLJ11838 |
| 4083 | 15706 | NM_053921 | u | | expressed sequence AI451906, peroxisomal biogenesis factor 12 |
| 4100 | 16809 | NM_053990 | l, oo | | expressed sequence AI462446, protein tyrosine phosphatase, non-receptor type 2 |
| 1170 | 3054 | AA996899 | gg, hh | | expressed sequence AI504642, spermatogenesis associated 2 |
| 4211 | 14876 | NM_134361 | h | | expressed sequence AI661682, small inducible cytokine subfamily C, member 1 (lymphotactin), small inducible cytokine subfamily C, member 2 |
| 3229 | 19335 | NM_013067 | x, dd | | expressed sequence AU018702, ribophorin |
| 266 | 320 | AA819905 | ee | | expressed sequence AU022220, stearoyl-CoA desaturase (delta-9-desaturase), stearoyl-Coenzyme A desaturase 1, stearoyl coenzyme A desaturase 3 |
| 3911 | 1302 | NM_031841 | pp | | expressed sequence AU022220, stearoyl-CoA desaturase (delta-9-desaturase), stearoyl-Coenzyme A desaturase 1, stearoyl coenzyme A desaturase 3 |
| 4279 | 1301 | NM_139192 | n | | expressed sequence AU022220, stearoyl-CoA desaturase (delta-9-desaturase), stearoyl-Coenzyme A desaturase 1 stearoyl coenzyme A desaturase 3 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4027 | 21637 | NM_053653 | kk | | expressed sequence AW228853, vascular endothelial growth factor C |
| 4182 | 5686 | NM_133428 | dd | | expressed sequence AW413091, fetuin B, fetuin beta, histidine-rich glycoprotein |
| 575 | 16023 | AA891872 | w | | expressed sequence BB168308, nicotinamide nucleotide transhydrogenase |
| 4141 | 23477 | NM_080891 | w | | Fas death domain-associated protein, death associated protein 6 |
| 2462 | 22366 | AI227743 | tt | | FAST kinase, Fas-activated serine/threonine kinase, RIKEN cDNA 2310010B21 gene, cell cycle progression 2 protein |
| 2252 | 19004 | AI175875 | ii | | fatty acid binding protein 5 (psoriasis-associated), fatty acid binding protein 5, epidermal |
| 2276 | 19006 | AI176393 | f | | fatty acid binding protein 5 (psoriasis-associated), fatty acid binding protein 5, epidermal |
| 4308 | 20740 | NM_145878 | bb, pp | | fatty acid binding protein 5 (psoriasis-associated), fatty acid binding protein 5, epidermal |
| 3413 | 24247 | NM_017332 | n, rr | | fatty acid synthase, hypothetical protein FLJ20604 |
| 4088 | 15822 | NM_053957 | General | | FE65-like protein 2, *Mus musculus*, Similar to amyloid beta (A4) precursor protein-binding, family B, member 3, clone MGC:38710 IMAGE:5357681, mRNA, complete cds, RIKEN cDNA 2810468K05 gene, amyloid beta (A4) precursor protein-binding, family B, member 1, amyloid beta (A4) precursor protein-binding, family B, member 2 |
| 1565 | 7935 | AI043945 | General | | ferrochelatase, ferrochelatase (protoporphyria) |
| 4079 | 1337 | NM_053895 | p, tt | | FGF receptor activating protein 1, *Mus musculus*, Similar to FGF receptor activating protein 1, clone MGC:8108 IMAGE:3588752, mRNA, complete cds |
| 1191 | 3250 | AA997765 | n | | fibrillin 1, fibrillin 1 (Marfan syndrome), fibulin 2 |
| 71 | 11531 | AA799773 | d | | filamin A, alpha (actin binding protein 280) |
| 2762 | 17618 | AI236786 | p, rr | | FK506 binding protein 10 (65 kDa), FK506 binding protein 1A (12 kD), FK506 binding protein 1a (12 kDa), FK506 binding protein 2 (13 kDa), FK506 binding protein 2 (13 kD), FK506 binding protein 4 (59 kDa), FK506 binding protein 5 (51 kDa), FK506 binding protein 9 |
| 2876 | 20519 | 006598 | v, w | | FK506 binding protein 1A (12 kD), FK506 binding protein 1a (12 kDa), FK506 binding protein 2 (13 kDa), FK506 binding protein 2 (13 kD), FK506 binding protein 4 (59 kDa), FK506 binding protein 5 (51 kDa) |
| 2016 | 13090 | AI136977 | m,ll | | FK506 binding protein 4 (59 kD), RIKEN cDNA 4930571K23 gene |
| 2016 | 13091 | AI136977 | v | | FK506 binding protein 4 (59 kD), RIKEN cDNA 4930571K23 gene |
| 2575 | 13092 | AI231547 | oo | | FK506 binding protein 4 (59 kD), RIKEN cDNA 4930571K23 gene |
| 3776 | 1963 | NM_031236 | xx | | fucosyltransferase 1, fucosyltransferase 1 (galactoside 2-alpha-L-fucosyltransferase, Bombay phenotype included) |
| 3134 | 13731 | NM_012755 | bb | | FYN oncogene related to SRC, FGR, YES, Fyn proto-oncogene |
| 3883 | 1105 | NM_031758 | nn | | G protein-coupled receptor 24 |
| 3414 | 2000 | NM_017333 | g | | G protein-coupled receptor 37-like 1, endothelin receptor type B |
| 3277 | 18313 | NM_013220 | x | | GA binding protein transcription factor, beta subunit 1 (53 kD), GA binding protein transcription factor, beta subunit 2 (47 kD), *Homo sapiens* cDNA FLJ32449 fis, clone SKMUS2001662, moderately similar to *Oryctolagus cuniculus* CARP mRNA, RIKEN cDNA 1700012M14 gene, RIKEN cDNA |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | 4933432B13 gene, ankyrin repeat domain 2 (stretch responsive muscle), ankyrin repeat domain 5, cardiac ankyrin repeat protein, cardiac responsive adriamycin protein |
| 1076 | 24289 | AA955986 | t | | galactokinase, galactokinase 1 |
| 2438 | 23989 | AI179953 | ii, ss | | gap junction protein, beta 2, 26 kD (connexin 26) |
| 4423 | 23987 | X51615 | w, gg, hh | | gap junction protein, beta 2, 26 kD (connexin 26) |
| 2429 | 16656 | AI179634 | h | | GASZ, Gasz, *Mus musculus,* Similar to hypothetical protein DKFZp564O043, clone MGC:36949 IMAGE 4946879 mRNA, complete cds, *Mus musculus,* Similar to regulatory factor X associated ankyrin-containing protein, clone MGC:13787 IMAGE:4190691, mRNA, complete cds, RIKEN cDNA 4933400N19 gene, kinase D-interacting substance of 220 kDa, regulatory factor X-associated ankyrin-containing protein |
| 1336 | 15452 | AI009484 | s | | gelsolin, gelsolin (amyloidosis, Finnish type) |
| 2722 | 24373 | AI235748 | l, y, ee, rr | | gene predicted from cDNA with a complete coding sequence |
| 3725 | 1336 | NM_031042 | k | | general transcription factor IIE, polypeptide 2 (30 kD subunit) |
| 1806 | 9399 | AI072812 | a | | glioma-amplified sequence-41 |
| 3877 | 13543 | NM_031749 | q, oo | | glucosidase 1, glucosidase I |
| 3877 | 13544 | NM_031749 | c | | glucosidase 1, glucosidase I |
| 3877 | 13545 | NM_031749 | e | | glucosidase 1, glucosidase I |
| 3877 | 25209 | NM_031749 | v, w, bb, rr | | glucosidase 1, glucosidase I |
| 1508 | 7451 | AI029450 | l, z, General | | glutamyl-prolyl-tRNA synthetase |
| 2717 | 20140 | AI235566 | g | | glutamyl-prolyl-tRNA synthetase |
| 2689 | 16781 | AI234527 | ll, qq | | glutathione S-transferase A4, glutathione S-transferase, alpha 4 |
| 4449 | 16780 | X62660 | b, m, qq, vv | | glutathione S-transferase A4, glutathione S-transferase, alpha 4 |
| 3973 | 6773 | NM_053410 | rr | | glyceronephosphate O-acyltransferase |
| 4051 | 6004 | NM_053796 | rr | | glycoprotein A33 (transmembrane), junction cell adhesion molecule 2, junction cell adhesion molecule 3, junction cell adhesion molecule 1, junctional adhesion molecule 1, junctional adhesion molecule 3 |
| 4051 | 6005 | NM_053796 | a, q, s | | glycoprotein A33 (transmembrane), junction cell adhesion molecule 2, junction cell adhesion molecule 3, junction cell adhesion molecule1, junctional adhesion molecule 1, junctional adhesion molecule 3 |
| 1907 | 2297 | AI103602 | General | | GM2 ganglioside activator protein |
| 1995 | 2296 | AI112979 | q, x, General | | GM2 ganglioside activator protein |
| 2563 | 2299 | AI231094 | w | | GM2 ganglioside activator protein |
| 4210 | 606 | NM_134352 | f, kk, tt | | GPI-anchored metastasis-associated protein homolog, plasminogen activator, urokinase receptor, urokinase plasminogen activator receptor |
| 1055 | 23542 | AA955389 | pp | | GRB2-related adaptor protein, GRB2-related adaptor protein 2, NCK adaptor protein 1 SH3 domain protein 3, Sh3 domain YSC-like 1, growth factor receptor bound protein 2, growth factor receptor-bound protein 2, monocytic adaptor |
| 3692 | 18728 | NM_030846 | b, ww | | GRB2-related adaptor protein, GRB2-related adaptor protein 2, SH3 domain protein 3, Sh3 domain YSC-like 1, growth factor receptor bound protein 2, growth factor receptor-bound protein 2, monocytic adaptor |
| 3692 | 18023 | NM_030846 | k | | GRB2-related adaptor protein, GRB2-related adaptor protein 2, SH3 domain protein 3, Sh3 domain YSC-like 1, growth factor receptor bound protein 2, growth factor receptor-bound protein 2, monocytic adaptor |
| 4109 | 16043 | NM_057100 | jj | | growth arrest specific 6, growth arrest-specific 6 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3888 | 14184 | NM_031776 | j | | guanine deaminase |
| 3888 | 14185 | NM_031776 | i, r, y | | guanine deaminase |
| 3723 | 15886 | NM_031035 | k, nn | | guanine nucleotide binding protein (G protein), alpha inhibiting activity polypeptide 2, guanine nucleotide binding protein, alpha inhibiting 2, guanine nucleotide binding protein, alpha inhibiting 3 |
| 2453 | 7460 | AI180413 | r | | H factor (complement)-like 1, H factor (complement)-like 2, complement factor H related 3 |
| 4420 | 7459 | X15551 | a, j, n, r | | H factor (complement)-like 1, H factor (complement)-like 2, complement factor H related 3 |
| 4150 | 3579 | NM_130409 | uu | | H factor (complement)-like 3, H factor 1 (complement), Mus musculus, clone MGC:30368 IMAGE:5135798, mRNA, complete cds, coagulation factor XIII, beta subunit, complement component factor h, complement factor H-related 4, expressed sequence AI194696, seizure related gene 6 |
| 3676 | 2733 | NM_024385 | bb, jj | | H2.0-like homeo box gene, hematopoietically expressed homeobox, homeo box 11-like 1 |
| 2030 | 18943 | AI137495 | d, ll | | H2A histone family, member C, H2A histone family, member D, H2A histone family, member l, H2A histone family, member L, H2A histone family, member N, H2A histone family, member O, Homo sapiens, clone MGC:21597 IMAGE:4511035, mRNA, complete cds, Mus musculus, similar to H2A histone family, member O, clone MGC:36202 IMAGE:5055276, mRNA, complete cds, expressed sequence R75370 |
| 3537 | 18839 | NM_021840 | g | | H2A histone family, member M, RIKEN cDNA 170001 2L04 gene, RIKEN cDNA 1700113017 gene |
| 655 | 20065 | AA892647 | c | | H4 histone family, member D, H4 histone family, member H, H4 histone family, member l, H4 histone family, member J, H4 histone family, member K, Mus musculus, H4 histone family, member A, clone MGC:30488 IMAGE:4205460, mRNA, comnlete cds. histone 4 protein |
| 3614 | 20506 | NM_022686 | ii | | H4 histone family, member D, H4 histone family, member H, H4 histone family, member l, H4 histone family, member J, H4 histone family, member K, Mus musculus, H4 histone family, member A, clone MGC:30488 IMAGE:4205460, mRNA, comolete cds. histone 4 protein |
| 3669 | 8879 | NM_024360 | u | | hairy and enhancer of split 1, (Drosophila), hairy and enhancer of split 6, (Drosophila), hairy homolog (Drosophila), hairy/enhancer-of-split related with YRPW motif 2, hairy/enhancer-of-split related with YRPW motif-like |
| 3520 | 18544 | NM_021592 | e | | heart and neural crest derivatives expressed 1, heart and neural crest derivatives expressed transcript 1, mesoderm posterior 1, nescient helix loop helix 1 |
| 4221 | 14697 | NM_134419 | dd | | heat shock 27 kDa associated protein |
| 2197 | 9537 | AI172097 | y | | heat shock factor 1, heat shock transcription factor 1 |
| 1254 | 23417 | AB022209 | l, General, kk | | heterogeneous nuclear ribonucleoprotein F |
| 2711 | 15858 | AI235455 | rr | | hexosaminidase B, hexosaminidase B (beta polypeptide) |
| 4399 | 23282 | U90725 | q, ff, tt | | high density lipoprotein binding protein (vigilin) |
| 685 | 3381 | AA892993 | jj | | high mobility group 20 B, high-mobility group 20B |
| 2725 | 14768 | AI235912 | f | | highly charged protein |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 149 | 21379 | AA800738 | ll | | HIV-1 Tat interactive protein, 60 kD, histone acetyltransferase MYST1, member of MYST family histone acetyl transferases, homolog of *Drosophila* MOE |
| 301 | 14608 | AA849805 | l, ss | | HLA-B associated transcript 5 |
| 2557 | 8036 | AI230884 | c, tt | | HMBA-inducible |
| 1493 | 23530 | AI014148 | t, w | | *Homo sapiens* cDNA FLJ10183 fis, clone HEMBA1004276, highly similar to *Homo sapiens* AP-4 adaptor complex beta4 subunit mRNA, adaptor-related protein complex 2, beta 1 subunit, adaptor-related protein complex 4, beta 1 subunit, adaptor-related protein complex AP-4. beta 1 |
| 839 | 4944 | AA924405 | h | | *Homo sapiens* cDNA FLJ11845 fis, clone HEMBA1006674, *Mus musculus*, Similar to hypothetical protein FLJ10350, clone MGC:27585 IMAGE:4489521, mRNA, complete cds, *Mus musculus*, Similar to neurofilament, heavy polypeptide (200 kD), clone MGC:32399 IMAGE:5037953, mRNA, complete cds, nucleolar protein 5A (56 kD with KKF/D repreat |
| 2253 | 7647 | AI175991 | d | | *Homo sapiens* cDNA FLJ12241 fis, clone MAMMA1001274, *Homo sapiens,* clone IMAGE:3343171, mRNA, partial cds, *Homo sapiens,* clone IMAGE:3961549, mRNA, partial cds, MCM3 minichromosome maintenance deficient 3 (*S. cerevisiae*) associated protein, RIKEN cDNA 2410004C24 gene, expressed sequence AW049671, hypothetical protein FLJ10508, minichromosome maintenance deficient (*S. cerevisaie*) 3-associated protein |
| 2268 | 12999 | AI176276 | General | | *Homo sapiens* cDNA FLJ12570 fis, clone NT2RM4000895 |
| 3279 | 1567 | NM_013223 | p, s | | *Homo sapiens* cDNA FLJ14016 fis, clone HEMBA1000459, *Mus musculus* 0 day neonate head cDNA, RIKEN full-length enriched library, clone:4833426L05:eukaryotic translation initiation factor 2 alpha kinase 1, full insert sequence, eukaryotic translation initiation factor 2 alpha kinase 1 |
| 1398 | 3941 | AI011598 | xx | | *Homo sapiens* cDNA FLJ14042 fis, clone HEMBA1006038, weakly similar to LAMININ ALPHA-5 CHAIN, expressed sequence AA408762, expressed sequence AI853660, aminin. alpha 5 |
| 4249 | 17530 | NM_138877 | s | | *Homo sapiens* cDNA FLJ14413 fis, clone HEMEA1004670, RIKEN cDNA 1500005G05 gene, cytochrome b5 reductase 1 (B5R.1), cytochrome b5 reductase b5R.2, diaphorase (NADH) (cytochrome b-5 reductase), diaphorase 1 (NADH) |
| 4249 | 17532 | NM_138877 | l, z, General, nn | | *Homo sapiens* cDNA FLJ14413 fis, clone HEMBA1004670, RIKEN cDNA 1500005G05 gene, cytochrome b5 reductase 1 (BSR.1), cytochrome b5 reductase b5R.2, diaphorase (NADH) (cytochrome b-5 reductase), diaphorase 1 (NADH) |
| 4249 | 17533 | NM_138877 | General, gg, hh, ll | | *Homo sapiens* cDNA FLJ14413 fis, clone HEMBA1004670, RIKEN cDNA 1500005G05 gene, cytochrome b5 reductase 1 (BSR.1), cytochrome b5 reductase b5R.2, diaphorase (NADH) (cytochrome b-5 reductase), diaphorase 1 (NADH) |
| 4249 | 25039 | NM_138877 | General, ss | | *Homo sapiens* cDNA FLJ14413 fis, clone HEMBA1004670, RIKEN cDNA 1500005G05 gene, cytochrome b5 reductase 1 (B5R.1), cytochrome b5 reductase b5R.2, diaphorase (NADH) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 2813 | 18S04 | AI639044 | cc | | (cytochrome b-5 reductase), diaphorase 1 (NADH) *Homo sapiens* cDNA FLJ20201 fis, clone COLF1210, *Musmusculus*, Similar to oculospanin, clone MGC:28508 IMAGE:4189407, mRNA, complete cds, *Mus musculus*, clone MGC:36554 IMAGE:4954874, mRNA, complete cds, RIKEN cDNA 1300010A20 gene, RIKEN cDNA 2210021G21 gene, tetraspan 5, transmembrane 4 superfamily member 9 |
| 1462 | 72S8 | AIO13475 | h | | *Homo sapiens* cDNA FLJ20750 fis, clone HEP05174, RIKEN cDNA 6330404A12 gene, VPS10 domain receptor protein SORCS 2 sortilin 1 |
| 28 | 19675 | AA799475 | s, oo | | *Homo sapiens* cDNA FLJ25124 fis, clone CBR06414, *Homo sapiens* cDNA FLJ32645 fis, clone SYNOV2001251, retinoic acid induced 14, uveal autoantigen with coiled-coil domains and ankyrin repeats |
| 3941 | 4723 | NM_033235 | j, ll, qq | | *Homo sapiens* cDNA FLJ25341 fis, clone TST00973, malate dehydrogenase 1 NAD (soluble), malate dehydrogenase, soluble |
| 3941 | 4724 | NM_033235 | j | | *Homo sapiens* cDNA FLJ25341 fis, clone TST00973, malate dehydrogenase 1, NAD (soluble), malate dehydrogenase, soluble |
| 4009 | 20896 | NM_053592 | w, x, bb | | *Homo sapiens* cDNA FLJ25344 fis, clone TST01087, RIKEN cDNA 5031412I06 gene |
| 388 | 6440 | AA859130 | w, pp | | *Homo sapiens* cDNA FLJ30116 fis, clone BRACE1000042, weakly similar to PROTEIN PHOSPHATASE 2C ABI2 (EC 3.1.3.16), *Homo sapiens* cDNA FLJ30553 fis, clone BRAWH2003689, highly similar to *Mus musculus* clone mouse 1-9 putative protein phosphatase type 2C mRNA, *Homo sapiens* cDNA FLJ32332 fis, clone PROST20051 21, weakly similar to PROBABLE PROTEIN PHOSPHATASE 2C T23F11.1 (EC 3.1.3.16), KIAA0015 gene product, expressed sequence AI481720, protein phosphatase 1G (formerly 2C), magnesium-dependent, gamma isoform |
| 2928 | 4378 | H32966 | y | | *Homo sapiens* cDNA FLJ30124 fis, clone BRACE1000093, highly similar to TNF RECEPTOR ASSOCIATED FACTOR 2, Tnf receptor-associated factor 2 |
| 463 | 15182 | M874832 | ff | | *Homo sapiens* cDNA FLJ30217 fis, clone BRACE2001709, highly similar to *Homo sapiens* anaphase-promoting complex subunit 5 (APC5) mRNA, anaphase promoting complex subunit 5 |
| 1111 | 15183 | AA963036 | l | | *Homo sapiens* cDNA FLJ30217 fis, clone BRACE2001709, highly similar to *Homo sapiens* anaphase-promoting complex subunit 5 (APC5) mRNA, anaphase promoting complex subunit 5 |
| 1817 | 20834 | AI073056 | cc | | *Homo sapiens* cDNA FLJ30312 fis, clone BRACE2003512, *Mus musculus*, clone IMAGE:3375769, mRNA, partial cds, *Mus musculus*, clone MGC:28837 IMAGE:4506646, mRNA, complete cds, RIKEN cDNA 1200014P03 gene, RIKEN cDNA 1300001I01 gene, RIKEN cDNA 1300003O07 gene, RIKEN cDNA 3632410F03 gene, kinesin 2 (60-70 kD), kinesin light chain 2 |
| 3029 | 20836 | M75148 | l, General, qq | | *Homo sapiens* cDNA FLJ30312 fis, clone BRACE2003512, *Mus musculus*, clone IMAGE:3375769, mRNA, partial cds, *Mus musculus*, clone MGC:28837 IMAGE:4506646, mRNA, complete cds, RIKEN cDNA 1200014P03 gene, RIKEN cDNA 1300001I01 gene, RIKEN cDNA 1300003O07 gene, RIKEN cDNA |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | 3632410F03 gene, kinesin 2 (60-70 kD), kinesin light chain 2 |
| 2242 | 18562 | AI175515 | s | | *Homo sapiens* cDNA FLJ30615 fis, clone CTONG2001226, moderately similar to LYSOSOMAL PROTECTIVE PROTEIN PRECURSOR (EC 3.4.16.5), carboxypeptidase, vitellogenic-like, likely homolog of rat and mouse retinoid-inducible serine carboxypeptidase |
| 3634 | 15696 | NM_022939 | e | | *Homo sapiens* cDNA FLJ31164 fis, clone KIDNE1000104, weakly similar to SYNTAXIN 7, expressed sequence AU041521, syntaxin 12, syntaxin 16, syntaxin 7 |
| 505 | 15410 | AA875268 | r | | *Homo sapiens* cDNA FLJ31499 fis, clone NT2NE2005441, weakly similar to SPLICEOSOME ASSOCIATED PROTEIN 49 |
| 3228 | 675 | NM_013066 | g | | *Homo sapiens* cDNA FLJ31586 fis, clone NT2R12002211, microtubule-associated protein 2, transformation related protein 53 binding protein 1 |
| 4458 | 602 | X68101 | bb | | *Homo sapiens* cDNA FLJ32122 fis, clone PEBLM1000144, moderately similar to Trg, kIAA1058 protein, erythroid differentiation regulator, expressed sequence AA959601, expressed sequence R75174 |
| 4280 | 22595 | NM_139253 | d | | *Homo sapiens* cDNA FLJ32237 fis, clone PLACE6004966, Human transposon-like element mRNA |
| 3445 | 18362 | NM_019187 | n, ff | | *Homo sapiens* cDNA FLJ32393 fis, clone SKMUS2000074, highly similar to *Homo sapiens* methyltransferase COQ3 mRNA |
| 4391 | 3387 | U75411 | cc | | *Homo sapiens* cDNA FLJ32612 fis, clone STOMA2000088, highly similar to IG LAMBDA CHAIN C REGIONS, RIKEN cDNA 2010309G21 riene |
| 403 | 23340 | AA859519 | jj | | *Homo sapiens* cDNA FLJ32971 fis, clone TEST12008847 |
| 403 | 23341 | AA859519 | bb | | *Homo sapiens* cDNA FLJ32971 fis, clone TEST12008847 |
| 2159 | 14941 | AI171196 | pp | | *Homo sapiens* cDNA: FLJ21205 fis, clone COL00328, integral inner nuclear membrane protein |
| 2907 | 21864 | H31144 | pp | | *Homo sapiens* cDNA: FLJ21251 fis, clone COL01259, *Homo sapiens*, Similar to activated p21cdc42Hs kinase, clone MGC:15139 IMAGE:4302390, mRNA, complete cds |
| 2907 | 20456 | H31144 | ll, pp | | *Homo sapiens* cDNA. FLJ212S1 fis, clone COL01259, *Homo sapiens*, Similar to activated p21 cdc42Hs kinase, clone MGC:15139 IMAGE:4302390, mRNA, complete cds |
| 4012 | 11830 | NM_053598 | General | | *Homo sapiens* cDNA: FLJ22642 fis, clone H5106970, RIKEN cDNA 4933436C10 gene, nudix (nucleoside diphosphate linked moiety X)-type motif 3, nudix (nucleotide diphosphate linked moiety X)-type motif 3 |
| 4012 | 18795 | NM_053598 | bb | | *Homo sapiens* cDNA: FLJ22642 fis, clone H5106970, RIKEN cDNA 4933436C10 gene, nudix (nucleoside diphosphate linked moiety X)-type motif 3, nudix (nucleotide diphosphate linked moiety X)-type motif 3 |
| 4012 | 23192 | NM_053598 | a, pp | | *Homo sapiens* cDNA: FLJ22642 fis, clone H5106970, RIKEN cDNA 4933436C10 gene, nudix (nucleoside diphosphate linked moiety X)-type motif 3, nudix (nucleotide diphosphate linked moiety X)-type motif 3 |
| 792 | 21649 | M900351 | l, uu | | *Homo sapiens* cDNA: FLJ22696 fis, clone HSI11696, RIKEN cDNA 3930402F23 gene |
| 1494 | 15247 | AI014169 | o, ii, ll, pp, xx | | *Homo sapiens* cDNA: FLJ22783 fis, clone KAIA1993, *Homo sapiens* mRNA full length insert cDNA clone EUROIMAGE 703547, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | *Homo sapiens* mRNA; cDNA DKFZp434B102 (from clone DKFZp434B102), KIAA1376 protein |
| 2789 | 15248 | AI237654 | nn, xx | | *Homo sapiens* cDNA: FLJ22783 fis, clone KAIA1993, *Homo sapiens* mRNA full length insert cDNA clone EUROIMAGE 703547, *Homo sapiens* mRNA; cDNA DKFZp434B102 (from clone DKFZp434B102), KIAA1376 protein |
| 4231 | 15054 | NM_138515 | p | | *Homo sapiens* cDNA: FLJ22845 fis, clone KAIA5195, cytochrome P450, 2d22, cytochrome P450, subfamily IID (debrisoquine, sparteine, etc., -metabolizing), polypeptide 6 |
| 1245 | 16304 | AB008424 | e,j | | *Homo sapiens* cDNA: FLJ22845 fis, clone KAIA5195, *Mus musculus*, Similar to cytochrome P450, 2db, clone MGG:18824 IMAGE:4207630, mRNA, complete cds, cytochrome P450, subfamily IID (debrisoquine, sparteine, etc., -metabolizing), polypeptide 6 |
| 2349 | 1131 | AI177919 | nn, pp, ww | | *Homo sapiens* cDNA: FLJ22845 fis, clone KAIA5195, *Mus musculus*, Similar to cytochrome P450, 2db, clone MGC:18824 IMAGE:4207630, mRNA, complete cds, cytochrome P450, subfamily IID (debrisoquine, sparteine, etc., -metabolizing), polypeptide 6 |
| 4320 | 1130 | NM_153313 | a, cc | | *Homo sapiens* cDNA: FLJ22845 fis, clone KAIA5195, *Mus musculus*, Similar to cytochrome P450, 2db, clone MGC:18824 IMAGE:4207630, mRNA, complete cds, cytochrome P450, subfamily IID (debrisoquine, sparteine, etc., -metabolizing), polypeptide 6 |
| 3124 | 18730 | NM_012730 | a, j | | *Homo sapiens* cDNA: FLJ22845 fis, clone KAIA519S, RIKEN cDNA 1300006E06 gene, cytochrome P450, subfamily IID (debrisoquine, sparteine, etc., -metabolizing), polyypeptide 6 |
| 607 | 3427 | AA892246 | nn | | *Homo sapiens* clone IMAGE:1963178, mRNA sequence, Mst3 and SOK1 -related kinase, *Mus musculus*, Similar to serine/threonine kinase 24 (Ste20, yeast homolog), clone MGC:6330 IMAGE:3482980, mRNA, complete cds, RIKEN cDNA 2610018G03 gene, expressed sequence AI042849, mitogen-activated protein kinase kinase kinase kinase 5, serine/threonine kinase 25 (yeast) |
| 969 | 22471 | AA944617 | bb | | *Homo sapiens* mRNA for FLJ00235 protein, chromosome 21 open reading frame 2, hypothetical protein FLJ10565 |
| 3978 | 23811 | NM_053436 | ww | | *Homo sapiens* mRNA full length insert cDNA clone EUROIMAGE 117929, TAR (HIV) RNA binding protein 2, protein kinase, interferon inducible double stranded RNA dependent activator, protein kinase, interferon-inducible double stranded RNA dependent activator, staufen (RNA binding protein) homolog 1 (*Drosophila*), staufen (RNA binding protein) homolog 2 (*Drosophila*), staufen, RNA binding protein (*Drosophila*), staufen, RNA binding protein, homolog 2 (*Drosophila*) |
| 830 | 4917 | AA924140 | p | | *Homo sapiens* mRNA; cDNA DKFZp566P2324 (from clone DKFZp566P2324), *Homo sapiens,* clone MGC:21553 IMAGE:4155396, mRNA, complete cds, KIAA0193 gene product, hypothetical protein BC002980, hypothetical protein FLJ23142 |
| 1869 | 2972 | AI102606 | ss | | *Homo sapiens* NADH dehydrogenase ubiquinone 1 alpha subcomplex mRNA, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | complete cds, NADH dehydrogenase (ubiquinone) 1 alpha subcomplex, 10 (42 kD) |
| 980 | 23423 | AA944912 | dd | | *Homo sapiens* NAG11 (NAG11) mRNA, complete cds, hypothetical protein FLJ20105, hypothetical protein from EUROIMAGE 2005326 |
| 4275 | 18108 | NM_139105 | l, w, General, uu, vv | | *Homo sapiens* PP1579 mRNA, complete cds, *Mus musculus*, clone MGC:6299 IMAGE:2654341, mRNA, complete cds, expressed sequence AW546468, expressed sequence C80305, ribonuclease/angiogenin inhibitor |
| 2917 | 17913 | H31707 | l, x, General, dd, uu | | *Homo sapiens*, clone IMAGE:3940519, mRNA, partial cds, hypothetical protein DKFZp762O076 |
| 436 | 23346 | AA859983 | c | | *Homo sapiens*, clone MGC:12617 IMAGE:2964706, mRNA, complete cds, cyclin M3, cyclin M4 |
| 440 | 23347 | AA860015 | c | | *Homo sapiens*, clone MGC:12617 IMAGE:2964706, mRNA, complete cds, cyclin M3, cyclin M4 |
| 3606 | 21211 | NM_022607 | t, nn | | *Homo sapiens*, clone MGC:12790 IMAGE:4302265, mRNA, complete cds, NADH dehydrogenase (ubiquinone) flavoprotein 3 (10KD), nucleolar and coiled-body phosphoprotein 1 |
| 968 | 17948 | AA944581 | f | | *Homo sapiens*, clone MGC:15307 IMAGE:4135946, mRNA, complete cds |
| 2576 | 19271 | AI231566 | f, q, pp, ww | | *Homo sapiens*, clone MGC:18164 IMAGE:4155088, mRNA, complete cds |
| 1775 | 8665 | AI071965 | ee | | *Homo sapiens*, clone MGC:25063 IMAGE:4480702, mRNA, complete cds |
| 589 | 16836 | AA892005 | r | | *Homo sapiens*, clone MGC:32124 IMAGE:4877960, mRNA, complete cds, RIKEN cDNA 1110060M21 gene, RIKEN cDNA 4631434O19 gene, progesterone receptor membrane component 1, progesterone receptor membrane component 2 |
| 2375 | 11374 | AI178672 | k | | *Homo sapiens*, clone MGC:8769 IMAGE:3860953, mRNA, complete cds |
| 2861 | 20468 | AI639494 | m | | *Homo sapiens*, clone MGC:8769 IMAGE:3860953, mRNA, complete cds |
| 3632 | 2006 | NM_022936 | o, xx | | *Homo sapiens*, clone MGC:9645 IMAGE:3922910, mRNA, complete cds, RIKEN cDNA 2310063B19 gene, epoxide hydrolase 2, cytoplasmic, hypothetical protein FLJ11743, hypothetical protein FLJ22408 |
| 3632 | 2007 | NM_022936 | o, s | | *Homo sapiens*, clone MGC:9645 IMAGE:3922910, mRNA, complete cds, RIKEN cDNA 2310063B19 gene, epoxide hydrolase 2, cytoplasmic, hypothetical protein FLJ11743, hypothetical protein FLJ22408 |
| 3632 | 2008 | NM_022936 | o, s, xx | | *Homo sapiens*, clone MGC:9645 IMAGE:3922910, mRNA, complete cds, RIKEN cDNA 2310063B19 gene, epoxide hydrolase 2, cytoplasmic, hypothetical protein FLJ11743, hypothetical protein FLJ22408 |
| 3632 | 2009 | NM_022936 | n, o | | *Homo sapiens*, clone MGC:9645 IMAGE:3922910, mRNA, complete cds, RIKEN cDNA 2310063B19 gene, epoxide hydrolase 2, cytoplasmic, hypothetical protein FLJ11743, hypothetical protein FLJ22408 |
| 3403 | 20583 | NM_017306 | k, nn | | *Homo sapiens*, Similar to dodecenoyl-Coenzyme A delta isomerase (3,2 trans-enoyl-Coenzyme A isomerase), clone MGC:3903 IMAGE:3630566, mRNA, complete cds |
| 1909 | 13317 | AI103637 | ee | | *Homo sapiens*, Similar to protein kinase NYD-SP25, clone MGC:26757 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3601 | 20960 | NM_022598 | a | | IMAGE:4828082, mRNA, complete cds, RIKEN cDNA 2810411G23 gene, tumor protein D52-like 2 Homo sapiens, Similar to RIKEN cDNA 4930513O09 gene, clone MGC:33185 IMAGE:5269882, mRNA, complete cds, Mus musculus, Similar to hypothetical protein DKFZp761J139, clone MGC:11924 IMAGE:3599595, mRNA, complete cds, RIKEN cDNA 4930513O09 gene, cellular nucleic acid binding protein, zinc finger protein 9 (a cellular retroviral nucleic acid binding protein) |
| 1038 | 18383 | AA946421 | m | | Homo sapiens, Similar to transcription factor EB, clone IMAGE:3944945, mRNA, partial cds |
| 2061 | 15399 | AI145451 | oo | | homolog of yeast mRNA transport regulator 3 |
| 2483 | 22455 | AI228524 | s | | HSPC230 gene, RIKEN cDNA 1700021F05 gene |
| 4244 | 1896 | NM_138840 | g | | HTGN29 protein, trans-golgi network protein 1, trans-golgi network protein 2 |
| 4244 | 1899 | NM_138840 | w | | HTGN29 protein, trans-golgi network protein 1, trans-golgi network protein 2 |
| 40 | 16959 | AA799550 | u | | Human putative ribosomal protein S1 mRNA, RIKEN cDNA 9130413I22 gene, T-cell activation protein, hypothetical protein BC006130 |
| 3080 | 17292 | NM_012584 | General, cc | | hydroxy-delta-5-steroid dehydrogenase, 3 beta- and steroid delta-isomerase 1, hydroxysteroid dehydrogenase-4, delta<5>-3-beta, hydroxysteroid dehydrogenase-5, delta<5>-3-beta |
| 1433 | 12475 | AI012632 | c | | hypothetical protein BC000919 |
| 566 | 11966 | AA891800 | w | | hypothetical protein BC008246, inorganic pyrophosphatase, pyrophosphatase (inorganic) |
| 1153 | 2583 | AA965166 | u, mm | | hypothetical protein BC008246, inorganic pyrophosphatase, pyrophosphatase (inorganic) |
| 4297 | 6731 | NM_145096 | c | | hypothetical protein DKFZp66702416, hypothetical protein FLJ20984, leukocyte receptor cluster (LRC) member 4, zinc finger, DHHC domain containing 7, zinc finger, DHHC domain containino 9 |
| 2100 | 16727 | AI169287 | z, General, kk | | hypothetical protein DKFZp761C169, hypothetical protein SP192 |
| 2513 | 23563 | AI229421 | pp | | hypothetical protein FLJ10074 |
| 1990 | 23099 | AI112365 | y, nn, ww | | hypothetical protein FLJ10292, mago-nashi homolog, proliferation-associated (Drosophila) |
| 2178 | 17746 | AI171615 | ss | | hypothetical protein FLJ10402 |
| 2535 | 4662 | AI230215 | ll | | hypothetical protein FLJ10468 |
| 609 | 22903 | M892250 | h, q, dd | | hypothetical protein FLJ10514 |
| 1703 | 8132 | AI060050 | p, bb | | hypothetical protein FLJ10613, hypothetical protein FLJ12595, nucleolar GTPase, putative nucleotide binding protein, estradiol induced |
| 1054 | 17191 | AA955382 | c | | hypothetical protein FLJ10637 |
| 240 | 7208 | AA819337 | t, mm, qq | | hypothetical protein FLJ10856 |
| 299 | 18876 | AA849790 | u | | hypothetical protein FLJ11773 |
| 4284 | 7859 | NM_139328 | kk | | hypothetical protein FLJ13291 |
| 1710 | 4337 | AI060281 | ll | | hypothetical protein FLJ13798, hypoxia-inducible factor 1, alpha subunit inhibitor |
| 2523 | 2688 | AI229793 | k, s | | hypothetical protein FLJ20010 |
| 2832 | 18533 | AI639231 | g | | hypothetical protein FLJ20333, hypothetical protein HSPC226 |
| 115 | 22918 | AA800243 | o, p, w, ii, rr | | hypothetical protein FLJ20871 similar to FSP27 |
| 1062 | 23278 | AA955553 | l | | hypothetical protein IMAGE3455200 |
| 1325 | 22801 | AI009197 | a | | hypothetical protein IMAGE3455200 |
| 702 | 3879 | M893237 | t, cc, xx | | hypothetical protein MBC3205 |
| 336 | 19187 | AA851230 | General, pp | | hypothetical protein MGC11102 |
| 51 | 20980 | AA799633 | dd, oo | | hypothetical protein MGC13016 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 392 | 15148 | AA859325 | w | | hypothetical protein MGC14151 |
| 241 | 17024 | AA819356 | i | | hypothetical protein MGC15677 |
| 2646 | 11507 | AI233222 | ee | | hypothetical protein MGC2803 |
| 915 | 9942 | AA942697 | y | | hypothetical protein MGC3133 |
| 561 | 17271 | AA891759 | a, s | | hypothetical protein MGC4308 |
| 120 | 17206 | AA800296 | u | | hypothetical protein MGC5378, poly(A) polymerase beta (testis specific) |
| 4212 | 12719 | NM_134373 | l, uu | | hypothetical protein PP5395 |
| 4205 | 15655 | NM_133621 | nn | | hypothetical protein SMAP31 |
| 3688 | 17916 | NM_024488 | g, q | | hypothetical protein, MGC:8303, likely ortholog of rat CDK5 activator-binding protein C53 |
| 4055 | 16921 | NM_053806 | gg, hh, jj | | hypoxanthine guanine phosphoribosyl transferase, hypoxanthine phosphoribosyltransferase 1 (Lesch-Nyhan syndrome) |
| 637 | 11994 | AA892507 | h | | immature colon carcinoma transcript 1 |
| 2257 | 1587 | AI176063 | ii | | inositol polyphosphate-5-phosphatase, 72 kDa |
| 3020 | 1586 | AA57728 | oo, pp | | inositol polyphosphate-5-phosphatase, 72 kDa |
| 3135 | 15174 | NM_012756 | j, ss | | insulin-like growth factor 2 receptor |
| 3252 | 16982 | NM_013144 | f, r, z, ee, ff, rr | | insulin-like growth factor binding protein 1 |
| 2778 | 23076 | AI237388 | q, dd | | interferon-related developmental regulator 1, interferon-related developmental regulator 2 |
| 3194 | 709 | NM_012968 | h | | interkeukin 1 receptor accessory protein-like 2, interleukin 1 receptor accessory protein, interleukin 18 receptor 1, interleukin 18 receptor accessory protein, single Ig IL-1 receptor related protein |
| 2387 | 4279 | AI178808 | k | | interleukin 2 receptor, gamma (severe combined immunodeficiency), interleukin 2 receptor, gamma chain |
| 271 | 23759 | AA848402 | u | | interleukin enhancer binding factor 2, 45 kD, spermatid perinuclear RNA binding protein |
| 3415 | 25515 | NM_017339 | g | | ISL1 transcription factor, LIM/homeodomain, (islet-1) |
| 1161 | 2809 | AA996471 | p | | JM11 protein |
| 2700 | 15034 | AI235054 | s | | JM5 protein, Mus musculus, Similar to hypothetical protein FLJ10055, clone MGC:36416 IMAGE:5322999, mRNA, complete cds, RIKEN cDNA 0610008N23 gene |
| 69 | 16730 | AA799766 | l | | JTV1 gene |
| 525 | 5384 | AA891041 | vv | | Jun-B oncogene, jun B proto-oncogene |
| 3536 | 20161 | NM_021836 | oo | | Jun-B oncogene, jun B proto-oncogene |
| 3727 | 1731 | NM_031047 | tt | | junction plakoglobin |
| 3889 | 1184 | NM_031778 | cc | | K+ voltage-gated channel, subfamily S, 2, potassium voltage-gated channel, delayed-rectifier, subfamily S, member 3 |
| 996 | 7683 | AA945320 | a | | karyopherin (importin) alpha 3, karyopherin alpha 3 (importin alpha 4) |
| 1387 | 4203 | AI011082 | j | | karyopherin (importin) alpha 3, karyopherin alpha 3 (importin alpha 4) |
| 462 | 16042 | AA874827 | cc | | KIAA008 gene product |
| 423 | 19486 | AA859870 | l, nn | | KIAA0063 gene product, hypothetical transmembrane protein SBBI54 |
| 914 | 20910 | AA942693 | x | | kIAA0102 gene product, RIKEN cDNA 5730406I15 gene |
| 2008 | 15196 | AI136610 | ee | | KIAA0185 protein |
| 2746 | 15398 | AI236566 | s | | KIAA0375 gene product, nesca protein |
| 1009 | 9657 | AA945739 | e | | KIAA0391 gene product |
| 2511 | 19138 | AI229413 | s | | KIAA0415 gene product |
| 803 | 3944 | AA900688 | ww | | KIAA0553 protein, MDN 1, midasin homolog (yeast), O-linked N-acetylglucosamine (GlcNAc) transferase (UDP-N-acetylglucosamine:polypeptide-N-acetylglucosaminyl transferase), PC326 protein, TPR-containing, SH2-binding phosphoprotein, death inducer-obliterator-1, expressed sequence AF013969 |
| 731 | 24185 | AA893708 | y | | KIAA0560 gene product |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4294 | 17277 | NM_145082 | g | | KIAA0562 gene product |
| 2371 | 8418 | AI178566 | u | | KIAA0605 gene product, hypothetical protein FLJ13710 |
| 1749 | 9615 | AI071289 | l, z | | KIAA0779 protein |
| 1700 | 8496 | AI059974 | tt | | KIAA0978 protein, KIAA1685 protein, KIAA1713 protein |
| 772 | 22490 | AA899289 | ii | | KIAA1049 protein |
| 972 | 22492 | AA944741 | dd | | KIAA1049 protein |
| 2565 | 14303 | AI231159 | y | | KIAA1049 protein |
| 4037 | 13622 | NM_053713 | l | | Kruppel-like factor 1 (erythroid), Kruppel-like factor 2 (lung), Kruppel-like factor 4 (gut) |
| 4037 | 22411 | NM_053713 | f, qq | | Kruppel-like factor 1 (erythroid), Kruppel-like factor 2 (lung), Kruppel-like factor 4 (gut) |
| 4037 | 25379 | NM_053713 | qq | | Kruppel-like factor 1 (erythroid), Kruppel-like factor 2 (lung), Kruppel-like factor 4 (gut) |
| 1165 | 2915 | AA996782 | ww | | lamin B1, lamin B2 |
| 1085 | 18669 | AA956453 | w | | leptin receptor gene-related protein |
| 2213 | 11525 | AI172286 | p | | leucine-rich PPR-motif containing |
| 368 | 10517 | AA858600 | nn | | leucine-zipper-like transcriptional regulator, |
| 3546 | 20204 | NM_022196 | f | | leukemia inhibitory factor, leukemia inhibitory factor (cholinergic differentiation factor) |
| 2470 | 14230 | AI228064 | y | | LIM domain only 1 (rhombotin 1), LIM domain only 4, LIM only 1, LIM only 4, expressed sequence AI854781 |
| 381 | 14589 | AA858982 | p, y | | LIM domain only 4, LIM only 4 |
| 295 | 22933 | AA849763 | y | | lipin 1 |
| 4413 | 672 | X13722 | ff, jj | | low density lipoprotein receptor, low density lipoprotein receptor (familial hypercholesterolemia) |
| 2602 | 409 | AI232268 | p, r | | low density lipoprotein receptor-related protein associated protein 1, low density lipoprotein-related protein-associated protein 1 (alpha-2-macroglobulin receptor-associated protein 1) |
| 4481 | 407 | Z11995 | gg, hh | | low density lipoprotein receptor-related protein associated protein 1, low density lipoprotein-related protein-associated protein 1 (alpha-2-macroglobulin receptor-associated protein 1) |
| 2638 | 17240 | AI233054 | mm | | low molecular mass ubiquinone-binding protein (9.5 kD) |
| 2781 | 21653 | AI237535 | l, qq | | LPS-induced TNF-alpha factor |
| 4382 | 21654 | U53184 | f, l, y, General, ee | | LPS-induced TNF-alpha factor |
| 2314 | 4190 | AI177016 | z, ee | | Lsm1 protein, U6 snRNA-associated Sm-like protein LSm8 |
| 2258 | 24745 | AI176101 | d, j | | lysosomal-associated protein transmembrane 4 alpha, lysosomal-associated protein transmembrane 4A, putative integral membrane transporter |
| 1480 | 7316 | AI013883 | s | | makorin, ring finger protein, 1 |
| 3984 | 3860 | NM_053477 | g, o, ff, ii | | malonyl-CoA decarboxylase |
| 3086 | 382 | NM_012599 | a, d, gg, hh | | mannose binding lectin, liver (A), mannose-binding lectin (protein C) 2, soluble (opsonic defect) |
| 3998 | 22919 | NM_053556 | uu, ww | | maternal G10 transcript |
| 2116 | 3909 | AI169903 | l | | MD-2 protein, lymphocyte antigen 96 |
| 2436 | 14803 | AI179906 | r | | Mdm4, transformed 3T3 cell double minute 4, p53 binding protein (mouse), expressed sequence C85810, transformed mouse 3T3 cell double minute 4 |
| 198 | 3275 | AA818112 | f, uu | | mesenchymal stem cell protein DSC92, neugrin |
| 2981 | 18620 | L40364 | gg, hh | | MHC (A.CA/J(H-2K-f) class I antigen, *Rattus norvegicus* clone 4 class I MHC heavy chain RT1.A(n) antigen precursor (RT1.A(n)) mRNA, complete cds, histocompatibility 2, D region locus 1, histocompatibility 2, L region, histocompatibility 2, Q region locus 10, histocompatibility 2, T region locus 24, major histocompatibility complex, class I, B |
| 605 | 8317 | AA892234 | b, s, z, General | | microsomal glutathione S-transferase 3 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 504 | 15205 | AA875263 | m | | microspherule protein 1 |
| 23 | 20957 | AA799440 | ff | | mitochondrial ribosomal protein L13 |
| 2205 | 11416 | AI172185 | t, ff | | mitochondrial ribosomal protein L49 |
| 2848 | 19152 | AI639387 | c | | mitochondrial ribosomal protein S6 |
| 4065 | 17299 | NM_053842 | ww | | mitogen activated protein kinase 1, mitogen-activated protein kinase 1, nemo like kinase |
| 97 | 16712 | AA800015 | v | | Mitogen activated protein kinase 12 (Zipper (leucine) protein kinase), integrin linked kinase, integrin-linked kinase, mitogen activated protein kinase kinase kinase 11, mitogen activated protein kinase kinase kinase 12, mitogen-activated protein kinase kinase kinase 12, mitogen-activated protein kinase kinase kinase 13 |
| 3411 | 24766 | NM_017322 | k | | mitogen activated protein kinase 9, mitogen-activated protein kinase 9 |
| 3411 | 24767 | NM_017322 | u | | mitogen activated protein kinase 9, mitogen-activated protein kinase 9 |
| 3907 | 10176 | NM_031837 | w | | MLL septin-like fusion, septin 9 |
| 306 | 18696 | AA849965 | q, nn, qq, xx | | MO25 protein, RIKEN cDNA 2810425O13 gene, calcium binding protein, 39 kDa |
| 356 | 18697 | M851776 | j | | MO25 protein, RIKEN cDNA 2810425O13 gene, calcium binding protein, 39 kDa |
| 328 | 3924 | AA851017 | ff | | molybdenum cofactor synthesis 2 |
| 1341 | 3926 | AI009592 | e, o | | molybdenum cofactor synthesis 2 |
| 4267 | 809 | NM_139089 | ee | | monokine induced by gamma interferon, small inducible cytokine B subfamily (Cys-X-Cys motif), member 13 (B-cell chemoattractant), small inducible cytokine B subfamily (Cys-X-Cys), member 10, small inducible cytokine subfamily B (Cys-X-Cys), member 10, small inducible cytokine subfamily B (Cys-X-Cys), member 11 |
| 4207 | 1463 | NM_134334 | e, jj | | *Mus musculus* 10 day old male pancreas cDNA, RIKEN full-length enriched library, clone:1810054L16:kidney-derived aspartic protease-like protein, full insert sequence, cathepsin D, cathepsin D (lysosomal aspartyl protease) |
| 3846 | 20766 | NM_031643 | nn | | *Mus musculus* 12 days embryo head cDNA, RIKEN full-length enriched library, clone:3000002B10:mitogen activated protein kinase kinase 5, full insert sequence, mitogen activated protein kinase kinase 1, mitogen-activated protein kinase kinase 1 |
| 3846 | 20767 | NM_031643 | s | | *Mus musculus* 12 days embryo head cDNA, RIKEN full-length enriched library, clone:3000002B10:mitogen activated protein kinase kinase 5, full insert sequence, mitogen activated protein kinase kinase 1, mitogen-activated protein kinase kinase 1 |
| 3530 | 19824 | NM_021750 | c, General, kk | | *Mus musculus* adult male liver cDNA, RIKEN full-length enriched library, clone: 1300015E02:deoxyribonuclease II alpha, full insert sequence, cysteine sulfinic acid decarboxylase-related protein 2 |
| 3530 | 19825 | NM_021750 | l, General, dd, ii, qq, vv | | *Mus musculus* adult male liver cDNA, RIKEN full-length enriched library, clone:1300015E02:deoxyribonuclease II alpha, full insert sequence, cysteine sulfinic acid decarboxylase-related protein 2 |
| 3269 | 1300 | NM_013190 | t | | *Mus musculus* adult male stomach cDNA, RIKEN full-length enriched library, clone:2210403E17:phosphofructokinase, liver, B-type, full insert sequence, phosphofructokinase, liver. B-type |
| 867 | 23261 | AA925145 | b, uu, vv | | *Mus musculus* adult male testis cDNA, RIKEN full-length enriched library, clone:4930572N12:betaine-homocysteine methyltransferase, full insert sequence, betaine-homocysteine methyltransferase, betaine-homocysteine methyltransferase 2 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3955 | 20235 | NM_053302 | bb | | *Mus musculus* dual specificity phosphatase T-DSP10 mRNA, complete cds, RIKEN cDNA 5930436K22 gene, protein phosphatase |
| 751 | 22783 | AA894207 | cc | | *Mus musculus* dual specificity phosphatase T-DSP10 mRNA, complete cds, RIKEN cDNA 5930436K22 gene, protein phosphatase |
| 4011 | 21709 | NM_053596 | kk, ss | | *Mus musculus* endothelin converting enzyme-2 mRNA, complete cds, endothelin converting enzyme 1, expressed sequence AW322500, mel transforming oncogene-like 1 |
| 4102 | 24430 | NM_053996 | w | | *Mus musculus* glycine transporter type 2 (Glyt2) mRNA, complete cds, glycine transporter 1, homolog of rat orphan transporter v7-3, solute carrier family 6 (neurotransmitter transporter, L-proline), member 7 |
| 2545 | 13555 | AI230547 | d | | *Mus musculus* lethal giant larvae-like protein 2 mRNA, complete cds, RIKEN cDNA 4930565N16 gene, lethal giant larvae homolog 1 (*Drosophila*) |
| 3241 | 1793 | NM_013105 | jj | | *Mus musculus* mRNA for cytochrome P450, CYP3A, complete cds, cytochrome P450, steroid inducible 3a11, dytochrome P450, subfamily IIIA (niphedipine oxidase), polypeptide 3 |
| 3241 | 1794 | NM_013105 | jj | | *Mus musculus* mRNA for cytochrome P450, CYP3A, complete cds, cytochrome P450, steroid inducible 3a11, cytochrome P450, subfamily IIIA (niphedipine oxidase), polypeptide 3 |
| 3241 | 1795 | NM_013105 | jj | | *Mus musculus* mRNA for cytochrome P450, CYP3A, complete cds, cytochrome P450, steroid inducible 3a11, cytochrome P450, subfamily IIIA (niphedipine oxidase), polypeptide 3 |
| 3241 | 1796 | NM_013105 | v | | *Mus musculus* mRNA for cytochrome P450, CYP3A, complete cds, cytochrome P450, steroid inducible 3a11, cytochrome P450, subfamily IIIA (niphedipine oxidase), polypeptide 3 |
| 3963 | 15790 | NM_053341 | u | | *Mus musculus* mRNA for PDZ-domain protein Gipc3, complete cds, PDZ domain protein GIPC2, expressed sequence AU021850, regulator of G-protein signaling 19 interacting protein 1, regulator of G-protein signalling 19 interacting protein 1, semaF cytoplasmic domain associated protein 2 |
| 3949 | 24484 | NM_052806 | k | | *Mus musculus* nicotinic acetylcholine receptor beta4 subunit (Chrnb4) mRNA, complete cds, cholinergic receptor, nicotinic, beta polypeptide 2 (neuronal), cholinergic receptor, nicotinic, beta polypeptide 4 |
| 3718 | 1624 | NM_031023 | q, z, General | | *Mus musculus* secreted protein precursor Ym2 mRNA, complete cds, *Mus musculus*, Similar to di-N-acetylchitobiase, clone IMAGE:4038549, mRNA, partial cds, RIKEN cDNA2210401K11 gene, RIKEN cDNA 4921536I21 gene, chitinase 1 (chitotriosidase), chitinase 3-like 3, chitobiase di-N-aceytyl- |
| 2351 | 19184 | AI178025 | d | | *Mus musculus* testis expressed homeobox mRNA, complete cds, RIKEN cDNA 5430405H02 gene, RIKEN cDNA 5730599O09 gene, TG interacting factor, TGF(beta)-induced transcription factor 2-like, TGFB-induced factor (TALE family homeobox), TGFB-induced factor 2 (TALE family homeobox) |
| 4285 | 1962 | NM_139329 | ii | | *Mus musculus*, clone IMAGE:3491119, mRNA, partial cds, *Rattus norvegicus* 3beta-hydroxysteroid dehydrogenase/delta5- |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | delta4 isomerase (3beta-HSD) mRNA, complete cds, hydroxy-delta-5-steroid dehydrogenase, 3 beta- and steroid delta-isomerase 1, hydroxysteroid dehydrogenase 1, delta<5>-3-beta, hydroxysteroid dehydrogenase-2, delta<5>-3-beta, hydroxysteroid dehydrogenase-3, delta<5>-3-beta, hydroxysteroid dehydrogenase-6, delta<5>-3-beta |
| 3672 | 23489 | NM_024375 | xx | | *Mus musculus*, clone IMAGE:4224368, mRNA, partial cds, growth differentiation factor 10 |
| 4230 | 534 | NM_138512 | b, u | | *Mus musculus*, clone MGC:25860 IMAGE:4195655, mRNA, complete cds, RIKEN cDNA 0610005C13 gene, RIKEN cDNA 2010301M18 gene, RIKEN cDNA 2210009K14 gene, cytochrome P450, 2c29, cytochrome P450, subfamily IIC (mephenytoin 4-hydroxylase), polypeptide 19 expressed sequence AI159681 |
| 3343 | 2968 | NM_017158 | n | | *Mus musculus*, clone MGC:25860 IMAGE:4195655, mRNA, complete cds, RIKEN cDNA 2010301M18 gene, RIKEN cDNA 2210009K14 gene, cytochrome P450, 2c29, cytochrome P450, 2c38, cytochrome P450, subfamily IIC (mephenytoin 4-hydroxylase), polypeptide 19, expressed sequence AI159681, expressed sequence AI662255 |
| 3343 | 2970 | NM_017158 | f, rr, ss | | *Mus musculus*, clone MGC:25860 IMAGE:4195655, mRNA, complete cds, RIKEN cDNA 2010301M18 gene, RIKEN cDNA 2210009K14 gene, cytochrome P450, 2c29, cytochrome P450, 2c38, cytochrome P450, subfamily IC (mephenytoin 4-hydroxylase), polypeptide 19, expressed sequence AI159681, expressed sequence AI662255 |
| 4203 | 699 | NM_133617 | b,q, General | | *Mus musculus*, clone MGC:25863 IMAGE:4196269, mRNA, complete cds, *Mus musculus*, clone MGC:37860 IMAGE:5100400, mRNA, complete cds, serine (or cysteine) proteinase inhibitor, clade A (alpha-1 antiproteinase, antitrypsin), member 10, serine protease inhibitor 1-1 |
| 4195 | 4312 | NM_133586 | y, rr, ww | | *Mus musculus*, clone MGC:28542 IMAGE:4194872, mRNA, complete cds, *Mus musculus*, clone MGC:31116 IMAGE:4163362, mRNA, complete cds, carboxylesterase 1, carboxylesterase 1 (monocyte/macrophage serine esterase 1), carboxylesterase 2 (intestine, liver), carboxylesterase 3, carboxylesterase 3 (brain), carboxylesterase-related protein, expressed sequence AI266984, neuroligin I |
| 977 | 2893 | AA944833 | kk | | *Mus musculus*, clone MGC:36467 IMAGE:5359082, mRNA, complete cds, RIKEN cDNA 4933434H11 gene, RNA binding protein p45AUF1, heterogeneous nuclear ribonucleoprotein D, heterogeneous nuclear ribonucleoprotein D (AU-rich element RNA binding protein 1, 37 kD), heterogeneous nuclear ribonucleoprotein D-like, high-glycine/tyrosine protein type I E5 |
| 4397 | 23926 | U86635 | d, oo | | *Mus musculus*, glutathione S-transferase, mu type 3 (Yb3), clone MGC:30483 IMAGE:4166881, mRNA, complete cds, RIKEN cDNA 0610005A07 gene, glutathione S-transferase M2 (muscle), glutathione S-transferase M5, glutathione S-transferase, mu 5, glutathione S transferase, mu type 3 (Yb3) |
| 3268 | 1255 | NM_013189 | ff, xx | | *Mus musculus*, Guanine nucleotide binding protein, alpha, clone MGC:25486 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | IMAGE:4501587, mRNA, complete cds, guanine nucleotide binding protein (G protein(), alpha z polypeptide |
| 4204 | 1728 | NM_133618 | b, m, o, cc | | *Mus musculus*, Similar to Acetyl-Co A acetyltransferase 1, mitochondrial, clone MGC:39067 IMAGE:5365469, mRNA, complete cds, *Mus musculus*, Similar to hydroxyacyl-Coenzyme A dehydrogenase/3-ketoacyl-Coenzyme A thiolase/enoyl-Coenzyme A hydratase (trifunctional protein), beta subunit, clone MGC:7126 IMAGE:3158015, mRNA, complete cds, acetyl-Coenzyme A acyltransferase (peroxisomal 3-oxoacyl-Coenzyme A thiolase), hydroxyacyl-Coenzyme A dehydrogenase/3-ketoacyl-Coenzyme A thiolase/enoyl-Coenzyme A hydratase (trifunctional protein), beta subunit |
| 4253 | 14964 | NM_138884 | s, uu | | *Mus musculus*, Similar to aldo-keto reductase family 1, member D1 (delta 4-3-ketosteroid-5-beta-reductase), clone MGC:25814 IMAGE:4162788, mRNA, complete cds, aldo-keto reductase family 1, member D1 (delta 4-3-ketosteroid-5-beta-reductase) |
| 4253 | 14965 | NM_138884 | m | | *Mus musculus*, Similar to aldo-keto reductase family 1, member D1 (delta 4-3-ketosteroid-5-beta-reductase), clone MGC:25814 IMAGE:4162788, mRNA, complete cds, aldo-keto reductase family 1, member D1 (delta 4-3-ketosteroid-5-beta-reductase) |
| 4353 | 13520 | S87522 | c | | *Mus musculus*, Similar to aminopeptidase B, clone MGC:29229 IMAGE:5041005, mRNA, complete cds, expressed sequence AI894167, leukotriene A4 hydrolase |
| 4089 | 6538 | NM_053959 | l | | *Mus musculus*, Similar to amphiphysin, clone IMAGE:5357091, mRNA, partial cds, bridging integrator 1, bridging integrator 2, myc box dependent interacting protein 1 |
| 4089 | 6539 | NM_053959 | ss, uu | | *Mus musculus*, Similar to amphiphysin, clone IMAGE:5357091, mRNA, partial cds, bridging integrator 1, bridging integrator 2, myc box dependent interacting protein 1 |
| 4053 | 25594 | NM_053799 | m | | *Mus musculus*, Similar to aspartyl-tRNA synthetase, clone MGC:6719 IMAGE:3586278, mRNA, complete cds, asparaginyl-tRNA synthetase, aspartyl-tRNA synthetase. lysyl-tRNA synthetase |
| 77 | 20998 | AA799803 | b, General | | *Mus musculus*, Similar to complement component 1, s subcomponent, clone MGC:19094 IMAGE:4196654, mRNA, complete cds, *Mus musculus*, Similar to complement component 1 s subcomponent, clone MGC:28492 IMAGE:4166254, mRNA, complete cds, complement component 1, s subcomponent, protein C |
| 813 | 4857 | AA901237 | mm | | *Mus musculus*, Similar to cydin K, clone MGC:28173 IMAGE:3986609, mRNA, complete cds, cyclin T1 |
| 4031 | 3454 | NM_053662 | ii, tt | | *Mus musculus*, Similar to cyclin K, clone MGC:28173 IMAGE:3986609, mRNA, complete cds, Paneth cell enhanced expression, RIKEN cDNA 1810009O10 gene. cyclin L, cyclin T1, cyclin T2 |
| 4031 | 3455 | NM_053662 | w, tt | | *Mus musculus*, Similar to cyclin K, clone MGC:28173 IMAGE:3986609, mRNA, complete cds, Paneth cell enhanced expression, RIKEN cDNA 1810009O10 gene, cyclin L. cyclin Ti cyclin T2 |
| 846 | 16806 | M924591 | r, nn | | *Mus musculus*, Similar to cytochrome P450, 4a10, clone MGC:18880 IMAGE:4237837, mRNA, complete cds, *Mus musculus*, Similar to cytochrome P450, 4a10, clone |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | MGC:25972 IMAGE:4240359, mRNA, complete cds, RIKEN cDNA A230105L22 gene, cytochrome P450, 4a10, cytochrome P450, 4a14, cytochrome P450, subfamily VA, polypeptide 11, expressed sequence AI314743 |
| 3014 | 16807 | M33936 | k, o, v, ss, uu, xx | | *Mus musculus*, Similar to cytochrome P450, 4a10, clone MGC:18880 IMAGE:4237837, mRNA, complete cds, *Mus musculus*, Similar to cytochrome P450, 4a10, clone MGC:25972 IMAGE:4240359, mRNA, complete cds, RIKEN cDNA A230105L22 gene, cytochrome P450, 4a10, cytochrome P450, 4a14, cytochrome P450, subfamily VA, polypeptide 11, expressed sequence AI314743 |
| 3967 | 19512 | NM_053365 | xx | | *Mus musculus*, Similar to fatty acid binding protein 4, adipocyte, clone MGC:18548 IMAGE:3670866, mRNA, complete cds, fatty acid binding protein 4, adipocyte |
| 4192 | 25821 | NM_133570 | cc | | *Mus musculus*, Similar to gastrin-releasing peptide, clone MGC:37475 IMAGE:4984025, mRNA, complete cds, gastrin-releasing peptide |
| 4161 | 16767 | NM_130826 | o | | *Mus musculus*, Similar to hydroxyacyl-Coenzyme A dehydrogenase/3-ketoacyl-Coenzyme A thiolase/enoyl-Coenzyme A hydratase (trifunctional protein), alpha subunit, clone IMAGE:4953760, mRNA, partial cds, enoyl Coenzyme A hydratase, short chain, 1, mitochondrial, hydroxyacyl-Coenzyme A dehydrogenase/3-ketoacyl-Coenzyme A thiolase/enoyl-Coenzyme A hydratase (trifunctional protein), alpha subunit |
| 4161 | 16768 | NM_130826 | o, ss | | *Mus musculus*, Similar to hydroxyacyl-Coenzyme A dehydrogenase/3-ketoacyl-Coenzyme A thiolase/enoyl-Coenzyme A hydratase (trifunctional protein), alpha subunit, clone IMAGE:4953760, mRNA, partial cds, enoyl Coenzyme A hydratase, short chain, 1, mitochondrial, hydroxyacyl-Coenzyme A dehydrogenase/3-ketoacyl-Coenzyme A thiolase/enoyl-Coenzyme A hydratase (trifunctional protein), alpha subunit |
| 4200 | 17758 | NM_133606 | k, o, v, xx | | *Mus musculus*, Similar to hydroxyacyl-Coenzyme A dehydrogenase/3-ketoacyl-Coenzyme A thiolase/enoyl-Coenzyme A hydratase (trifunctional protein), alpha subunit, clone IMAGE:4953760, mRNA, partial cds, RIKEN cDNA 1300002P22 gene, enoyl Coenzyme A hydratase, short chain, 1, mitochondrial, enoyl-Coenzyme A, hydratase/3-hydroxyacyl Coenzyme A dehydrogenase |
| 640 | 15154 | AA892532 | q, x, dd, tt | | *Mus musculus*, Similar to hypothetical protein MGC3178, clone MGC:28887 IMAGE:4911455, mRNA, complete cds, RIKEN cDNA 1200006L06 gene, RIKEN cDNA 1700015E05 gene, RIKEN cDNA 2700053F16 gene, RIKEN cDNA 4921506J03 gene, expressed sequence AI987846, expressed sequence AL023058, expressed sequence C77895, protein disulfide isomerase-related protein |
| 4068 | 19018 | NM_053849 | y, xx | | *Mus musculus*, Similar to hypothetical protein MGC3178, clone MGC:28887 IMAGE:4911455, mRNA, complete cds, RIKEN cDNA 1700015E05 gene, RIKEN cDNA 2700053F16 gene, RIKEN cDNA 4921506J03 gene, calcium binding protein, intestinal, expressed sequence AI987846, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 16 | 22646 | AA799301 | r | | protein disulfide isomerase related protein (calcium-binding protein, intestinal-related) *Mus musculus*, Similar to ligatin, clone IMAGE:4982955, mRNA, partial cds, ligatin |
| 1075 | 22576 | M955983 | m, dd | | *Mus musculus*, Similar to microsomal glutathione S-transferase 2, clone MGC:41409 IMAGE:1511631, mRNA, complete cds, arachidonate 5-lipoxygenase-activating protein, leukotriene C4 synthase, microsomal glutathione S-transferase 2 |
| 3204 | 9917 | NM_012993 | qq | | *Mus musculus*, Similar to N-arginine dibasic convertase 1, clone MGC:25477 IMAGE:4486176, mRNA, complete cds, expressed sequence AI875733, insulin degrading enzyme, nardilysin (N-arginine dibasic convertase) |
| 3204 | 9918 | NM_012993 | ll | | *Mus musculus*, Similar to N-arginine dibasic convertase 1, clone MGC:25477 IMAGE:4486176, mRNA, complete cds, expressed sequence AI875733, insulin degrading enzyme, nardilysin (N-arginine dibasic convertase) |
| 3257 | 1309 | NM_013159 | e, bb, oo | | *Mus musculus*, Similar to N-arginine dibasic convertase 1, clone MGC:25477 IMAGE:44861 76, mRNA, complete cds, insulin degrading enzyme, insulin-degrading enzyme |
| 3996 | 1198 | NM_053554 | t, mm | | *Mus musculus*, Similar to phosphatidylinositol binding clathrin assembly protein, clone MGC:36430 IMAGE:5345558, mRNA, complete cds, phosphatidylinositol binding clathrin assembly protein, synaptosomal-associated protein. 91 kDa |
| 3042 | 3424 | M94557 | o | | *Mus musculus*, Similar to single-stranded DNA binding protein, clone MGC:41439 IMAGE:1314987, mRNA, complete cds, single-stranded DNA binding protein, single-stranded DNA binding protein 1 |
| 3992 | 31 | NM_053537 | j | | *Mus musculus*, Similar to solute carrier family 22 (organic anion transporter), member 7, clone MGC:18877 IMAGE:4236556, mRNA, complete cds, expressed sequence AI648912, solute carrier family 22 (organic anion transporter), member 6, solute carrier family 22 (organic anion transporter), member 7 |
| 3992 | 32 | NM_053537 | h, k, l, uu | | *Mus musculus*, Similar to solute carrier family 22 (organic anion transporter), member 7, clone MGC:18877 IMAGE:4236556, mRNA, complete cds, expressed sequence AI648912, solute carrier family 22 (organic anion transporter), member 6, solute carrier family 22 (organic anion transporter), member 7 |
| 3117 | 1602 | NM_012697 | dd, mm | | *Mus musculus*, Similar to solute carrier family 22 (organic cation transporter)-like 2, clone MGC:25980 IMAGE:4242162, mRNA, complete cds, solute, carrier family 22 (organic cation transporter), member 1 |
| 1401 | 16112 | AI011706 | tt | | *Mus musculus*, Similar to splicing factor, arginine/serine-rich 7 (35 kD), clone MGC:38287 IMAGE:5342587, mRNA, complete cds, *Mus musculus*, clone MGC:36924 IMAGE:4945988, mRNA, complete cds, RIKEN cDNA 1210001E11 gene, splicing factor, arginine/serine-rich 3, splicing factor, arginine/serine-rich 3 (SRp20), splicing factor, arginine/serine-rich 4, splicing factor, arginine/serine-rich 5, splicing factor, arginine/serine-rich 5 (SRp40 HRS) |
| 1283 | 20741 | AF084186 | nn | | *Mus musculus*, similar to src homology three (SH3) and cysteine rich domain, clone |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | MGC:38869 IMAGE:5361431, mRNA, complete cds, RIKEN cDNA 2610027H02 gene, RIKEN cDNA 2610301F02 gene, alpha-spectrin 1, erythroid, nesprin-1, spectrin, alpha, erythrocytic 1 (elliptocytosis 2), spectrin, alpha, non-erythrocytic 1 (alpha fodrin), src homology three (SH3) and cysteine rich domain |
| 3551 | 762 | NM_022245 | t, mm | | *Mus musculus*, Similar to sulfite oxidase, clone MGC:28458 IMAGE:4160277, mRNA, complete cds, RIKEN cDNA 0610009N12 gene, cytochrome b-5 |
| 3761 | 14970 | NM_031127 | l, p, x, z, General, kk, nn | | *Mus musculus*, Similar to sulfite oxidase, clone MGC:28458 IMAGE:4160277, mRNA, complete cds, RIKEN cDNA 1810044O22 gene, RIKEN cDNA 2810034J18 gene, sulfite oxidase |
| 1315 | 24151 | AI008793 | u | | *Mus musculus*, Similar to TAF6-like RNA polymerase II, p300/CBP-associated factor (PCAF)-associated factor, 65 kD, clone MGC:41377 IMAGE:1244243, mRNA, complete cds, TAF6 RNA polymerase II, TATA box binding protein (TBP)-associated factor, 80 kD, TAF6 RNA polymerase II, TATA box binding protein (TBP)-associated factor, 80 kDa, TAF6-like RNA polymerase II, p300/CBP-associated factor (POAF)-associated factor, 65 kD |
| 1928 | 8372 | AI104256 | pp | | MUS81 endonuclease, RIKEN cDNA 1200008A18 gene |
| 160 | 10320 | AA800855 | k | | myeloid leukemia factor 2 |
| 160 | 17775 | AA800855 | cc | | myeloid leukemia factor 2 |
| 4209 | 517 | NM_134350 | ee | | myxovirus (influenza virus) resistance 1, interferon-inducible protein p78 (mouse), myxovirus (influenza virus) resistance 2 |
| 2020 | 23788 | AI137176 | ss | | N-acetylglucosaminidase, alpha- (Sanfilippo disease IIIB), alpha-N-acetylglucosaminidase (Sanfilippo disease IIIB) |
| 1986 | 7266 | AI112237 | d, kk, nn | | NADH dehydrogenase (ubiquinone) 1 beta subcomplex, 2 (8 kD, AGGG), RIKEN cDNA 1810011O01 gene |
| 32 | 6505 | AA799499 | p | | NADH dehydrogenase (ubiquinone) 1 beta subcomplex, 3 (12 kD, B12), RIKEN cDNA 2700033I16 gene |
| 18 | 3636 | AA799336 | qq | | NADH dehydrogenase (ubiquinone) 1, alpha/beta subcomplex, 1 (8 kD, SDAP) |
| 1946 | 22822 | AI104679 | p, z | | NADH dehydrogenase (ubiquinone) 1, subcomplex unknown, 1, NADH dehydrogenase (ubiquinone) 1, subcomplex unknown, 1 (6 kD, KFYI) |
| 1456 | 21302 | AI013297 | o | | NADH dehydrogenase (ubiquinone) Fe-S protein 4, NADH dehydrogenase (ubiquinone) Fe-S protein 4 (18 kD) (NADH-coenzyme Q reductase) |
| 1332 | 16956 | AI009390 | ee | | NADH dehydrogenase (ubiquinone) Fe-S protein 5 (15 kD) (NADH-coenzyme Q reductase) |
| 2583 | 17297 | AI231785 | ii, rr | | Niemann Pick type C2, Niemann-Pick disease, type C2 |
| 4067 | 1508 | NM_053845 | e, uu, vv | | Nit protein 2, expressed sequence AI195023, nitrilase 1, ureidopropionase, beta |
| 1185 | 16883 | AA997345 | dd | | Nit protein 2, RIKEN cDNA 1190017B19 gene |
| 2698 | 3875 | AI235047 | q | | nuclear cap binding protein subunit 1, 80 kD |
| 87 | 18378 | AA799888 | bb | | nuclear localization signal deleted in velocardiofacial syndrome, nuclear localization signal protein absent in velo-cardio-facial patients |
| 808 | 18379 | AA900993 | u | | nuclear localization signal deleted in velocardiofacial syndrome, nuclear localization signal protein absent in velo-cardio-facial patients |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 795 | 6483 | AA900461 | v | | OB-receptor gene related protein (OB-RGRP), RIKEN cDNA 1520402O14 gene, leptin receptor gene-related protein, leptin receptor overlapping transcript-like 1 |
| 1284 | 20214 | AF091567 | xx | | odorant receptor S1 gene, olfactory receptor 41, olfactory receptor, family 6, subfamily A, member 1 |
| 1285 | 20236 | AF091570 | cc | | odorant receptor S1 gene, olfactory receptor 41, olfactory receptor, family 6, subfamily A, member 1 |
| 1286 | 25222 | AF091574 | g | | odorant receptor S1 gene, olfactory receptor 41, olfactory receptor, family 6, subfamily A, member 1 |
| 518 | 18911 | AA875615 | s, qq | | Opa-interacting protein 2, polymyositis/scleroderma autoantigen 1, polymyositis/scleroderma autoantigen 1 (75 kD) |
| 1602 | 5712 | AI045154 | n | | origin recognition complex, subunit 5 homolog (*S. cerevisiae*), origin recognition complex, subunit 5-like (yeast) |
| 1486 | 2909 | AI013946 | m | | oxysterol binding protein |
| 2870 | 14332 | AI001044 | q, ff | | p53-induced protein PIGPC1, tumor-associated calcium signal transducer 1 |
| 3483 | 16330 | NM_019331 | General, kk | | paired basic amino acid cleaving enzyme (furin, membrane associated receptor protein), proprotein convertase subtilisin/kexin type 3, proprotein convertase subtilisin/kexin type 4 |
| 3483 | 16331 | NM_019331 | h, m, General, mm | | paired basic amino acid cleaving enzyme (furin, membrane associated receptor protein), proprotein convertase subtilisin/kexin type 3, proprotein convertase subtilisin/kexin type 4 |
| 4114 | 15391 | NM_057114 | l | | peroxiredoxin 1 |
| 3985 | 4290 | NM_053487 | o, y, xx | | peroxisomal biogenesis factor 11A, peroxisomal biogenesis factor 11B, peroxisomal biogenesis factor 11a, peroxisomal biooenesis factor 11b |
| 1443 | 2937 | AI012951 | pp | | peroxisome biogenesis factor 13 |
| 4131 | 23129 | NM_078622 | t, ff | | phosphate cytidylyltransferase 1, choline, alpha isoform, solute carrier family 25 (mitochondrial carrier; citrate transporter), member 1 |
| 2192 | 6085 | AI171990 | ww | | Phosphatidylglycerophosphate Synthase, hypothetical protein DKFZp762M186 |
| 4258 | 1049 | NM_138901 | g | | phosphatidylinositol glycan, class L |
| 480 | 20389 | AA875045 | oo | | phosphodiesterase 6D, cGMP-specific, rod, delta |
| 3624 | 24540 | NM_022707 | u | | phospholamban |
| 1976 | 11339 | AI111840 | ll | | phosphomevalonate kinase |
| 2536 | 15862 | AI230228 | m, n, u | | ihosphoserine aminotransferase |
| 4035 | 1957 | NM_053674 | ii | | phytanoyl-CoA hydroxylase, phytanoyl-CoA hydroxylase (Refsum disease) |
| 851 | 4994 | AA924658 | k | | PIN2-interacting protein 1, PIN2/TRF1-interacting protein |
| 50 | 19472 | M799616 | c, f, p, General, kk | | pituitary tumor-transforming 1 interacting protein |
| 2410 | 13606 | AI179289 | j | | placenta-specific 3 |
| 3253 | 46 | NM_013151 | l, vv | | plasminogen activator, tissue |
| 1210 | 14149 | AA998172 | y | | platelet-activating factor acetylhydrolase, isoform 1b, alpha2 subunit, platelet-activating factor acetylhydrolase, isoform Ib, beta subunit (30 kD) |
| 3731 | 9516 | NM_031053 | g | | PMS1 postmeiotic segregation increased 1 (*S. cerevisiae*), PMS2 postmeiotic segregation increased 2 (*S. cerevisiae*), expressed sequence AI317206, mutL homolog 1 (*E. coli*), mutL homolog 1, colon cancer, nonpolyposis type 2 (*E. coli*), postmeiotic segregation increased 2 (*S. cerevisaie*), postmeiotic segregation, increased 2-like 8 |
| 3313 | 923 | NM_017076 | f, l, n, p, kk, xx | | poliovirus receptor, poliovirus receptor-related 1, poliovirus receptor-related 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | (herpesvirus entry mediator C; nectin), poliovirus receptor-related 2 (herpesvirus entry mediator B), poliovirus sensitivity, tumor-associated antigen 1 |
| 1274 | 15715 | AF053092 | ii | | Polo-like kinase homolog, endoplasmic reticulum (ER) to nucleus signalling 1, polo-like kinase (*Drosophila*), polo-like kinase homolog, (*Drosophila*) |
| 4223 | 2801 | NM_134449 | jj, oo | | polymerase I and transcript release factor, serum deprivation response, serum deprivation response (phosphatidylserine binding protein) |
| 4223 | 2802 | NM_134449 | c | | polymerase I and transcript release factor, serum deprivation response, serum deprivation response (phosphatidylserine binding protein) |
| 1873 | 5910 | AI102689 | k | | POP7 (processing of precursor, *S. cerevisaie*) homolog, RIKEN cDNA 0610037N12 gene |
| 599 | 19469 | AA892112 | r | | proline dehydrogenase, proline dehydrogenase (oxidase) 1 |
| 3781 | 1422 | NM_031324 | ss | | prolyl endopeptidase |
| 3319 | 1968 | NM_017091 | g | | proprotein convertase subtilisin/kexin type 2 |
| 379 | 6403 | AA858879 | y | | proteasome (prosome, macropain) 26S subunit, non-ATPase, 13 |
| 2661 | 18900 | AI233570 | ee | | proteasome (prosome, macropain) 26S subunit, non-ATPase, 8 |
| 3891 | 4325 | NM_031784 | u, v, tt | | protein inhibitor of activated STAT 1, protein inhibitor of activated STAT 3, protein inhibitor of activated STAT gamma, protein inhibitor of activated STAT3 |
| 4169 | 25405 | NM_133307 | s, t, mm | | protein kinase C, delta, protein kinase C, theta |
| 540 | 21952 | AA891537 | tt | | protein redicted by clone 23733 |
| 1650 | 10080 | AI058639 | General | | protein Z, vitamin K-dependent plasma glycoprotein |
| 3531 | 20035 | NM_021754 | qq | | PRP31 pre-mRNA processing factor 31 homolog (yeast), RIKEN cDNA 1500019O16 gene, nucleolar protein 5, nucleolar protein 5A (56 kD with KKE/D repeat), nucleolar protein NOP5/NOP58 |
| 3531 | 20036 | NM_021754 | r | | PRP31 pre-mRNA processing factor 31 homolog (yeast), RIKEN cDNA 1500019O16 gene, nucleolar protein 5, nucleolar protein 5A (56 kD with KKE/D repeat), nucleolar protein NOP5/NOP58 |
| 4183 | 21703 | NM_133525 | oo | | putative c-Myc-responsive |
| 2004 | 23653 | AI136396 | bb | | RAB geranylgeranyl transferase, b subunit, expressed sequence AA409500, farnesyltransferase, CAAX box, beta |
| 3035 | 24651 | M83678 | u, y, nn | | RAB10, member RAS oncogene family, RAB12, member RAS oncogene family, RAB13, member RAS oncogene family, RIKEN cDNA 0610007N03 gene, expressed sequence AW107754 |
| 4196 | 19822 | NM_133590 | x | | RAB7, member RAS oncogene family-like 1, RAB9, member RAS oncogene family, RAB9A, member RAS oncogene family, RAB9B, member RAS oncogene family, RIKEN cDNA 2810011A17 aene |
| 3424 | 20778 | NM_019124 | a, ww | | rabaptin 5, rabaptin-5 |
| 333 | 12769 | AA851192 | a, cc, jj | | Rag C protein, Rag D protein |
| 785 | 21213 | AA899991 | f, General | | Rag C protein, Rag D protein |
| 4299 | 9845 | NM_145672 | m | | *Rattus norvegicus* CXC chemokine RTCK1 (Rtck1) mRNA, complete cds, interleukin 8 |
| 2440 | 6455 | AI179984 | vv | | *Rattus norvegicus* kallistatin mRNA, complete cds, serine (or cysteine) proteinase inhibitor, clade F (alpha-2 antiplasmin, pigment epithelium derived factor), member 1, serine protease inhibitor 2 |
| 4287 | 4949 | NM_139338 | s | | *Rattus norvegicus* mRNA for NaPi-2 alpha, complete cds, Solute carrier family 17 (sodium/hydrogen exchanger), member 2, |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| | | | | | expressed sequence AI649385, solute carrier family 34 (sodium phosphate), member 1 |
| 3745 | 1515 | NM_031095 | uu | | renin binding protein |
| 3745 | 1516 | NM_031095 | x | | renin binding protein |
| 3745 | 1517 | NM_031095 | ss | | renin binding protein |
| 2502 | 23955 | AI229178 | e | | ret proto-oncogene (multiple endocrine neoplasia and medullary thyroid carcinoma 1, Hirschsprung disease) |
| 3619 | 17808 | NM_022699 | h, ll | | ribosomal protein L30 |
| 3579 | 1867 | NM_022510 | ee | | ribosomal protein L4 |
| 4069 | 24705 | NM_053850 | ww | | RIKEN cDNA 0610006A11 gene, biliverdin reductase A |
| 1474 | 7310 | AI013816 | ff | | RIKEN cDNA 0610006I08 gene, hypothetical protein MGC3196 |
| 2397 | 19041 | AI179049 | oo | | RIKEN cDNA 0610009J22 gene, RIKEN cDNA 1600023E10 gene, RIKEN cDNA 1700065B19 gene, expressed sequence AI854545, ring finger protein (C3H2C3 type) 6, ring finger protein 12 |
| 4217 | 23321 | NM_134407 | ss | | RIKEN cDNA 0610025K21 gene, aflatoxin B1 aldehyde reductase, aldo-keto reductase family 7, member A2 (aflatoxin aldehyde reductase) |
| 365 | 18001 | AA858573 | x, bb, gg, hh | | RIKEN cDNA 0610038O04 gene, secreted phosphoprotein 2, 24 kD |
| 1553 | 18002 | AI043655 | g, x, dd | | RIKEN cDNA 0610038O04 gene, secreted phosphoprotein 2, 24 kD |
| 4365 | 17999 | U19485 | a, g, x, bb, rr | | RIKEN cDNA 0610038O04 gene, secreted phosphoprotein 2, 24 kD |
| 4365 | 18000 | U19485 | g, x, cc, dd | | RIKEN cDNA 0610038O04 gene, secreted phosphoprotein 2, 24 kD |
| 964 | 14763 | AA944481 | s, ff, nn | | RIKEN cDNA 1110007F23 gene, angiopoietin 2, angiopoietin-like 3, angiopoietin-like 4, ficolin (collagen/fibrinogen domain containing lectin) 2 (hucolin), ficolin (collagen/fibrinogen domain containing) 1, ficolin B |
| 3981 | 23274 | NM_053467 | b, j, q, ee | | RIKEN cDNA 1110014L17gene, RIKEN cDNA 1810008K16 gene, RIKEN cDNA 2400003B06 gene, transmembrane trafficking protein |
| 3981 | 23276 | NM_053467 | n | | RIKEN cDNA 1110014L17 gene, RIKEN cDNA 1810008K16 gene, RIKEN cDNA 2400003B06 gene, transmembrane trafficking protein |
| 1126 | 2308 | AA964227 | l, General | | RIKEN cDNA 1110019K23 gene, methylene tetrahydrofolate dehydrogenase (NAD+ dependent), methenyltetrahydrofolate cyclohydrolase, methylenetetrahydrofolate dehydrogenase (NAD+dependent), methenyltetrahydrofolate cyclohydrolase, methylenetetrahydrofolate dehydrogenase (NADP+dependent), methenyltetrahydrofolate cyclohydrolase, formyltetrahydrofolate synthase |
| 4000 | 21940 | NM_053568 | General | | RIKEN cDNA 1110033E03 gene, phosphate cytidylyltransferase 2, ethanolamine |
| 4000 | 21941 | NM_053568 | ff | | RIKEN cDNA 1110033E03 gene, phosphate cytidylyltransferase 2, ethanolamine |
| 2207 | 6147 | AI172236 | u | | RIKEN cDNA 1110063B05 gene, cofactor required for Sp1 transcriptional activation, subunit 9 (33 kD) |
| 3545 | 20194 | NM_022192 | v | | RIKEN cDNA 1190005L05 gene, histidine triad nucleotide binding protein, histidine triad nucleotide binding protein 1, histidine triad nucleotide binding protein 2 |
| 3724 | 21095 | NM_031039 | e | | RIKEN cDNA 1300007J06 gene, RIKEN cDNA 2310022B03 gene, expressed sequence AU014768, glutamic pyruvate transaminase (alanine aminotransferase) 2, glutamic-pyruvate transaminase (alanine aminotransferase) |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3791 | 5821 | NM_031351 | ll | | RIKEN cDNA 1300011D16 gene, attractin, testis intracellular mediator protein |
| 4056 | 15800 | NM_053810 | w, cc | | RIKEN cDNA 1300018G05 gene, synaptosomal-associated protein, 29 kD |
| 3041 | 25467 | M93297 | t | | RIKEN cDNA 1300019H02 gene, RIKEN cDNA 2900006B13 gene, ornithine aminotransferase, ornithine aminotransferase (gyrate atrophy) |
| 3586 | 4242 | NM_022521 | xx | | RIKEN cDNA 1300019H02 gene, RIKEN cDNA 2900006B13 gene, ornithine aminotransferase, ornithine aminotransferase (gyrate atrophy) |
| 1866 | 15218 | AI102495 | cc | | RIKEN cDNA 1300019I21 gene, nucleoside phosphorylase |
| 1133 | 12563 | AA964533 | m | | RIKEN cDNA 1500003K04 gene, density-regulated protein |
| 2640 | 14098 | AI233114 | j | | RIKEN cDNA 1500004O06 gene, ubiquinol-cytochrome c reductase core protein II |
| 1959 | 21253 | AI105110 | ii, ww | | RIKEN cDNA 1500010M16 gene, translation factor sui1 homolog |
| 375 | 6380 | AA858758 | o | | RIKEN cDNA 1500031O19 gene, hypothetical protein MG012335 |
| 3276 | 20826 | NM_013218 | gg, hh | | RIKEN cDNA 1700018L02 gene, adenylate kinase 3 alpha like, expressed sequence AI506714 |
| 35 | 21120 | AA799526 | pp | | RIKEN cDNA 1700043E15 gene, small nuclear ribonucleoprotein D3 polypeptide (18 kD) |
| 175 | 1397 | AA817787 | s, General | | RIKEN cDNA 1700094M07 gene, potassium channel modulatory factor |
| 2200 | 1398 | AI172105 | kk | | RIKEN cDNA 1700094M07 gene, potassium channel modulatory factor |
| 4125 | 706 | NM_057147 | ll | | RIKEN cDNA 1810005O06 gene, SEC22 vesicle trafficking protein-like 1 (*S. cerevisaie*), vesicle trafficking protein |
| 2171 | 17529 | AI171460 | u | | RIKEN cDNA 1810026B04 gene, dicarbonyl/L-xylulose reductase, hydroxysteroid (17-beta) dehydrogenase 8, hypothetical protein BC014057, hypothetical protein FLJ14431, oxidoreductase UCPA |
| 346 | 883 | AA851347 | t | | RIKEN cDNA 2010006G21 gene, RIKEN cDNA 2810425K19 gene, sorting nexin 5 |
| 2777 | 14841 | AI237372 | v | | RIKEN cDNA 2310009A18 gene, RTC domain containing 1 |
| 706 | 16168 | XA893280 | z, nn | | RIKEN cDNA 2310076L09 gene, adipose differentiation related protein, adipose differentiation-related protein |
| 1546 | 16169 | AI030932 | nn, rr | | RIKEN cDNA 2310076L09 gene, adipose differentiation related protein, adipose differentiation-related protein |
| 2154 | 16170 | AI170894 | ii | | RIKEN cDNA 2310076L09 gene, adipose differentiation related protein, adipose differentiation-related protein |
| 2354 | 13389 | AI178104 | d | | RIKEN cDNA 2400009B11 gene, chromosome 11 open reading frame 13 |
| 2231 | 4926 | AI175034 | ll | | RIKEN cDNA 2410002O22 gene, hypothetical protein FLJ13611 |
| 3578 | 1610 | NM_022509 | ee, gg, hh | | RIKEN cDNA 2410004J23 gene, expressed sequence AI849087, splicing factor 30, survival of motor neuron-related, survival motor neuron, survival of motor neuron 1, telomeric |
| 3578 | 1611 | NM_022509 | h, l | | RIKEN cDNA 2410004J23 gene, expressed sequence AI849087, splicing factor 30, survival of motor neuron-related, survival motor neuron, survival of motor neuron 1, telomeric |
| 3759 | 1580 | NM_031117 | oo, ww | | RIKEN cDNA 2410045I01 gene, SNRPN upstream reading frame, small nuclear ribonucleoprotein B, small nuclear ribonucleoprotein N, small nuclear ribonucleoprotein polypeptide N, small nuclear ribonucleoprotein polypeptides B and B1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3564 | 13479 | NM_022390 | e, y, xx | | RIKEN cDNA 2610008L04 gene, quinoid dihydropteridine reductase |
| 3564 | 13480 | NM_022390 | r, ss | | RIKEN cDNA 2610008L04 gene, quinoid dihydropteridine reductase |
| 383 | 17559 | AA858994 | ll | | RIKEN cDNA 2610009E16 gene, parathymosin, prothymosin alpha |
| 3919 | 16257 | NM_031975 | l, s, General, ll, rr | | RIKEN cDNA 2610009E16 gene, parathymosin, prothymosin alpha |
| 4118 | 15151 | NM_057131 | ss | | RIKEN cDNA 2610101M19 gene, phosphoribosyl pyrophosphate synthetase-associated protein 2 |
| 382 | 16985 | AA858990 | rr | | RIKEN cDNA 2610301D06 gene, eukaryotic translation elongation factor 1 gamma |
| 441 | 4222 | AA860024 | ll, rr | | RIKEN cDNA 2610301D06 gene, eukaryotic translation elongation factor 1 gamma |
| 2930 | 16986 | H33020 | bb | | RIKEN cDNA 2610301D06 gene, eukaryotic translation elongation factor 1 gamma |
| 2294 | 3034 | AI176613 | b | | RIKEN cDNA 2610312E17 gene, RIKEN cDNA 2810047L02 gene, hypothetical protein DKFZp434F054, hypothetical protein FLJ12270, peroxisomal biogenesis factor 7, peroxisome biogenesis factor 7 |
| 3223 | 14421 | NM_013053 | o | | RIKEN cDNA 2700028P07 gene, tyrosine 3-monooxygenase/tryptophan 5-monooxygenase activation protein, theta polypeptide |
| 548 | 22858 | AA891591 | w | | RIKEN cDNA 2810401C16 gene, programmed cell death 8 (apoptosis inducing factor), programmed cell death 8 (apoptosis-inducing factor) |
| 3974 | 13903 | NM_053412 | General | | RIKEN cDNA 2810405J04 gene, interleukin enhancer binding factor 2, interleukin enhancer binding factor 2, 45 kD, interleukin enhancer binding factor 3, interleukin enhancer binding factor 3, 90 kD, zinc finger RNA binding protein |
| 3417 | 16381 | NM_017343 | l, y, z, General, ee | | RIKEN cDNA 2900073G15 gene, myosin regulatory light chain |
| 3417 | 16382 | NM_017343 | z | | RIKEN cDNA 2900073G15 gene, myosin regulatory light chain |
| 96 | 2098 | AA799995 | l | | RIKEN cDNA 3100001N19 gene, ribosomal protein L14 |
| 2441 | 2099 | AI180015 | w, tt | | RIKEN cDNA 3100001N19 gene, ribosomal protein L14 |
| 3638 | 18107 | NM_022949 | b, l, General, ee | | RIKEN cDNA 3100001N19 gene, ribosomal protein L14 |
| 1698 | 900 | AI059963 | i, jj | | RIKEN cDNA 3110021P21 gene, expressed sequence AI314976, syntaxin binding protein 2, vacuolar protein sorting 33B (yeast) |
| 3674 | 768 | NM_024382 | u, rr | | RIKEN cDNA 4833409F13 gene, expressed sequence AI303446, serine (or cysteine) proteinase inhibitor, clade D (heparin cofactor), member 1, serine (or cysteine) proteinase inhibitor, clade F (alpha-2 antiplasmin, pigment epithelium derived factor), member 2 |
| 119 | 19020 | AA800291 | e, h, n | | RIKEN cDNA 4921528H16 gene, discs, large homolog 3 (Drosophila), guanylate kinase 1, syntrophin, acidic 1, syntrophin, basic 2, syntrophin, beta 2 (dystrophin associated protein A1, 59 kD, basic component 2) |
| 2595 | 14102 | AI232131 | rr | | RIKEN cDNA 4930425N13 gene, hexosaminidase A, hexosaminidase A (alpha polypeptide) |
| 1093 | 16578 | AA957143 | d | | RIKEN cDNA 4930502N02 gene, dpy-30-like protein |
| 1093 | 16579 | AA957143 | bb | | RIKEN cDNA 4930502N02 gene, dpy-30-like protein |
| 2080 | 16580 | AI168989 | oo | | RIKEN cDNA 4930502N02 gene, dpy-30-like protein |
| 4243 | 23166 | NM_138839 | m, rr | | RIKEN cDNA 4930579A11 gene, likely ortholog of rat vacuole membrane protein 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 3989 | 18826 | NM_053523 | x, ff, nn, ss | | RIKEN cDNA 5031400M07 gene, homocysteine-inducible, endoplasmic reticulum stress-inducible, ubiquitin-like domain member 1, hypothetical protein FLJ22313 |
| 539 | 21951 | AA891535 | f, s, pp | | RIKEN cDNA 5730414C17 gene, hippocampus abundant gene transcript 1, hypothetical protein DKFZp564L0864 similar to HIAT1, hypothetical protein FLJ14753 |
| 4120 | 8592 | NM_057137 | q, xx | | RIKEN cDNA 5730442K12 gene, emopamil binding protein (sterol isomerase), emopamil binding related protein, delta8-delta7 sterol isomerase related protein, phenylalkylamine Ca2+ antagonist (emopamil) binding protein |
| 1686 | 6370 | AI059568 | g | | RIKEN cDNA 5830405C08 gene, Syntaxin 2, expressed sequence AU015105, syntaxin 1 b-like, syntaxin 1B1, syntaxin 1B2 |
| 516 | 16516 | AA875563 | x | | RIKEN cDNA 6030455P07 gene, calumenin, reticulocalbin, reticulocalbin 1, EF-hand calcium binding domain, reticulocalbin 2, reticulocalbin 2, EF-hand calcium bindino domain |
| 471 | 17303 | AA874990 | u | | RIKEN cDNA 6330407G1 1 gene, hypothetical protein FLJ10342 |
| 465 | 16082 | AA874887 | ww | | RIKEN cDNA C030018L16 gene, SMO (segregation of mitotic chromosomes 1)-like 1 (yeast), SMC (structural maintenace of chromosomes 1)-like 2 (*S. cerevisiae*), SMC (structural maintenance of chromosomes 1)-like 1 (*S. cerevisiae*), SMOl structural maintenance of chromosomes 1-like 1 (yeast), SMC4 structural maintenance of chromosomes 4-like 1 (yeast) |
| 4090 | 16552 | NM_053961 | General | | RIKEN cDNA C030022K24 gene, chromosome 12 open reading frame 8, endoplasmic reticulum protein 29 |
| 4090 | 16554 | NM_053961 | f | | RIKEN cDNA C030022K24 gene, chromosome 12 open reading frame 8, endoplasmic reticulum protein 29 |
| 63 | 20995 | AA799724 | General | | RNA polymerase 1-3 (16 kDa subunit), RNA polymerase 116 kDa subunit |
| 63 | 20996 | AA799724 | b, f, General, kk, nn, qq | | RNA polymerase 1-3 (16 kDa subunit), RNA polymerase 116 kDa subunit |
| 2953 | 23485 | K02816 | ww | | RNA polymerase II transcriptional coactivator, activated RNA polymerase II transcription cofactor 4 |
| 2953 | 23486 | K02816 | kk, ww | | RNA polymerase II transcriptional coactivator, activated RNA polymerase II transcription cofactor 4 |
| 105 | 23329 | AA800126 | tt | | RNA-binding region (RNP1, RRM) containing 2 |
| 1613 | 6609 | AI045458 | ii, tt | | RNA-binding region (RNP1, RRM) containing 2 |
| 2843 | 14606 | AI639342 | d | | S164 protein |
| 262 | 813645 | AI232694 | tt | | 4SEC24 related gene family, member C(*S. cerevisaie*) |
| 582 | 23862 | AA891933 | g | | second mitochondrea-derived activator of caspase |
| 4142 | 6143 | NM_080892 | e | | selenium binding protein 1, selenium binding protein 2 |
| 588 | 17088 | AA891998 | General, cc, oo, uu | | sequestosome 1 |
| 232 | 5527 | AA819027 | gg, hh | | serine hydroxymethyltransferase 1 (soluble) |
| 1326 | 9150 | AI009198 | h | | serine/threonine kinase receptor associated protein, unr-interacting protein |
| 824 | 22980 | AA923973 | y | | seven in absentia 1A, seven in absentia 1B, seven in absentia 2, seven in absentia homolog 1 (*Drosophila*), seven in absentia homolog 2 (*Drosophila*) |
| 2489 | 21822 | AI228642 | oo | | seven transmembrane domain protein |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4224 | 1440 | NM_134456 | u | | SH2-B PH domain containing signaling mediator 1, SH2-B homolog, adaptor protein with pleckstrin homology and src, adaptor protein with pleckstrin homology and src homology 2 domains, src homology 2 domain-containing transforming protein C3 |
| 2196 | 7733 | AI172086 | z | | SH3 domain binding glutamic acid-rich protein like 3, SH3 domain binding glutamic acid-rich protein-like 3 |
| 3788 | 11962 | NM_031337 | rr | | sialyltransferase 9 (CMP-NeuAc:lactosylceramide alpha-2,3-sialyltransferase), sialyltransferase 9 (CMP-NeuAc:lactosylceramide alpha-2,3-sialyltransferase: GM3 synthase) |
| 3788 | 11963 | NM_031337 | xx | | sialyltransferase 9 (CMP-NeuAc:lactosylceramide alpha-2,3-sialyltransferase), sialyltransferase 9 (CMP-NeuAc:lactosylceramide alpha-2,3-sialyltransferase: GM3 synthase) |
| 3637 | 18100 | NM_022948 | y | | sideroflexin 1, sideroflexin 2, sideroflexin 3 |
| 2663 | 7888 | AI233583 | n, kk | | similar to arginyl-tRNA synthetase |
| 170 | 21437 | AA801230 | z | | similar to HYPOTHETICAL 34.0 KDA PROTEIN ZK795.3 IN CHROMOSOME IV |
| 4265 | 1674 | NM_139086 | e | | similar to putative, syncollin |
| 2166 | 11518 | AI171272 | e | | similar to S. cerevisiae RER1 |
| 944 | 21600 | AA943997 | r | | Sjogren's syndrome/scleroderma autoantigen 1, Sjogren's syndrome/scleroderma autoantigen 1 homolog (human) |
| 208 | 6332 | AA818406 | u | | Sm protein F |
| 1169 | 2939 | M996885 | ll | | small inducible cytokine A19, small inducible cytokine subfamily A (Cys—Cys), member 19 |
| 3548 | 20269 | NM_022214 | bb | | small inducible cytokine B subfamily, member 5, small inducible cytokine subfamily B (Cys-X-Cys), member 5 (epithelial-derived neutrophil-activating peptide 78), small inducible cytokine subfamily B (Cys-X-Cys), member 6 (granulocyte chemotactic protein 2) |
| 3009 | 17123 | M29295 | nn, tt | | small nuclear ribonucleoprotein B, small nuclear ribonucleoprotein polypeptides B and B1 |
| 1875 | 23538 | AI102727 | l, n, p | | solute carrier family 20 (phosphate transporter), member 1, solute carrier family 20 (phosphate transporter), member 2, solute carrier family 20, member 1, solute carrier family 20, member 2 |
| 641 | 17468 | AA892545 | General | | solute carrier family 22 (organic cation transporter), member 1-like |
| 3790 | 4346 | NM_031343 | k | | solute carrier family 6 (neurotransmitter transporter, noradrenalin), member 2 |
| 3521 | 17340 | NM_021594 | General, dd | | solute carrier family 9 (sodium/hydrogen exchanger), isoform 3 regulator 1, solute carrier family 9 (sodium/hydrogen exchanger), isoform 3 regulator 2, solute carrier family 9 (sodium/hydrogen exchanger), isoform 3 regulatory factor 1, solute carrier family 9 (sodium/hydrogen exchanger) isoform 3 regulatory factor 2 |
| 469 | 15115 | AA874928 | r, v | | sorting nexin 4 |
| 2769 | 11404 | AI237002 | v, w, bb | | spermidine synthase, spermine synthase |
| 2495 | 15078 | AI228830 | s | | stearoyl-CoA desaturase (delta-9-desaturase), stearoyl-Coenzyme A desaturase 2 |
| 2731 | 20788 | AI236053 | qq | | sterol O-acyltransferase 1, sterol O-acyltransferase 2 |
| 3580 | 2384 | NM_022513 | b, k, l, qq, uu, vv | | sulfotransferase family 1B, member 1, sulfotransferase family, cytosolic, 1B, member 1 |
| 908 | 11691 | AA926193 | t, mm | | sulfotransferase family, cytosolic, 1C, member 1 |
| 2077 | 11693 | AI168953 | mm | | sulfotransferase family, cytosolic, 1C, member 1 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 816 | 17096 | AA901343 | g | | suppressor of G2 allele of SKP1, *S. cerevisiae*, homolog of |
| 2051 | 12482 | AI144965 | p | | SWI/SNE related, matrix associated, actin dependent regulator of chromatin, subfamily a, member 4 |
| 660 | 4524 | AA892759 | f, s, ff, pp, qq, vv | | synaptosomal-associated protein, 23 kD |
| 1005 | 13751 | AA945699 | kk | | synaptosomal-associated protein, 23 kD |
| 3615 | 20509 | NM_022689 | f, cc, dd, ff | | synaptosomal-associated protein, 23 kD |
| 3701 | 25130 | NM_030991 | k | | synaptosomal-associated protein, 25 kDa, synaptosomal-associated protein, 25 kD |
| 1572 | 5431 | AI044257 | l | | syndecan binding protein, syndecan binding protein (syntenin), syndecan binding protein (syntenin) 2, syntenin |
| 2199 | 6057 | AI172102 | dd | | syntaxin 18 |
| 2713 | 22070 | AI235528 | jj | | synuclein, gamma, synuclein, gamma (breast cancer-specific protein 1) |
| 2042 | 6898 | AI144623 | p | | thyroid hormone receptor interactor 3 |
| 2703 | 15004 | AI235224 | k | | tissue inhibitor of metalloproteinase, tissue inhibitor of metalloproteinase 1 (erythroid potentiating activity, collagenase inhibitor) |
| 1623 | 6808 | AI045600 | a | | TRAM-like protein, translocating chain-associating membrane protein |
| 3899 | 16039 | NM_031811 | b, c, ee, xx | | transaldolase 1 |
| 3264 | 24774 | NM_013176 | uu | | transcription factor 12, transcription factor 12 (HTF4, helix-loop-helix transcription factors 4) |
| 239 | 9000 | AA819318 | r | | transcription factor-like 1 |
| 3971 | 13492 | NM_053400 | ss | | transducin-like enhancer of split 1 (E(sp1) homolog, *Drosophila*), transducin-like enhancer of split 1, homolog of *Drosophila* E(sp1), transducin-like enhancer of split 2 (E(sp1) homolog, *Drosophila*), transducin-like enhancer of split 2, homolog of *Drosophila* E(sp1), transducin-like enhancer of split 3 (E(sp1) homolog, *Drosophila*), transducin-like enhancer of split 3, homolog of *Drosophila* E(spl) |
| 2071 | 23224 | AI146033 | h, z, ll | | translocase of inner mitochondrial membrane 10 homolog (yeast), translocase of inner mitochondrial membrane 9 homolog (yeast) |
| 155 | 19102 | AA800794 | ww | | tripartite motif-containing 32 |
| 1125 | 2270 | AA964116 | s | | tripartite motif-containing 37 |
| 911 | 14223 | AA926352 | h | | TRK-fused gene, Trk-fused gene |
| 2560 | 14224 | AI230956 | rr | | TRK-fused gene, Trk-fused gene |
| 188 | 2431 | AA817945 | ff | | tubulin cofactor a, tubulin-specific chaperone a |
| 617 | 17405 | AA892313 | ii, rr | | tubulin-specific chaperone e |
| 1432 | 5528 | AI012631 | bb, qq | | tumor antigen SLP-8p |
| 2033 | 14396 | AI137689 | s | | tumor antigen SLP-8p |
| 552 | 9090 | AA891690 | h, s | | tumor necrosis factor (ligand) superfamily, member 13 |
| 2290 | 3619 | AI176588 | vv | | tumor protein p53-binding protein |
| 3399 | 707 | NM_017293 | b | | U2 small nuclear ribonucleoprotein auxiliary factor (65 kD), U2 small nuclear ribonucleoprotein auxiliary factor (U2AF), 65 kDa, dual-specificity tyrosine-(Y)-phosphorylation regulated kinase 2, kinase interacting with leukemia-associated gene (stathmin) |
| 630 | 16469 | AA892462 | j, mm | | ubiquinol-cytochrome c reductase (6.4 kD) subunit |
| 906 | 16468 | AA926137 | p, t, y, mm | | ubiquinol-cytochrome C reductase (6.4 kD) subunit |
| 1303 | 17359 | AI007981 | mm | | ubiquinol-cytochrome c reductase complex (7.2 kD) |
| 1989 | 2501 | AI112343 | f, nn, ww | | ubiquitin fusion degradation 1 like, ubiquitin fusion degradation 1-like |
| 1761 | 9259 | AI071606 | q | | ubiquitin specific protease 1 |
| 699 | 3877 | AA893224 | d | | ubiquitin specific protease 19 |
| 1104 | 18413 | AA957763 | ff | | ubiquitin specific protease 19 |
| 4149 | 18027 | NM_130407 | e | | UDP glycosyltransferase 1 family, polypeptide A8 |

TABLE 2-continued

| SEQ ID NO. | GLGC ID NO. | GenBank Acc. or RefSeq ID No. | Model Code | Human Homologous Gene Name | Human Homologous Cluster Title |
|---|---|---|---|---|---|
| 4149 | 18028 | NM_130407 | e | | UDP glycosyltransferase 1 family, polypeptide A8 |
| 1272 | 13464 | AF047707 | f, ss | | UDP-glucose ceramide glucosyltransferase |
| 3782 | 18597 | NM_031325 | y, uu | | UDP-glucose dehydrogenase |
| 823 | 12354 | AA923957 | a, k, cc, tt | | UDP-N-acteylglucosamine pyrophosphorylase 1 |
| 693 | 14859 | AA893173 | e | | vacuolar protein sorting 29 (*S. pombe*), vacuolar protein sorting 29 (yeast) |
| 2401 | 5887 | AI179099 | j, o | | vanin 1 |
| 4251 | 4593 | NM_138881 | a | | vipirin, viral hemorrhagic septicemia virus(VHSV) induced gene 1 |
| 4251 | 4594 | NM_138881 | a, qq | | vipirin, viral hemorrhagic septicemia virus(VHSV) induced gene 1 |
| 4251 | 4595 | NM_138881 | k | | vipirin, viral hemorrhagic septicemia virus(VHSV) induced gene 1 |
| 3792 | 18538 | NM_031353 | t, y, mm | | voltage-dependent anion channel 1 |
| 3792 | 18539 | NM_031353 | t, mm | | voltage-dependent anion channel 1 |
| 3533 | 17884 | NM_021765 | q | | WD repeat domain 1, coatomer protein complex, subunit alpha, coatomer protein complex, subunit beta 2 (beta prime), expressed sequence AI256832 |
| 3533 | 17885 | NM_021765 | q | | WD repeat domain 1, coatomer protein complex, subunit alpha, coatomer protein complex, subunit beta 2 (beta prime), expressed sequence AI256832 |
| 2772 | 3355 | AA848530 | l, bb | | WD repeat domain 12, retinoblastoma binding protein 4, retinoblastoma binding protein 7 |
| 2728 | 13617 | AI236021 | d | | X-box binding protein 1 |
| 103 | 9202 | AA800053 | c | | zinc finger protein 363 |
| 3771 | 1201 | NM_031150 | v | | zona pellucida glycoprotein 2, zona pellucida glycoprotein 2 (sperm receptor) |
| 4310 | 6824 | NM_147138 | ll, ss | | ZW10 interactor |

TABLE 3

| SEQ ID NO. | GLGC ID NO. | GenBank Acc. or RefSeq ID No. | Model Code | Pathways |
|---|---|---|---|---|
| 3242 | 24195 | NM_013111 | f, q | Actions of Nitric Oxide in the Heart |
| 3242 | 24196 | NM_013111 | f, l, q, z, General, dd | Actions of Nitric Oxide in the Heart |
| 3005 | 668 | M25823 | jj | Activation of Csk by cAMP-dependent Protein Kinase Inhibits Signaling through the T Cell Receptor, B Lymphocyte Cell Surface Molecules, Lck and Fyn tyrosine kinases in initiation of TCR Activation, Phosphatidylinositol signaling system, T Cytotoxic Cell Surface Molecules, T Helper Cell Surface Molecules |
| 3121 | 24545 | NM_012713 | s | Activation of PKC through G protein coupled receptor, Angiotensin II mediated activation of JNK Pathway via Pyk2 dependent signaling, Apoptotic Signaling in Response to DNA Damage, Attenuation of GPCR Signaling, BCR Signaling Pathway, Bioactive Peptide Induced Signaling Pathway, CCR3 signaling in Eosinophils, CXCR4 Signaling Pathway, EGF Signaling Pathway, Effects of calcinurin in Keratinocyte Differentiation, Fc Epsilon Receptor I Signaling in Mast Cells, Growth Hormone Signaling Pathway, Ion Channel and Phorbal Esters Signaling Pathway, Links between Pyk2 and Map Kinases, PDGF Signaling Pathway, PKC-catalyzed phosphorylation of inhibitory phosphoprotein of myosin phosphatase, Pertussis toxin-insensitive CCR5 Signaling in Macrophage, Phospholipase C Signaling Pathway, Phospholipase C d1 in phospholipid associated cell signaling, Regulation of eIF4e and p70 S6 Kinase, Signaling Pathway from G-Protein Families, T Cell Receptor Signaling Pathway, TPO Signaling Pathway, Thrombin signaling and protease-activated receptors, Transcription factor CREB and its extracellular signals, Trka Receptor Signaling Pathway, egf, g-Secretase mediated ErbB4 Signaling Pathway, pdgf |
| 3193 | 2554 | NM_012967 | vv | Adhesion Molecules on Lymphocyte, B Lymphocyte Cell Surface Molecules, CTL mediated immune response against target cells, Cells and Molecules involved in local acute inflammatory response, Monocyte and its Surface Molecules, Neutrophil and Its Surface Molecules, T Cytoxic Cell Surface Molecules, T Helper Cell Surface Molecules |
| 3193 | 2555 | NM_012967 | vv | Adhesion Molecules on Lymphocyte, B Lymphocyte Cell Surface Molecules, CTL mediated immune response against target cells, Cells and Molecules involved in local acute inflammatory response, Monocyte and its Surface Molecules, Neutrophil and Its Surface Molecules, T Cytoxic Cell Surface Molecules, T Helper Cell Surface Molecules |
| 4394 | 25642 | U77697 | gg, hh | Adhesion Molecules on Lymphocyte, Cell to Cell Adhesion Signaling, Monocyte and its Surface Molecules, Neutrophil and Its Surface Molecules |

TABLE 3-continued

| SEQ ID NO. | GLGC ID NO. | GenBank Acc. or RefSeq ID No. | Model Code | Pathways |
|---|---|---|---|---|
| 2330 | 14989 | AI177366 | b | Adhesion Molecules on Lymphocyte, Cells and Molecules involved in local acute inflammatory response, Erk and PI-3 Kinase Are Necessary for Collagen Binding in Corneal Epithelia, Erk1/Erk2 Mapk Signaling pathway, Integrin Signaling Pathway, Monocyte and its Surface Molecules, PTEN dependent cell cycle arrest and apoptosis, Ras-Independent pathway in NK cell-mediated cytotoxicity |
| 4453 | 25090 | X63594 | ii | AKT Signaling Pathway, ATM Signaling Pathway, Acetylation and Deacetylation of RelA in The Nucleus, Activation of PKC through G protein coupled receptor, CD40L Signaling Pathway, Double Stranded RNA Induced Gene Expression, Erythropoietin mediated neuroprotection through NF-kB, HIV-I Nef: negative effector of Fas and TNF, Induction of apoptosis through DR3 and DR4/5 Death Receptors, Influence of Ras and Rho proteins on G1 to S Transition, NF-kB Signaling Pathway, Neuropeptides VIP and PACAP inhibit the apoptosis of activated T cells, Signal transduction through IL1R, T Cell Receptor Signaling Pathway, TNF/Stress Related Signaling, TNFR2 Signaling Pathway, The 41BB-dependent immune response, Toll-Like Receptor Signaling, interact6-1 |
| 3222 | 16683 | NM_013052 | r | AKT Signaling Pathway, Cell Cycle: G2/M Checkpoint, Control of skeletal myogenesis by HDAC & calcium/calmodulin-dependent kinase (CaMK), Multiple antiapoptotic pathways from IGF-1R signaling lead to BAD phosphphorylation, RB Tumor Suppressor/Checkpoint Signaling in response to DNA damage, Regulation of BAD phosphorylation, Role of nicotinic acetylcholine receptors in the regulation of apoptosis, Signal Dependent Regulation of Myogenesis by Corepressor MITR, cdc25 and chk1 Regulatory Pathway in response to DNA damage |
| 3222 | 16684 | NM_013052 | pp | AKT Signaling Pathway, Cell Cycle: G2/M Checkpoint, Control of skeletal myogenesis by HDAC & calcium/calmodulin-dependent kinase (CaMK), Multiple antiapoptotic pathways from IGF-1R signaling lead to BAD phosphphorylation, RB Tumor Suppressor/Checkpoint Signaling in response to DNA damage, Regulation of BAD phosphorylation, Role of nicotinic acetylcholine receptors in the regulation of apoptosis, Signal Dependent Regulation of Myogenesis by Corepressor MITR, cdc25 and chk1 Regulatory Pathway in response to DNA damage |
| 3302 | 3202 | NM_017039 | t | AKT Signaling Pathway, ChREBP regulation by carbohydrates and cAMP, Erk1/Erk2 Mapk Signaling pathway, Inactivation of Gsk3 by AKT causes accumulation of b-catenin in Alveolar Macrophages, Regulation of ck1/cdk5 by type 1 glutamate receptors, Skeletal muscle hypertrophy is regulated via AKT/mTOR pathway, WNT Signaling Pathway, mTOR Signaling Pathway |
| 3302 | 3203 | NM_017039 | oo | AKT Signaling Pathway, ChREBP regulation by carbohydrates and cAMP, Erk1/Erk2 Mapk Signaling pathway, Inactivation of Gsk3 by AKT causes accumulation of b-catenin in Alveolar Macrophages, Regulation of ck1/cdk5 by type 1 glutamate receptors, Skeletal muscle hypertrophy is regulated via AKT/mTOR pathway, WNT Signaling Pathway, mTOR Signaling Pathway |
| 1376 | 17524 | AI010568 | ss | AKT Signaling Pathway, Growth Hormone Signaling Pathway, Regulation of eIF4e and p70 S6 Kinase |
| 873 | 21010 | AA925306 | o | Alanine and aspartate metabolism |
| 3076 | 20744 | NM_012571 | e, ll, oo | Alanine and aspartate metabolism, Alkaloid biosynthesis I, Arginine and proline metabolism, Carbon fixation, Cysteine metabolism, Glutamate metabolism, Malate-aspartate shuttle, Phenylalanine metabolism, Phenylalanine, tyrosine and tryphophan biosynthesis, Tyrosine metabolism |
| 3524 | 23424 | NM_021680 | x, z | Alanine and aspartate metabolism, Aminoacyl-tRNA biosynthesis |
| 3233 | 1583 | NM_013079 | a, m, s, General, dd | Alanine and aspartate metabolism, Aminoacyl-tRNA biosynthesis, Nitrogen metabolism |
| 3783 | 4234 | NM_031330 | m, ff | Alanine and aspartate metabolism, Arginine and proline metabolism, Urea cycle and metabolism of amino groups |
| 4412 | 20597 | X12459 | b, ff | Alanine and aspartate metabolism, Arginine and proline metabolism, Urea cycle and metabolism of amino groups |
| 3517 | 18727 | NM_021577 | g, m | Alanine and aspartate metabolism, Arginine and proline metabolism, Urea cycle and metabolism of amino groups |
| 3724 | 21095 | NM_031039 | e | Alanine and aspartate metabolism, Carbon fixation, Glutamate metabolism |
| 3132 | 1478 | NM_012744 | kk | Alanine and aspartate metabolism, Citrate cycle (TCA cycle), Pyruvate metabolism |
| 3905 | 7914 | NM_031835 | b, h, l, General, nn | Alanine and aspartate metabolism, Glycine, serine and threonine metabolism |
| 3103 | 24825 | NM_012668 | x, ee, ss | Alkaloid biosynthesis I, Phenylalanine metabolism, Phenylalanine, tyrosine and tryptophan biosynthesis, Tyrosine metabolism |
| 4389 | 25083 | U72632 | nn | Alkaloid biosynthesis II, Arginine and proline metabolism, Glycine, serine and threonine metabolism, Histidine metabolism, Phenylalanine metabolism, Tryptophan metabolism, Tyrosine metabolism, beta-Alanine metabolism |
| 3092 | 23522 | NM_012615 | c, g, l, m, n, w, General, kk | Alkaloid biosynthesis II, Arginine and proline metabolism, Urea cycle and metabolism of amino groups |
| 3092 | 23523 | NM_012615 | l, v | Alkaloid biosynthesis II, Arginine and proline metabolism, Urea cycle and metabolism of amino groups |
| 3440 | 7489 | NM_019169 | g | Alpha-synuclein and Parkin-mediated proteolysis in Parkinson's disease, Role of Parkin in Ubiquitin-Proteasomal Pathway |
| 3287 | 1958 | NM_016994 | b, General, uu, vv | Alternative Complement Pathway, Cells and Molecules involved in local acute inflammatory response, Classic Complement Pathway, Complement Pathway, Lectin Induced Complement Pathway |
| 3287 | 1959 | NM_016994 | f, u, uu | Alternative Complement Pathway, Cells and Molecules involved in local acute inflammatory response, Classic Complement Pathway, Complement Pathway, Lectin Induced Complement Pathway |
| 231 | 5331 | AA818996 | ii, rr | Aminoacyl-tRNA biosynthesis, Glutamate metabolism |
| 196 | 16756 | AA818089 | q, z | Aminoacyl-tRNA biosynthesis, Glycine, serine and threonine metabolism |
| 735 | 12031 | AA893860 | General | Aminoacyl-tRNA biosynthesis, Glycine, serine and threonine metabolism |

TABLE 3-continued

| SEQ ID NO. | GLGC ID NO. | GenBank Acc. or RefSeq ID No. | Model Code | Pathways |
|---|---|---|---|---|
| 1096 | 2702 | AA957307 | l, l, p, z, General, dd, ii, pp, qq, rr | Aminoacyl-tRNA biosynthesis, Glycine, serine and threonine metabolism |
| 4131 | 23129 | NM_078622 | t, ff | Aminophosphonate metabolism, Glycerolipid metabolism |
| 3404 | 23130 | NM_017307 | j, z, General | Aminophosphonate metabolism, Glycerolipid metabolism, Shuttle for transfer of acetyl groups from mitochrondria to the cytosol |
| 4044 | 7927 | NM_053765 | e, t | Aminosugars metabolism |
| 3745 | 1515 | NM_031095 | uu | Aminosugars metabolism |
| 3745 | 1516 | NM_031095 | x | Aminosugars metabolism |
| 3745 | 1517 | NM_031095 | ss | Aminosugars metabolism |
| 3127 | 1372 | NM_012734 | xx | Aminosugars metabolism, Erythromycin biosynthesis, Fructose and mannose metabolism, Galactose metabolism, Glycolysis/Gluconeogensis, Glycolysis Pathway, Starch and sucrose metabolism |
| 3542 | 17100 | NM_022179 | d, h, l, ee | Aminosugars metabolism, Erythromycin biosynthesis, Fructose and mannose metabolism, Galactose metabolism, Glycolysis/Gluconeogensis, Starch and sucrose metabolism |
| 3542 | 17101 | NM_022179 | b, General, ii, kk, ss | Aminosugars metabolism, Erythromycin biosynthesis, Fructose and mannose metabolism, Galactose metabolism, Glycolysis/Gluconeogensis, Starch and sucrose metabolism |
| 3073 | 619 | NM_012565 | h, r, kk | Aminosugars metabolism, Erythromycin biosynthesis, Fructose and mannose metabolism, Galactose metabolism, Glycolysis/Gluconeogensis, Starch and sucrose metabolism |
| 3300 | 24861 | NM_017033 | p, General | Aminosugars metabolism, Erythromycin biosynthesis, Galactose metabolism, Glycolysis/Gluconeogenesis, Pentose phosphate pathway, Starch and sucrose metabolism, Streptomycin biosynthesis |
| 3300 | 24862 | NM_017033 | x, General | Aminosugars metabolism, Erythromycin biosynthesis, Galactose metabolism, Glycolysis/Gluconeogenesis, Pentose phosphate pathway, Starch and sucrose metabolism, Streptomycin biosynthesis |
| 2020 | 23788 | AI137176 | ss | Aminosugars metabolism, Glycosaminoglycan degradation |
| 3678 | 713 | NM_024391 | pp | Androgen and estrogen metabolism |
| 3679 | 25070 | NM_024392 | o, General | Androgen and estrogen metabolism |
| 3679 | 9929 | NM_024392 | p, w, ss | Androgen and estrogen metabolism |
| 3679 | 9931 | NM_024392 | o, xx | Androgen and estrogen metabolism |
| 3372 | 21743 | NM_017235 | jj | Androgen and estrogen metabolism |
| 3372 | 21744 | NM_017235 | bb, ii, jj | Androgen and estrogen metabolism |
| 2946 | 20429 | J05035 | t, xx | Androgen and estrogen metabolism, Bile acid biosynthesis |
| 2946 | 20430 | J05035 | bb, qq | Androgen and estrogen metabolism, Bile acid biosynthesis |
| 4351 | 20431 | S81448 | qq, xx | Androgen and estrogen metabolism, Bile acid biosynthesis |
| 3080 | 17292 | NM_012584 | General, cc | Androgen and estrogen metabolism, C21-Steroid hormone metabolism |
| 3316 | 23660 | NM_017080 | a, l, vv | Androgen and estrogen metabolism, C21-Steroid hormone metabolism, Visceral Fat Deposits and the Metabolic Syndrome |
| 4112 | 5492 | NM_057105 | e | Androgen and estrogen metabolism, Pentose and glucuronate interconversions, Porphyrin and chlorophyll metabolism, Starch and sucrose metabolism |
| 4112 | 5493 | NM_057105 | e | Androgen and estrogen metabolism, Pentose and glucuronate interconversions, Porphyrin and chlorophyll metabolism, Starch and sucrose metabolism |
| 4112 | 15124 | NM_057105 | jj | Androgen and estrogen metabolism, Pentose and glucuronate interconversions, Porphyrin and chlorophyll metabolism, Starch and sucrose metabolism |
| 4112 | 15126 | NM_057105 | t, jj | Androgen and estrogen metabolism, Pentose and glucuronate interconversions, Porphyrin and chlorophyll metabolism, Starch and sucrose metabolism |
| 4112 | 15127 | NM_057105 | k, t, General, mm | Androgen and estrogen metabolism, Pentose and glucuronate interconversions, Porphyrin and chlorophyll metabolism, Starch and sucrose metabolism |
| 3804 | 14633 | NM_031533 | b, l, s, General, vv | Androgen and estrogen metabolism, Pentose and glucuronate interconversions, Porphyrin and chlorophyll metabolism, Starch and sucrose metabolism |
| 4321 | 14632 | NM_153314 | f, uu | Androgen and estrogen metabolism, Pentose and glucuronate interconversions, Porphyrin and chlorophyll metabolism, Starch and sucrose metabolism |
| 2894 | 15123 | D38066 | j, t, mm, xx | Androgen and estrogen metabolism, Pentose and glucuronate interconversions, Porphyrin and chlorophyll metabolism, Starch and sucrose metabolism |
| 4321 | 11755 | NM_153314 | b, l, s, General, cc, vv | Androgen and estrogen metabolism, Pentose and glucuronate interconversions, Porphyrin and chlorophyll metabolism, Starch and sucrose metabolism |
| 3166 | 16301 | NM_012883 | g, w, rr | Androgen and estrogen metabolism, Sulfur metabolism |
| 3166 | 4282 | NM_012883 | rr | Androgen and estrogen metabolism, Sulfur metabolism |
| 3115 | 18719 | NM_012695 | n, dd, ii, uu | Androgen and estrogen metabolism, Sulfur metabolism |
| 3377 | 17562 | NM_017245 | h, t, mt | Angiotensin II mediated activation of JNK Pathway via Pyk2 dependent signaling, Anthrax Toxin Mechanism of Action, Bioactive Peptide Induced Signaling Pathway, Erk1/Erk2 Mapk Signaling pathway, Integrin Signaling Pathway, Links between Pyk2 and Map Kinases, MAPKinase Signaling Pathway, Phosphorylation of MEK1 by cdk5/p35 down regulates the MAP kinase pathway |
| 4164 | 17560 | NM_133283 | e, t, mm | Angiotensin II mediated activation of JNK Pathway via Pyk2 dependent signaling, Anthrax Toxin Mechanism of Action, Bioactive Peptide Induced Signaling Pathway, Erk1/Erk2 Mapk Signaling pathway, Integrin Signaling Pathway, Links between Pyk2 and Map Kinases, MAPKinase Signaling Pathway, Phosphorylation of MEK1 by cdk5/p35 down regulates the MAP kinase pathway |

TABLE 3-continued

| SEQ ID NO. | GLGC ID NO. | GenBank Acc. or RefSeq ID No. | Model Code | Pathways |
|---|---|---|---|---|
| 4164 | 17564 | NM_133283 | ff | Angiotensin II mediated activation of JNK Pathway via Pyk2 dependent signaling, Anthrax Toxin Mechanism of Action, Bioactive Peptide Induced Signaling Pathway, Erk1/Erk2 Mapk Signaling pathway, Integrin Signaling Pathway, Links between Pyk2 and Map Kinases, MAPKinase Signaling Pathway, Phosphorylation of MEK1 by cdk5/p35 down regulates the MAP kinase pathway |
| 4164 | 21848 | NM_133283 | v, y | Angiotensin II mediated activation of JNK Pathway via Pyk2 dependent signaling, Anthrax Toxin Mechanism of Action, Bioactive Peptide Induced Signaling Pathway, Erk1/Erk2 Mapk Signaling pathway, Integrin Signaling Pathway, Links between Pyk2 and Map Kinases, MAPKinase Signaling Pathway, Phosphorylation of MEK1 by cdk5/p35 down regulates the MAP kinase pathway |
| 4164 | 21849 | NM_133283 | ff | Angiotensin II mediated activation of JNK Pathway via Pyk2 dependent signaling, Anthrax Toxin Mechanism of Action, Bioactive Peptide Induced Signaling Pathway, Erk1/Erk2 Mapk Signaling pathway, Integrin Signaling Pathway, Links between Pyk2 and Map Kinases, MAPKinase Signaling Pathway, Phosphorylation of MEK1 by cdk5/p35 down regulates the MAP kinase pathway |
| 3098 | 20798 | NM_012639 | ll | Angiotensin II mediated activation of JNK Pathway via Pyk2 dependent signaling, BCR Signaling Pathway, Bioactive Peptide Induced Signaling Pathway, CCR3 signaling in Eosinophils, CXCR4, EGF & EPO signaling pathways, Erk and PI-3 Kinase Are Necessary for Collagen Binding in Corneal Epithelia, Erk1/Erk2 Mapk Signaling pathway, Fc Epsilon Receptor I Signaling in Mast Cells, Growth Hormone Signaling Pathway, IGF-1 Signaling Pathway, IL 2, 3 & 6 signaling pathways, IL-2 Receptor B Protein Interaction Pathway, Influence of Ras and Rho proteins on G1 to S Transition, Inhibition of Cellular Proliferation by Gleevec, Insulin Signaling Pathway, Integrin Signaling Pathway, Links between Pyk2 and Map Kinases, MAPKinase Signaling Pathway, Multiple antiapoptotic pathways from IGF-1R signaling lead to BAD phosphphorylation, Nerve growth factor pathway (NGF), PDGF Signaling Pathway, Phosphorylation of MEK1 by cdk5/p35 down regulates the MAP kinase pathway, Ras Signaling Pathway, Signaling Pathway from G-Protein Families, T Cell Receptor Signaling Pathway, TPO Signaling Pathway, egf, epo, igf-1, il2, il3, il6, insulin, interact6-1, ngf, pdgf, tpo |
| 3098 | 20799 | NM_012639 | p | Angiotensin II mediated activation of JNK Pathway via Pyk2 dependent signaling, BCR Signaling Pathway, Bioactive Peptide Induced Signaling Pathway, CCR3 signaling in Eosinophils, CXCR4, EGF & EPO signaling pathways, Erk and PI-3 Kinase Are Necessary for Collagen Binding in Corneal Epithelia, Erk1/Erk2 Mapk Signaling pathway, Fc Epsilon Receptor I Signaling in Mast Cells, Growth Hormone Signaling Pathway, IGF-1 Signaling Pathway, IL 2, 3 & 6 signaling pathways, IL-2 Receptor B Protein Interaction Pathway, Influence of Ras and Rho proteins on G1 to S Transition, Inhibition of Cellular Proliferation by Gleevec, Insulin Signaling Pathway, Integrin Signaling Pathway, Links between Pyk2 and Map Kinases, MAPKinase Signaling Pathway, Multiple antiapoptotic pathways from IGF-1R signaling lead to BAD phosphphorylation, Nerve growth factor pathway (NGF), PDGF Signaling Pathway, Phosphorylation of MEK1 by cdk5/p35 down regulates the MAP kinase pathway, Ras Signaling Pathway, Signaling Pathway from G-Protein Families, T Cell Receptor Signaling Pathway, TPO Signaling Pathway, egf, epo, igf-1, il2, il3, il6, insulin, interact6-1, ngf, pdgf, tpo |
| 1908 | 2069 | AI103616 | bb | Angiotensin II mediated activation of JNK Pathway via Pyk2 dependent signaling, BCR Signaling Pathway, Influence of Ras and Rho proteins on G1 to S Transition, Links between Pyk2 and Map Kinases, MAPKinase Signaling Pathway, Rac 1 cell motility signaling pathway, Ras Signaling Pathway, Ras-independent pathway in NK cell-mediated cytotoxicity, Role of PI3K subunit p85 in regulation of Actin Organization and Cell Migration, T Cell Receptor Signaling Pathway, Transcription factor CREB and its extracellular signals, p38 MAPK Signaling Pathway |
| 2985 | 21097 | M12112 | s | Angiotensin II mediated activation of JNK Pathway via Pyk2 dependent signaling, Bioactive Peptide Induced Signaling Pathway |
| 4222 | 21098 | NM_134432 | qq | Angiotensin II mediated activation of JNK Pathway via Pyk2 dependent signaling, Bioactive Peptide Induced Signaling Pathway |
| 2647 | 17907 | AI233224 | t | Angiotensin II mediated activation of JNK Pathway via Pyk2 dependent signaling, EGF Signaling Pathway, Erk1/Erk2 Mapk Signaling pathway, egf |
| 3154 | 11138 | NM_012839 | jj | Apoptotic Signaling in Response to DNA Damage, Caspase Cascade in Apoptosis, D4-GDI Signaling Pathway, Electron - Transfer Reaction in Mitochondria, HIV-I Nef: negative effector of Fas and TNF, Induction of apoptosis through DR3 and DR4/5 Death Receptors, Role of Mitochondria in Apoptotic Signaling |
| 3179 | 776 | NM_012922 | u | Apoptotic Signaling in Response to DNA Damage, Caspase Cascade in Apoptosis, D4-GDI Signaling Pathway, FAS signaling pathway (CD95), HIV-I Nef: negative effector of Fas and TNF, Induction of apoptosis through DR3 and DR4/5 Death Receptors, Role of Mitochondria in Apoptotic Signaling, TNFR1 Signaling Pathway, TSP-1 Induced Apoptosis in Microvascular Endothelial Cell |
| 3179 | 777 | NM_012922 | z | Apoptotic Signaling in Response to DNA Damage, Caspase Cascade in Apoptosis, D4-GDI Signaling Pathway, FAS signaling pathway (CD95), HIV-I Nef: negative effector of Fas and TNF, Induction of apoptosis through DR3 and DR4/5 Death Receptors, Role of Mitochondria in Apoptotic Signaling, TNFR1 Signaling Pathway, TSP-1 Induced Apoptosis in Microvascular Endothelial Cell |
| 3887 | 16115 | NM_031775 | bb | Apoptotic Signaling in Response to DNA Damage, Caspase Cascade in Apoptosis, FAS signaling pathway (CD95), HIV-I Nef: negative effector of Fas and TNF, Induction of apoptosis through DR3 and DR4/5 Death Receptors, Role of Mitochondria on Apoptotic Signaling |
| 1241 | 3081 | AA999171 | General | Apoptotic Signaling in Response to DNA Damage, EGF Signaling Pathway, IFN alpha signaling pathway, IFN gamma signaling pathway, IL22 Soluble Receptor Signaling Pathway, Inhibition of Cellular Proliferation by Gleevec, PDGF Signaling Pathway, TPO Signaling Pathway, egf, ifn_alpha, ifn_gamma, igf-1, p38 MAPK Signaling Pathway, pdgf, tpo |
| 3286 | 24897 | NM_016993 | pp | Apoptotic Signaling in Response to DNA Damage, HIV-I Nef: negative effector of Fas and TNF, IL-2 Receptor B Protein Interaction Pathway, Induction of apoptosis through DR3 and DR4/5 Death Receptors, Inhibition of Cellular Proliferation by Gleevec, Regulation of BAD phosphorylation, Role of Mitochondria in Apoptotic Signaling, p53 Signaling Pathway |
| 3306 | 910 | NM_017059 | bb, ss | Apoptotic Signaling in Response to DNA Damage, Hypoxia and p53 in the Cardiovascular system, Regulation of BAD phosphorylation, Role of Mitochondria in Apoptotic Signaling, p53 Signaling Pathway |

TABLE 3-continued

| SEQ ID NO. | GLGC ID NO. | GenBank Acc. or RefSeq ID No. | Model Code | Pathways |
|---|---|---|---|---|
| 3306 | 911 | NM_017059 | ss | Apoptotic Signaling in Response to DNA Damage, Hypoxia and p53 in the Cardiovascular system, Regulation of BAD phosphorylation, Role of Mitochondria in Apoptotic Signaling, p53 Signaling Pathway |
| 3306 | 912 | NM_017059 | qq | Apoptotic Signaling in Response to DNA Damage, Hypoxia and p53 in the Cardiovascular system, Regulation of BAD phosphorylation, Role of Mitochondria in Apoptotic Signaling, p53 Signaling Pathway |
| 991 | 22283 | AA945172 | mm | Arginine and proline metabolism |
| 3710 | 15682 | NM_031011 | a | Arginine and proline metabolism |
| 3710 | 15683 | NM_031011 | kk, oo | Arginine and proline metabolism |
| 166 | 11901 | AA801058 | l, nn | Arginine and proline metabolism, Ascorbate and aldarate metabolism, Bile acid biosynthesis, Butanoate metabolism, Fatty acid metabolism, Glycerolipid metabolism, Glycolysis/Gluconeogenesis, Histidine metabolism, Lysine degradation, Propanoate metabolism, Pyruvate metabolism, Tryptophan metabolism, Valine, leucine and isoleucine degradation, beta-Alanine metabolism |
| 3570 | 20915 | NM_022407 | b, ff | Arginine and proline metabolism, Ascorbate and aldarate metabolism, Bile acid biosynthesis, Butanoate metabolism, Fatty acid metabolism, Glycerolipid metabolism, Glycolysis/Gluconeogenesis, Histidine metabolism, Lysine degradation, Propanoate metabolism, Pyruvate metabolism, Tryptophan metabolism, Valine, leucine and isoleucine degradation, beta-Alanine metabolism |
| 3873 | 23883 | NM_031731 | n, General, ee | Arginine and proline metabolism, Ascorbate and aldarate metabolism, Bile acid biosynthesis, Butanoate metabolism, Fatty acid metabolism, Glycerolipid metabolism, Glycolysis/Gluconeogenesis, Histidine metabolism, Lysine degradation, Propanoate metabolism, Pyruvate metabolism, Tryptophan metabolism, Valine, leucine and isoleucine degradation, beta-Alanine metabolism |
| 3873 | 23884 | NM_031731 | ii | Arginine and proline metabolism, Ascorbate and aldarate metabolism, Bile acid biosynthesis, Butanoate metabolism, Fatty acid metabolism, Glycerolipid metabolism, Glycolysis/Gluconeogenesis, Histidine metabolism, Lysine degradation, Propanoate metabolism, Pyruvate metabolism, Tryptophan metabolism, Valine, leucine and isoleucine degradation, beta-Alanine metabolism |
| 3934 | 12299 | NM_032416 | a, General | Arginine and proline metabolism, Ascorbate and aldarate metabolism, Bile acid biosynthesis, Butanoate metabolism, Fatty acid metabolism, Glycerolipid metabolism, Glycolysis/Gluconeogenesis, Histidine metabolism, Lysine degradation, Propanoate metabolism, Pyruvate metabolism, Tryptophan metabolism, Valine, leucine and isoleucine degradation, beta-Alanine metabolism |
| 3388 | 20914 | NM_017272 | j, o, v, vv | Arginine and proline metabolism, Ascorbate and aldarate metabolism, Bile acid biosynthesis, Butanoate metabolism, Fatty acid metabolism, Glycerolipid metabolism, Glycolysis/Gluconeogenesis, Histidine metabolism, Lysine degradation, Propanoate metabolism, Pyruvate metabolism, Tryptophan metabolism, Valine, leucine and isoleucine degradation, beta-Alanine metabolism |
| 3075 | 4573 | NM_012570 | l, General | Arginine and proline metabolism, Catabolic Pathways for Arginine, Histidine, Glutamate, Glutamine, and Proline, D-Glutamine and D-glutamate metabolism, Glutamate metabolism, Nitrogen metabolism, Urea cycle and metabolism of amino groups |
| 3075 | 4574 | NM_012570 | h, l, p, General, dd, ii, uu | Arginine and proline metabolism, Catabolic Pathways for Arginine, Histidine, Glutamate, Glutamine, and Proline, D-Glutamine and D-glutamate metabolism, Glutamate metabolism, Nitrogen metabolism, Urea cycle and metabolism of amino groups |
| 3330 | 24693 | NM_017134 | a, b, l, General, cc | Arginine and proline metabolism, Catabolic Pathways for Arginine, Histidine, Glutamate, Glutamine, and Proline, Urea cycle and metabolism of amino groups |
| 3310 | 20649 | NM_017072 | b, General, kk, vv | Arginine and proline metabolism, Glutamate metabolism, Nitrogen metabolism, Urea cycle and metabolism of amino groups |
| 3310 | 20650 | NM_017072 | b, c, General, cc, kk, uu, vv | Arginine and proline metabolism, Glutamate metabolism, Nitrogen metabolism, Urea cycle and metabolism of amino groups |
| 2879 | 18456 | D00688 | bb | Arginine and proline metabolism, Glycine, serine and threonine metabolism, Histidine metabolism, Phenylalanine metabolism, Tryptophan metabolism, Tyrosine metabolism |
| 3271 | 21396 | NM_013198 | k, jj | Arginine and proline metabolism, Glycine, serine and threonine metabolism, Histidine metabolism, Phenylalanine metabolism, Tryptophan metabolism, Tyrosine metabolism |
| 3142 | 16947 | NM_012793 | a, b, e, m, s, z, General, qq, uu, vv | Arginine and proline metabolism, Glycine, serine and threonine metabolism, Urea cycle and metabolism of amino groups |
| 3142 | 16948 | NM_012793 | qq, uu | Arginine and proline metabolism, Glycine, serine and threonine metabolism, Urea cycle and metabolism of amino groups |
| 3205 | 19391 | NM_012998 | t, y, mm | Arginine and proline metabolism, Hypoxia-Inducible Factor in the Cardiovascular System |
| 3205 | 19392 | NM_012998 | j, gg, hh | Arginine and proline metabolism, Hypoxia-Inducible Factor in the Cardiovascular System |
| 3205 | 19393 | NM_012998 | gg, hh, ll | Arginine and proline metabolism, Hypoxia-Inducible Factor in the Cardiovascular System |
| 3232 | 13282 | NM_013078 | n, jj | Arginine and proline metabolism, Urea cycle and metabolism of amino groups |
| 3232 | 13283 | NM_013078 | h, l, m, s, General, cc, uu | Arginine and proline metabolism, Urea cycle and metabolism of amino groups |
| 3041 | 25467 | M93297 | t | Arginine and proline metabolism, Urea cycle and metabolism of amino groups |
| 3586 | 4242 | NM_022521 | xx | Arginine and proline metabolism, Urea cycle and metabolism of amino groups |
| 3549 | 20299 | NM_022220 | j | Ascorbate and aldarate metabolism |
| 3535 | 20162 | NM_021835 | u, tt | ATM Signaling Pathway, Angiotensin II mediated activation of JNK Pathway via Pyk2 dependent signaling, BCR Signaling Pathway, D4-GDI Signaling Pathway, EGF Signaling Pathway, EPO Signaling Pathway, FAS signaling pathway (CD95), Fc Epsilon Receptor I Signaling in Mast Cells, Hypoxia-Inducible Factor in the Cardiovascular System, IGF-1 Signaling Pathway, IL 2 signaling pathway, IL 6 signaling pathway, Inhibition of Cellular Proliferation by Gleevec, Insulin Signaling Pathway, Integrin Signaling Pathway, Links between Pyk2 and Map Kinases, MAPKinase Signaling Pathway, Nerve growth factor pathway (NGF), PDGF Signaling Pathway, Pertussis toxin-insensitive |

TABLE 3-continued

| SEQ ID NO. | GLGC ID NO. | GenBank Acc. or RefSeq ID No. | Model Code | Pathways |
|---|---|---|---|---|
| 3535 | 22350 | NM_021835 | tt | CCR5 Signaling in Macrophage, Repression of Pain Sensation by the Transcriptional Regulator DREAM, Signal transduction through IL1R, Signaling Pathway from G-Protein Families, T Cell Receptor Signaling Pathway, TNF/Stress Related Signaling, TNFR1 Signaling Pathway, TPO Signaling Pathway, TSP-1 Induced Apoptosis in Microvascular Endothelial Cell, The 41BB-dependent immune response, Toll-Like Receptor Pathway, egf, epo, igf-1, il2, il6, insulin, ngf, pdgf, tpo ATM Signaling Pathway, Angiotensin II mediated activation of JNK Pathway via Pyk2 dependent signaling, BCR Signaling Pathway, D4-GDI Signaling Pathway, EGF Signaling Pathway, EPO Signaling Pathway, FAS signaling pathway (CD95), Fc Epsilon Receptor I Signaling in Mast Cells, Hypoxia-Inducible Factor in the Cardiovascular System, IGF-1 Signaling Pathway, IL 2 signaling pathway, IL 6 signaling pathway, Inhibition of Cellular Proliferation by Gleevec, Insulin Signaling Pathway, Integrin Signaling Pathway, Links between Pyk2 and Map Kinases, MAPKinase Signaling Pathway, Nerve growth factor pathway (NGF), PDGF Signaling Pathway, Pertussis toxin-insensitive |
| 3535 | 22351 | NM_021835 | kk, tt | CCR5 Signaling in Macrophage, Repression of Pain Sensation by the Transcriptional Regulator DREAM, Signal transduction through IL1R, Signaling Pathway from G-Protein Families, T Cell Receptor Signaling Pathway, TNF/Stress Related Signaling, TNFR1 Signaling Pathway, TPO Signaling Pathway, TSP-1 Induced Apoptosis in Microvascular Endothelial Cell, The 41BB-dependent immune response, Toll-Like Receptor Pathway, egf, epo, igf-1, il2, il6, insulin, ngf, pdgf, tpo ATM Signaling Pathway, Angiotensin II mediated activation of JNK Pathway via Pyk2 dependent signaling, BCR Signaling Pathway, D4-GDI Signaling Pathway, EGF Signaling Pathway, EPO Signaling Pathway, FAS signaling pathway (CD95), Fc Epsilon Receptor I Signaling in Mast Cells, Hypoxia-Inducible Factor in the Cardiovascular System, IGF-1 Signaling Pathway, IL 2 signaling pathway, IL 6 signaling pathway, Inhibition of Cellular Proliferation by Gleevec, Insulin Signaling Pathway, Integrin Signaling Pathway, Links between Pyk2 and Map Kinases, MAPKinase Signaling Pathway, Nerve growth factor pathway (NGF), PDGF Signaling Pathway, Pertussis toxin-insensitive |
| 3535 | 22352 | NM_021835 | y, kk, ss tt | CCR5 Signaling in Macrophage, Repression of Pain Sensation by the Transcriptional Regulator DREAM, Signal transduction through IL1R, Signaling Pathway from G-Protein Families, T Cell Receptor Signaling Pathway, TNF/Stress Related Signaling, TNFR1 Signaling Pathway, TPO Signaling Pathway, TSP-1 Induced Apoptosis in Microvascular Endothelial Cell, The 41BB-dependent immune response, Toll-Like Receptor Pathway, egf, epo, igf-1, il2, il6, insulin, ngf, pdgf, tpo ATM Signaling Pathway, Angiotensin II mediated activation of JNK Pathway via Pyk2 dependent signaling, BCR Signaling Pathway, D4-GDI Signaling Pathway, EGF Signaling Pathway, EPO Signaling Pathway, FAS signaling pathway (CD95), Fc Epsilon Receptor I Signaling in Mast Cells, Hypoxia-Inducible Factor in the Cardiovascular System, IGF-1 Signaling Pathway, IL 2 signaling pathway, IL 6 signaling pathway, Inhibition of Cellular Proliferation by Gleevec, Insulin Signaling Pathway, Integrin Signaling Pathway, Links between Pyk2 and Map Kinases, MAPKinase Signaling Pathway, Nerve growth factor pathway (NGF), PDGF Signaling Pathway, Pertussis toxin-insensitive CCR5 Signaling in Macrophage, Repression of Pain Sensation by the Transcriptional Regulator DREAM, Signal transduction through IL1R, Signaling Pathway from G-Protein Families, T Cell Receptor Signaling Pathway, TNF/Stress Related Signaling, TNFR1 Signaling Pathway, TPO Signaling Pathway, TSP-1 Induced Apoptosis in Microvascular Endothelial Cell, The 41BB-dependent immune response, Toll-Like Receptor Pathway, egf, epo, igf-1, il2, il6, insulin, ngf, pdgf, tpo |
| 4137 | 132 | NM_080782 | ll, tt | ATM Signaling Pathway, Cell Cycle: G1/S Check Point, Cell Cycle: G2/M Checkpoint, Cyclins and Cell Cycle Regulation, Effects of calcinurin in Keratinocyte Differentiation, Erythropoietin mediated neuroprotection through NF-kB, Hypoxia and p53 in the Cardiovascular system, Influence of Ras and Rho proteins on G1 to S Transition, p53 Signaling Pathway |
| 4137 | 133 | NM_080782 | p, ll, ss | ATM Signaling Pathway, Cell Cycle: G1/S Check Point, Cell Cycle: G2/M Checkpoint, Cyclins and Cell Cycle Regulation, Effects of calcinurin in Keratinocyte Differentiation, Erythropoietin mediated neuroprotection through NF-kB, Hypoxia and p53 in the Cardiovascular system, Influence of Ras and Rho proteins on G1 to S Transition, p53 Signaling Pathway |
| 3699 | 17377 | NM_030989 | jj | ATM Signaling Pathway, Cell Cycle: G1/S Check Point, Cell Cycle: G2/M Checkpoint, Double Standard RNA Induced Gene Expression, Hypoxia and p53 in the Cardiovascular system, Overview of telomerase protein component gene hTert Transcriptional Regulation, RB Tumor Suppressor/Checkpoint Signaling in response to DNA damage, p53 Signaling Pathway |
| 3650 | 352 | NM_024127 | s, General | ATM Signaling Pathway, Cell Cycle: G2/M Checkpoint, Hypoxia and p53 in the Cardiovascular system, p53 Signaling Pathway |
| 3650 | 353 | NM_024127 | n, z, General, ee, kk, qq, ww | ATM Signaling Pathway, Cell Cycle: G2/M Checkpoint, Hypoxia and p53 in the Cardiovascular system, p53 Signaling Pathway |
| 3650 | 354 | NM_024127 | n, r, General, qq, vv | ATM Signaling Pathway, Cell Cycle: G2/M Checkpoint, Hypoxia and p53 in the Cardiovascular system, p53 Signaling Pathway |
| 913 | 10569 | AA942681 | n, z, General | ATP Synthesis, Oxidative phosphorylation |
| 4074 | 20939 | NM_053884 | l, m, s, General, bb, qq, uu | ATP Synthesis, Oxidative phosphorylation |
| 82 | 16346 | AA799824 | a, e, f, s, General, kk, oo | ATP Synthesis, Oxidative phosphorylation |
| 3406 | 16844 | NM_017311 | r | ATP Synthesis, Oxidative phosphorylation |
| 4271 | 17203 | NM_139099 | pp | ATP Synthesis, Oxidative phosphorylation |
| 4271 | 17204 | NM_139099 | p, x, mm | ATP Synthesis, Oxidative phosphorylation |
| 705 | 17754 | AA893246 | a, w | ATP Synthesis, Oxidative phosphorylation |

TABLE 3-continued

| SEQ ID NO. | GLGC ID NO. | GenBank Acc. or RefSeq ID No. | Model Code | Pathways |
|---|---|---|---|---|
| 2336 | 8949 | AI177593 | l, General | ATP Synthesis, Oxidative phosphorylation |
| 2096 | 22661 | AI169265 | t, mm | ATP Synthesis, Oxidative phosphorylation |
| 3892 | 16178 | NM_031785 | ii | ATP Synthesis, Oxidative phosphorylation |
| 3501 | 22726 | NM_019383 | r | ATP Synthesis, Oxidative phosphorylation |
| 590 | 2107 | AA892006 | e | ATP Synthesis, Oxidative phosphorylation |
| 1517 | 2108 | AI029960 | ee | ATP Synthesis, Oxidative phosphorylation |
| 2089 | 17914 | AI169159 | ll | ATP Synthesis, Oxidative phosphorylation |
| 2264 | 10182 | AI176185 | tt | BCR Signaling Pathway, EGF Signaling Pathway, EPO Signaling Pathway, Fc Epsilon Receptor I Signaling in Mast Cells, IGF-1 Signaling Pathway, IL 2 signaling pathway, IL 3 signaling pathway, IL 6 signaling pathway, IL-2 Receptor B Protein Interaction Pathway, Inhibition of Cellular Proliferation by Gleevec, Insulin Signaling Pathway, Nerve growth factor pathway (NGF), PDGF Signaling Pathway, Pertussis toxin-insensitive CCR5 Signaling in Macrophage, Repression of Pain Sensation by the Transcriptional Regular DREAM, Signaling Pathway from G-Protein Families, T Cell Receptor Signaling Pathway, TPO Signaling Pathway, TSP-1 Induced Apoptosis in Microvascular Endothelial Cell, Toll-Like Receptor Pathway, egf, epo, igf-1, il2, il3, il6, insulin, ngf, pdgf, tpo |
| 3312 | 18957 | NM_017075 | o, xx | Benzoate degradation, Bile acid biosynthesis, Butanoate metabolism, Fatty acid biosynthesis (path 2), Fatty acid metabolism, Lysine degradation, Propanoate metabolism, Pyruvate metabolism, Synthesis and degradation of ketone bodies, Tyrptophan metabolism |
| 3312 | 18958 | NM_017075 | o, jj | Benzoate degradation, Bile acid biosynthesis, Butanoate metabolism, Fatty acid biosynthesis (path 2), Fatty acid metabolism, Lysine degradation, Propanoate metabolism, Pyruvate metabolism, Synthesis and degradation of ketone bodies, Tyrptophan metabolism |
| 1967 | 23596 | AI105435 | uu, vv | Benzoate degradation, Fatty acid metabolism, Lysine degradation, Tryptophan metabolism |
| 2731 | 20788 | AI236053 | qq | Bile acid biosynthesis |
| 1083 | 23700 | AA956382 | ff | Bile acid biosynthesis, Fatty acid biosynthesis (path 2), Fatty acid metabolism, Valine, leucine and isoleucine degradation |
| 3046 | 23698 | NM_012489 | o, xx | Bile acid biosynthesis, Fatty acid biosynthesis (path 2), Fatty acid metabolism, Valine, leucine and isoleucine degradation |
| 3046 | 23699 | NM_012489 | o, u, v, ss | Bile acid biosynthesis, Fatty acid biosynthesis (path 2), Fatty acid metabolism, Valine, leucine and isoleucine degradation |
| 464 | 16074 | AA874874 | t | Bile acid biosynthesis, Fatty acid metabolism, Glycerolipid metabolism, Glycolysis/Gluconeogenesis, Methane metabolism, Pyruvate metabolism, Tyrosine metabolism |
| 3477 | 22219 | NM_019286 | c, vv | Bile acid biosynthesis, Fatty acid metabolism, Glycerolipid metabolism, Glycolysis/Gluconeogenesis, Tyrosine metabolism |
| 4159 | 22220 | NM_130780 | vv | Bile acid biosynthesis, Fatty acid metabolism, Glycerolipid metabolism, Glycolysis/Gluconeogenesis, Tyrosine metabolism |
| 74 | 1680 | AA799792 | gg, hh | Bile acid biosynthesis, Glycerolipid metabolism |
| 3125 | 16613 | NM_012732 | c | Bile acid biosynthesis, Glycerolipid metabolism |
| 3125 | 10260 | NM_012732 | y | Bile acid biosynthesis, Glycerolipid metabolism |
| 3401 | 1531 | NM_017300 | General, ff, rr, uu | Bile acid biosynthesis, Taurine and hypotaurine metabolism |
| 3047 | 265 | NM_012494 | gg, hh, jj | Bioactive Peptide Induced Signaling Pathway |
| 3364 | 13938 | NM_017212 | g | Bioactive Peptide Induced Signaling Pathway |
| 3800 | 12580 | NM_031514 | m, v | Bioactive Peptide Induced Signaling Pathway, EPO Signaling Pathway, Erythropoietin mediated neuroprotection through NF-kB, Growth Hormone Signaling Pathway, IFN gamma signaling pathway, IL 3 signaling pathway, IL 6 signaling pathway, IL22 Soluble Receptor Signaling Pathway, Inhibition of Cellular Proliferation by Gleevec, Stat3 Signaling Pathway, TPO Signaling Pathway, epo ifn_gamma, il3 il6, interact6-1, pdgf, tpo |
| 3630 | 24838 | NM_022924 | tt | Bioactive Peptide Induced Signaling Pathway, Thrombin signaling and protease-activated receptors, Transcriptional activation of dbpb from mRNA |
| 3776 | 1963 | NM_031236 | xx | Blood group glycolipid biosynthesis - lact series, Blood group glycolipid biosynthesis - neolact series, Globoside metabolism |
| 1913 | 23829 | AI103754 | h | Blood group glycolipid biosynthesis - neolact series, Galactose metabolism, Keratan sulfate biosynthesis, N-Glycans biosynthesis |
| 1890 | 11486 | AI103162 | j | Blood group glycolipid biosynthesis - neolact series, Galactose metabolism, Keratan sulfate biosynthesis, N-Glycans biosynthesis |
| 4482 | 20426 | Z12158 | ff, gg, hh | Butanoate metabolism, Glycolysis/Gluconeogenesis, Pyruvate metabolism, Shuttle for transfer of acetyl groups from mitochondria to the cytosol, Valine, leucine and isoleucine biosynthesis |
| 668 | 11997 | AA892828 | ll | Butanoate metabolism, Glycolysis/Gluconeogenesis, Pyruvate metabolism, Valine, leucine and isoleucine biosynthesis |
| 1098 | 12000 | AA957319 | bb | Butanoate metabolism, Glycolysis/Gluconeogenesis, Pyruvate metabolism, Valine, leucine and isoleucine biosynthesis |
| 2259 | 5876 | AI176117 | oo | Butanoate metabolism, Glycolysis/Gluconeogenesis, Pyruvate metabolism, Valine, leucine and isoleucine biosynthesis |
| 4213 | 8692 | NM_134387 | e | Butanoate metabolism, Pentose and glucuronate interconversions |
| 3386 | 20600 | NM_017268 | q, w, jj | Butanoate metabolism, SREBP and controls lipid synthesis, Synthesis and degradation of ketone bodies, Valine, leucine and isoleucine degradation |
| 3386 | 20601 | NM_017268 | q, w, jj | Butanoate metabolism, SREBP and controls lipid synthesis, Synthesis and degradation of ketone bodies, Valine, leucine and isoleucine degradation |
| 4101 | 17739 | NM_053995 | h, General, qq | Butanoate metabolism, Synthesis and degradation of ketone bodies |
| 1957 | 18278 | AI105080 | m | Butanoate metabolism, Synthesis and degradation of ketone bodies, Valine, leucine and isoleucine degradation |

TABLE 3-continued

| SEQ ID NO. | GLGC ID NO. | GenBank Acc. or RefSeq ID No. | Model Code | Pathways |
|---|---|---|---|---|
| 3677 | 2811 | NM_024386 | jj | Butanoate metabolism, Synthesis and degradation of ketone bodies, Valine, leucine and isoleucine degradation |
| 3677 | 2812 | NM_024386 | rr | Butanoate metabolism, Synthesis and degradation of ketone bodies, Valine, leucine and isoleucine degradation |
| 3677 | 2813 | NM_024386 | oo, ii | Butanoate metabolism, Synthesis and degradation of ketone bodies, Valine, leucine and isoleucine degradation |
| 3772 | 164 | NM_031151 | v | Carbon fixation, Citrate cycle (TCA cycle), Glyoxylate and dicarboxylate metabolism, Pyruvate metabolism, Reductive carboxylate cycle (CO2 fixation) |
| 1938 | 18277 | AI104399 | t | Carbon fixation, Fructose and mannose metabolism, Glycerolipid metabolism, Glycolysis/Gluconeogenesis, Glycolysis Pathway, Inositol metabolism |
| 624 | 820 | AA892395 | a, s, ss, uu | Carbon fixation, Fructose and mannose metabolism, Glycolysis/Gluconeogenesis, Glycolysis Pathway, Pentose phosphate pathway |
| 4404 | 818 | X02291 | a, s, ff, qq, tt, uu | Carbon fixation, Fructose and mannose metabolism, Glycolysis/Gluconeogenesis, Glycolysis Pathway, Pentose phosphate pathway |
| 3048 | 7062 | NM_012495 | t, bb, mm | Carbon fixation, Fructose and mannose metabolism, Glycolysis/Gluconeogenesis, Pentose phosphate pathway |
| 3048 | 7064 | NM_012495 | s | Carbon fixation, Fructose and mannose metabolism, Glycolysis/Gluconeogenesis, Pentose phosphate pathway |
| 3049 | 1655 | NM_012497 | n | Carbon fixation, Fructose and mannose metabolism, Glycolysis/Gluconeogenesis, Pentose phosphate pathway |
| 3070 | 16895 | NM_012558 | a, cc, gg, hh, ss, uu | Carbon fixation, Fructose and mannose metabolism, Glycolysis/Gluconeogenesis, Pentose phosphate pathway |
| 3952 | 1311 | NM_053291 | j, s, t | Carbon fixation, Glycolysis/Gluconeogenesis, Glycolysis Pathway |
| 3597 | 20803 | NM_022592 | d, q | Carbon fixation, Pentose phosphate pathway |
| 1304 | 17353 | AI008020 | o | Carbon fixation, Pyruvate metabolism, Shuttle for transfer of acetyl groups from mitochondria to the cytosol |
| 3087 | 18746 | NM_012600 | gg, hh | Carbon fixation, Pyruvate metabolism, Shuttle for transfer of acetyl groups from mitochondria to the cytosol |
| 3074 | 20717 | NM_012569 | c | Catabolic Pathways for Arginine, Histidine, Glutamate, Glutamine, and Proline, D-Glutamine and D-glutamate metabolism, Glutamate metabolism, Nitrogen metabolism |
| 2455 | 21296 | AI227641 | j | CCR3 signaling in Eosinophils, Erk and PI-3 Kinase Are Necessary for Collagen Binding in Corneal Epithelia, PKC-catalyzed phosphorylation of inhibitory phosphoprotein of myosin phosphatase, Rac 1 cell motility signaling pathway, Rho cell motility signaling pathway |
| 2712 | 2241 | AI235500 | ss | CCR3 signaling in Eosinophils, Rac 1 cell motility signaling pathway, Rho cell motility signaling pathway |
| 3337 | 15364 | NM_017147 | j | CCR3 signaling in Eosinophils, Rac 1 cell motility signaling pathway, Rho cell motility signaling pathway |
| 4046 | 15995 | NM_053769 | r, ff | CD40L Signaling Pathway, Phosphatidylinositol signaling system, TNFR2 Signaling Pathway |
| 4046 | 15996 | NM_053769 | n, ff, kk | CD40L Signaling Pathway, Phosphatidylinositol signaling system, TNFR2 Signaling Pathway |
| 4046 | 15997 | NM_053769 | d, n, r, w, y | CD40L Signaling Pathway, Phosphatidylinositol signaling system, TNFR2 Signaling Pathway |
| 4143 | 13424 | NM_080899 | ww | CD40L Signaling Pathway, TNFR2 Signaling Pathway |
| 1094 | 24230 | AA957218 | ii | Cell Cycle: G1/S Check Point, Cyclins and Cell Cycle Regulation, Inactivation of Gsk3 by AKT causes accumulation of b-catenin in Alveolar Macrophages, Influence of Ras and Rho proteins on G1 to S Transition, WNT Signaling Pathway, p53 Signaling Pathway |
| 3932 | 590 | NM_032080 | b, c, m, kk | Cell Cycle: G1/S Check Point, Inactivation of Gsk3 by AKT causes accumulation of b-catenin in Alveolar Macrophages, Presenilin action in Notch and Wnt signaling, Regulation of eIF2, Skeletal muscle hypertrophy is regulated via AKT/mTOR pathway, WNT Signaling Pathway, il2 |
| 3932 | 591 | NM_032080 | b, c, l, z, General, tt, vv | Cell Cycle: G1/S Check Point, Inactivation of Gsk3 by AKT causes accumulation of b-catenin in Alveolar Macrophages, Presenilin action in Notch and Wnt signaling, Regulation of eIF2, Skeletal muscle hypertrophy is regulated via AKT/mTOR pathway, WNT Signaling Pathway, il2 |
| 4361 | 1392 | U10188 | j | Cell Cycle: G2/M Checkpoint |
| 73 | 13683 | AA799788 | s | Cell Cycle: G2/M Checkpoint, Cyclin E Destruction Pathway, E2F1 Destruction Pathway |
| 2979 | 13682 | L38482 | p | Cell Cycle: G2/M Checkpoint, Cyclin E Destruction Pathway, E2F1 Destruction Pathway |
| 3705 | 21165 | NM_031005 | mm | Cell to Cell Adhesion Signaling, Integrin Signaling Pathway |
| 3705 | 21166 | NM_031005 | t, mm | Cell to Cell Adhesion Signaling, Integrin Signaling Pathway |
| 1251 | 4307 | AB012600 | s | Circadian Rhythms |
| 1259 | 4308 | AF015953 | ww | Circadian Rhythms |
| 4025 | 23305 | NM_053638 | jj | Citrate cycle (TCA cycle) |
| 3797 | 17427 | NM_031510 | p | Citrate cycle (TCA cycle), Glutathione metabolism, Reductive carboxylate cycle (CO2 fixation) |
| 2706 | 19995 | AI235320 | p, t | Citrate cycle (TCA cycle), Glyoxylate and dicarboxylate metabolism, Reductive carboxylate cycle (CO2 fixation) |
| 3681 | 19993 | NM_024398 | o, xx | Citrate cycle (TCA cycle), Glyoxylate and dicarboxylate metabolism, Reductive carboxylate cycle (CO2 fixation) |
| 4090 | 19991 | NM_053961 | cc | Citrate cycle (TCA cycle), Glyoxylate and dicarboxylate metabolism, Reductive carboxylate cycle (CO2 fixation) |
| 3410 | 17516 | NM_017321 | o, ii, jj, tt | Citrate cycle (TCA cycle), Glyoxylate and dicarboxylate metabolism, Reductive carboxylate cycle (CO2 fixation) |
| 886 | 17513 | AA925554 | h, u | Citrate cycle (TCA cycle), Oxidative phosphorylation |
| 4153 | 17512 | NM_130428 | w | Citrate cycle (TCA cycle), Oxidative phosphorylation |
| 4042 | 18174 | NM_053752 | o | Citrate cycle (TCA cycle), Propanoate metabolism |
| 3290 | 15620 | NM_017005 | p | Citrate cycle (TCA cycle), Reductive carboxylate cycle (CO2 fixation) |
| 3283 | 15612 | NM_016987 | ee | Citrate cycle (TCA cycle), Shuttle for transfer of acetyl groups from mitochondria to the cytosol |
| 3283 | 15613 | NM_016987 | ii, ll, ww | Citrate cycle (TCA cycle), Shuttle for transfer of acetyl groups from mitochondria to the cytosol |
| 163 | 15852 | AA800942 | gg, hh | Classic Complement Pathway, Complement Pathway, Lectin Induced Complement Pathway |
| 4377 | 15851 | U42719 | vv | Classic Complement Pathway, Complement Pathway, Lectin Induced Complement Pathway |

TABLE 3-continued

| SEQ ID NO. | GLGC ID NO. | GenBank Acc. or RefSeq ID No. | Model Code | Pathways |
|---|---|---|---|---|
| 2992 | 21053 | M15481 | qq | Control of skeletal myogenesis by HDAC & calcium/calmodulin-dependent kinase (CaMK), Erythrocyte Differentiation Pathway, IGF-1 Signaling Pathway, Regulation of BAD phosphorylation, Skeletal muscle hypertrophy is regulated via AKT/mTOR pathway, igf-1 |
| 4406 | 21054 | X06107 | g, v | Control of skeletal myogenesis by HDAC & calcium/calmodulin-dependent kinase (CaMK), Erythrocyte Differentiation Pathway, IGF-1 Signaling Pathway, Regulation of BAD phosphorylation, Skeletal muscle hypertrophy is regulated via AKT/mTOR pathway, igf-1 |
| 4245 | 16354 | NM_138843 | v, xx | Cysteine metabolism |
| 3950 | 25024 | NM_052809 | b, o, vv | Cysteine metabolism, Taurine and hypotaurine metabolism |
| 3950 | 15028 | NM_052809 | b, qq, vv | Cysteine metabolism, Taurine and hypotaurine metabolism |
| 3246 | 14300 | NM_013129 | pp | Cytokine Network, Cytokines and Inflammatory Response |
| 1454 | 1332 | AI013222 | mm | Cytokines and Inflammatory Response, PDGF Signaling Pathway, pdgf |
| 3291 | 8417 | NM_017008 | l | D-Arginine and D-ornithine metabolism, Glycolysis/Gluconeogenesis, Glycolysis Pathway |
| 3334 | 24105 | NM_017141 | a | DNA polymerase, Purine metabolism, Pyrimidine metabolism |
| 3334 | 24107 | NM_017141 | d, g | DNA polymerase, Purine metabolism, Pyrimidine metabolism |
| 1626 | 24336 | AI045621 | r | Effects of calcinurin in Keratinocyte Differentiation |
| 1667 | 10138 | AI059048 | m | Effects of calcinurin in Keratinocyte Differentiation, Overview of telomerase RNA component gene hTerc Transcriptional Regulation, Overview of telomerase protein component gene hTert Transcriptional Regulation |
| 2869 | 25233 | AJ000556 | p, mm | EGF Signaling Pathway, IFN alpha signaling pathway, IFN gamma signaling pathway, IL 2 signaling pathway, IL 4 signaling pathway, IL-2 Receptor B Protein Interaction Pathway, PDGF Signaling Pathway, egf, ifn_alpha, ifn_gamma, il2, il4, il6, interact6-1, pdgf |
| 3558 | 1914 | NM_022380 | g | egf, epo, il2, il3, tpo |
| 3088 | 2628 | NM_012603 | f, l, y, z, General | Erk1/Erk2 Mapk Signaling pathway, IL-2 Receptor B Protein Interaction Pathway, Inhibition of Cellular Proliferation by Gleevec, Neuropeptides VIP and PACAP inhibit the apoptosis of activated T cells, Overview of telomerase protein component gene hTert Transcriptional Regulation, WNT Signaling Pathway, p38 MAPK Signaling Pathway |
| 3088 | 2629 | NM_012603 | f, l, l, z, General, nn | Erk1/Erk2 Mapk Signaling pathway, IL-2 Receptor B Protein Interaction Pathway, Inhibition of Cellular Proliferation by Gleevec, Neuropeptides VIP and PACAP inhibit the apoptosis of activated T cells, Overview of telomerase protein component gene hTert Transcriptional Regulation, WNT Signaling Pathway, p38 MAPK Signaling Pathway |
| 2571 | 19288 | AI231305 | e | Erk1/Erk2 Mapk Signaling pathway, PDGF Signaling Pathway, Rac 1 cell motility signaling pathway, Role of PI3K subunit p85 in regulation of Actin Organization and Cell Migration, pdgf |
| 3211 | 208 | NM_013025 | vv | Erythrocyte Differentiation Pathway, Selective expression of chemokine receptors during T-cell polarization |
| 2724 | 21414 | AI235842 | x | Erythropoietin mediated neuroprotection through NF-kB |
| 3668 | 1146 | NM_024359 | a, m | Erythropoietin mediated neuroprotection through NF-kB, Hypoxia and p53 in the Cardiovascular system, Hypoxia-Inducible Factor in the Cardiovascular System |
| 3668 | 1148 | NM_024359 | a | Erythropoietin mediated neuroprotection through NF-kB, Hypoxia and p53 in the Cardiovascular system, Hypoxia-Inducible Factor in the Cardiovascular System |
| 4148 | 8167 | NM_130406 | q, ll | FAS signaling pathway (CD95) |
| 3413 | 24247 | NM_017332 | n, rr | Fatty acid biosynthesis (path 1) |
| 2880 | 18686 | D00729 | o, ff, jj | Fatty acid metabolism |
| 3149 | 6780 | NM_012819 | n | Fatty acid metabolism |
| 3403 | 18685 | NM_017306 | o | Fatty acid metabolism |
| 3403 | 18687 | NM_017306 | o, ff, rr | Fatty acid metabolism |
| 4016 | 15925 | NM_053607 | m | Fatty acid metabolism |
| 4113 | 3743 | NM_057107 | nn | Fatty acid metabolism |
| 704 | 20986 | AA893242 | o | Fatty acid metabolism |
| 1596 | 20983 | AI044900 | o, v | Fatty acid metabolism |
| 2901 | 20984 | D90109 | o, gg, hh, oo, uu | Fatty acid metabolism |
| 4022 | 13005 | NM_053623 | a | Fatty acid metabolism |
| 3416 | 16148 | NM_017340 | o, y, jj, ss, xx | Fatty acid metabolism |
| 3416 | 16150 | NM_017340 | o, jj | Fatty acid metabolism |
| 3273 | 20854 | NM_013200 | j, nn | Fatty acid metabolism, Glycerolipid metabolism |
| 3273 | 20856 | NM_013200 | o, jj | Fatty acid metabolism, Glycerolipid metabolism |
| 3182 | 1977 | NM_012930 | o, p, y, ff, xx | Fatty acid metabolism, Glycerolipid metabolism, Mitochondrial Carnitine Palmitoyltransferase (CPT) System |
| 3813 | 15411 | NM_031559 | o, y, ff | Fatty acid metabolism, Glycerolipid metabolism, Mitochondrial Carnitine Palmitoyltransferase (CPT) System, Reversal of Insulin Resistance by Leptin |
| 3282 | 21078 | NM_016986 | l, o, ss | Fatty acid metabolism, Propanoate metabolism, Valine, leucine and isoleucine degradation, beta-Alanine metabolism |
| 835 | 20711 | AA924267 | o | Fatty acid metabolism, Tryptophan metabolism |
| 1194 | 20712 | AA997806 | b, uu | Fatty acid metabolism, Tryptophan metabolism |
| 2991 | 20714 | M14972 | o, r | Fatty acid metabolism, Tryptophan metabolism |
| 3019 | 20713 | M57718 | o, r, xx | Fatty acid metabolism, Tryptophan metabolism |
| 3064 | 488 | NM_012540 | j, w | Fatty acid metabolism, Tryptophan metabolism |
| 3064 | 489 | NM_012540 | e, tt | Fatty acid metabolism, Tryptophan metabolism |
| 3064 | 20705 | NM_012540 | j | Fatty acid metabolism, Tryptophan metabolism |
| 3065 | 20703 | NM_012541 | xx | Fatty acid metabolism, Tryptophan metabolism |
| 3186 | 190 | NM_012940 | e | Fatty acid metabolism, Tryptophan metabolism |
| 3186 | 191 | NM_012940 | e | Fatty acid metabolism, Tryptophan metabolism |
| 3186 | 192 | NM_012940 | e | Fatty acid metabolism, Tryptophan metabolism |
| 3186 | 193 | NM_012940 | e, v | Fatty acid metabolism, Tryptophan metabolism |

TABLE 3-continued

| SEQ ID NO. | GLGC ID NO. | GenBank Acc. or RefSeq ID No. | Model Code | Pathways |
|---|---|---|---|---|
| 3187 | 20928 | NM_012941 | ee | Fatty acid metabolism, Tryptophan metabolism |
| 3187 | 20929 | NM_012941 | jj | Fatty acid metabolism, Tryptophan metabolism |
| 3187 | 20931 | NM_012941 | uu | Fatty acid metabolism, Tryptophan metabolism |
| 4408 | 20715 | X07259 | o, xx | Fatty acid metabolism, Tryptophan metabolism |
| 3831 | 67 | NM_031605 | cc | Fatty acid metabolism, Tryptophan metabolism |
| 3124 | 18730 | NM_012730 | a, j | Fatty acid metabolism, Tryptophan metabolism |
| 3343 | 2968 | NM_017158 | n | Fatty acid metabolism, Tryptophan metabolism |
| 3343 | 2970 | NM_017158 | f, rr, ss | Fatty acid metabolism, Tryptophan metabolism |
| 3505 | 20716 | NM_019623 | b, l, General, gg, hh, ll, uu | Fatty acid metabolism, Tryptophan metabolism |
| 3817 | 15024 | NM_031572 | General, ll, qq | Fatty acid metabolism, Tryptophan metabolism |
| 3817 | 15025 | NM_031572 | bb, qq | Fatty acid metabolism, Tryptophan metabolism |
| 3482 | 1099 | NM_019303 | y | Fatty acid metabolism, Tryptophan metabolism |
| 3807 | 4010 | NM_031543 | e, r | Fatty acid metabolism, Tryptophan metabolism |
| 3807 | 4011 | NM_031543 | j, w | Fatty acid metabolism, Tryptophan metabolism |
| 3807 | 4012 | NM_031543 | e, rr | Fatty acid metabolism, Tryptophan metabolism |
| 209 | 12160 | AA818412 | o, qq | Fatty acid metabolism, Tryptophan metabolism |
| 2948 | 12156 | K00996 | o | Fatty acid metabolism, Tryptophan metabolism |
| 2950 | 12157 | K01721 | o | Fatty acid metabolism, Tryptophan metabolism |
| 4312 | 683 | NM_147206 | ii | Fatty acid metabolism, Tryptophan metabolism |
| 3012 | 16305 | M33312 | o, General | Fatty acid metabolism, Tryptophan metabolism |
| 3113 | 16306 | NM_012692 | uu | Fatty acid metabolism, Tryptophan metabolism |
| 3114 | 24707 | NM_012693 | c, r, s | Fatty acid metabolism, Tryptophan metabolism |
| 3443 | 1173 | NM_019184 | j, rr | Fatty acid metabolism, Tryptophan metabolism |
| 3443 | 1174 | NM_019184 | rr | Fatty acid metabolism, Tryptophan metabolism |
| 3743 | 1175 | NM_031093 | x, xx | Fatty acid metabolism, Tryptophan metabolism |
| 4002 | 19252 | NM_053576 | x | Flavonoids, stilbene and lignin biosynthesis, Methane metabolism, Phenylalanine metabolism |
| 3667 | 15350 | NM_024356 | p | Folate biosynthesis |
| 3564 | 13479 | NM_022390 | e, y, xx | Folate biosynthesis |
| 3564 | 13480 | NM_022390 | r, ss | Folate biosynthesis |
| 3017 | 21399 | M36410 | General | Folate biosynthesis |
| 3017 | 21400 | M36410 | n, x, General, dd, ee | Folate biosynthesis |
| 3225 | 14996 | NM_013059 | x | Folate biosynthesis, Glycerolipid metabolism |
| 3225 | 14997 | NM_013059 | f, ff, kk | Folate biosynthesis, Glycerolipid metabolism |
| 3304 | 20876 | NM_017050 | k, tt | Free Radical Induced Apoptosis |
| 2980 | 6406 | L38615 | v | Free Radical Induced Apoptosis, Glutamate metabolism, Glutathione metabolism |
| 3689 | 1853 | NM_030826 | g | Free Radical Induced Apoptosis, Glutathione metabolism |
| 4206 | 17112 | NM_134326 | ee | Free Radical Induced Apoptosis, Glutathione metabolism |
| 3342 | 21975 | NM_017154 | l | Free Radical Induced Apoptosis, Purine metabolism |
| 3305 | 1877 | NM_017052 | w | Fructose and mannose metabolism |
| 3913 | 16726 | NM_031855 | General, dd | Fructose and mannose metabolism |
| 2312 | 15588 | AI176916 | dd | Fructose and mannose metabolism |
| 2975 | 12058 | L25387 | t | Fructose and mannose metabolism, Galactose metabolism, Glycolysis/Gluconeogenesis, Pentose phosphate pathway |
| 3870 | 1339 | NM_031715 | e, bb | Fructose and mannose metabolism, Galactose metabolism, Glycolysis/Gluconeogenesis, Pentose phosphate pathway |
| 3269 | 1300 | NM_013190 | t | Fructose and mannose metabolism, Galactose metabolism, Glycolysis/Gluconeogenesis, Pentose phosphate pathway |
| 3529 | 19712 | NM_021745 | t, General, ff, kk, oo | FXR and LXR Regulation of Cholesterol Metabolism |
| 3876 | 1214 | NM_031741 | z, jj | FXR and LXR Regulation of Cholesterol Metabolism |
| 3841 | 1639 | NM_031627 | c, x, General, ss | FXR and LXR Regulation of Cholesterol Metabolism |
| 1076 | 24289 | AA955986 | t | Galactose metabolism |
| 4138 | 25693 | NM_080783 | jj, xx | Galactose metabolism, Leloir pathway of galactose metabolism, Nucleotide sugars metabolism |
| 2143 | 17027 | AI170679 | xx | Galactose metabolism, Nucleotide sugars metabolism, Pentose and glucuronate interconversions, Starch and sucrose metabolism |
| 4483 | 19694 | Z48444 | ee | Generation of amyloid b-peptide by PS1 |
| 250 | 10157 | AA819527 | rr | Generation of amyloid b-peptide by PS1 |
| 2352 | 10156 | AI178039 | bb | Generation of amyloid b-peptide by PS1 |
| 4410 | 10154 | X07648 | m | Generation of amyloid b-peptide by PS1 |
| 3438 | 20256 | NM_019163 | ii | Generation of amyloid b-peptide by PS1, HIV-I Nef: negative effector of Fas and TNF, Presenilin action in Notch and Wnt signaling, Proteolysis and Signaling Pathway of Notch, g-Secretase mediated ErbB4 Signaling Pathway |
| 2947 | 1247 | J05181 | vv | Glutamate metabolism, Glutathione metabolism |
| 3402 | 14002 | NM_017305 | qq | Glutamate metabolism, Glutathione metabolism |

TABLE 3-continued

| SEQ ID NO. | GLGC ID NO. | GenBank Acc. or RefSeq ID No. | Model Code | Pathways |
|---|---|---|---|---|
| 3402 | 14003 | NM_017305 | qq, vv | Glutamate metabolism, Glutathione metabolism |
| 3311 | 11152 | NM_017073 | q, z | Glutamate metabolism, Nitrogen metabolism |
| 3311 | 11153 | NM_017073 | q, r, s, z, rr | Glutamate metabolism, Nitrogen metabolism |
| 3143 | 961 | NM_012796 | p | Glutathione metabolism |
| 3953 | 1524 | NM_053293 | General | Glutathione metabolism |
| 2689 | 16781 | AI234527 | ll, qq | Glutathione metabolism |
| 4449 | 16780 | X62660 | b, m, qq, vv | Glutathione metabolism |
| 1246 | 14583 | AB008807 | dd, uu | Glutathione metabolism |
| 3292 | 18989 | NM_017013 | qq, vv | Glutathione metabolism |
| 3347 | 17686 | NM_017165 | o | Glutathione metabolism |
| 3796 | 18990 | NM_031509 | e | Glutathione metabolism |
| 1429 | 20817 | AI012589 | c | Glutathione metabolism |
| 4397 | 23926 | U86635 | d, oo | Glutathione metabolism |
| 3796 | 635 | NM_031509 | vv | Glutathione metabolism |
| 2926 | 21011 | H32189 | nn | Glutathione metabolism |
| 2942 | 21012 | J02592 | b, l, General, gg, hh, kk, ll | Glutathione metabolism |
| 2945 | 21014 | J03914 | b, l, o, x, General, ll, rr | Glutathione metabolism |
| 3293 | 21013 | NM_017014 | cc | Glutathione metabolism |
| 3293 | 21015 | NM_017014 | s, cc | Glutathione metabolism |
| 1246 | 25148 | AB008807 | bb | Glutathione metabolism |
| 2084 | 17812 | AI169075 | uu | Glutathione metabolism, Styrene degradation, Tyrosine metabolism |
| 3085 | 2505 | NM_012597 | w | Glycerolipid metabolism |
| 3328 | 1305 | NM_017127 | oo | Glycerolipid metabolism |
| 3328 | 1306 | NM_017127 | f, l, General, kk, qq, vv | Glycerolipid metabolism |
| 3673 | 20380 | NM_024381 | o | Glycerolipid metabolism |
| 1210 | 14149 | AA998172 | y | Glycerolipid metabolism |
| 3973 | 6773 | NM_053410 | rr | Glycerolipid metabolism |
| 4028 | 7228 | NM_053654 | jj | Glycerolipid metabolism |
| 3352 | 3512 | NM_017177 | d, o, q, v, dd | Glycerolipid metabolism |
| 3352 | 3513 | NM_017177 | d, n, dd | Glycerolipid metabolism |
| 3389 | 17715 | NM_017274 | ss, xx | Glycerolipid metabolism |
| 3389 | 20282 | NM_017274 | y | Glycerolipid metabolism |
| 3259 | 200 | NM_013161 | k, v | Glycerolipid metabolism |
| 3778 | 8149 | NM_031242 | ii | Glycerolipid metabolism |
| 3979 | 14621 | NM_053437 | o, ss | Glycerolipid metabolism |
| 3317 | 1550 | NM_017084 | uu | Glycine, serine and threonine metabolism |
| 3317 | 1551 | NM_017084 | uu | Glycine, serine and threonine metabolism |
| 3317 | 1552 | NM_017084 | g, uu | Glycine, serine and threonine metabolism |
| 3686 | 21039 | NM_024484 | ii | Glycine, serine and threonine metabolism |
| 3207 | 24718 | NM_013003 | tt | Glycine, serine and threonine metabolism |
| 3837 | 21585 | NM_031620 | j | Glycine, serine and threonine metabolism |
| 3837 | 21586 | NM_031620 | j, u, dd, oo | Glycine, serine and threonine metabolism |
| 3837 | 21587 | NM_031620 | k | Glycine, serine and threonine metabolism |
| 3694 | 1995 | NM_030850 | d, h, uu | Glycine, serine and threonine metabolism, Methionine metabolism |
| 2105 | 4091 | AI169417 | l, rr, tt | Glycolysis/Gluconeogenesis, Glycolysis Pathway |
| 2897 | 935 | D49434 | bb, ww | Glycosaminoglycan degradation |
| 3294 | 17815 | NM_017015 | p, r, w, z | Glycosaminoglycan degradation, Porphyrin and chlorophyll metabolism, Starch and sucrose metabolism |
| 3507 | 574 | NM_019905 | m | Glyoxylate and dicarboxylate metabolism |
| 2592 | 573 | AI232087 | h, l, m, qq | Glyoxylate and dicarboxylate metabolism |
| 1126 | 2308 | AA964227 | l, General | Glyoxylate and dicarboxylate metabolism, One carbon pool by folate |
| 665 | 22537 | AA892799 | kk | Glyoxylate and dicarboxylate metabolism, Pyruvate metabolism |
| 665 | 22538 | AA892799 | z | Glyoxylate and dicarboxylate metabolism, Pyruvate metabolism |
| 850 | 22540 | AA924630 | ff | Glyoxylate and dicarboxylate metabolism, Pyruvate metabolism |
| 2591 | 22542 | AI232066 | ff | Glyoxylate and dicarboxylate metabolism, Pyruvate metabolism |
| 3104 | 24427 | NM_012669 | pp | Growth Hormone Signaling Pathway, Presenilin action in Notch and Wnt signaling, WNT Signaling Pathway |
| 3344 | 70 | NM_017159 | b, c, y | Histidine metabolism, Nitrogen metabolism |
| 3854 | 18403 | NM_031677 | r | Hypoxia and p53 in the Cardiovascular system |
| 3289 | 1698 | NM_017000 | e | Hypoxia and p53 in the Cardiovascular system, Sterol biosynthesis |
| 4017 | 20243 | NM_053615 | ff | Hypoxia and p53 in the Cardiovascular system, WNT Signaling Pathway |
| 3948 | 1423 | NM_052801 | mm | Hypoxia-Inducible Factor in the Cardiovascular System |
| 3948 | 1424 | NM_052801 | ww | Hypoxia-Inducible Factor in the Cardiovascular System |

TABLE 3-continued

| SEQ ID NO. | GLGC ID NO. | GenBank Acc. or RefSeq ID No. | Model Code | Pathways |
|---|---|---|---|---|
| 4175 | 656 | NM_133380 | x | IL 4 signaling pathway, Selective expression of chemokine receptors during T-cell polarization, Th1/Th2 Differentiation, il4 |
| 3799 | 24710 | NM_031512 | vv | IL 5 Signaling Pathway, Msp/Ron Receptor Signaling Pathway, Signal transduction through IL1R, interact6-1 |
| 3296 | 6598 | NM_017020 | j, n, xx | IL 6 signaling pathway, il6, interact6-1 |
| 3649 | 21238 | NM_024125 | t, ff | IL 6 signaling pathway, il6, interact6-1 |
| 3649 | 21239 | NM_024125 | d, l, z | IL 6 signaling pathway, il6, interact6-1 |
| 3321 | 4392 | NM_017101 | mm | IL-2 Receptor B Protein Interaction Pathway |
| 3321 | 4393 | NM_017101 | bb, mm | IL-2 Receptor B Protein Interaction Pathway |
| 3539 | 243 | NM_021989 | ii, rr | Inhibition of Matrix Metalloproteinases |
| 2306 | 17235 | AI176815 | n | Inhibition of Matrix Metalloproteinases, p53 Signaling Pathway |
| 2187 | 10087 | AI171803 | w, General, uu | Inositol metabolism, Propanoate metabolism, Valine, leucine and isoleucine degradation |
| 3732 | 17269 | NM_031057 | General, kk | Inositol metabolism, Propanoate metabolism, Valine, leucine and isoleucine degradation |
| 1809 | 9421 | AI072885 | pp | Inositol phosphate metabolism, Phosphatidylinositol signaling system |
| 3635 | 19669 | NM_022944 | x | Inositol phosphate metabolism, Phosphatidylinositol signaling system, Skeletal muscle hypertrophy is regulated via AKT/mTOR pathway |
| 3928 | 18640 | NM_032057 | p, ee | Inositol phosphate metabolism, Phosphatidylinositol signaling system, Streptomycin biosynthesis |
| 3435 | 20863 | NM_019152 | g | Integrin Signaling Pathway |
| 4367 | 25593 | U26310 | k | Integrin Signaling Pathway |
| 3382 | 1496 | NM_017255 | qq, vv | Ion Channel and Phorbal Esters Signaling Pathway |
| 1229 | 20271 | AA998747 | cc, mm | Lysine degradation |
| 4062 | 20270 | NM_053827 | bb, mm | Lysine degradation |
| 3059 | 15740 | NM_012520 | p | Methane metabolism, Tryptophan metabolism |
| 3059 | 15741 | NM_012520 | o, General, bb | Methane metabolism, Tryptophan metabolism |
| 234 | 576 | AA819118 | vv | Methionine metabolism, Selenoamino acid metabolism |
| 3359 | 20779 | NM_017201 | u | Methionine metabolism, Selenoamino acid metabolism |
| 4421 | 575 | X15734 | a, l | Methionine metabolism, Selenoamino acid metabolism |
| 3666 | 844 | NM_024352 | h, l, n, uu | Msp/Ron Receptor Signaling Pathway |
| 3802 | 20448 | NM_031530 | vv | Msp/Ron Receptor Signaling Pathway, Pertussis toxin-insensitive CCR5 Signaling in Macrophage |
| 3802 | 20449 | NM_031530 | vv | Msp/Ron Receptor Signaling Pathway, Pertussis toxin-insensitive CCR5 Signaling in Macrophage |
| 3239 | 15296 | NM_013102 | k | mTOR Signaling Pathway |
| 1202 | 16625 | AA998062 | j | N-Glycans biosynthesis |
| 3004 | 6626 | M24353 | l, k, General, ll | N-Glycans biosynthesis |
| 3861 | 21575 | NM_031698 | xx | N-Glycans biosynthesis |
| 3229 | 19335 | NM_013067 | x, dd | N-Glycans biosynthesis |
| 3696 | 15186 | NM_030861 | g, p, General, rr | N-Glycans biosynthesis |
| 3696 | 15187 | NM_030861 | n, z, General, rr | N-Glycans biosynthesis |
| 3696 | 15188 | NM_030861 | d, s, General | N-Glycans biosynthesis |
| 236 | 6018 | AA819140 | x | Nitrogen metabolism |
| 3480 | 24883 | NM_019293 | e, k, u | Nitrogen metabolism |
| 3782 | 18597 | NM_031325 | y, uu | Nucleotide sugars metabolism, Pentose and glucuronate interconversions, Starch and sucrose metabolism |
| 3595 | 12606 | NM_022547 | General, vv | One carbon pool by folate |
| 488 | 4339 | AA875121 | d | Overview of telomerase RNA component gene hTerc Transcriptional Regulation |
| 3163 | 4338 | NM_012866 | ll | Overview of telomerase RNA component gene hTerc Transcriptional Regulation |
| 1305 | 22056 | AI008066 | p, mm | Oxidative phosphorylation |
| 1919 | 15050 | AI103911 | r | Oxidative phosphorylation |
| 3360 | 14694 | NM_017202 | ff | Oxidative phosphorylation |
| 3983 | 21866 | NM_053472 | s | Oxidative phosphorylation |
| 4305 | 1448 | NM_145783 | oo | Oxidative phosphorylation |
| 4005 | 21423 | NM_053586 | r | Oxidative phosphorylation |
| 4005 | 21424 | NM_053586 | e, General | Oxidative phosphorylation |
| 1940 | 23574 | AI104520 | ll | Oxidative phosphorylation |
| 29 | 16901 | AA799479 | r | Oxidative phosphorylation, Ubiquinone biosynthesis |
| 3454 | 20938 | NM_019223 | t | Oxidative phosphorylation, Ubiquinone biosynthesis |
| 1456 | 21302 | AI013297 | o | Oxidative phosphorylation, Ubiquinone biosynthesis |
| 4416 | 15653 | X14210 | ee, ll | Oxidative phosphorylation, Ubiquinone biosynthesis |
| 13 | 1599 | AA686470 | General | p38 MAPK Signaling Pathway |
| 13 | 1600 | AA686470 | pp | p38 MAPK Signaling Pathway |
| 3654 | 1598 | NM_024134 | f, l, o, p, q, General, | p38 MAPK Signaling Pathway |

TABLE 3-continued

| SEQ ID NO. | GLGC ID NO. | GenBank Acc. or RefSeq ID No. | Model Code | Pathways |
|---|---|---|---|---|
| | | | cc, dd, kk, ll, gg | |
| 3559 | 11454 | NM_022381 | c, f, kk, tt | p53 Signaling Pathway |
| 3559 | 11455 | NM_022381 | c, f, jj, kk, nn | p53 Signaling Pathway |
| 3865 | 811 | NM_031705 | c, s, General, ll | Pantothenate and CoA biosynthesis, Pyrimidine metabolism, beta-Alanine metabolism |
| 3865 | 812 | NM_031705 | s, oo | Pantothenate and CoA biosynthesis, Pyrimidine metabolism, beta-Alanine metabolism |
| 4067 | 1508 | NM_053845 | e, uu, vv | Pantothenate and CoA biosynthesis, Pyrimidine metabolism, beta-Alanine metabolism |
| 805 | 23038 | AA900881 | t, mm | Pantothenate and CoA biosynthesis, Valine, leucine and isoleucine biosynthesis, Valine, leucine and isoleucine degradation |
| 3381 | 23037 | NM_017253 | t, mm | Pantothenate and CoA biosynthesis, Valine, leucine and isoleucine biosynthesis, Valine, leucine and isoleucine degradation |
| 3899 | 16039 | NM_031811 | b, c, ee, xx | Pentose phosphate pathway |
| 3376 | 24582 | NM_017243 | kk, pp | Pentose phosphate pathway, Purine metabolism |
| 449 | 17742 | AA866302 | ss | Phenylalanine metabolism, Tyrosine metabolism |
| 3371 | 17740 | NM_017233 | ss | Phenylalanine metabolism, Tyrosine metabolism |
| 3093 | 6055 | NM_012619 | b, l, General, uu | Phenylalanine, tyrosine and tryptophan biosynthesis |
| 3210 | 11905 | NM_013016 | s, x | Phosphatidylinositol signaling system |
| 3431 | 14971 | NM_019140 | n, bb | Phosphatidylinositol signaling system |
| 3431 | 14975 | NM_019140 | dd | Phosphatidylinositol signaling system |
| 4100 | 16809 | NM_053990 | l, oo | Phosphatidylinositol signaling system |
| 3097 | 1840 | NM_012637 | g | Phosphatidylinositol signaling system |
| 3097 | 1841 | NM_012637 | ww | Phosphatidylinositol signaling system |
| 3097 | 1844 | NM_012637 | ww | Phosphatidylinositol signaling system |
| 3464 | 1973 | NM_019249 | h, q, r, w, z, General, ee, nn | Phosphatidylinositol signaling system |
| 4073 | 19781 | NM_053883 | q, tt | Phosphatidylinositol signaling system |
| 765 | 18094 | AA899051 | rr | Phosphatidylinositol signaling system |
| 2332 | 18095 | AI177482 | rr | Phosphatidylinositol signaling system |
| 3237 | 18096 | NM_013088 | ff | Phosphatidylinositol signaling system |
| 4301 | 242 | NM_145683 | u | Phosphatidylinositol signaling system, T Cell Receptor Signaling Pathway |
| 3067 | 23868 | NM_012551 | dd, oo, tt | Phosphorylation of MEK1 by cdk5/p35 down regulates the MAP kinase pathway |
| 3067 | 23869 | NM_012551 | oo, tt | Phosphorylation of MEK1 by cdk5/p35 down regulates the MAP kinase pathway |
| 3067 | 23871 | NM_012551 | tt, vv | Phosphorylation of MEK1 by cdk5/p35 down regulates the MAP kinase pathway |
| 3067 | 23872 | NM_012551 | dd, tt | Phosphorylation of MEK1 by cdk5/p35 down regulates the MAP kinase pathway |
| 3351 | 114 | NM_017175 | oo | PKC-catalyzed phosphorylation of inhibitory phosphoprotein of myosin phosphatase |
| 2427 | 16081 | AI179610 | s, rr | Porphyrin and chlorophyll metabolism |
| 3172 | 18564 | NM_012899 | k, w | Porphyrin and chlorophyll metabolism |
| 416 | 14138 | AA859700 | p, General | Porphyrin and chlorophyll metabolism |
| 1565 | 7935 | AI043945 | General | Porphyrin and chlorophyll metabolism |
| 3262 | 1451 | NM_013168 | tt | Porphyrin and chlorophyll metabolism |
| 3262 | 1452 | NM_013168 | ii | Porphyrin and chlorophyll metabolism |
| 4069 | 24705 | NM_053850 | ww | Porphyrin and chlorophyll metabolism |
| 3062 | 16520 | NM_012532 | b, u | Porphyrin and chlorophyll metabolism |
| 3930 | 860 | NM_032063 | mm | Presenilin action in Notch and Wnt signaling, Proteolysis and Signaling Pathway of Notch |
| 3111 | 5850 | NM_012687 | g | Prostaglandin and leukotriene metabolism |
| 3370 | 20192 | NM_017232 | s | Prostaglandin and leukotriene metabolism |
| 3370 | 20193 | NM_017232 | qq, vv | Prostaglandin and leukotriene metabolism |
| 4353 | 13520 | S87522 | c | Prostaglandin and leukotriene metabolism |
| 1465 | 17065 | AI013531 | qq | Prostaglandin and leukotriene metabolism |
| 3441 | 17064 | NM_019170 | uu | Prostaglandin and leukotriene metabolism |
| 3812 | 692 | NM_031557 | g | Prostaglandin and leukotriene metabolism |
| 3120 | 4002 | NM_012708 | p, General, nn | Proteasome |
| 3120 | 4003 | NM_012708 | p | Proteasome |
| 3120 | 4004 | NM_012708 | nn | Proteasome |
| 3120 | 4005 | NM_012708 | General | Proteasome |
| 3391 | 15141 | NM_017278 | gg, hh | Proteasome |
| 3392 | 5747 | NM_017279 | p | Proteasome |
| 3392 | 5748 | NM_017279 | xx | Proteasome |
| 3393 | 1447 | NM_017281 | t | Proteasome |
| 3394 | 3254 | NM_017282 | e, kk, mm, nn | Proteasome |
| 3394 | 3256 | NM_017282 | l, j, xx | Proteasome |
| 3842 | 20940 | NM_031629 | y, nn | Proteasome |
| 3842 | 20941 | NM_031629 | bb | Proteasome |

TABLE 3-continued

| SEQ ID NO. | GLGC ID NO. | GenBank Acc. or RefSeq ID No. | Model Code | Pathways |
|---|---|---|---|---|
| 3842 | 20942 | NM_031629 | mm | Proteasome |
| 4108 | 22849 | NM_057099 | c | Proteasome |
| 4008 | 20842 | NM_053590 | mm | Proteasome |
| 2896 | 9135 | D45247 | b, mm | Proteasome |
| 3395 | 15535 | NM_017283 | ll | Proteasome |
| 3396 | 12523 | NM_017285 | tt | Proteasome |
| 3396 | 12524 | NM_017285 | kk | Proteasome |
| 2896 | 9134 | D45247 | j, y | Proteasome |
| 3762 | 15539 | NM_031132 | v | Proteasome, TGF beta signaling pathway, tgf-beta |
| 3832 | 11296 | NM_031606 | b, m, General, oo, ww, xx | PTEN dependent cell cycle arrest and apoptosis, Phosphatidylinositol signaling system, Regulation of eIF4e and p70 S6 Kinase, mTOR Signaling Pathway |
| 3832 | 11297 | NM_031606 | ss | PTEN dependent cell cycle arrest and apoptosis, Phosphatidylinositol signaling system, Regulation of eIF4e and p70 S6 Kinase, mTOR Signaling Pathway |
| 65 | 14250 | AA799729 | qq, vv | Purine metabolism |
| 3169 | 16708 | NM_012895 | a, b, h, w | Purine metabolism |
| 3369 | 442 | NM_017229 | y | Purine metabolism |
| 3808 | 1504 | NM_031544 | a, l, General, uu | Purine metabolism |
| 480 | 20389 | AA875045 | oo | Purine metabolism |
| 3888 | 14184 | NM_031776 | j | Purine metabolism |
| 3888 | 14185 | NM_031776 | j, r, y | Purine metabolism |
| 4064 | 16590 | NM_053838 | v | Purine metabolism |
| 1257 | 20438 | AF009656 | e, u | Purine metabolism |
| 2532 | 23041 | AI230130 | e | Purine metabolism |
| 3027 | 13547 | M63983 | e | Purine metabolism |
| 3707 | 997 | NM_031007 | u | Purine metabolism |
| 119 | 19020 | AA800291 | e, h, n | Purine metabolism |
| 2320 | 14384 | AI177096 | e | Purine metabolism |
| 2469 | 21505 | AI228005 | bb | Purine metabolism |
| 4045 | 1868 | NM_053768 | General, dd, vv | Purine metabolism |
| 4045 | 1869 | NM_053768 | q, General, dd, vv | Purine metabolism |
| 2865 | 4714 | AI639518 | k, ww, xx | Purine metabolism, Pyrimidine metabolism, RNA polymerase |
| 4085 | 15857 | NM_053948 | b, e, bb, oo, ww | Purine metabolism, Pyrimidine metabolism, RNA polymerase |
| 63 | 20995 | AA799724 | General | Purine metabolism, Pyrimidine metabolism, RNA polymerase |
| 63 | 20996 | AA799724 | b, f, General, kk, nn, gg | Purine metabolism, Pyrimidine metabolism, RNA polymerase |
| 2650 | 5778 | AI233246 | ii | Purine metabolism, Pyrimidine metabolism, RNA polymerase |
| 2654 | 5779 | AI233350 | l | Purine metabolism, Pyrimidine metabolism, RNA polymerase |
| 3886 | 15647 | NM_031773 | l, y | Purine metabolism, Pyrimidine metabolism, RNA polymerase |
| 3787 | 15360 | NM_031335 | p, v | Purine metabolism, Pyrimidine metabolism, RNA polymerase |
| 3835 | 24235 | NM_031614 | uu | Pyrimidine metabolism |
| 3276 | 20826 | NM_013218 | gg, hh | Pyrimidine metabolism |
| 4009 | 20896 | NM_053592 | w, x, bb | Pyrimidine metabolism |
| 4466 | 25746 | X80778 | t | Pyrimidine metabolism |
| 3943 | 1409 | NM_033349 | t, jj | Pyruvate metabolism |
| 2465 | 22845 | AI227887 | t | Ras Signaling Pathway, Role of PI3K subunit p85 in regulation of Actin Organization and Cell Migration, p38 MAPK Signaling Pathway |
| 3509 | 18714 | NM_020075 | y | Regulation of eIF2 |
| 3509 | 18715 | NM_020075 | l | Regulation of eIF2 |
| 3509 | 18716 | NM_020075 | p, gg, hh | Regulation of eIF2 |
| 3828 | 14295 | NM_031599 | f, l, pp | Regulation of eIF2 |
| 3697 | 1928 | NM_030872 | z, General, ee, kk | Regulation of eIF4e and p70 S6 Kinase |
| 2090 | 23152 | AI169170 | xx | Regulation of eIF4e and p70 S6 Kinase, mTOR Signaling Pathway |
| 4250 | 9896 | NM_138878 | p | Regulation of p27 Phosphorylation during Cell Cycle Progression |
| 3084 | 24735 | NM_012596 | pp | Reversal of Insulin Resistance by Leptin |
| 2434 | 3376 | AI179755 | w | Rho cell motility signaling pathway |
| 3434 | 17304 | NM_019144 | d, p, gg, hh | Riboflavin metabolism |
| 3284 | 24649 | NM_016988 | b, e, l, w, General | Riboflavin metabolism |
| 1206 | 3364 | AA998097 | General | Selenoamino acid metabolism |
| 60 | 2040 | AA799700 | w | Selenoamino acid metabolism |
| 3345 | 17105 | NM_017160 | ee | Skeletal muscle hypertrophy is regulated via AKT/mTOR pathway, mTOR Signaling Pathway |

TABLE 3-continued

| SEQ ID NO. | GLGC ID NO. | GenBank Acc. or RefSeq ID No. | Model Code | Pathways |
|---|---|---|---|---|
| 1753 | 16058 | AI071490 | General, vv | Sphingoglycolipid metabolism |
| 107 | 4832 | AA800190 | oo | Starch and sucrose metabolism |
| 3553 | 10509 | NM_022268 | p, General | Starch and sucrose metabolism |
| 3553 | 25814 | NM_022268 | l | Starch and sucrose metabolism |
| 3795 | 24645 | NM_031502 | a, d, k, l, dd, uu | Starch and sucrose metabolism |
| 3728 | 301 | NM_031049 | jj | Sterol biosynthesis |
| 3726 | 302 | NM_031049 | jj | Sterol biosynthesis |
| 3728 | 303 | NM_031049 | k, jj | Sterol biosynthesis |
| 3248 | 650 | NM_013134 | vv | Sterol biosynthesis |
| 3248 | 651 | NM_013134 | t | Sterol biosynthesis |
| 3248 | 652 | NM_013134 | n, t | Sterol biosynthesis |
| 3734 | 400 | NM_031062 | jj, ww | Sterol biosynthesis |
| 3735 | 21701 | NM_031063 | jj | Sterol biosynthesis |
| 4120 | 8592 | NM_057137 | q, xx | Sterol biosynthesis |
| 3331 | 16681 | NM_017136 | r, w, jj | Sterol biosynthesis, Terpenoid biosynthesis |
| 3331 | 16682 | NM_017136 | t, mm | Sterol biosynthesis, Terpenoid biosynthesis |
| 3458 | 16449 | NM_019238 | jj | Sterol biosynthesis, Terpenoid biosynthesis |
| 3458 | 16450 | NM_019238 | jj, oo, ss | Sterol biosynthesis, Terpenoid biosynthesis |
| 3458 | 16451 | NM_019238 | bb, jj | Sterol biosynthesis, Terpenoid biosynthesis |
| 3458 | 16452 | NM_019238 | jj | Sterol biosynthesis, Terpenoid biosynthesis |
| 2752 | 7691 | AI236611 | v, x, bb | Sterol biosynthesis, Terpenoid biosynthesis |
| 3993 | 1058 | NM_053539 | d, o, q, v, jj, pp | Sterol biosynthesis, Terpenoid biosynthesis |
| 3910 | 15069 | NM_031840 | k, s, jj | Sterol biosynthesis, Terpenoid biosynthesis |
| 3910 | 15070 | NM_031840 | ii, jj, rr | Sterol biosynthesis, Terpenoid biosynthesis |
| 3910 | 25460 | NM_031840 | k, jj | Sterol biosynthesis, Terpenoid biosynthesis |
| 3354 | 23961 | NM_017181 | b, uu, vv | Styrene degradation, Tyrosine metabolism |
| 3761 | 14970 | NM_031127 | l, p, x, z, General, kk, nn | Sulfur metabolism |
| 3904 | 4748 | NM_031834 | k, cc, vv | Sulfur metabolism |
| 3904 | 4749 | NM_031834 | b, k, l, ii | Sulfur metabolism |
| 3106 | 17117 | NM_012673 | w | T Cytotoxic Cell Surface Molecules, T Helper Cell Surface Molecules |
| 3530 | 19824 | NM_021750 | c, General, kk | Taurine and hypotaurine metabolism |
| 3530 | 19825 | NM_021750 | l, General, dd, ii, qq, vv | Taurine and hypotaurine metabolism |
| 2961 | 790 | L10073 | g | Taurine and hypotaurine metabolism |
| 3156 | 17541 | NM_012844 | l, s, General, ff, ll, ww | Tetrachloroethene degradation |
| 3632 | 2006 | NM_022936 | o, xx | Tetrachloroethene degradation |
| 3632 | 2007 | NM_022936 | o, s | Tetrachloroethene degradation |
| 3632 | 2008 | NM_022936 | o, s, xx | Tetrachloroethene degradation |
| 3632 | 2009 | NM_022936 | n, o | Tetrachloroethene degradation |
| 3446 | 15242 | NM_019191 | f, General, jj | TGF beta signaling pathway, tgf-beta |
| 3815 | 16164 | NM_031563 | h, m, n, General | Transcriptional activation of dbpb from mRNA |
| 3148 | 326 | NM_012818 | ss | Tryptophan metabolism |
| 3510 | 20493 | NM_020076 | b, k, l, General, bb, ff, qq, tt, uu | Tryptophan metabolism |
| 3510 | 20494 | NM_020076 | cc, ii, ss | Tryptophan metabolism |
| 3569 | 402 | NM_022403 | c, l, vv, xx | Tryptophan metabolism |
| 4080 | 794 | NM_053902 | l | Tryptophan metabolism |
| 3814 | 18315 | NM_031561 | o | TSP-1 Induced Apoptosis in Microvascular Endothelial Cell |
| 3814 | 18316 | NM_031561 | o | TSP-1 Induced Apoptosis in Microvascular Endothelial Cell |
| 3814 | 18317 | NM_031561 | o | TSP-1 Induced Apoptosis in Microvascular Endothelial Cell |
| 3814 | 18318 | NM_031561 | j | TSP-1 Induced Apoptosis in Microvascular Endothelial Cell |
| 3814 | 18319 | NM_031561 | o | TSP-1 Induced Apoptosis in Microvascular Endothelial Cell |
| 3814 | 25139 | NM_031561 | o | TSP-1 Induced Apoptosis in Microvascular Endothelial Cell |
| 3061 | 11115 | NM_012531 | l, nn | Tyrosine metabolism |
| 3061 | 11116 | NM_012531 | nn | Tyrosine metabolism |
| 3083 | 4449 | NM_012592 | z, General | Valine, leucine and isoleucine degradation |

TABLE 3-continued

| SEQ ID NO. | GLGC ID NO. | GenBank Acc. or RefSeq ID No. | Model Code | Pathways |
|---|---|---|---|---|
| 3083 | 4450 | NM_012592 | p | Valine, leucine and isoleucine degradation |
| 1476 | 21950 | AI013861 | h | Valine, leucine and isoleucine degradation |
| 3448 | 18572 | NM_019201 | pp, tt | WNT Signaling Pathway |

TABLE 4

| Model | Time Point (hr) | Model Code |
|---|---|---|
| amiodarone | 24 | a |
| anit | 24 | b |
| apap | 24 | c |
| apap | 3, 6 | d |
| ay-25329 | 24 | e |
| ay-25329 | 3, 6 | f |
| carbamazepine | 24 | g |
| Carcinogen Genotoxic | Various | h |
| Carcinogen NonGenotoxic | Various | i |
| ccl4 | 24 | j |
| chlorpromazine | 3, 6, 24 | k |
| Cholestasis | Various | l |
| ci1000 | 24 | m |
| ci1000 | 3, 6 | n |
| clofibrate | 24 | o |
| cpa | 3, 6 | p |
| diclofenac | 24 | q |
| diclofenac | 3, 6 | r |
| diflunisal | 6, 24 | s |
| Direct Acting | Various | t |
| dmn | 24 | u |
| estradiol | 24 | v |
| estradiol | 3, 6 | w |
| gemfibrozil | 24 | x |
| gemfibrozil | 3, 6 | y |
| Hepatitis | Various | z |
| General | Various | aa |
| hydrazine | 24 | bb |
| imipramine | 24 | cc |
| indomethacin | 24 | dd |
| indomethacin | 3, 6 | ee |
| Inducer Liver Enlargement | Various | ff |
| Inflammation | Various | gg |
| lps | 24 | hh |
| methotrexate | 24 | ii |
| lovastatin | 24 | jj |
| Necrosis | Various | kk |
| Necrosis Steatosis | Various | ll |
| NegCtrls | Various | mm |
| Peroxisome Prolif | Various | nn |
| phenobarbital | 24 | oo |
| phenobarbital | 3, 6 | pp |
| Steatosis | Various | qq |
| Steatosis Hepatitis | Various | rr |
| tacrine | 24 | ss |
| tacrine | 3, 6 | tt |
| tamoxifen | 24 | uu |
| tetracycline | 24 | vv |
| valproate | 6, 24 | ww |
| wy-14643 | 3 | xx |

TABLE 5A

AMIODARONE
Timepoint(s): 24 hrs

| GLGC ID NO. | LDA Score | Mean Tox | SD Tox | Mean Nontox | SD Nontox |
|---|---|---|---|---|---|
| 19227 | 99.3537 | 237.5478 | 9.4790 | 122.0614 | 33.4838 |
| 15891 | 99.2949 | 664.6183 | 27.2304 | 353.6949 | 82.6001 |
| 24693 | 98.9424 | 5.9428 | 9.9573 | 774.2990 | 485.4948 |
| 20746 | 98.6486 | 1890.1518 | 183.4396 | 559.2120 | 295.3021 |
| 18725 | 98.6486 | 15.4600 | 1.3119 | 93.1144 | 59.1159 |
| 20745 | 98.5899 | 1186.4775 | 145.7624 | 410.1949 | 217.0560 |
| 25694 | 98.5899 | 27.6885 | 0.8157 | 10.5083 | 7.6496 |
| 7459 | 98.5311 | 678.6165 | 38.9410 | 1498.9003 | 427.3513 |
| 1925 | 98.5311 | 197.1045 | 12.0379 | 95.3063 | 34.6330 |
| 1798 | 98.4136 | 339.0583 | 19.4480 | 1202.4789 | 660.6362 |
| 19226 | 98.4136 | 314.5943 | 23.0072 | 187.4882 | 44.2100 |
| 1546 | 98.3549 | 30.2790 | 2.9156 | 108.1889 | 45.4599 |
| 17754 | 98.3549 | 861.7003 | 36.9938 | 461.2268 | 161.4413 |
| 16947 | 98.2374 | 89.0373 | 9.0197 | 346.8332 | 139.0200 |
| 16895 | 98.2374 | 8.7830 | 7.3940 | 266.3850 | 166.9155 |
| 4517 | 98.1786 | 115.6470 | 6.9333 | 57.0316 | 20.6191 |
| 23660 | 98.1199 | 451.7370 | 29.3710 | 999.4975 | 278.6556 |
| 18069 | 98.1199 | 119.5903 | 56.3270 | 27.6058 | 24.0523 |
| 17271 | 98.0611 | 48.2335 | 3.4521 | 22.2641 | 8.8891 |
| 1818 | 98.0611 | 302.7925 | 23.3457 | 761.8910 | 294.9364 |
| 19059 | 98.0020 | 81.7113 | 55.2270 | −11.9952 | 19.0361 |
| 16650 | 97.9436 | 984.8695 | 199.5778 | 307.8347 | 152.7819 |
| 588 | 97.8848 | 82.1803 | 11.4658 | 295.3147 | 124.7987 |
| 16524 | 97.8261 | 85.1848 | 9.5840 | 37.7218 | 14.4670 |
| 19631 | 97.8261 | 102.9018 | 9.3182 | 45.7772 | 18.9003 |
| 20698 | 97.7673 | 10.6448 | 11.2907 | 375.2461 | 209.6079 |
| 20421 | 97.7673 | 96.5418 | 8.4793 | 50.9359 | 14.6279 |
| 8599 | 97.7673 | 90.3548 | 6.1425 | 40.4861 | 18.4379 |
| 17604 | 97.7673 | 154.1105 | 6.9312 | 90.9187 | 28.3066 |
| 16708 | 97.7086 | 153.2685 | 3.8280 | 261.0070 | 84.4659 |
| 1146 | 97.7086 | 96.6360 | 9.8336 | 36.6841 | 18.0282 |
| 20405 | 97.7086 | 39.4923 | 17.1729 | 219.3474 | 96.6090 |
| 818 | 97.6498 | 380.2108 | 140.0541 | 2886.6125 | 1763.6190 |
| 20971 | 97.6498 | 152.5923 | 4.6182 | 98.0412 | 31.6824 |
| 20700 | 97.5911 | 938.3848 | 184.0039 | 3038.1616 | 1093.1116 |
| 21882 | 97.5911 | 375.2395 | 21.5724 | 684.7875 | 179.0462 |
| 16346 | 97.5323 | 354.4890 | 35.6167 | 160.2222 | 65.0523 |
| 1942 | 97.5323 | −4.0835 | 0.8028 | 35.7589 | 58.4215 |
| 20960 | 97.5323 | 936.4035 | 38.3038 | 567.4968 | 152.9725 |
| 20778 | 97.5323 | 113.9043 | 7.7578 | 65.7477 | 18.0438 |
| 24105 | 97.5323 | 80.1058 | 12.1136 | 33.3450 | 15.1070 |
| 19679 | 97.5323 | 19.2213 | 3.0228 | 74.3247 | 49.4056 |
| 4593 | 97.4736 | 579.0483 | 191.1175 | 126.9294 | 152.5171 |
| 1376 | 97.4736 | 31.9268 | 1.9123 | 18.5861 | 6.2796 |
| 570 | 97.4736 | 508.8248 | 87.4490 | 257.9509 | 79.7458 |
| 16993 | 97.4736 | 5.2723 | 9.2009 | 111.8037 | 65.8527 |
| 17039 | 97.4148 | 245.4835 | 18.1872 | 134.5809 | 40.7935 |
| 24670 | 97.4148 | 39.2255 | 14.4852 | 175.0608 | 64.5671 |
| 8182 | 97.4148 | 255.6065 | 51.5111 | 817.8461 | 299.6077 |
| 4594 | 97.3561 | 966.2893 | 281.3000 | 174.8865 | 223.6608 |
| 17999 | 97.3561 | 430.8943 | 59.7906 | 968.1279 | 261.6398 |
| 1504 | 97.2973 | 81.2268 | 26.7097 | 16.9902 | 14.9484 |
| 18883 | 97.2973 | 127.7325 | 10.1291 | 76.7439 | 17.7798 |
| 12299 | 97.2973 | 215.0775 | 21.0509 | 471.5100 | 159.4446 |
| 4547 | 97.2973 | 164.5733 | 20.2171 | 91.7422 | 23.0812 |
| 23343 | 97.2385 | 85.2673 | 3.0350 | 54.9234 | 21.7933 |
| 25799 | 97.1798 | 573.4228 | 43.8220 | 211.3966 | 139.3948 |
| 8266 | 97.1798 | 606.4828 | 131.9853 | 2088.0466 | 952.5685 |
| 25325 | 97.1210 | 104.6418 | 70.8716 | 980.3722 | 541.5019 |
| 382 | 97.1210 | −29.6223 | 7.7239 | 44.1494 | 43.2343 |
| 6049 | 97.0623 | 2163.6495 | 311.8916 | 1212.2164 | 281.4331 |

TABLE 5A-continued

AMIODARONE
Timepoint(s): 24 hrs

| GLGC ID NO. | LDA Score | Mean Tox | SD Tox | Mean Nontox | SD Nontox |
|---|---|---|---|---|---|
| 1130 | 97.0623 | 302.9488 | 63.2883 | 969.2272 | 386.8300 |
| 19101 | 97.0035 | 282.6973 | 38.9054 | 117.3576 | 50.3312 |
| 5497 | 97.0035 | 35.1683 | 16.5699 | 212.6923 | 135.0406 |
| 670 | 96.8860 | 81.5793 | 12.5146 | 313.6205 | 123.2619 |
| 20586 | 96.8860 | 20.1963 | 8.4496 | 142.0140 | 69.0493 |
| 21842 | 96.8860 | 1093.5040 | 82.2799 | 478.1786 | 259.3258 |
| 26032 | 96.8860 | 67.3053 | 18.9306 | 502.6090 | 438.5387 |
| 16018 | 96.8860 | 249.3688 | 43.0307 | 102.3648 | 47.4464 |
| 6425 | 96.8860 | 258.8950 | 30.2217 | 146.7642 | 38.7837 |
| 13005 | 96.8860 | 304.0158 | 85.6333 | 104.3331 | 46.6571 |
| 18730 | 96.8860 | 259.6305 | 75.8338 | 1241.4116 | 593.0451 |
| 18578 | 96.8273 | 365.2230 | 67.8270 | 136.3383 | 101.2350 |
| 575 | 96.8273 | 31.8003 | 7.6632 | 169.8753 | 104.1103 |
| 15661 | 96.8273 | 64.1050 | 4.5854 | 29.6029 | 26.4071 |
| 25204 | 96.7685 | 20.8115 | 4.3729 | 106.6515 | 56.2028 |
| 1583 | 96.7685 | 219.5193 | 14.0706 | 122.4061 | 42.4123 |
| 25326 | 96.7685 | 879.7590 | 180.0783 | 2199.9202 | 685.7314 |
| 21350 | 96.7685 | 59.4465 | 12.9149 | 19.5448 | 14.5359 |
| 19144 | 96.7685 | 23.3323 | 1.0373 | 12.8535 | 8.3691 |
| 23324 | 96.7098 | 199.6150 | 46.3919 | 44.5582 | 62.5752 |
| 22413 | 96.7098 | 1529.8625 | 480.3424 | 461.5830 | 272.5368 |
| 1854 | 96.7098 | 714.9543 | 187.2927 | 2085.4645 | 888.2733 |
| 1037 | 96.7098 | 164.9610 | 9.2642 | 94.6965 | 44.2249 |
| 14034 | 96.6510 | 164.4735 | 8.3770 | 96.4698 | 30.5137 |
| 19177 | 96.6510 | 116.8100 | 37.2390 | 37.9294 | 19.6835 |
| 1850 | 96.6510 | 806.1135 | 205.0686 | 2283.4617 | 1008.9738 |
| 24362 | 96.5922 | 414.5140 | 28.9011 | 1371.8917 | 765.5993 |
| 23192 | 96.5335 | 202.7878 | 3.7852 | 285.5847 | 85.7375 |
| 10503 | 96.5335 | 55.4060 | 5.2182 | 183.7161 | 121.5956 |
| 24645 | 96.5335 | 39.1603 | 8.6167 | 115.8294 | 43.6326 |
| 15682 | 96.5335 | 109.9260 | 9.6581 | 58.0469 | 22.9376 |
| 18881 | 96.5335 | 33.6695 | 4.8400 | 16.3807 | 6.0946 |
| 16376 | 96.4747 | 36.7405 | 0.6836 | 31.0483 | 16.6419 |
| 24326 | 96.4747 | 1265.2950 | 49.6198 | 826.1223 | 255.2820 |
| 820 | 96.4160 | 143.5745 | 72.7519 | 1033.5250 | 716.2222 |
| 16017 | 96.3572 | 93.8553 | 27.2057 | 35.7248 | 18.4475 |
| 771 | 96.3572 | 91.2233 | 23.1086 | 32.1010 | 16.8266 |
| 21001 | 96.3572 | 253.3903 | 10.4906 | 178.5226 | 39.6339 |
| 24453 | 96.3572 | 8.2448 | 4.2925 | 39.2748 | 18.3887 |
| 16496 | 99.5887 | 405.5363 | 38.9131 | 1131.7293 | 408.5323 |
| 7683 | 99.5300 | 1272.7238 | 33.3495 | 628.4154 | 178.5282 |
| 2818 | 99.1187 | 739.8768 | 18.0280 | 502.3980 | 82.4618 |
| 6005 | 99.0599 | 984.5308 | 11.8395 | 1474.3549 | 310.7437 |
| 3062 | 98.8249 | 390.7458 | 15.6797 | 1117.6792 | 442.2921 |
| 4521 | 98.7662 | 142.5955 | 10.7502 | 304.9070 | 86.0162 |
| 1148 | 98.7074 | 590.6433 | 97.1960 | 207.1857 | 89.4288 |
| 7147 | 98.5899 | 508.5110 | 34.3797 | 1056.6155 | 253.3393 |
| 12354 | 98.5311 | 473.1683 | 72.1941 | 152.5497 | 73.9953 |
| 12479 | 98.4724 | 428.2905 | 55.0405 | 1666.1192 | 812.0432 |
| 12908 | 98.4136 | 721.7805 | 196.1904 | 88.3413 | 99.6503 |
| 16314 | 98.3549 | 117.0538 | 7.4441 | 45.9282 | 35.0244 |
| 7596 | 98.3549 | 400.8305 | 75.1441 | 161.5614 | 55.6695 |
| 16865 | 98.2961 | 290.6443 | 107.3565 | 41.9286 | 51.4241 |
| 5377 | 98.2961 | 87.0393 | 8.9609 | 31.0460 | 21.0164 |
| 18800 | 98.1786 | 585.7013 | 21.1459 | 259.0642 | 186.8598 |
| 15644 | 98.1786 | 846.1423 | 45.5800 | 1516.8638 | 399.1451 |
| 8057 | 98.1199 | 76.9045 | 21.7453 | 14.2054 | 15.8823 |
| 23200 | 98.0611 | 229.5073 | 9.5432 | 138.8740 | 38.5548 |
| 14656 | 98.0611 | 157.5353 | 13.4656 | 67.3595 | 28.4443 |
| 18612 | 98.0611 | 388.6913 | 18.0706 | 222.1326 | 67.6918 |
| 19555 | 98.0611 | 116.1578 | 6.8729 | 384.0183 | 247.0203 |
| 23808 | 98.0024 | 130.0633 | 24.4008 | 323.9509 | 86.4883 |
| 5355 | 97.9436 | 178.6520 | 54.8038 | 1112.0963 | 518.9281 |
| 15500 | 97.9436 | 645.6283 | 19.5208 | 448.6024 | 94.4894 |
| 3475 | 97.8261 | 215.6923 | 3.8099 | 324.4232 | 89.2062 |
| 12916 | 97.7673 | 64.4325 | 11.5686 | 20.2753 | 18.9189 |
| 22883 | 97.7673 | 196.2880 | 37.2430 | 91.8094 | 28.5421 |
| 23162 | 97.7086 | 84.0273 | 13.9702 | 420.9424 | 302.2216 |
| 18765 | 97.7086 | 188.8203 | 26.0729 | 693.5048 | 317.2794 |
| 6808 | 97.7086 | 812.3230 | 138.6541 | 1721.1242 | 435.7420 |
| 8926 | 97.6498 | 358.0805 | 140.7574 | 103.5883 | 49.6079 |
| 22801 | 97.6498 | 437.7643 | 87.4251 | 1445.0242 | 649.3366 |
| 3917 | 97.5911 | 54.9983 | 63.1220 | 873.0312 | 516.8557 |

TABLE 5A-continued

AMIODARONE
Timepoint(s): 24 hrs

| GLGC ID NO. | LDA Score | Mean Tox | SD Tox | Mean Nontox | SD Nontox |
|---|---|---|---|---|---|
| 11173 | 97.5911 | 156.9755 | 48.8266 | 638.3982 | 212.4591 |
| 18909 | 97.5911 | 67.8935 | 10.5592 | 366.3420 | 198.4210 |
| 7359 | 97.5323 | 273.9243 | 12.9310 | 172.5763 | 39.6917 |
| 21885 | 97.5323 | 125.6663 | 7.4470 | 61.5046 | 25.9663 |
| 19206 | 97.5323 | 90.8053 | 20.1546 | 23.8699 | 17.5814 |
| 9399 | 97.5323 | 391.2453 | 83.4745 | 206.3806 | 51.3381 |
| 22746 | 97.4736 | 17.7768 | 11.6834 | 157.1981 | 88.2396 |
| 22079 | 97.4148 | 1171.8738 | 112.8873 | 2413.7116 | 764.1889 |
| 12769 | 97.4148 | 172.1220 | 61.2983 | 37.8882 | 39.2371 |
| 11550 | 97.3561 | 93.4875 | 5.1468 | 47.3131 | 23.8512 |
| 22586 | 97.3561 | 142.2270 | 84.8485 | 3849.5442 | 3589.5813 |
| 22387 | 97.2973 | 1501.9503 | 35.7480 | 1043.8475 | 263.3120 |
| 2528 | 97.2973 | 556.9448 | 75.7505 | 202.6152 | 115.2814 |

TABLE 5B

ANIT
Timepoint(s): 24 hrs

| GLGC ID NO. | LDA Score | Mean Tox | SD Tox | Mean Nontox | SD Nontox |
|---|---|---|---|---|---|
| 17226 | 99.6475 | 260.2300 | 29.4102 | 847.1671 | 245.8089 |
| 958 | 99.6475 | 171.7825 | 6.1527 | 505.1358 | 203.1121 |
| 10306 | 99.5887 | 1656.4500 | 89.5745 | 648.9015 | 230.8451 |
| 22582 | 99.5300 | 24.8575 | 1.5360 | 81.2763 | 39.7678 |
| 17227 | 99.4125 | 457.2900 | 49.1530 | 1279.9480 | 335.6271 |
| 17393 | 99.4125 | 1004.3575 | 91.5302 | 480.0924 | 115.3988 |
| 20650 | 99.3537 | 30.5775 | 4.4423 | 607.5490 | 404.7953 |
| 18867 | 99.2949 | 36.9200 | 8.3960 | 310.5191 | 157.0590 |
| 556 | 99.2949 | 92.9600 | 5.4166 | 265.0881 | 88.8586 |
| 20712 | 99.2949 | 60.3375 | 7.2241 | 246.6753 | 132.5902 |
| 7914 | 99.2362 | 7.4525 | 3.3544 | 75.2857 | 35.1121 |
| 17145 | 99.1774 | 122.5500 | 22.3433 | 501.2566 | 208.9837 |
| 16039 | 99.1774 | 1555.8475 | 239.0546 | 710.0814 | 198.7351 |
| 2384 | 99.1187 | 12.7300 | 3.4102 | 287.4855 | 165.4902 |
| 819 | 99.1187 | 296.9500 | 28.6319 | 1706.3283 | 942.6241 |
| 15661 | 99.1187 | 109.5150 | 8.7478 | 29.3894 | 25.9353 |
| 11755 | 99.1187 | 167.3525 | 14.4052 | 686.1423 | 302.1233 |
| 25024 | 99.1187 | 34.6700 | 8.1472 | 239.8022 | 113.9015 |
| 6055 | 99.0012 | 24.5550 | 8.9442 | 315.8067 | 163.0696 |
| 20915 | 99.0012 | 61.4800 | 9.0675 | 416.2936 | 339.2109 |
| 18107 | 99.0012 | 1336.6650 | 49.3207 | 789.4380 | 164.3049 |
| 626 | 98.9424 | 418.7675 | 78.5459 | 88.1139 | 71.7967 |
| 17146 | 98.9424 | 5.3575 | 10.3645 | 311.6243 | 163.0481 |
| 707 | 98.9424 | 69.7350 | 9.2046 | 20.3268 | 12.7871 |
| 15516 | 98.9424 | 229.8925 | 19.4393 | 118.8714 | 26.6507 |
| 20597 | 98.8837 | 341.3975 | 50.6871 | 1004.2454 | 292.2911 |
| 16520 | 98.8837 | 314.1200 | 51.0088 | 1107.7091 | 460.8147 |
| 20716 | 98.8249 | 136.1825 | 16.2657 | 524.2016 | 180.6620 |
| 11296 | 98.8249 | 298.1875 | 55.0257 | 113.7404 | 36.8520 |
| 21014 | 98.8249 | 145.1225 | 30.4029 | 830.3951 | 436.6797 |
| 15850 | 98.8249 | 3181.9800 | 262.7109 | 1960.7014 | 341.5800 |
| 21657 | 98.8249 | 289.4750 | 42.9002 | 889.0573 | 404.7665 |
| 23274 | 98.7662 | 1606.7000 | 176.4449 | 945.9733 | 176.2985 |
| 1529 | 98.7662 | 26.8125 | 5.6383 | 114.2765 | 46.7335 |
| 18430 | 98.7074 | 243.6850 | 28.7774 | 71.8774 | 42.6409 |
| 1514 | 98.7074 | 391.7850 | 25.6586 | 145.9972 | 62.9319 |
| 18726 | 98.7074 | 54.3250 | 4.9052 | 194.8737 | 85.1441 |
| 699 | 98.7074 | 126.3225 | 21.6857 | 344.9964 | 109.8292 |
| 24693 | 98.7074 | 59.0275 | 6.1621 | 774.0495 | 485.8765 |
| 7602 | 98.7074 | 601.4825 | 57.6071 | 349.5946 | 99.2395 |
| 20701 | 98.6486 | 35.3050 | 13.4351 | 399.9427 | 198.8453 |
| 6108 | 98.6486 | 1257.5950 | 153.7835 | 506.8269 | 168.3936 |
| 20996 | 98.6486 | 563.4050 | 60.0400 | 249.5158 | 88.8218 |
| 18331 | 98.6486 | 1068.9125 | 351.8292 | 194.1789 | 102.9796 |
| 14347 | 98.5899 | 286.6525 | 22.2057 | 884.5109 | 341.5771 |
| 2368 | 98.5899 | 248.3250 | 20.4877 | 464.7006 | 104.1860 |
| 109 | 98.5899 | 1220.6625 | 215.4760 | 3518.8273 | 1219.9646 |
| 15028 | 98.5899 | 51.1875 | 17.0011 | 337.0457 | 149.0499 |

TABLE 5B-continued

ANIT
Timepoint(s): 24 hrs

| GLGC ID NO. | LDA Score | Mean Tox | SD Tox | Mean Nontox | SD Nontox |
|---|---|---|---|---|---|
| 111 | 98.5311 | 1154.5000 | 120.5988 | 2872.5752 | 975.8517 |
| 23248 | 98.5311 | 119.3600 | 9.4801 | 39.6988 | 36.7799 |
| 70 | 98.4724 | 33.3500 | 3.5382 | 106.8160 | 50.4471 |
| 24204 | 98.4136 | 282.6300 | 16.0594 | 154.7034 | 48.6518 |
| 16947 | 98.4136 | 68.0425 | 12.1380 | 346.9319 | 138.8283 |
| 21012 | 98.4136 | 278.5050 | 50.7066 | 1222.4598 | 628.8894 |
| 19831 | 98.4136 | 200.1900 | 18.7815 | 107.3044 | 32.1896 |
| 14989 | 98.4136 | 761.9800 | 52.9341 | 450.4529 | 89.2946 |
| 591 | 98.3549 | 95.7775 | 9.8999 | 37.0750 | 16.6713 |
| 17101 | 98.3549 | 786.3625 | 28.2350 | 456.0729 | 164.1279 |
| 20998 | 98.3549 | 236.8825 | 25.8019 | 614.3989 | 220.5771 |
| 16780 | 98.3549 | 64.1125 | 4.5187 | 175.0989 | 96.2990 |
| 23961 | 98.2961 | 43.8725 | 18.2043 | 274.4207 | 121.5970 |
| 2744 | 98.2961 | 504.6525 | 25.3389 | 314.3893 | 85.6597 |
| 9135 | 98.2961 | 983.9925 | 5.8230 | 1000.8397 | 221.8925 |
| 25475 | 98.2961 | −0.4050 | 8.2282 | 139.3692 | 86.1464 |
| 10108 | 98.2961 | 479.9000 | 74.9704 | 204.0318 | 79.9186 |
| 17805 | 98.2374 | 142.7425 | 30.0475 | 658.8843 | 269.8694 |
| 18728 | 98.2374 | 307.9675 | 32.8908 | 163.4587 | 37.1792 |
| 1728 | 98.2374 | 386.6850 | 20.1036 | 227.3063 | 89.6840 |
| 8317 | 98.2374 | 74.9550 | 21.1926 | 244.7780 | 101.6263 |
| 23806 | 98.1786 | 113.9400 | 10.7734 | 339.7217 | 116.6303 |
| 19942 | 98.1786 | 256.9775 | 14.4830 | 146.1837 | 42.5731 |
| 20649 | 98.1786 | 22.8400 | 8.0761 | 347.8181 | 312.4591 |
| 16825 | 98.1786 | 95.4325 | 5.7153 | 45.7425 | 24.7772 |
| 24649 | 98.1199 | 38.0150 | 4.1274 | 92.5731 | 26.3787 |
| 25678 | 98.1199 | 213.1250 | 79.5654 | 36.2870 | 26.0791 |
| 2667 | 98.1199 | 31.0325 | 11.2037 | 180.7067 | 85.5313 |
| 24458 | 98.1199 | 930.0925 | 166.4411 | 439.9366 | 109.9386 |
| 20493 | 98.1199 | 14.8350 | 6.5987 | 109.3934 | 46.5082 |
| 534 | 98.1199 | 368.2525 | 161.0394 | 2338.7487 | 961.5722 |
| 3910 | 98.0611 | 147.9425 | 9.5553 | 67.8434 | 27.7125 |
| 18553 | 98.0611 | 644.5600 | 167.2313 | 114.6238 | 88.6532 |
| 48 | 98.0611 | 19.7775 | 13.1178 | 214.8831 | 118.5530 |
| 3131 | 98.0611 | 32.3250 | 3.6906 | 102.1725 | 52.6095 |
| 6107 | 98.0611 | 1411.1725 | 296.9593 | 541.8858 | 208.6218 |
| 2367 | 98.0611 | 94.9950 | 13.5344 | 207.9150 | 53.3577 |
| 4749 | 98.0024 | 103.6225 | 13.2539 | 706.9315 | 504.0897 |
| 4314 | 98.0024 | 30.7450 | 11.1057 | 163.9737 | 83.5641 |
| 15281 | 98.0024 | 967.7075 | 99.3001 | 544.3753 | 174.0717 |
| 1958 | 98.0024 | 445.1375 | 117.2457 | 1764.2088 | 838.9820 |
| 1548 | 97.9436 | 28.2950 | 12.2955 | 213.4790 | 93.1374 |
| 16708 | 97.9436 | 124.9825 | 9.2980 | 261.1399 | 84.2720 |
| 4433 | 97.9436 | 192.5450 | 5.6646 | 129.6513 | 34.0088 |
| 20719 | 97.9436 | 179.7650 | 17.6955 | 99.8016 | 33.6155 |
| 18724 | 97.8848 | 12.4325 | 5.6879 | 206.3522 | 135.0903 |
| 14346 | 97.8848 | 202.0600 | 36.6153 | 728.8054 | 319.3257 |
| 15857 | 97.8848 | 271.8300 | 13.0074 | 171.3616 | 45.2873 |
| 16510 | 97.8848 | 41.9375 | 13.2198 | 173.9038 | 80.1378 |
| 14633 | 97.8261 | 93.9800 | 21.7354 | 491.5620 | 204.1518 |
| 20153 | 97.7673 | 105.6300 | 9.8568 | 320.1023 | 120.0871 |
| 590 | 97.7673 | 104.3425 | 14.1552 | 47.2263 | 17.6984 |
| 11183 | 99.8237 | 60.1550 | 10.3184 | 282.8550 | 150.6241 |
| 5954 | 99.7650 | 619.6375 | 45.2357 | 5530.8616 | 1783.9112 |
| 3828 | 99.7062 | 29.5325 | 4.4363 | 496.3116 | 311.1641 |
| 10304 | 99.6475 | 604.2200 | 57.4522 | 181.8207 | 72.9208 |
| 3501 | 99.4712 | 59.5025 | 1.7444 | 132.3961 | 35.3421 |
| 3746 | 99.4125 | 1444.9650 | 113.4109 | 781.3370 | 155.7630 |
| 3411 | 99.4125 | 66.6150 | 22.3679 | 531.0550 | 256.5738 |
| 6630 | 99.2949 | 1437.7850 | 136.7189 | 875.5654 | 134.4828 |
| 18528 | 99.2362 | 1077.5450 | 66.4474 | 366.4033 | 172.1542 |
| 8856 | 99.2362 | 177.4850 | 13.1452 | 70.3709 | 23.6796 |
| 24229 | 99.1774 | 334.9775 | 32.9092 | 1970.5376 | 1246.6237 |
| 13374 | 99.1774 | 649.7950 | 73.5470 | 320.8445 | 75.2796 |
| 9871 | 99.1774 | 97.4400 | 1.3737 | 24.8101 | 48.7035 |
| 5019 | 99.1774 | 1221.5325 | 39.5840 | 756.4039 | 171.5874 |
| 13615 | 99.1187 | 68.6600 | 3.0861 | 171.1194 | 54.7801 |
| 14181 | 99.0599 | 8.1200 | 1.5898 | 48.5713 | 22.4862 |
| 13614 | 99.0599 | 45.3500 | 5.4268 | 178.6050 | 62.7585 |
| 3034 | 99.0012 | 43.1700 | 0.4387 | 71.9742 | 22.3106 |
| 18846 | 99.0012 | 368.4975 | 14.0361 | 240.9675 | 43.6985 |
| 6060 | 99.0012 | 96.4450 | 13.0907 | 240.0063 | 64.9394 |
| 5355 | 99.0012 | 139.3025 | 34.8060 | 1112.2812 | 518.5939 |
| 19398 | 99.0012 | 193.6300 | 10.7707 | 534.4723 | 205.8335 |
| 16 | 98.9424 | 89.0750 | 16.9430 | 329.6668 | 130.4868 |
| 4046 | 98.8837 | 499.9575 | 65.2513 | 162.0740 | 66.0405 |
| 9440 | 98.8837 | 322.1375 | 10.1546 | 204.6000 | 65.5862 |
| 9079 | 98.8837 | 74.4625 | 17.8935 | 327.2513 | 227.2493 |
| 8500 | 98.8837 | 56.9975 | 20.7527 | 1038.0882 | 686.1585 |
| 22607 | 98.8837 | 8.8650 | 11.4080 | 152.1883 | 70.9472 |
| 3576 | 98.8249 | 152.8700 | 10.1725 | 55.2392 | 32.5345 |
| 16688 | 98.7662 | 1308.3125 | 60.6521 | 686.7498 | 191.5996 |
| 21254 | 98.7662 | 229.1025 | 10.3990 | 136.5379 | 34.3869 |
| 18529 | 98.7074 | 556.0425 | 39.9996 | 207.1498 | 87.9950 |
| 21660 | 98.7074 | 507.1475 | 80.7518 | 1788.5884 | 910.5618 |
| 24119 | 98.7074 | 512.9650 | 54.3836 | 250.7251 | 82.5293 |
| 7524 | 98.7074 | 1557.7450 | 92.0207 | 926.7397 | 207.0042 |
| 3238 | 98.7074 | 450.3850 | 80.8831 | 159.6256 | 71.1281 |
| 24236 | 98.6486 | 354.9450 | 33.7812 | 160.2793 | 54.7563 |
| 19249 | 98.6486 | 1110.8600 | 132.2140 | 483.9407 | 239.6846 |
| 3850 | 98.5899 | 182.0800 | 6.4533 | 396.8754 | 158.0713 |
| 16088 | 98.5899 | 79.0275 | 8.6165 | 182.7218 | 48.2105 |
| 17358 | 98.5899 | 158.8900 | 19.9766 | 494.2814 | 214.2275 |
| 23504 | 98.5899 | 993.5700 | 56.7524 | 540.8315 | 140.4424 |
| 23261 | 98.5899 | 22.5575 | 6.3117 | 395.9670 | 235.6986 |
| 3302 | 98.5899 | 29.6050 | 2.2556 | 105.6777 | 48.8850 |
| 9680 | 98.5311 | 31.3275 | 1.1534 | 69.4657 | 27.2159 |
| 15081 | 98.5311 | 67.9025 | 13.2453 | 278.5142 | 118.2369 |
| 11978 | 98.5311 | 26.1525 | 3.1692 | 206.7815 | 192.2707 |
| 23813 | 98.5311 | 85.6825 | 17.8264 | 862.1642 | 732.1538 |
| 19359 | 98.5311 | 134.6600 | 34.8771 | 552.2129 | 191.7083 |
| 8436 | 98.4724 | 1227.9025 | 69.5826 | 1726.4417 | 791.3808 |

TABLE 5C

APAP
Timepoint(s): 24 hrs

| GLGC ID NO. | LDA Score | Mean Tox | SD Tox | Mean Nontox | SD Nontox |
|---|---|---|---|---|---|
| 15426 | 100.0000 | 508.7167 | 10.4587 | 238.7766 | 52.1295 |
| 19945 | 99.9413 | 31.7433 | 0.1012 | 4.4675 | 13.9739 |
| 23194 | 99.9413 | 33.2900 | 10.5596 | 187.1331 | 76.7380 |
| 21062 | 99.8239 | 155.9033 | 11.0095 | 39.8660 | 19.7916 |
| 20717 | 99.7653 | 24.0867 | 7.4705 | −27.1935 | 20.0993 |
| 643 | 99.7066 | 340.2600 | 85.7686 | 12.9827 | 14.5256 |
| 15401 | 99.7066 | 439.4600 | 93.5865 | 81.8626 | 25.7716 |
| 17858 | 99.7066 | 118.1333 | 0.6603 | 190.9158 | 37.3408 |
| 15134 | 99.7066 | 1674.1333 | 189.9743 | 695.2466 | 191.2070 |
| 9202 | 99.6479 | 251.0500 | 9.1900 | 122.0969 | 31.5514 |
| 19152 | 99.5892 | 136.6300 | 13.5257 | 44.4279 | 15.5199 |
| 1382 | 99.5305 | 56.5133 | 1.7517 | 115.2506 | 27.3775 |
| 18393 | 99.5305 | 345.2200 | 8.6614 | 196.4126 | 47.3379 |
| 20182 | 99.5305 | 327.5033 | 37.7188 | 104.6493 | 37.3168 |
| 25802 | 99.4718 | 1089.8333 | 22.3068 | 646.7085 | 150.2169 |
| 20065 | 99.4718 | 411.6600 | 145.4597 | 35.2978 | 17.2813 |
| 20817 | 99.4131 | 1724.6633 | 12.4475 | 988.0682 | 568.4936 |
| 24205 | 99.4131 | 17.4067 | 2.3690 | 73.0638 | 23.8265 |
| 11384 | 99.2958 | 59.3533 | 3.1197 | 31.5539 | 8.6823 |
| 18161 | 99.2958 | 28.8933 | 0.0814 | 47.7268 | 30.5503 |
| 16318 | 99.2958 | 705.0933 | 177.9215 | 153.1467 | 66.0596 |
| 23522 | 99.2958 | 487.6967 | 21.0557 | 251.4014 | 78.3595 |
| 18578 | 99.2371 | 521.4367 | 19.9051 | 136.0569 | 99.8756 |
| 24707 | 99.2371 | 68.7733 | 1.6107 | 180.2722 | 101.2117 |
| 25251 | 99.2371 | 2211.0700 | 209.4688 | 1121.0552 | 266.6471 |
| 24161 | 99.2371 | 559.1000 | 31.9529 | 349.6547 | 60.2197 |
| 22625 | 99.1784 | 503.3133 | 126.9978 | 95.4733 | 39.8115 |
| 485 | 99.1784 | 97.5667 | 8.3547 | 34.4478 | 12.4000 |
| 16372 | 99.1784 | 29.9133 | 1.4348 | 8.3543 | 6.9524 |
| 25250 | 99.1784 | 1915.3933 | 242.4802 | 897.5140 | 235.5335 |
| 590 | 99.1197 | 134.0267 | 16.6233 | 47.1888 | 17.3693 |
| 1262 | 99.0023 | 9.9700 | 0.7031 | 42.6714 | 24.2706 |

TABLE 5C-continued

APAP
Timepoint(s): 24 hrs

| GLGC ID NO. | LDA Score | Mean Tox | SD Tox | Mean Nontox | SD Nontox |
|---|---|---|---|---|---|
| 23346 | 99.0023 | 327.2133 | 125.3665 | 70.5714 | 22.4292 |
| 70 | 99.0023 | 23.2833 | 6.0407 | 106.7652 | 50.4246 |
| 16039 | 98.9437 | 1064.6167 | 12.0737 | 712.8037 | 206.3057 |
| 14353 | 98.8850 | 43.0333 | 2.0021 | 95.8245 | 34.8232 |
| 15936 | 98.8263 | 53.2900 | 0.1908 | 47.2757 | 17.1305 |
| 11454 | 98.8263 | 801.5433 | 127.0116 | 228.6376 | 99.7531 |
| 20772 | 98.7676 | 50.9033 | 3.8709 | 116.3212 | 32.5185 |
| 548 | 98.7676 | 3.7067 | 3.7534 | 172.5627 | 193.1658 |
| 23544 | 98.7676 | 1755.4267 | 139.1646 | 1006.1279 | 189.3010 |
| 591 | 98.7089 | 139.2400 | 25.0521 | 36.9909 | 15.9959 |
| 16716 | 98.7089 | 42.1967 | 2.1667 | 99.1762 | 41.6847 |
| 17661 | 98.7089 | 655.7767 | 80.4655 | 308.4746 | 81.0864 |
| 18060 | 98.7089 | 109.5267 | 3.5574 | 174.4818 | 38.5570 |
| 20650 | 98.6502 | 109.6367 | 10.6686 | 606.5934 | 405.4088 |
| 764 | 98.5915 | 13.7833 | 0.8882 | 39.4112 | 17.4926 |
| 6944 | 98.5915 | 32.1967 | 7.6422 | 3.4959 | 8.9960 |
| 23324 | 98.5329 | 276.3033 | 21.1283 | 44.4702 | 61.9779 |
| 1579 | 98.5329 | 35.2833 | 0.3499 | 23.9286 | 14.7245 |
| 25718 | 98.5329 | 1230.8200 | 7.1078 | 1009.9121 | 162.7991 |
| 13520 | 98.5329 | 152.6533 | 16.2654 | 0.9068 | 79.1834 |
| 23347 | 98.5329 | 247.4267 | 88.4194 | 50.8436 | 22.3920 |
| 18497 | 98.4742 | 199.7433 | 3.8004 | 117.3543 | 37.7368 |
| 1390 | 98.4155 | −2.2767 | 1.1542 | 55.3681 | 52.0545 |
| 9427 | 98.4155 | 18.1867 | 0.1097 | 20.8208 | 9.6290 |
| 811 | 98.4155 | 28.3600 | 3.0565 | 93.4182 | 41.8558 |
| 9745 | 98.3568 | 122.8933 | 11.8739 | 59.7544 | 18.8183 |
| 19824 | 98.3568 | 35.3233 | 1.6971 | 96.6294 | 46.8731 |
| 25495 | 98.3568 | 44.4500 | 4.2985 | 91.3471 | 22.2570 |
| 22849 | 98.3568 | 537.9733 | 9.6668 | 350.8469 | 108.8176 |
| 457 | 98.3568 | 199.7967 | 15.2999 | 507.3457 | 183.1674 |
| 11455 | 98.2981 | 530.5267 | 140.9872 | 124.5180 | 64.4100 |
| 18056 | 98.2981 | 26.3633 | 14.6246 | 0.6585 | 6.1065 |
| 4280 | 98.2394 | 212.8700 | 20.8259 | 718.4590 | 282.2208 |
| 9527 | 98.2394 | 8.3667 | 0.5713 | 27.5479 | 16.0965 |
| 17382 | 98.1808 | 496.8667 | 13.3045 | 274.7006 | 103.5741 |
| 220 | 98.1221 | 61.7867 | 5.5879 | 16.6764 | 17.8073 |
| 10623 | 98.0634 | 24.4800 | 0.4431 | 68.5285 | 58.7579 |
| 85 | 98.0634 | 3.5767 | 0.4895 | 21.6693 | 16.5031 |
| 17345 | 98.0634 | 69.0600 | 6.0032 | 147.9359 | 44.9269 |
| 1920 | 98.0634 | 928.5733 | 34.3835 | 516.6548 | 215.9846 |
| 25598 | 98.0047 | 26.7633 | 1.2454 | 3.7137 | 12.6894 |
| 19472 | 98.0047 | 1215.3600 | 92.8050 | 734.3796 | 155.6344 |
| 851 | 98.0047 | 89.3467 | 7.5617 | 176.2289 | 58.0706 |
| 22219 | 97.9460 | 226.7067 | 15.6383 | 605.4227 | 271.7582 |
| 1822 | 97.9460 | 95.6433 | 5.2991 | 54.8922 | 18.2739 |
| 21066 | 97.9460 | 249.3000 | 5.8075 | 185.0295 | 44.2426 |
| 16220 | 97.8873 | 13.2900 | 0.1819 | 20.5091 | 16.4022 |
| 18553 | 97.8873 | 422.6867 | 51.0400 | 116.0270 | 94.4780 |
| 24431 | 97.8873 | 1458.2500 | 236.1872 | 399.8840 | 302.3252 |
| 16327 | 97.8873 | 80.4867 | 5.8849 | 170.6925 | 53.1228 |
| 9501 | 97.8873 | 356.4200 | 53.7191 | 187.7905 | 42.9664 |
| 23781 | 97.8286 | 54.0967 | 4.0951 | 21.9835 | 12.7267 |
| 25528 | 97.8286 | 106.8133 | 30.6038 | 37.7109 | 14.0360 |
| 25682 | 97.8286 | 30.3067 | 3.7154 | 73.2820 | 30.3069 |
| 16613 | 97.7700 | 304.4900 | 10.6274 | 165.6273 | 61.8232 |
| 18895 | 97.7700 | 335.2700 | 22.9533 | 204.5314 | 47.9066 |
| 21372 | 97.7700 | 83.9000 | 7.9815 | 35.7524 | 25.8834 |
| 16607 | 97.7113 | 76.2733 | 0.7472 | 93.1454 | 31.0277 |
| 25679 | 97.7113 | 3262.0667 | 85.4511 | 2307.4418 | 495.9447 |
| 2802 | 97.7113 | 287.4000 | 23.0774 | 508.2268 | 123.1165 |
| 11350 | 97.6526 | 11.5533 | 0.2967 | 24.4017 | 14.1174 |
| 17158 | 97.6526 | 179.8267 | 20.6158 | 57.0472 | 53.6574 |
| 7864 | 97.6526 | 1981.3600 | 93.3036 | 1386.8293 | 210.7234 |
| 15446 | 97.6526 | 588.8367 | 5.8295 | 440.2583 | 107.8880 |
| 1639 | 97.6526 | 46.6933 | 6.5739 | 114.1908 | 36.1461 |
| 23524 | 97.6526 | 888.3567 | 70.4133 | 394.4549 | 192.5390 |
| 402 | 97.5939 | 103.2833 | 49.8744 | 1077.5835 | 530.1980 |
| 16570 | 97.5939 | 75.5167 | 3.0230 | 40.0877 | 15.5691 |
| 6522 | 100.0000 | 1968.4300 | 148.0193 | 695.1637 | 184.3169 |
| 22994 | 100.0000 | 172.8467 | 15.9732 | 36.8467 | 36.2080 |
| 17191 | 100.0000 | 631.8700 | 40.1597 | 130.3766 | 57.7180 |
| 9984 | 100.0000 | 267.6333 | 28.8770 | 68.3918 | 22.5913 |
| 9985 | 100.0000 | 674.9700 | 23.4601 | 165.1377 | 39.3858 |
| 6521 | 99.9413 | 514.6400 | 52.6171 | 171.6850 | 49.0532 |
| 23068 | 99.9413 | 104.9967 | 3.0839 | 301.1018 | 100.6838 |
| 11695 | 99.9413 | 367.1833 | 23.4211 | 164.3552 | 48.6426 |
| 12542 | 99.8826 | 1802.8400 | 136.9358 | 376.6228 | 123.5600 |
| 12475 | 99.8826 | 395.5967 | 9.2602 | 174.2870 | 70.2874 |
| 22311 | 99.8239 | 368.4967 | 3.7352 | 163.2658 | 55.1799 |
| 24213 | 99.8239 | 2045.8967 | 131.8617 | 1061.7206 | 203.5007 |
| 16389 | 99.8239 | 173.4967 | 5.3095 | 66.7760 | 39.0675 |
| 4097 | 99.7653 | 79.9267 | 22.8934 | 3.0603 | 11.0234 |
| 2607 | 99.7653 | 662.7800 | 78.0727 | 293.8548 | 61.7989 |
| 21956 | 99.7653 | 98.1300 | 7.5346 | 249.1019 | 52.6859 |
| 11167 | 99.7653 | 281.4333 | 7.5405 | 158.2284 | 35.8893 |
| 3005 | 99.7653 | 97.9367 | 3.3580 | 35.8346 | 16.9840 |
| 5074 | 99.7066 | 278.4900 | 23.3951 | 70.8190 | 36.1596 |
| 6205 | 99.7066 | 1288.3400 | 126.2781 | 549.1274 | 102.1613 |
| 2679 | 99.7066 | 150.0800 | 9.1234 | 283.4974 | 42.8420 |
| 6930 | 99.7066 | 190.0067 | 30.7149 | 43.5522 | 18.4002 |
| 18280 | 99.7066 | 5916.7333 | 1020.0622 | 1157.7615 | 460.7589 |
| 8020 | 99.7066 | 324.9367 | 6.8947 | 179.1750 | 46.1026 |
| 4095 | 99.7066 | 141.2067 | 55.8411 | −5.5369 | 24.8092 |
| 18612 | 99.6479 | 425.7967 | 9.1978 | 222.1975 | 67.5419 |
| 11934 | 99.6479 | 654.1200 | 46.6177 | 305.7983 | 73.5168 |
| 12177 | 99.6479 | 72.5967 | 0.2676 | 99.0290 | 31.5028 |
| 7918 | 99.6479 | 43.0767 | 1.5627 | 118.6390 | 34.8780 |
| 3986 | 99.6479 | 227.9400 | 10.7655 | 86.9262 | 29.3074 |
| 12372 | 99.6479 | 165.1867 | 3.3621 | 85.5917 | 27.8416 |
| 15949 | 99.6479 | 327.5167 | 16.0266 | 155.0162 | 33.9501 |
| 24212 | 99.5892 | 2324.7367 | 191.5912 | 1130.2271 | 237.8618 |
| 2513 | 99.5892 | 132.7533 | 7.9340 | 31.8050 | 28.2157 |
| 2355 | 99.5892 | 633.5000 | 14.2379 | 387.5819 | 90.3883 |
| 4881 | 99.5892 | 124.2967 | 0.3881 | 112.9733 | 47.1381 |
| 6730 | 99.5892 | 58.4333 | 20.5060 | −31.1792 | 21.8676 |
| 17339 | 99.5892 | 623.1733 | 17.9148 | 266.7174 | 296.0186 |
| 8036 | 99.5305 | 924.2000 | 272.5005 | 115.0638 | 52.9874 |
| 6731 | 99.5305 | 49.9567 | 3.3194 | 9.3945 | 12.8125 |
| 9987 | 99.5305 | 58.6700 | 34.0338 | −77.0584 | 51.7029 |
| 13544 | 99.5305 | 451.1367 | 5.5307 | 290.4937 | 74.3729 |
| 21410 | 99.5305 | 208.8567 | 0.5749 | 290.8960 | 105.9309 |
| 2954 | 99.5305 | 1364.8667 | 302.3458 | 195.0317 | 103.0005 |
| 9386 | 99.5305 | 112.1433 | 10.4855 | 295.9813 | 87.0384 |
| 7281 | 99.5305 | 499.9433 | 63.2290 | 212.6755 | 53.9126 |
| 2762 | 99.5305 | 4570.0300 | 1382.3233 | 787.7552 | 277.2978 |
| 16380 | 99.5305 | 863.1100 | 84.4538 | 410.4057 | 126.4365 |
| 6474 | 99.4718 | 60.4333 | 0.8808 | 117.0451 | 29.8100 |
| 4046 | 99.4718 | 343.9167 | 13.2171 | 163.0200 | 69.2096 |
| 14292 | 99.4718 | 5091.8067 | 1584.2719 | 813.6737 | 344.1822 |
| 6929 | 99.4718 | 231.0667 | 35.7028 | 55.0348 | 28.9698 |
| 19756 | 99.4718 | 631.9867 | 41.9889 | 267.5566 | 110.0864 |
| 5327 | 99.4718 | 202.8267 | 41.1461 | 34.3415 | 26.1075 |
| 2250 | 99.4131 | 7537.1700 | 1059.4558 | 1627.4254 | 583.8293 |
| 6254 | 99.3545 | 239.7500 | 111.4009 | −1.4705 | 34.3790 |
| 13190 | 99.3545 | 154.2533 | 5.4056 | 79.7578 | 29.8057 |
| 19195 | 99.3545 | 3390.7767 | 25.6454 | 2248.2852 | 549.5162 |
| 16088 | 99.3545 | 91.9667 | 2.2236 | 182.5546 | 48.4071 |
| 21747 | 99.2958 | 347.6100 | 4.1478 | 577.5340 | 117.7814 |
| 6743 | 99.2958 | 567.2700 | 51.8693 | 1001.3272 | 175.5170 |
| 10986 | 99.2958 | 6.1700 | 2.0880 | 91.2459 | 51.6085 |
| 22970 | 99.2958 | 139.4967 | 41.6315 | −3.2291 | 38.2572 |
| 22596 | 99.2958 | 77.3567 | 2.8055 | 165.4281 | 53.3266 |
| 16945 | 99.2958 | 1779.5333 | 66.9230 | 1109.0688 | 208.8481 |
| 6506 | 99.2371 | 727.0000 | 50.8762 | 355.3469 | 84.8725 |
| 2781 | 99.2371 | 3.8800 | 3.0938 | 140.4973 | 94.2682 |
| 4722 | 99.2371 | 96.3767 | 5.1514 | 35.1113 | 23.8239 |
| 13098 | 99.2371 | 575.7700 | 51.7092 | 189.1089 | 93.1684 |
| 7092 | 99.1784 | 1525.6700 | 52.1908 | 939.1531 | 209.5750 |
| 13740 | 99.1784 | 425.8500 | 8.5001 | 290.6156 | 46.1641 |
| 8398 | 99.1784 | 199.1200 | 9.9964 | 91.3519 | 34.1304 |
| 21504 | 99.1784 | 3049.2467 | 564.2810 | 741.9966 | 237.0281 |

TABLE 5D

APAP
Timepoint(s): 3, 6 hrs

| GLGC ID NO. | LDA Score | Mean Tox | SD Tox | Mean Nontox | SD Nontox |
|---|---|---|---|---|---|
| 7096 | 99.5300 | 8.8025 | 2.1642 | 58.8955 | 24.5748 |
| 23000 | 99.4125 | 11.9175 | 2.5110 | 42.4073 | 13.5671 |
| 12978 | 98.5899 | 59.4550 | 9.1613 | 186.2018 | 92.3491 |
| 25899 | 98.4724 | 4.7325 | 1.7898 | 27.5541 | 12.8572 |
| 15401 | 98.2374 | 190.6050 | 43.3682 | 82.6121 | 33.8893 |
| 25103 | 97.5323 | 18.0800 | 1.0907 | 30.8700 | 38.4395 |
| 252 | 97.4736 | 19.1150 | 0.5332 | 33.2151 | 12.2893 |
| 1170 | 96.5335 | 120.4400 | 5.6101 | 267.7128 | 129.4942 |
| 4683 | 96.1222 | 116.5075 | 7.0379 | 200.6738 | 60.5369 |
| 13485 | 96.0635 | 30.1000 | 0.5207 | 43.4102 | 19.0447 |
| 16825 | 95.8872 | 15.3325 | 2.4347 | 46.1190 | 24.9225 |
| 24066 | 95.7697 | 15.7975 | 7.9453 | 52.6179 | 17.6657 |
| 20515 | 95.4759 | 86.3425 | 1.5363 | 109.6628 | 28.3797 |
| 21239 | 95.4759 | 169.4225 | 36.4198 | 424.4383 | 146.3786 |
| 7170 | 95.1821 | 38.5000 | 3.4757 | 66.7824 | 19.2410 |
| 17128 | 95.0059 | 37.7325 | 12.2574 | 93.0797 | 29.1857 |
| 8598 | 94.8296 | 35.2950 | 2.8068 | 63.9389 | 21.6690 |
| 7266 | 94.7709 | 573.8200 | 32.4097 | 373.7213 | 113.6404 |
| 20182 | 94.6533 | 186.1375 | 29.8953 | 105.0519 | 39.2205 |
| 1058 | 94.6533 | 382.5600 | 68.9621 | 180.0567 | 113.5756 |
| 1260 | 94.4771 | 17.8350 | 5.9331 | 49.1813 | 17.3894 |
| 4349 | 94.4183 | 23.8275 | 0.8574 | 20.2237 | 14.0855 |
| 21683 | 94.3596 | 12.8800 | 5.7920 | 50.3082 | 24.5157 |
| 14606 | 94.3008 | 43.2425 | 10.6302 | 95.8142 | 28.9036 |
| 904 | 94.1833 | 24.3350 | 5.6076 | 49.2998 | 13.0363 |
| 17131 | 94.1246 | 59.6500 | 7.9624 | 115.0877 | 37.7876 |
| 10340 | 94.0071 | 50.2475 | 1.3385 | 65.5841 | 26.8410 |
| 15579 | 94.0071 | 363.2750 | 27.4364 | 597.4441 | 506.1998 |
| 23324 | 94.0071 | 109.2025 | 22.2909 | 44.9832 | 63.3624 |
| 24107 | 93.9483 | 111.5950 | 2.1406 | 153.2069 | 56.1474 |
| 25112 | 93.9483 | 6.8650 | 2.9919 | 26.4261 | 14.3220 |
| 1169 | 93.8895 | 67.7525 | 11.7128 | 179.1938 | 85.1520 |
| 4577 | 93.8895 | 20.6075 | 0.8344 | 28.3634 | 8.8634 |
| 15188 | 93.7720 | 100.2725 | 24.3600 | 182.0351 | 41.8199 |
| 23926 | 93.6545 | 35.5100 | 2.3428 | 8.7056 | 60.5796 |
| 2016 | 93.5958 | 114.8175 | 6.3649 | 163.5275 | 33.3586 |
| 15642 | 93.4195 | 1589.7725 | 327.7097 | 929.3076 | 324.2229 |
| 16499 | 93.4195 | 21.4000 | 1.9792 | 5.1991 | 14.6482 |
| 5656 | 93.3020 | 19.1950 | 5.2352 | 39.5487 | 12.7064 |
| 25496 | 93.3020 | 74.1775 | 4.2640 | 104.6852 | 25.4088 |
| 269 | 93.1845 | 81.5850 | 3.1827 | 117.2364 | 44.2898 |
| 20840 | 93.1257 | 36.2950 | 5.7126 | 69.8897 | 22.6940 |
| 1806 | 93.0670 | 6.4525 | 2.9939 | 32.6495 | 24.6001 |
| 11079 | 93.0670 | 115.7100 | 4.4728 | 106.3768 | 39.4286 |
| 19679 | 92.9495 | 122.7300 | 15.3513 | 73.8382 | 49.4282 |
| 17304 | 92.9495 | 55.5150 | 2.2319 | 63.2332 | 37.4111 |
| 16108 | 92.8907 | 88.5975 | 9.0119 | 131.2886 | 27.0740 |
| 12087 | 92.7732 | 361.5400 | 37.7432 | 192.0296 | 91.5937 |
| 3512 | 92.7145 | 84.1900 | 11.9679 | 146.3744 | 45.8898 |
| 1855 | 92.7145 | 7.8325 | 2.3374 | 21.2220 | 10.2294 |
| 3240 | 92.6557 | 7.6875 | 1.6237 | 21.3009 | 12.8298 |
| 7789 | 92.5969 | 14.5675 | 0.6985 | 22.8609 | 17.0871 |
| 734 | 92.5382 | 21.6475 | 4.1430 | 39.5222 | 12.2859 |
| 15152 | 92.5382 | 56.1075 | 4.8717 | 94.0495 | 39.4272 |
| 1561 | 92.5382 | 345.4650 | 22.7745 | 246.7394 | 147.2155 |
| 17858 | 92.5382 | 141.1875 | 6.7558 | 190.8929 | 37.4549 |
| 21162 | 92.4794 | 1.9600 | 3.0131 | 40.5579 | 64.3726 |
| 17661 | 92.4794 | 459.5125 | 62.5970 | 308.9890 | 83.0797 |
| 20803 | 92.4794 | 568.5500 | 11.9340 | 522.6252 | 128.1331 |
| 17100 | 92.4207 | 2126.6075 | 47.4035 | 2114.7200 | 460.6116 |
| 11531 | 92.3032 | 21.6500 | 1.4624 | 39.1081 | 20.0134 |
| 15844 | 92.2444 | 11.5625 | 3.6536 | 23.0384 | 6.9503 |
| 24645 | 92.2444 | 140.1350 | 5.7923 | 115.3548 | 43.9159 |
| 15997 | 92.1269 | 233.9050 | 19.6299 | 291.6676 | 219.3167 |
| 21827 | 92.0094 | 77.6000 | 24.6701 | 148.4808 | 36.9971 |
| 11863 | 92.0094 | 15.3825 | 2.3374 | 28.0473 | 9.2716 |
| 17130 | 92.0094 | 110.1875 | 16.5072 | 201.5343 | 58.1037 |
| 25862 | 92.0094 | 8.0350 | 24.8522 | 13.0127 | |
| 10504 | 91.9506 | 311.9150 | 13.6702 | 329.1181 | 200.4643 |
| 3877 | 91.9506 | 104.0650 | 5.1455 | 142.8524 | 37.5065 |
| 17154 | 91.8331 | 281.3150 | 7.7221 | 284.0276 | 75.4471 |
| 9391 | 91.7156 | 625.1725 | 43.1230 | 454.6670 | 116.5087 |
| 17129 | 91.7156 | 10.0500 | 2.8529 | 25.5615 | 15.8567 |
| 11313 | 91.5981 | 13.3350 | 3.1925 | 25.8944 | 8.5545 |
| 1995 | 91.4806 | 405.5200 | 52.2144 | 278.1466 | 212.8740 |
| 18180 | 91.4806 | 37.4975 | 1.6927 | 35.7117 | 16.1218 |
| 1386 | 91.4219 | 95.7600 | 10.2254 | 147.1360 | 38.0292 |
| 1798 | 91.4219 | 1133.5450 | 76.5602 | 1198.7445 | 663.2441 |
| 19709 | 91.4219 | 7.6100 | 2.5888 | 22.1400 | 13.1498 |
| 22301 | 91.3631 | 24.4275 | 0.8275 | 30.8226 | 20.2706 |
| 3513 | 91.3631 | 97.1725 | 20.1569 | 190.3459 | 66.6944 |
| 17843 | 91.3631 | 12.1550 | 2.2620 | 30.6029 | 18.5957 |
| 16479 | 91.3631 | 43.6000 | 2.2122 | 63.7131 | 19.3431 |
| 382 | 91.3043 | 79.3100 | 12.1470 | 43.6374 | 43.4560 |
| 17684 | 91.3043 | 67.7900 | 4.2872 | 62.1906 | 33.1932 |
| 5317 | 91.3043 | 688.2775 | 56.5133 | 692.8058 | 479.6152 |
| 8870 | 91.2456 | 12.5250 | 9.9560 | 47.9946 | 28.5628 |
| 1632 | 91.2456 | 27.9100 | 1.4986 | 33.3400 | 18.5449 |
| 18881 | 91.2456 | 24.3600 | 1.8481 | 16.4245 | 6.1903 |
| 13307 | 91.2456 | 5.1175 | 4.5511 | 34.9725 | 23.2619 |
| 4339 | 91.2456 | 120.4850 | 8.9192 | 171.7809 | 37.7485 |
| 24506 | 91.1868 | 35.5750 | 3.7338 | 47.1151 | 69.7806 |
| 24589 | 91.1868 | 156.6975 | 13.1227 | 99.2475 | 43.0384 |
| 19222 | 91.1868 | 1129.5850 | 59.0020 | 863.4332 | 182.6511 |
| 16138 | 91.1281 | 59.3050 | 10.8771 | 102.7867 | 29.6238 |
| 11940 | 90.8931 | 22.9700 | 10.7755 | 51.1598 | 16.2242 |
| 16993 | 90.8931 | 172.1400 | 18.1313 | 111.0194 | 66.1164 |
| 17957 | 90.8343 | 27.6100 | 4.5128 | 46.4370 | 14.0635 |
| 22009 | 90.7756 | 27.9000 | 1.5413 | 34.8772 | 15.0597 |
| 2119 | 90.7168 | 25.7550 | 4.5100 | 41.5996 | 11.3876 |
| 17484 | 99.8237 | 296.5900 | 24.0916 | 114.6340 | 34.2202 |
| 15280 | 99.8237 | 56.4375 | 3.1817 | 120.6087 | 29.1945 |
| 9605 | 99.1187 | 70.5200 | 6.8104 | 163.1478 | 45.9187 |
| 18447 | 99.1187 | 1204.7050 | 149.5109 | 404.1362 | 129.4772 |
| 2250 | 99.1187 | 5568.6200 | 1219.2733 | 1629.7338 | 623.5503 |
| 10233 | 99.0012 | 54.1050 | 9.2568 | 176.3844 | 58.9829 |
| 19379 | 98.7662 | 1215.7375 | 24.8818 | 805.6366 | 183.6969 |
| 12542 | 98.7662 | 1021.7525 | 290.8539 | 378.6183 | 142.2927 |
| 22451 | 98.4724 | 168.9425 | 12.3015 | 93.6291 | 34.5389 |
| 9089 | 98.4136 | -2.5800 | 0.5079 | 42.5416 | 53.2086 |
| 18658 | 98.2961 | 2196.8850 | 214.3939 | 892.2216 | 361.9912 |
| 23115 | 98.2961 | 788.8525 | 182.1200 | 193.3938 | 153.5716 |
| 6254 | 98.2374 | 81.6575 | 45.4698 | -1.0109 | 37.1194 |
| 18446 | 98.2374 | 448.3175 | 114.2497 | 99.0030 | 48.6653 |
| 24239 | 98.0611 | 957.8325 | 27.9050 | 663.5669 | 147.0674 |
| 6489 | 97.8848 | 128.9075 | 8.7726 | 239.2584 | 57.8421 |
| 5471 | 97.6498 | 149.0475 | 14.5816 | 66.1577 | 36.6653 |
| 13262 | 97.6498 | 75.3975 | 3.2197 | 116.9107 | 26.2743 |
| 11028 | 97.4148 | 21.6775 | 1.4722 | 55.3397 | 30.8757 |
| 24166 | 97.4148 | 248.3025 | 23.5662 | 435.6270 | 84.5070 |
| 21130 | 97.3561 | 98.0400 | 22.1590 | 241.2839 | 76.6858 |
| 23027 | 97.2973 | 357.0950 | 125.1845 | 109.1604 | 63.9898 |
| 12979 | 97.2385 | 346.7725 | 41.0457 | 895.8667 | 426.8559 |
| 6384 | 97.2385 | 54.9925 | 31.5034 | 218.9759 | 69.5079 |
| 5073 | 97.2385 | 413.3575 | 125.0664 | 127.4450 | 90.4538 |
| 18505 | 97.1210 | 96.7575 | 112.2612 | 189.1475 | 54.2202 |
| 21504 | 97.0623 | 1443.5450 | 1230.3985 | 746.8328 | 270.6645 |
| 6791 | 97.0623 | 1515.2125 | 124.7331 | 664.6464 | 340.9147 |
| 15644 | 97.0035 | 2784.8025 | 406.7310 | 1507.7514 | 391.4188 |
| 22688 | 96.9448 | 48.6900 | 5.2073 | 189.3009 | 109.3565 |
| 18977 | 96.9448 | 67.6275 | 11.3929 | 23.2862 | 16.6057 |
| 19184 | 96.7685 | 144.6925 | 30.4252 | 465.5574 | 221.1904 |
| 26118 | 96.7685 | 394.7400 | 49.7311 | 214.5454 | 64.8190 |
| 11135 | 96.7098 | 121.8425 | 13.0704 | 59.3226 | 27.5878 |
| 17482 | 96.7098 | 246.5025 | 43.1950 | 104.8441 | 44.0051 |
| 7751 | 96.7098 | 82.2350 | 26.6289 | 27.3013 | 17.7075 |
| 18115 | 96.6510 | 12.6875 | 3.6213 | 105.6400 | 76.9781 |
| 7647 | 96.6510 | 78.0625 | 21.1044 | 114.3698 | 25.8109 |
| 13702 | 96.6510 | 2.0475 | 2.2234 | 28.2887 | 19.0053 |
| 3617 | 96.6510 | 539.0275 | 49.9588 | 873.5382 | 190.6386 |
| 14267 | 96.5335 | 1090.6410 | 123.2935 | 636.5769 | 263.7684 |
| 21913 | 96.4747 | 55.8475 | 11.7951 | 116.7997 | 27.8677 |
| 22712 | 96.4747 | 3.3075 | 3.3811 | 29.4462 | 17.6086 |
| 21561 | 96.4160 | 2.9450 | 3.7673 | 42.0632 | 28.7155 |
| 22970 | 96.1810 | 81.0325 | 35.8981 | -3.1220 | 38.7729 |
| 16754 | 96.1810 | 91.3600 | 36.9542 | 264.2357 | 84.4353 |

TABLE 5D-continued

APAP
Timepoint(s): 3, 6 hrs

| GLGC ID NO. | LDA Score | Mean Tox | SD Tox | Mean Nontox | SD Nontox |
|---|---|---|---|---|---|
| 7379 | 96.1222 | 48.3700 | 3.3151 | 95.4708 | 35.5532 |
| 13704 | 96.1222 | 42.6200 | 2.6121 | 105.8035 | 20.4275 |
| 22395 | 96.1222 | 184.2000 | 27.9360 | 345.5862 | 90.5226 |
| 20566 | 96.0047 | 39.4675 | 5.6584 | 12.9169 | 12.1278 |
| 4478 | 95.9459 | 164.5875 | 64.3145 | 39.7471 | 48.0157 |
| 3597 | 95.9459 | 72.4525 | 28.8316 | 9.3649 | 22.9664 |
| 24190 | 95.8872 | 104.9700 | 30.8553 | 321.0467 | 106.6381 |
| 18235 | 95.7109 | 51.7550 | 5.3352 | 93.0842 | 25.1438 |
| 22686 | 95.6522 | 175.8750 | 79.2795 | 145.0658 | 32.6400 |
| 21176 | 95.5934 | −37.2625 | 14.5363 | 105.9687 | 117.9199 |
| 22595 | 95.5347 | 1088.8225 | 106.0272 | 707.4990 | 159.3306 |
| 13389 | 95.4759 | 21.4625 | 2.7460 | 59.8904 | 31.2367 |
| 6552 | 95.4759 | 3755.3175 | 592.2922 | 2149.9622 | 616.9073 |
| 24745 | 95.4759 | 1986.1850 | 89.7452 | 1470.6746 | 267.8751 |
| 2422 | 95.4172 | 16.0300 | 6.6954 | 62.9213 | 28.8767 |
| 16673 | 95.3584 | 29.4200 | 6.9349 | 60.9729 | 22.7704 |
| 2850 | 95.3584 | 15.1525 | 2.2294 | 33.0466 | 12.6184 |
| 17483 | 95.3584 | 20.1375 | 1.2520 | 11.0384 | 9.9516 |
| 23007 | 95.2996 | 2.3625 | 4.6309 | 22.2332 | 13.2647 |
| 16578 | 95.2996 | 616.8975 | 24.2227 | 456.6515 | 107.9740 |
| 15504 | 95.2409 | 40.7275 | 2.7203 | 12.8941 | 35.4411 |
| 19495 | 95.2409 | 98.8900 | 11.1578 | 54.5442 | 26.5099 |
| 23379 | 95.1234 | 327.4775 | 168.9093 | 264.6640 | 65.5405 |
| 15984 | 95.1234 | 77.6200 | 16.7135 | 148.9644 | 37.2649 |
| 18943 | 95.0646 | 1071.5625 | 161.7169 | 635.7350 | 194.0796 |
| 12588 | 95.0646 | 47.6000 | 5.5872 | 90.6607 | 28.2380 |
| 7521 | 95.0646 | 23.1000 | 4.0925 | 72.1363 | 37.0846 |
| 22058 | 95.0646 | 16.1525 | 4.8821 | 51.3316 | 19.7832 |
| 13555 | 95.0059 | 56.8400 | 5.5827 | 106.8458 | 33.3741 |
| 22559 | 95.0059 | 406.9000 | 25.3093 | 253.8055 | 112.8122 |
| 22617 | 95.0059 | 2049.4375 | 159.4037 | 1296.8578 | 368.9993 |
| 12321 | 95.0059 | 40.3900 | 7.2929 | 87.3672 | 26.9394 |
| 22017 | 95.0059 | 138.6975 | 21.9975 | 67.4823 | 72.0425 |
| 7628 | 94.8884 | 23.4650 | 9.1093 | −2.6628 | 17.3442 |
| 4856 | 94.8884 | 36.7325 | 13.3821 | 116.7521 | 48.1624 |
| 9746 | 94.8884 | 260.9025 | 39.3829 | 124.2830 | 65.6026 |
| 17253 | 94.8296 | 293.2975 | 10.8520 | 158.3254 | 124.7764 |
| 2462 | 94.8296 | −52.0175 | 63.5847 | 85.9253 | 58.3485 |

TABLE 5E

Ay-25329
Timepoint(s): 24 hrs

| GLGC ID NO. | LDA Score | Mean Tox | SD Tox | Mean Nontox | SD Nontox |
|---|---|---|---|---|---|
| 192 | 99.8239 | 50.5900 | 4.9254 | 8.1404 | 8.0040 |
| 190 | 99.6479 | 142.1433 | 33.4751 | −27.1779 | 23.2822 |
| 18028 | 99.5305 | 524.4900 | 67.1830 | 70.4836 | 56.1651 |
| 6013 | 99.5305 | 210.9300 | 0.7882 | 527.3891 | 270.0111 |
| 193 | 99.5305 | 359.7900 | 105.5128 | 26.2667 | 25.8989 |
| 19032 | 99.5305 | 4.9833 | 0.6634 | 49.8328 | 35.6162 |
| 191 | 99.4131 | 249.5833 | 52.7951 | 36.6039 | 25.6612 |
| 5493 | 99.3545 | 340.2467 | 21.4290 | 122.6623 | 59.2893 |
| 18027 | 98.7676 | 439.8567 | 86.6104 | 104.8121 | 50.0470 |
| 15696 | 98.7089 | 26.8100 | 0.5651 | 4.4260 | 14.9067 |
| 17995 | 98.6502 | 154.1433 | 1.6574 | 546.3056 | 370.7675 |
| 24649 | 98.5329 | 140.1000 | 1.6328 | 92.1496 | 26.4749 |
| 2143 | 98.4742 | 554.0300 | 8.3372 | 400.6795 | 83.0525 |
| 19050 | 98.4155 | 154.6767 | 10.3920 | 80.6395 | 29.6965 |
| 3831 | 98.2981 | 155.4433 | 1.5353 | 125.8643 | 63.4397 |
| 11756 | 98.2394 | 43.0000 | 0.9906 | 98.1459 | 66.6702 |
| 1471 | 98.2394 | 22.7200 | 0.1931 | 39.0220 | 19.5713 |
| 5492 | 98.1808 | 376.6033 | 75.5901 | 118.0557 | 65.9463 |
| 4010 | 98.1221 | 181.0567 | 3.2993 | 786.8278 | 550.3464 |
| 1382 | 98.1221 | 115.5700 | 0.4951 | 115.0427 | 27.5981 |
| 4012 | 97.9460 | 137.8867 | 4.4446 | 526.6647 | 309.8667 |
| 17147 | 97.8873 | 839.7800 | 14.6223 | 1709.5554 | 970.8092 |
| 25057 | 97.8873 | 206.0967 | 39.4156 | 47.7405 | 33.6075 |

TABLE 5E-continued

Ay-25329
Timepoint(s): 24 hrs

| GLGC ID NO. | LDA Score | Mean Tox | SD Tox | Mean Nontox | SD Nontox |
|---|---|---|---|---|---|
| 19020 | 97.8873 | 78.3567 | 1.0180 | 58.2582 | 18.9872 |
| 23041 | 97.8286 | 63.2333 | 1.1711 | 28.0313 | 36.8550 |
| 1529 | 97.7700 | 132.2433 | 1.0492 | 113.8026 | 47.0761 |
| 4540 | 97.7700 | 47.4000 | 0.3576 | 57.7065 | 25.4625 |
| 1522 | 97.5939 | 376.8433 | 49.5235 | 133.4522 | 79.0320 |
| 15857 | 97.5939 | 242.3067 | 6.2311 | 171.5835 | 45.5927 |
| 24883 | 97.4765 | 3.1067 | 1.1686 | 33.6264 | 24.0792 |
| 489 | 97.4178 | 2510.7867 | 668.7792 | 438.2292 | 456.7883 |
| 4212 | 97.3592 | 2813.1500 | 62.2953 | 4623.0827 | 1366.4076 |
| 18150 | 97.3005 | 297.6267 | 13.9709 | 191.0128 | 44.7739 |
| 18349 | 97.2418 | 127.1567 | 2.6039 | 224.1898 | 92.4037 |
| 25328 | 97.1244 | 77.5267 | 0.7506 | 63.0118 | 21.9550 |
| 20744 | 97.1244 | 97.8900 | 1.5088 | 73.6626 | 48.1547 |
| 2107 | 97.1244 | 162.5333 | 3.6979 | 113.9964 | 38.2226 |
| 4487 | 97.0657 | 97.4967 | 1.9068 | 48.6883 | 40.4020 |
| 1508 | 97.0657 | 161.1467 | 6.3293 | 267.2798 | 123.8161 |
| 1271 | 97.0657 | 206.6267 | 5.1341 | 140.3387 | 36.0158 |
| 25098 | 96.9484 | 58.1767 | 1.2029 | 35.7683 | 20.4305 |
| 25949 | 96.8897 | 41.9433 | 0.3853 | 46.3301 | 20.5893 |
| 2753 | 96.8897 | 36.1100 | 1.0672 | 42.2632 | 33.2088 |
| 25801 | 96.8897 | 109.6700 | 5.1065 | 30.7146 | 115.3006 |
| 8210 | 96.8310 | 42.1467 | 4.6013 | 14.1151 | 17.2530 |
| 17560 | 96.7723 | 1306.9633 | 21.4633 | 1170.6436 | 525.8797 |
| 24653 | 96.7136 | 44.3967 | 4.9832 | 15.7796 | 12.3568 |
| 819 | 96.7136 | 941.8800 | 38.9477 | 1702.4032 | 945.9157 |
| 18990 | 96.6549 | 33.9067 | 1.0324 | 33.5855 | 35.6224 |
| 1308 | 96.6549 | 70.0667 | 0.9823 | 55.3598 | 23.2480 |
| 7927 | 96.5962 | 70.2667 | 1.7400 | 45.6521 | 28.1624 |
| 13479 | 96.5376 | 310.9033 | 34.2642 | 164.6665 | 58.4256 |
| 17480 | 96.4789 | 29.7300 | 0.8487 | 48.3151 | 34.2346 |
| 19049 | 96.4789 | 53.4200 | 1.4451 | 36.9941 | 11.7790 |
| 1698 | 96.4202 | 1512.4367 | 541.0817 | 441.6654 | 239.4362 |
| 13547 | 96.4202 | 238.1467 | 7.5976 | 164.9258 | 55.9441 |
| 21665 | 96.4202 | 143.2867 | 4.0796 | 101.9201 | 37.6385 |
| 1608 | 96.3615 | 69.6467 | 4.6158 | 18.6671 | 25.3792 |
| 4292 | 96.3615 | 32.3933 | 0.9261 | 54.2326 | 25.4056 |
| 18544 | 96.3028 | 24.4200 | 0.3045 | 29.3746 | 8.4750 |
| 13969 | 96.3028 | 27.4067 | 0.6413 | 23.1601 | 20.3594 |
| 1693 | 96.3028 | 47.8733 | 3.1905 | 8.1141 | 29.9617 |
| 20438 | 96.2441 | 354.7267 | 3.9289 | 308.0016 | 85.3288 |
| 16109 | 96.2441 | 478.0900 | 32.0430 | 297.3074 | 85.7848 |
| 1674 | 96.0681 | 32.1367 | 1.2016 | 45.2912 | 30.5203 |
| 1559 | 96.0681 | 77.6733 | 1.8707 | 55.6769 | 25.2180 |
| 16272 | 96.0094 | 128.4033 | 6.5974 | 337.2285 | 180.8575 |
| 11865 | 95.9507 | 48.0167 | 1.2439 | 50.2143 | 29.0790 |
| 1339 | 95.9507 | 21.0233 | 0.4051 | 18.4668 | 9.7705 |
| 1835 | 95.8333 | 76.7767 | 1.6489 | 112.8462 | 45.2731 |
| 1463 | 95.8333 | 337.2100 | 30.9159 | 144.7256 | 84.8924 |
| 1683 | 95.8333 | 20.4333 | 0.3194 | 19.3551 | 9.0679 |
| 2263 | 95.8333 | 63.6933 | 0.6897 | 65.1829 | 19.1841 |
| 17508 | 95.8333 | 96.3733 | 8.9416 | 55.7992 | 19.5631 |
| 16947 | 95.8333 | 136.7733 | 21.8195 | 346.3625 | 139.4977 |
| 16304 | 95.7746 | 174.1367 | 8.2022 | 316.3077 | 162.1031 |
| 25713 | 95.7746 | 28.8533 | 0.7753 | 37.9252 | 20.9867 |
| 1501 | 95.7746 | 1354.0800 | 72.5087 | 2213.4915 | 566.4845 |
| 21424 | 95.7160 | 268.2033 | 8.4967 | 389.1401 | 95.9650 |
| 21488 | 95.6573 | 81.7400 | 7.5306 | 41.8202 | 17.5053 |
| 20518 | 95.6573 | 127.8133 | 2.5460 | 116.8656 | 40.1474 |
| 1558 | 95.6573 | 123.0667 | 8.4021 | 71.5809 | 35.6994 |
| 25042 | 95.5986 | 24.7667 | 0.9931 | 47.4573 | 24.4716 |
| 20816 | 95.5399 | 1024.2167 | 30.6503 | 851.8755 | 394.8442 |
| 16346 | 95.5399 | 268.8633 | 21.5600 | 160.7518 | 66.0735 |
| 25479 | 95.4812 | 354.5733 | 5.5004 | 436.2706 | 164.4732 |
| 24849 | 95.4812 | 3.2700 | 1.6756 | 23.0494 | 16.8298 |
| 7898 | 95.4812 | 1709.9667 | 154.3895 | 3223.1676 | 1138.2456 |
| 3254 | 95.3638 | 549.2100 | 7.0530 | 481.4882 | 127.2471 |
| 2744 | 95.3638 | 406.3767 | 8.1912 | 314.9587 | 86.4353 |
| 14859 | 95.2465 | 333.2100 | 29.1366 | 202.3538 | 57.0808 |
| 5496 | 95.2465 | 66.0300 | 6.3902 | 164.6468 | 97.5388 |
| 14384 | 95.2465 | 580.6200 | 26.1895 | 408.8050 | 97.6933 |

TABLE 5E-continued

Ay-25329
Timepoint(s): 24 hrs

| GLGC ID NO. | LDA Score | Mean Tox | SD Tox | Mean Nontox | SD Nontox |
|---|---|---|---|---|---|
| 17953 | 95.2465 | 247.6200 | 14.0815 | 175.3613 | 43.7937 |
| 1309 | 95.2465 | 77.3000 | 2.1556 | 56.2805 | 22.7967 |
| 21707 | 95.2465 | 180.1867 | 5.7874 | 146.5187 | 82.6364 |
| 16955 | 95.1878 | 568.3467 | 6.5116 | 585.5587 | 181.5563 |
| 21843 | 95.1878 | 200.6233 | 14.6176 | 124.8148 | 35.0886 |
| 15750 | 95.1878 | 41.2967 | 1.6511 | 24.6614 | 11.8698 |
| 737 | 95.1878 | 45.0533 | 2.0552 | 20.9840 | 25.9469 |
| 15200 | 99.5305 | 79.1500 | 0.1819 | 79.5625 | 44.7894 |
| 2161 | 99.4131 | 487.8733 | 17.6574 | 190.2738 | 80.8372 |
| 8692 | 99.2371 | 114.5467 | 1.2979 | 257.7685 | 142.0990 |
| 10829 | 99.2371 | 20.2367 | 0.3612 | 48.5766 | 20.8523 |
| 5272 | 99.0610 | 139.2667 | 1.5723 | 34.4273 | 80.0283 |
| 5692 | 99.0023 | 310.0333 | 1.2810 | 433.0616 | 111.7953 |
| 12412 | 98.9437 | 23.8000 | 0.1559 | 9.2227 | 17.5190 |
| 7711 | 98.8850 | 12.0167 | 0.1877 | 23.5190 | 23.4336 |
| 9407 | 98.7676 | 151.6833 | 3.0104 | 461.6438 | 427.8043 |
| 22037 | 98.7089 | 176.9600 | 0.6365 | 184.3368 | 55.4198 |
| 5759 | 98.7089 | 70.0600 | 0.5738 | 121.1328 | 62.8226 |
| 24307 | 98.6502 | 195.5867 | 0.9280 | 261.9180 | 101.2259 |
| 16010 | 98.4742 | 43.7733 | 1.2458 | 21.7906 | 15.6498 |
| 24073 | 98.2981 | 58.1800 | 3.0905 | 11.1551 | 32.9037 |
| 21489 | 98.1808 | 249.6767 | 14.7118 | 144.4374 | 35.7640 |
| 23176 | 98.1221 | 97.1900 | 0.4957 | 87.8247 | 36.3900 |
| 6143 | 98.0634 | 2245.4633 | 167.8408 | 650.4672 | 571.7397 |
| 4661 | 98.0634 | 73.8967 | 2.7148 | 66.2992 | 59.3843 |
| 2933 | 98.0047 | 28.7300 | 0.2615 | 35.4785 | 18.3467 |
| 11774 | 97.9460 | 13.0600 | 0.2691 | 21.3834 | 21.1584 |
| 4699 | 97.9460 | 45.0367 | 1.2851 | 75.2419 | 48.5429 |
| 11518 | 97.8873 | 866.3333 | 5.0257 | 700.7905 | 152.2198 |
| 3926 | 97.8286 | 161.7933 | 1.5088 | 169.5411 | 75.3381 |
| 7899 | 97.8286 | 97.1133 | 2.0311 | 197.7857 | 105.8826 |
| 14128 | 97.7700 | 23.4533 | 0.3164 | 27.8790 | 16.4904 |
| 13545 | 97.7700 | 166.1967 | 21.3480 | −42.6609 | 90.7246 |
| 13298 | 97.7113 | 83.8033 | 0.9404 | 112.3971 | 60.2811 |
| 24144 | 97.7113 | 85.0733 | 1.6774 | 136.4863 | 58.5385 |
| 3766 | 97.6526 | 1104.0800 | 21.8812 | 1701.8873 | 523.1631 |
| 9968 | 97.6526 | 58.9033 | 1.0584 | 94.7145 | 47.1795 |
| 11798 | 97.5352 | 70.2967 | 0.5886 | 99.5352 | 39.9368 |
| 12166 | 97.5352 | 19.0067 | 0.2747 | 22.2075 | 15.7144 |
| 18831 | 97.4765 | 4809.9200 | 69.6443 | 6750.4066 | 1537.9084 |
| 10096 | 97.4178 | 65.7900 | 0.6657 | 76.3099 | 31.8946 |
| 21762 | 97.4178 | 466.5167 | 4.5356 | 376.5299 | 92.5215 |
| 16079 | 97.3592 | 256.4833 | 2.1796 | 236.7633 | 69.5309 |
| 23943 | 97.3592 | 193.3133 | 1.9399 | 238.6120 | 138.7008 |
| 23151 | 97.3005 | 10.1833 | 0.8635 | 34.5003 | 22.6926 |
| 12572 | 97.3005 | 72.6600 | 1.3066 | 110.4397 | 44.0860 |
| 14361 | 97.2418 | 110.6000 | 2.8727 | 55.7494 | 72.3869 |
| 19288 | 97.1831 | 187.8967 | 37.1048 | 28.8610 | 54.8651 |
| 11228 | 97.1244 | 490.0467 | 9.7160 | 364.7764 | 145.4307 |
| 24046 | 97.1244 | 108.2300 | 1.7785 | 105.7480 | 105.8608 |
| 22755 | 97.1244 | 127.2467 | 2.3448 | 83.2311 | 39.9777 |
| 9721 | 97.0070 | 20.3833 | 4.0155 | 99.4118 | 58.5648 |
| 18612 | 97.0070 | 342.4933 | 8.9446 | 222.4908 | 68.2419 |
| 7113 | 97.0070 | 258.9567 | 29.7332 | 132.9384 | 44.7526 |
| 21095 | 96.9484 | 117.8333 | 1.1484 | 150.2953 | 45.7433 |
| 23955 | 96.9484 | 128.7667 | 16.9215 | 38.1743 | 33.4258 |
| 4251 | 96.9484 | 662.4133 | 30.4248 | 362.9457 | 144.8585 |
| 5151 | 96.9484 | 60.9833 | 1.7539 | 104.3052 | 54.4726 |
| 3690 | 96.9484 | 215.8300 | 64.2400 | 49.8174 | 39.1039 |
| 9657 | 96.8897 | 86.2000 | 3.2922 | 15.2155 | 54.2610 |
| 8047 | 96.8897 | 52.2700 | 8.8581 | −42.9515 | 63.3252 |
| 18422 | 96.8310 | 38.5533 | 0.7600 | 39.6485 | 23.5532 |
| 17368 | 96.8310 | 235.3267 | 4.7107 | 175.3676 | 47.9310 |

TABLE 5F

Ay-25329
Timepoint(s) 3, 6 hrs

| GLGC ID NO. | LDA Score | Mean Tox | SD Tox | Mean Nontox | SD Nontox |
|---|---|---|---|---|---|
| 18430 | 97.8799 | 244.4133 | 59.6164 | 71.4675 | 41.6287 |
| 13464 | 97.8799 | 105.1833 | 8.0050 | 46.4058 | 31.0661 |
| 14295 | 97.1731 | 88.9483 | 17.8311 | 33.4665 | 16.1875 |
| 2628 | 96.9376 | 492.8917 | 34.5114 | 184.1623 | 135.2229 |
| 15937 | 96.8198 | 169.7067 | 34.6420 | 78.4724 | 30.5320 |
| 11494 | 96.5253 | 380.8500 | 49.2497 | 169.0470 | 144.6119 |
| 4524 | 96.4075 | 131.3050 | 9.6564 | 70.9689 | 30.5601 |
| 18405 | 96.4075 | 73.1433 | 1.3001 | 56.2209 | 16.3299 |
| 14353 | 96.2898 | 159.8883 | 9.8128 | 95.1852 | 34.5947 |
| 20359 | 95.8775 | 23.2233 | 1.5818 | 52.2767 | 27.9906 |
| 24196 | 95.8775 | 56.2083 | 16.0105 | 18.4056 | 17.8373 |
| 8641 | 95.8775 | 418.7433 | 123.4335 | 167.0685 | 79.7843 |
| 2629 | 95.8186 | 556.8817 | 149.7753 | 197.6202 | 116.9833 |
| 18949 | 95.6419 | 217.6067 | 13.5541 | 129.5842 | 42.4331 |
| 15224 | 95.4064 | 529.3033 | 45.4816 | 837.2908 | 188.2989 |
| 24195 | 95.1708 | 20.3117 | 6.6761 | −3.8527 | 17.4214 |
| 22412 | 95.1708 | 1181.4517 | 96.9794 | 687.0701 | 451.2515 |
| 22413 | 95.0530 | 777.7333 | 59.6676 | 464.3818 | 282.6921 |
| 11455 | 94.9352 | 265.3333 | 43.1649 | 124.9575 | 68.1315 |
| 1495 | 94.9352 | 225.5533 | 25.5123 | 134.3143 | 44.7788 |
| 15703 | 94.9352 | 70.4600 | 13.9834 | 27.2264 | 16.2986 |
| 4683 | 94.9352 | 121.4117 | 7.6137 | 200.8374 | 60.5156 |
| 21951 | 94.8763 | 252.2717 | 27.3888 | 139.1377 | 49.0136 |
| 11454 | 94.8174 | 451.5483 | 73.5754 | 229.0866 | 103.9297 |
| 16825 | 94.7585 | 89.7350 | 12.1107 | 45.6657 | 24.7499 |
| 16346 | 94.7585 | 269.8583 | 28.7645 | 160.3627 | 65.8357 |
| 21069 | 94.6996 | 60.3067 | 2.3909 | 42.4731 | 12.3421 |
| 1070 | 94.5819 | 30.2617 | 15.0986 | −2.9041 | 15.9980 |
| 18442 | 94.5819 | 86.7183 | 13.9898 | 48.8404 | 18.7263 |
| 13271 | 94.5819 | 126.9467 | 6.3864 | 86.0945 | 24.1985 |
| 1306 | 94.3463 | 270.6533 | 46.3224 | 151.2611 | 57.9675 |
| 19924 | 94.2874 | 142.2083 | 43.7937 | 53.2145 | 38.6505 |
| 22841 | 94.2285 | 377.3850 | 33.5481 | 237.2008 | 86.1178 |
| 21827 | 94.2285 | 88.1283 | 8.1489 | 148.5733 | 37.0364 |
| 25855 | 94.1696 | 57.7200 | 5.6047 | 117.2248 | 49.8470 |
| 11483 | 93.8751 | 883.2850 | 232.7277 | 391.2303 | 250.5088 |
| 21375 | 93.8163 | 76.8383 | 10.0983 | 43.5258 | 16.2520 |
| 6980 | 93.8163 | 20.1200 | 4.1902 | 50.3957 | 20.8092 |
| 14997 | 93.8163 | 159.6967 | 35.3579 | 469.4307 | 215.5138 |
| 2947 | 93.6985 | 149.2450 | 18.3877 | 81.5813 | 32.6704 |
| 17214 | 93.4629 | 537.1983 | 123.3613 | 303.7725 | 107.9353 |
| 1421 | 93.4629 | 107.4083 | 7.8489 | 152.5249 | 28.4429 |
| 10936 | 93.3440 | 386.2567 | 24.4089 | 285.8312 | 55.1814 |
| 21696 | 93.3451 | 513.0367 | 32.2830 | 366.5037 | 91.6917 |
| 923 | 93.2862 | 447.6017 | 76.9493 | 191.9330 | 109.2271 |
| 5655 | 93.2862 | 54.4933 | 5.1710 | 22.8081 | 21.3101 |
| 11493 | 93.2273 | 76.4950 | 11.3082 | 33.6475 | 53.6664 |
| 405 | 93.2273 | 415.8367 | 34.1897 | 214.7555 | 114.7106 |
| 18393 | 93.2273 | 262.2117 | 13.3125 | 196.4734 | 47.9128 |
| 23248 | 93.1684 | 81.5267 | 12.9663 | 39.7785 | 37.0517 |
| 22411 | 92.8740 | 84.2033 | 30.7726 | 37.2245 | 44.4022 |
| 20996 | 92.8740 | 388.8817 | 32.0371 | 250.0097 | 90.7838 |
| 606 | 92.8740 | 44.4467 | 12.7203 | −8.6008 | 32.0556 |
| 10622 | 92.8151 | 194.4550 | 67.2120 | 45.3615 | 98.1684 |
| 18396 | 92.8151 | 757.9317 | 102.5283 | 393.7471 | 199.8948 |
| 19472 | 92.8151 | 921.4283 | 33.9163 | 734.7573 | 157.7721 |
| 21654 | 92.6973 | 1234.4150 | 106.7444 | 853.2560 | 222.8128 |
| 23211 | 92.6973 | 76.8150 | 4.8992 | 52.6554 | 16.7993 |
| 17581 | 92.6384 | 156.6733 | 23.5839 | 100.5028 | 28.8250 |
| 15313 | 92.5795 | 630.9917 | 78.0988 | 299.2288 | 167.9021 |
| 21989 | 92.5795 | 178.0983 | 25.4530 | 111.0253 | 34.2502 |
| 1598 | 92.5795 | 512.5183 | 123.0998 | 280.3115 | 272.4337 |
| 16982 | 92.5795 | 2994.6350 | 385.1215 | 1616.1479 | 977.2105 |
| 15402 | 92.5206 | 36.9500 | 11.0460 | 110.3461 | 59.5505 |
| 14632 | 92.5206 | 1058.1517 | 30.6674 | 937.6025 | 398.2665 |
| 23550 | 92.5206 | 26.7900 | 1.6882 | 41.6228 | 14.5863 |
| 18967 | 92.4617 | 46.7667 | 19.8022 | 159.5867 | 88.6779 |
| 1141 | 92.4617 | 143.3867 | 14.5223 | 224.5637 | 56.6202 |
| 19086 | 92.2850 | 725.2767 | 110.2406 | 400.0317 | 159.9841 |
| 10623 | 92.2261 | 157.1383 | 39.7242 | 67.7467 | 58.3618 |
| 1959 | 92.1673 | 728.9033 | 48.0728 | 1344.1193 | 856.2213 |
| 17908 | 92.1673 | 851.1117 | 160.5609 | 447.3364 | 270.3713 |
| 427 | 92.1673 | 743.2883 | 89.4843 | 1717.1696 | 924.3084 |

TABLE 5F-continued

Ay-25329
Timepoint(s) 3, 6 hrs

| GLGC ID NO. | LDA Score | Mean Tox | SD Tox | Mean Nontox | SD Nontox |
|---|---|---|---|---|---|
| 19962 | 91.9317 | 113.4650 | 29.0504 | 234.8810 | 75.8808 |
| 8768 | 91.9317 | 89.6550 | 5.9309 | 59.7671 | 20.8109 |
| 1949 | 91.8728 | 145.9350 | 18.9856 | 78.3360 | 37.9597 |
| 14066 | 91.8728 | 66.8400 | 4.3112 | 100.3023 | 28.4136 |
| 463 | 91.8139 | 65.4117 | 12.9313 | 41.0991 | 13.4054 |
| 17227 | 91.8139 | 891.5767 | 57.6923 | 1278.8168 | 339.1518 |
| 25170 | 91.7550 | 139.2517 | 29.8308 | 80.0907 | 33.5922 |
| 13160 | 91.6372 | 55.0983 | 10.6580 | 91.1136 | 22.2215 |
| 6554 | 91.6372 | 284.3233 | 25.0925 | 189.6051 | 66.0887 |
| 25701 | 91.6372 | 61.5150 | 3.4145 | 87.8364 | 26.0903 |
| 21670 | 91.6372 | 181.9217 | 13.8454 | 119.7302 | 44.8171 |
| 14968 | 91.6372 | 19.0850 | 6.8948 | 64.4396 | 34.8537 |
| 21842 | 91.5783 | 759.7133 | 123.9583 | 479.0880 | 261.8514 |
| 798 | 91.5783 | 79.7200 | 10.3744 | 52.4562 | 22.5528 |
| 23312 | 91.5783 | 91.9350 | 10.9517 | 57.3650 | 20.6881 |
| 2970 | 91.5783 | 946.5083 | 114.5514 | 462.1050 | 377.7985 |
| 22321 | 91.4605 | 1434.4917 | 198.8243 | 829.6159 | 434.5747 |
| 20204 | 91.4016 | 19.4967 | 2.0304 | 40.2957 | 20.2264 |
| 10626 | 91.3428 | 268.4650 | 66.5615 | 121.6039 | 93.3006 |
| 4957 | 91.3428 | 144.9233 | 8.2315 | 147.7554 | 68.3542 |
| 19730 | 91.3428 | 71.9250 | 11.4500 | 44.7419 | 40.5468 |
| 25799 | 91.2839 | 294.6833 | 45.3323 | 212.5137 | 141.5602 |
| 25756 | 91.2839 | 109.0567 | 5.1192 | 105.3100 | 50.6019 |
| 19222 | 91.2839 | 1125.1583 | 55.5409 | 862.8375 | 182.4373 |
| 15242 | 91.1661 | 114.5167 | 13.7470 | 83.3984 | 19.6550 |
| 20509 | 91.1072 | 96.5950 | 5.9580 | 71.2690 | 26.6920 |
| 17158 | 90.9894 | 87.5017 | 11.5433 | 57.2658 | 54.1871 |
| 3290 | 97.5265 | 613.4167 | 39.9942 | 314.5679 | 109.5502 |
| 4828 | 97.1143 | 142.4550 | 43.4747 | 46.8512 | 26.7454 |
| 9796 | 97.1143 | 255.0833 | 18.0860 | 123.2008 | 55.7286 |
| 21390 | 97.0554 | 405.1600 | 31.5841 | 193.6104 | 81.9021 |
| 2506 | 96.9376 | 398.0800 | 27.9546 | 218.1467 | 70.2029 |
| 11714 | 96.7609 | 61.7217 | 9.8318 | 247.6829 | 126.7089 |
| 8305 | 96.7609 | 375.7550 | 22.1251 | 183.0852 | 93.0472 |
| 22689 | 96.7020 | 232.9067 | 27.4459 | 97.7041 | 46.2643 |
| 3923 | 96.6431 | 139.4550 | 24.6741 | 54.1024 | 32.1015 |
| 22180 | 96.6431 | 178.1850 | 59.1702 | 61.6409 | 37.0427 |
| 16234 | 96.6431 | 301.8650 | 39.7464 | 162.4979 | 52.4535 |
| 9168 | 96.5253 | 509.6183 | 100.2313 | 185.4878 | 93.8896 |
| 5381 | 96.4664 | 306.8217 | 28.5645 | 187.0617 | 47.6178 |
| 14211 | 96.4664 | 209.1150 | 10.7566 | 119.0507 | 52.6792 |
| 7192 | 96.4075 | 102.5200 | 11.8983 | 38.9664 | 27.9945 |
| 19403 | 96.4075 | 754.6017 | 87.0801 | 415.5562 | 121.2843 |
| 23541 | 96.4075 | 890.8783 | 193.8994 | 275.9950 | 179.2010 |
| 2772 | 96.2309 | 184.5450 | 27.6946 | 100.9273 | 33.0488 |
| 3275 | 96.2309 | 336.9533 | 39.9584 | 178.2048 | 63.8171 |
| 21561 | 96.1720 | 114.9450 | 23.4685 | 41.3638 | 28.1508 |
| 15007 | 96.1131 | 668.6550 | 48.1401 | 455.1624 | 95.6014 |
| 11324 | 96.1131 | 46.2600 | 3.1691 | 96.2170 | 44.1997 |
| 169 | 96.0542 | 40.0800 | 3.3572 | 87.3002 | 34.3463 |
| 22517 | 95.9953 | 223.0367 | 40.6905 | 46.7656 | 73.5935 |
| 19271 | 95.9953 | 490.6917 | 53.7345 | 278.7017 | 95.6827 |
| 14768 | 95.9953 | 425.8033 | 108.9164 | 202.3506 | 66.2873 |
| 13758 | 95.8775 | 83.0517 | 5.7052 | 46.8549 | 18.7966 |
| 3307 | 95.8775 | 101.2317 | 4.0591 | 117.0139 | 53.3865 |
| 17540 | 95.6419 | 2146.7033 | 204.5770 | 1144.7223 | 422.9289 |
| 21213 | 95.6419 | 1280.9050 | 260.8250 | 655.9604 | 225.0079 |
| 21894 | 95.6419 | 336.2600 | 35.4620 | 177.3960 | 85.7771 |
| 19006 | 95.5830 | 10.7983 | 6.3550 | 77.7137 | 44.6839 |
| 21534 | 95.5241 | 407.5467 | 71.6526 | 156.6914 | 99.0124 |
| 5131 | 95.4064 | 372.5217 | 28.4889 | 222.5597 | 70.0298 |
| 10068 | 95.4064 | 202.3933 | 11.5238 | 369.9565 | 141.8671 |
| 6818 | 95.4064 | 158.7683 | 4.9907 | 231.9303 | 66.5161 |
| 12833 | 95.2886 | 104.2533 | 19.2388 | 51.5040 | 28.5502 |
| 8214 | 95.2297 | 69.6917 | 11.0812 | −2.4645 | 50.2674 |
| 12713 | 95.1708 | 174.6267 | 6.9790 | 244.1152 | 65.7408 |
| 15091 | 95.1119 | 576.4117 | 48.8357 | 314.5218 | 119.7311 |
| 2501 | 95.1119 | 256.4683 | 36.4618 | 147.7495 | 48.9318 |
| 23619 | 95.1119 | 834.4217 | 102.6296 | 434.5440 | 153.2857 |
| 8966 | 95.1119 | 323.8550 | 37.2591 | 194.4778 | 70.4282 |
| 8020 | 95.0530 | 233.9050 | 5.5042 | 179.3032 | 46.7638 |
| 10020 | 95.0530 | 46.5100 | 5.9047 | 103.1178 | 45.7959 |
| 21839 | 94.9941 | 414.3417 | 43.1152 | 235.5447 | 80.1501 |
| 21573 | 94.9941 | 149.2700 | 7.8562 | 105.1396 | 25.9713 |
| 13265 | 94.9352 | 48.9750 | 9.3582 | 17.2554 | 12.6876 |
| 5630 | 94.8763 | 83.8650 | 3.9246 | 146.5377 | 80.0144 |
| 21214 | 94.8763 | 1552.6417 | 218.7283 | 901.2968 | 278.8069 |
| 4205 | 94.8174 | 1137.8867 | 128.3597 | 598.7179 | 242.8131 |
| 4707 | 94.8174 | 133.5667 | 12.9546 | 68.5205 | 32.2890 |
| 13229 | 94.7585 | 73.6167 | 5.4273 | 123.1325 | 32.5103 |
| 10750 | 94.7585 | 10.5883 | 0.9995 | 21.4047 | 25.8245 |
| 16554 | 94.6996 | 13.2400 | 1.6809 | 31.3074 | 38.2654 |
| 5781 | 94.6996 | 353.0233 | 130.2003 | 151.0561 | 90.8658 |
| 21509 | 94.6996 | −55.7467 | 14.6589 | 84.2766 | 90.4791 |
| 17948 | 94.6996 | 326.7133 | 28.9977 | 195.8269 | 70.0555 |
| 2093 | 94.5819 | 1588.8000 | 316.8382 | 503.8423 | 404.0605 |
| 2563 | 94.5819 | 720.3150 | 72.6944 | 451.8885 | 120.9167 |
| 4067 | 94.5230 | 662.1267 | 126.1669 | 343.2365 | 144.5664 |
| 5350 | 94.5230 | 175.5117 | 7.7610 | 273.7931 | 89.2739 |
| 24021 | 94.5230 | 214.7350 | 22.8421 | 351.3859 | 84.4421 |
| 6929 | 94.4641 | 119.9667 | 23.5626 | 55.1980 | 30.3598 |
| 15042 | 94.4052 | 287.3567 | 53.4370 | 125.5995 | 79.3029 |
| 17387 | 94.4052 | 386.0967 | 118.0665 | 72.4263 | 138.5332 |
| 21409 | 94.3463 | 296.5533 | 39.2811 | 152.9101 | 67.8517 |
| 3993 | 94.3463 | 204.8100 | 28.8425 | 132.1381 | 32.9209 |
| 2484 | 94.2874 | 126.1267 | 11.8361 | 57.2559 | 35.6616 |

TABLE 5G

CARBAMAZEPINE
Timepoint(s): 24 hrs

| GLGC ID NO. | LDA Score | Mean Tox | SD Tox | Mean Nontox | SD Nontox |
|---|---|---|---|---|---|
| 14123 | 100.0000 | 48.4980 | 0.7756 | −11.6124 | 18.3792 |
| 24809 | 99.9413 | 180.3570 | 1.8345 | 56.8638 | 32.3758 |
| 25403 | 99.8239 | 64.0790 | 0.2905 | 25.4184 | 17.4170 |
| 15823 | 99.7653 | 83.4667 | 1.9097 | −8.0912 | 27.0973 |
| 15805 | 99.7066 | 112.9880 | 6.5119 | 14.5016 | 20.1291 |
| 15316 | 99.7066 | 55.0293 | 0.3776 | 33.4617 | 8.5637 |
| 20865 | 99.7066 | −37.6357 | 4.9729 | 34.6265 | 23.5257 |
| 5850 | 99.7066 | 44.4007 | 1.4649 | 15.7542 | 8.3847 |
| 1164 | 99.7066 | 46.5737 | 0.4884 | 18.8003 | 11.7037 |
| 790 | 99.7066 | 55.8813 | 1.7601 | 13.0070 | 31.9294 |
| 15186 | 99.6479 | 126.6513 | 0.1590 | 114.2720 | 42.5942 |
| 1318 | 99.5892 | 135.9500 | 8.4584 | 6.1624 | 39.5671 |
| 25505 | 99.5892 | 53.0530 | 0.6712 | 24.0215 | 12.1296 |
| 21007 | 99.5305 | −16.9577 | 1.1134 | 136.6015 | 135.1118 |
| 24205 | 99.5305 | 160.7647 | 9.8152 | 72.5590 | 23.4742 |
| 7960 | 99.4718 | 41.7373 | 1.9215 | 9.8023 | 8.1546 |
| 24410 | 99.4718 | 45.8827 | 1.5862 | 8.2973 | 11.3059 |
| 1389 | 99.4718 | 243.8687 | 24.1626 | −2.5747 | 56.8163 |
| 23897 | 99.4718 | 64.6800 | 3.7886 | 10.4497 | 15.5433 |
| 20410 | 99.4718 | 279.9763 | 5.6300 | 70.7098 | 45.3260 |
| 21054 | 99.4718 | 3.5047 | 5.6705 | 174.0597 | 99.2673 |
| 20014 | 99.4131 | 91.9310 | 5.4248 | 14.5709 | 15.9063 |
| 12072 | 99.4131 | 81.5930 | 4.5469 | 27.4857 | 17.7969 |
| 22890 | 99.4131 | −2.8330 | 3.4395 | 59.6139 | 33.0271 |
| 2000 | 99.3545 | 45.8990 | 2.7151 | 10.1577 | 8.5937 |
| 3886 | 99.2958 | 1.0683 | 1.0933 | 36.3414 | 18.0822 |
| 25416 | 99.2958 | 74.3677 | 7.2411 | 16.8752 | 44.2188 |
| 1968 | 99.2371 | 50.4590 | 3.9402 | 10.1379 | 11.2938 |
| 19786 | 99.2371 | 38.7987 | 1.9629 | 10.1821 | 7.3119 |
| 7351 | 99.2371 | 150.8150 | 11.3270 | 42.1127 | 24.3023 |
| 21034 | 99.2371 | 96.3640 | 12.6094 | 1.5747 | 18.6184 |
| 16255 | 99.2371 | 155.2367 | 9.3656 | 1112.7028 | 612.4604 |
| 23682 | 99.2371 | −33.3880 | 6.6373 | 66.6017 | 36.1225 |
| 17916 | 99.2371 | 88.5927 | 0.6726 | 63.7029 | 19.9293 |
| 6672 | 99.2371 | 86.9130 | 0.3191 | 117.2217 | 54.7811 |
| 1552 | 99.2371 | −9.1733 | 2.4677 | 85.4641 | 66.1090 |
| 9516 | 99.2371 | 37.1223 | 2.1698 | 15.5424 | 56.3491 |
| 1914 | 99.1784 | 196.7423 | 11.3560 | 87.7237 | 33.2131 |

TABLE 5G-continued

CARBAMAZEPINE
Timepoint(s): 24 hrs

| GLGC ID NO. | LDA Score | Mean Tox | SD Tox | Mean Nontox | SD Nontox |
|---|---|---|---|---|---|
| 17999 | 99.1784 | 318.9597 | 39.2363 | 967.8914 | 261.2563 |
| 18924 | 99.1784 | 84.9983 | 3.5681 | 30.6930 | 17.5419 |
| 9126 | 99.1784 | 321.0840 | 22.8784 | 106.5052 | 51.6009 |
| 20831 | 99.1784 | 50.0190 | 8.3389 | 164.8933 | 50.8114 |
| 25195 | 99.1784 | 105.6267 | 9.2087 | 23.5897 | 19.3267 |
| 4601 | 99.1784 | 29.1593 | 2.2838 | −1.0195 | 15.9477 |
| 18365 | 99.1197 | 131.8590 | 0.6389 | 101.3220 | 30.1635 |
| 18897 | 99.1197 | 366.1280 | 24.8456 | 117.0836 | 56.2510 |
| 7693 | 99.1197 | 56.9730 | 2.7278 | 22.3518 | 11.0319 |
| 18727 | 99.1197 | 741.6577 | 1.6270 | 881.8320 | 229.7376 |
| 1049 | 99.0610 | 257.4263 | 18.7145 | 110.2200 | 33.3008 |
| 313 | 99.0610 | 157.1730 | 6.2781 | 72.5416 | 30.0850 |
| 26001 | 99.0610 | 75.3957 | 0.7580 | 23.4137 | 51.8819 |
| 16301 | 99.0610 | 21.6367 | 0.4663 | 146.4527 | 147.2906 |
| 11 | 99.0610 | 45.1377 | 5.3267 | −3.2473 | 13.4996 |
| 20863 | 99.0610 | 273.8600 | 9.6637 | 123.7345 | 44.5968 |
| 13938 | 99.0610 | 121.9280 | 13.9465 | 26.9523 | 21.3376 |
| 20153 | 99.0610 | 85.0960 | 7.7296 | 319.9229 | 120.1068 |
| 9840 | 99.0610 | 269.0617 | 16.7867 | 1116.7820 | 503.8976 |
| 24732 | 99.0023 | 68.6833 | 5.9190 | 22.9610 | 12.6860 |
| 1840 | 99.0023 | 165.6460 | 4.9015 | 66.3054 | 30.2296 |
| 25936 | 99.0023 | 30.7817 | 1.5750 | 9.7733 | 7.6718 |
| 23522 | 99.0023 | 439.8797 | 10.7217 | 251.5698 | 78.8198 |
| 926 | 99.0023 | 114.5767 | 6.8464 | 41.7867 | 23.9772 |
| 1575 | 99.0023 | 54.0730 | 4.1433 | 13.0610 | 11.1845 |
| 22872 | 99.0023 | 215.2283 | 3.5063 | 144.2281 | 27.4511 |
| 25515 | 99.0023 | 24.3793 | 13.2816 | −11.9388 | 8.8595 |
| 18000 | 99.0023 | 431.1557 | 62.3955 | 1239.1314 | 347.3849 |
| 18338 | 99.0023 | 85.6710 | 4.6222 | 26.2959 | 17.7964 |
| 11836 | 99.0023 | 78.7933 | 3.3954 | 27.3050 | 15.8532 |
| 21794 | 99.0023 | 140.7727 | 10.0847 | 51.4299 | 27.2684 |
| 17277 | 99.0023 | 143.6707 | 14.5302 | 46.9303 | 25.0079 |
| 25196 | 99.0023 | 110.5447 | 11.8558 | 22.3283 | 31.0538 |
| 1925 | 99.0023 | 181.1357 | 4.5046 | 95.4820 | 34.9458 |
| 7489 | 98.9437 | 77.9070 | 5.1620 | 26.2102 | 15.5952 |
| 24107 | 98.9437 | 393.5383 | 34.3071 | 152.1653 | 54.3095 |
| 21683 | 98.9437 | 144.5073 | 13.3131 | 49.8008 | 23.9805 |
| 692 | 98.9437 | 34.8557 | 0.9564 | 13.5990 | 10.2824 |
| 1896 | 98.9437 | 34.7883 | 0.6874 | 16.2825 | 8.2526 |
| 3430 | 98.9437 | 953.4527 | 25.0185 | 500.6999 | 183.2857 |
| 25753 | 98.9437 | 79.6427 | 7.7013 | −17.8280 | 32.6002 |
| 24528 | 98.9437 | 55.0493 | 5.1799 | 16.9409 | 10.6080 |
| 25336 | 98.9437 | 168.8077 | 17.8126 | 29.9355 | 27.7323 |
| 25222 | 98.9437 | 25.5017 | 1.3525 | 10.4093 | 8.1741 |
| 17991 | 98.8850 | 108.9530 | 14.7206 | 24.1683 | 16.8260 |
| 536 | 98.8850 | 55.4430 | 7.0163 | 13.0676 | 10.0571 |
| 24568 | 98.8850 | 53.7473 | 3.6314 | 21.7335 | 13.0969 |
| 1480 | 98.8850 | 107.7950 | 11.6472 | 347.8121 | 122.6750 |
| 18533 | 98.8850 | 90.3800 | 13.4304 | 9.7228 | 24.1083 |
| 631 | 98.8850 | 25.9430 | 0.7283 | 10.9174 | 6.1250 |
| 13488 | 98.8850 | −9.1863 | 7.5260 | 29.3408 | 12.6819 |
| 24869 | 98.8263 | 305.1247 | 16.2346 | 96.4816 | 60.9388 |
| 25244 | 98.8263 | 95.2620 | 5.4541 | 19.2113 | 17.8717 |
| 1120 | 98.8263 | 55.6800 | 2.4398 | 23.7226 | 11.9836 |
| 4721 | 98.8263 | 99.9530 | 8.2323 | 39.0086 | 16.5644 |
| 17676 | 98.8263 | 23.5260 | 16.1556 | 908.5257 | 764.6878 |
| 8831 | 98.8263 | 328.0247 | 47.4173 | 52.6739 | 70.0195 |
| 15727 | 98.8263 | 75.0070 | 9.4361 | 20.8071 | 13.4201 |
| 9174 | 98.8263 | 60.7883 | 5.6686 | 14.6962 | 18.1791 |
| 1853 | 98.8263 | 1315.8550 | 6.7931 | 1828.5987 | 535.5986 |
| 17486 | 98.8263 | 46.2910 | 9.6281 | 5.0471 | 8.3023 |
| 675 | 98.8263 | 32.4463 | 6.9857 | −8.9789 | 12.9485 |
| 7307 | 99.8826 | 146.0617 | 1.1531 | 70.1148 | 28.8654 |
| 11630 | 99.7653 | 455.1767 | 3.0582 | 281.2968 | 61.7315 |
| 4751 | 99.7653 | 227.2887 | 0.6892 | 114.1999 | 45.0664 |
| 11767 | 99.7066 | 154.7667 | 8.7236 | 35.3085 | 32.3148 |
| 18002 | 99.7066 | 374.4650 | 25.4273 | 1301.7414 | 484.1351 |
| 21465 | 99.7066 | 445.4160 | 30.5791 | 1930.4288 | 819.0464 |
| 24251 | 99.5892 | 132.1863 | 0.9781 | 69.3626 | 88.3190 |
| 18681 | 99.5305 | 146.4137 | 17.5015 | 469.0938 | 138.2230 |
| 15122 | 99.5305 | 195.3107 | 0.8623 | 266.4687 | 61.3122 |
| 6874 | 99.4718 | 234.0087 | 13.0313 | 54.6951 | 40.3200 |
| 24223 | 99.4718 | 585.9413 | 7.0652 | 275.0404 | 125.3416 |

TABLE 5G-continued

CARBAMAZEPINE
Timepoint(s): 24 hrs

| GLGC ID NO. | LDA Score | Mean Tox | SD Tox | Mean Nontox | SD Nontox |
|---|---|---|---|---|---|
| 24130 | 99.4718 | 177.5050 | 7.1452 | 66.5799 | 34.3252 |
| 18491 | 99.4131 | 405.2177 | 24.9928 | 751.4099 | 125.7073 |
| 6890 | 99.4131 | 182.9777 | 9.0777 | 79.3668 | 30.4514 |
| 2025 | 99.4131 | 136.4650 | 3.0285 | 61.8417 | 37.8943 |
| 18910 | 99.4131 | −84.9320 | 28.8661 | 189.4222 | 118.4656 |
| 4618 | 99.4131 | 142.9597 | 1.4231 | 81.4530 | 34.9566 |
| 17096 | 99.4131 | 421.0987 | 0.5803 | 523.5151 | 122.9930 |
| 6313 | 99.3545 | 161.2440 | 7.5580 | 31.6342 | 47.8259 |
| 13141 | 99.3545 | 102.7810 | 0.8108 | 58.9323 | 19.1751 |
| 3860 | 99.3545 | 144.2537 | 1.1453 | 311.6792 | 134.2491 |
| 8580 | 99.3545 | 113.6997 | 0.2805 | 95.9177 | 34.5760 |
| 5309 | 99.2958 | 223.5827 | 0.8326 | 344.2408 | 87.1220 |
| 6699 | 99.2958 | 294.8583 | 4.9811 | 46.3019 | 83.8043 |
| 6370 | 99.2958 | 209.9073 | 14.3105 | 20.3682 | 43.8699 |
| 13753 | 99.2371 | 39.8550 | 0.5715 | 13.6806 | 14.1475 |
| 4951 | 99.2371 | 183.0727 | 23.8127 | 544.7317 | 193.5944 |
| 23756 | 99.2371 | 227.3547 | 12.1648 | 652.0333 | 363.0901 |
| 9289 | 99.1784 | 175.8997 | 17.8885 | 61.9873 | 35.6449 |
| 20633 | 99.1784 | 62.7547 | 2.4832 | 16.5823 | 17.3640 |
| 13958 | 99.1784 | 26.8990 | 2.9256 | −7.4870 | 16.4666 |
| 18138 | 99.1784 | 636.0283 | 22.6070 | 1864.4630 | 742.3702 |
| 12836 | 99.1784 | 177.7727 | 8.8776 | 57.2892 | 35.9146 |
| 16779 | 99.1784 | 115.0767 | 1.4765 | 60.9063 | 40.8888 |
| 22637 | 99.1784 | 55.1107 | 4.0960 | 11.8810 | 18.5527 |
| 20140 | 99.1197 | 47.4840 | 0.6659 | 16.4757 | 21.2829 |
| 17646 | 99.1197 | 166.2943 | 4.7569 | 102.5739 | 23.5564 |
| 11192 | 99.1197 | 25.2547 | 1.2049 | 1.2014 | 15.4768 |
| 8330 | 99.1197 | 108.2920 | 5.4333 | 42.2278 | 22.7628 |
| 21466 | 99.1197 | 835.2790 | 129.6464 | 3183.2413 | 1232.0680 |
| 16533 | 99.1197 | 60.6637 | 25.3108 | 384.7378 | 144.8104 |
| 23535 | 99.0610 | 248.9700 | 10.9006 | 91.4745 | 50.4478 |
| 18212 | 99.0610 | 112.1510 | 24.8844 | −31.1676 | 29.8890 |
| 18839 | 99.0610 | 11.3043 | 6.6877 | 103.1519 | 45.6866 |
| 12602 | 99.0610 | 112.6727 | 3.7478 | 245.4803 | 66.5770 |
| 9746 | 99.0610 | 194.9770 | 1.1266 | 124.6755 | 66.1367 |
| 21442 | 99.0610 | 14.9597 | 0.2368 | 47.6371 | 28.6294 |
| 2571 | 99.0610 | 150.3277 | 24.8886 | −42.2173 | 67.7958 |

TABLE 5H

Carcinogen Gentoxic
Timepoint(s): Various

| GLGC ID NO. | LDA Score | Mean Tox | SD Tox | Mean Nontox | SD Nontox |
|---|---|---|---|---|---|
| 17684 | 83.2437 | 24.1679 | 10.8529 | 63.0350 | 32.9578 |
| 20466 | 78.7037 | 15.4799 | 18.8561 | 57.3331 | 40.3580 |
| 18867 | 78.7037 | 152.5066 | 69.4881 | 312.6097 | 157.4767 |
| 17739 | 78.3154 | 13.0738 | 5.8696 | 44.0949 | 41.6782 |
| 24327 | 77.8375 | 1488.5860 | 350.4001 | 1017.6059 | 335.8338 |
| 18606 | 77.4791 | 2824.6361 | 611.6411 | 2168.1253 | 568.0217 |
| 1694 | 77.0012 | 3018.2006 | 535.2345 | 2466.3986 | 617.7198 |
| 573 | 76.4934 | 28.2431 | 18.7839 | 81.0548 | 59.0454 |
| 13283 | 76.4337 | 82.5342 | 33.3722 | 146.3369 | 71.9209 |
| 24626 | 76.3441 | 2376.6147 | 273.0064 | 2111.8089 | 359.3834 |
| 18895 | 76.3142 | 244.5522 | 49.7790 | 204.1394 | 48.1019 |
| 25058 | 76.0454 | 68.6969 | 10.7667 | 84.6507 | 46.2064 |
| 815 | 75.5078 | 3428.6683 | 516.3530 | 2934.2645 | 654.7969 |
| 15239 | 75.4480 | 2072.2969 | 424.1459 | 1641.8186 | 416.6065 |
| 18375 | 75.0299 | 287.3852 | 56.9144 | 225.8582 | 75.6946 |
| 16929 | 74.9104 | 2312.8700 | 433.5204 | 1972.9877 | 396.4671 |
| 16180 | 74.8208 | 57.2374 | 21.6973 | 95.5882 | 43.1725 |
| 14876 | 74.7909 | 35.2148 | 16.3889 | 14.1246 | 22.1227 |
| 8597 | 74.7611 | 25.1917 | 21.4400 | 43.6334 | 29.5628 |
| 4292 | 74.7013 | 43.2759 | 5.8170 | 54.3900 | 25.6016 |
| 626 | 74.6714 | 155.2046 | 66.5618 | 88.2512 | 74.8286 |
| 18305 | 74.5818 | 4090.2974 | 756.0369 | 3302.5231 | 876.5555 |
| 11865 | 74.4624 | 24.5675 | 12.9383 | 50.7579 | 29.0331 |
| 15310 | 73.9845 | 34.7029 | 8.8888 | 26.9325 | 13.2867 |

TABLE 5H-continued

Carcinogen Gentoxic
Timepoint(s): Various

| GLGC ID NO. | LDA Score | Mean Tox | SD Tox | Mean Nontox | SD Nontox |
|---|---|---|---|---|---|
| 16847 | 73.9546 | 1865.2128 | 330.3253 | 1534.1079 | 327.1473 |
| 17562 | 73.9546 | 552.2980 | 151.3505 | 653.8965 | 387.5632 |
| 25204 | 73.9247 | 60.4349 | 28.6014 | 107.2352 | 56.4270 |
| 16331 | 73.8650 | 327.0269 | 85.2858 | 429.1192 | 123.9959 |
| 22903 | 73.8650 | 210.4887 | 25.5060 | 206.8894 | 54.1631 |
| 18611 | 73.8650 | 3492.6204 | 625.1874 | 2793.9336 | 802.3376 |
| 15652 | 73.7157 | 3660.3111 | 564.5969 | 3089.4855 | 568.9847 |
| 20872 | 73.6858 | 2746.6096 | 482.6771 | 2267.9399 | 612.0351 |
| 16708 | 73.5066 | 200.5813 | 86.2312 | 261.7915 | 84.1375 |
| 17997 | 73.3871 | 33.7788 | 31.9197 | 50.0072 | 23.8590 |
| 4426 | 73.3274 | 377.7188 | 62.9380 | 275.3301 | 76.0192 |
| 5545 | 73.3274 | 332.4978 | 160.6275 | 546.7870 | 273.7831 |
| 17567 | 72.9988 | 3275.2471 | 635.6829 | 2640.8623 | 675.9263 |
| 16322 | 72.9689 | 42.5881 | 10.3937 | 64.8080 | 34.4905 |
| 16164 | 72.9689 | 1499.2766 | 196.2598 | 1279.1471 | 248.1887 |
| 4574 | 72.9391 | 222.2413 | 131.1893 | 328.5879 | 127.8903 |
| 24577 | 72.9391 | 2644.0129 | 450.9776 | 2164.7557 | 529.5811 |
| 2667 | 72.8793 | 100.5019 | 58.9314 | 181.7163 | 85.6482 |
| 4439 | 72.8495 | 186.1599 | 48.4753 | 244.3336 | 74.2609 |
| 25705 | 72.8495 | 2181.2321 | 207.8482 | 1873.7307 | 390.4862 |
| 10819 | 72.7897 | 3325.8141 | 666.3316 | 2785.1932 | 734.6304 |
| 32 | 72.7897 | 23.7469 | 30.6246 | 51.1800 | 27.0449 |
| 19020 | 72.7300 | 69.2854 | 18.3031 | 58.0931 | 18.9467 |
| 9620 | 72.7300 | 1607.7848 | 205.3970 | 1351.3844 | 295.0936 |
| 1973 | 72.6404 | 200.5189 | 41.8816 | 265.2599 | 76.0872 |
| 844 | 72.5806 | 102.0208 | 29.4549 | 143.1441 | 38.6051 |
| 1995 | 72.5508 | 124.2003 | 68.8714 | 282.0650 | 213.3999 |
| 317 | 72.5209 | 19.3689 | 11.9793 | 37.1872 | 21.0550 |
| 25777 | 72.4313 | 2568.1025 | 840.8705 | 1733.0832 | 547.8341 |
| 4647 | 72.3118 | 173.6651 | 83.7718 | 214.1083 | 63.8184 |
| 6128 | 72.2820 | 28.6517 | 10.8568 | 41.4035 | 15.5873 |
| 537 | 72.2820 | 578.2862 | 177.7466 | 927.1787 | 355.2321 |
| 5667 | 72.2521 | 2202.9148 | 313.9591 | 1842.6349 | 349.7418 |
| 21950 | 72.2222 | 210.2395 | 61.4833 | 258.8539 | 70.7675 |
| 25540 | 72.1924 | 85.4082 | 18.6506 | 65.4353 | 27.1327 |
| 15387 | 72.1625 | 1238.3254 | 205.3824 | 1085.5852 | 286.3376 |
| 3131 | 72.1027 | 61.6861 | 17.0982 | 102.7094 | 52.8770 |
| 16953 | 72.0729 | 1786.6267 | 208.7103 | 1518.2197 | 331.2064 |
| 1347 | 71.9534 | 2914.3907 | 358.4854 | 2513.0395 | 531.1009 |
| 9090 | 71.9534 | 71.7453 | 42.5372 | 31.4616 | 54.8234 |
| 8137 | 71.8937 | 207.2667 | 83.6075 | 152.8135 | 58.7335 |
| 17729 | 71.8638 | 2510.5232 | 415.6794 | 2183.1620 | 428.4607 |
| 19727 | 71.7742 | 3004.0926 | 512.1218 | 2630.9137 | 587.5475 |
| 17100 | 71.7443 | 2604.3299 | 546.6047 | 2104.2476 | 452.0819 |
| 19244 | 71.7443 | 3689.5559 | 647.5039 | 3011.2287 | 757.8297 |
| 1611 | 71.7443 | 87.6601 | 13.9565 | 69.8552 | 33.7531 |
| 3027 | 71.7145 | 2784.9022 | 517.9926 | 2336.2082 | 596.9884 |
| 9745 | 71.7145 | 72.4216 | 14.5577 | 59.7082 | 19.1666 |
| 17808 | 71.7145 | 1779.8404 | 266.5749 | 1508.1624 | 345.8634 |
| 22282 | 71.6846 | 189.2981 | 49.6545 | 144.0702 | 45.3583 |
| 14959 | 71.6547 | 1950.3103 | 243.7238 | 1625.4320 | 410.8811 |
| 10109 | 71.5651 | 3600.9485 | 608.1086 | 3020.9218 | 696.0940 |
| 16930 | 71.5352 | 285.6808 | 173.5339 | 618.6573 | 335.9065 |
| 20807 | 71.5054 | 2380.6327 | 406.5916 | 1997.2291 | 472.1739 |
| 10267 | 71.4755 | 6198.5065 | 1513.2710 | 4837.7717 | 1384.2252 |
| 20462 | 71.4456 | 2074.7572 | 351.5390 | 1694.9889 | 408.2619 |
| 709 | 71.4158 | 15.7658 | 4.1818 | 21.2559 | 11.8469 |
| 4592 | 71.4158 | 521.0269 | 92.2932 | 417.6593 | 130.2386 |
| 17963 | 71.3560 | 37.5585 | 10.8328 | 51.4726 | 22.5152 |
| 15136 | 71.1470 | 2350.9841 | 523.1582 | 1864.5272 | 607.3231 |
| 15468 | 71.1470 | 2277.0235 | 366.3536 | 1913.7428 | 434.0124 |
| 25576 | 71.1171 | 38.0117 | 17.4168 | 30.2739 | 20.3120 |
| 765 | 70.9976 | 11.7574 | 8.1788 | 22.2856 | 14.8998 |
| 7914 | 70.9677 | 45.2762 | 21.0352 | 75.6069 | 35.3139 |
| 11994 | 70.9379 | 101.4992 | 22.2917 | 82.2689 | 21.4963 |
| 18541 | 70.9379 | 2808.4522 | 360.2590 | 2495.8491 | 560.3452 |
| 619 | 70.8781 | 48.3771 | 33.1710 | 99.1181 | 66.2423 |
| 14924 | 70.8781 | 123.4532 | 24.5390 | 100.2456 | 40.6245 |
| 20082 | 70.8483 | 679.6899 | 257.7474 | 450.5680 | 161.7391 |
| 3015 | 70.8483 | 4501.4371 | 1119.9668 | 3379.2707 | 1048.8013 |
| 25761 | 70.8483 | 27.6317 | 12.7503 | 15.9796 | 13.5651 |
| 1530 | 70.8483 | 23.9997 | 18.3781 | 16.9459 | 16.0533 |
| 25088 | 70.8483 | 31.1699 | 9.9798 | 29.7340 | 26.6803 |
| 17764 | 70.8184 | 3252.5971 | 850.8214 | 2512.8403 | 634.2208 |
| 1153 | 70.8184 | 120.0533 | 47.7266 | 185.1854 | 103.2523 |
| 1529 | 70.8184 | 76.6221 | 40.2183 | 114.6682 | 46.8373 |
| 13718 | 78.6440 | 26.5046 | 18.9754 | 45.8103 | 21.6080 |
| 2845 | 77.8076 | 1386.7830 | 117.3309 | 1228.6847 | 199.8863 |
| 5258 | 77.2103 | 131.6422 | 46.9568 | 192.2809 | 56.1012 |
| 19544 | 77.1505 | 1800.3195 | 359.4844 | 1434.1918 | 373.0310 |
| 6479 | 76.9713 | 225.1826 | 88.9313 | 425.7913 | 209.4747 |
| 17513 | 76.8519 | 46.4941 | 20.4082 | 79.1162 | 33.8067 |
| 19092 | 76.6726 | 7218.1836 | 1623.4245 | 5075.2803 | 1385.8701 |
| 4900 | 76.6726 | 311.1479 | 58.2227 | 411.2640 | 102.7585 |
| 24411 | 76.6129 | 568.3201 | 97.8176 | 440.6609 | 123.8636 |
| 4849 | 76.5830 | 1711.5001 | 238.8230 | 1409.4051 | 315.9705 |
| 3730 | 76.4934 | 339.2046 | 107.5556 | 605.1650 | 311.5296 |
| 12825 | 76.2545 | 338.6201 | 40.2940 | 297.6594 | 100.5426 |
| 18205 | 76.0454 | 938.3951 | 144.5144 | 759.4102 | 211.2884 |
| 13598 | 75.9259 | 469.1300 | 132.2803 | 308.8207 | 98.2254 |
| 3417 | 75.8662 | 1457.0043 | 228.6052 | 1141.7598 | 327.8584 |
| 14181 | 75.8065 | 28.7701 | 21.8647 | 48.8043 | 22.4436 |
| 21982 | 75.6870 | 33.1250 | 36.7892 | 81.3948 | 51.4937 |
| 8988 | 75.6571 | 98.9101 | 50.3124 | 61.7987 | 41.2460 |
| 23097 | 75.5974 | 598.8099 | 126.5915 | 475.3528 | 106.0657 |
| 23521 | 75.5974 | 71.5079 | 47.8226 | 279.0167 | 251.5306 |
| 7055 | 75.5078 | 520.4733 | 93.2605 | 406.2953 | 97.5641 |
| 14984 | 75.4182 | 21.6388 | 46.6039 | −25.6164 | 50.8683 |
| 5013 | 75.3584 | 343.1448 | 128.1612 | 172.7631 | 134.4316 |
| 22765 | 75.0000 | 32.3662 | 37.1378 | 97.1570 | 77.8761 |
| 4585 | 74.8507 | 1573.0931 | 152.4961 | 1345.7750 | 326.2358 |
| 8518 | 74.8208 | 38.2193 | 13.7657 | 23.7024 | 19.1698 |
| 8477 | 74.7312 | 656.7041 | 145.3255 | 515.5827 | 143.5322 |
| 4233 | 74.7312 | 439.4909 | 171.0227 | 391.5380 | 460.1507 |
| 6841 | 74.7013 | 185.7423 | 59.4116 | 278.1277 | 110.6067 |
| 17089 | 74.6714 | 7685.5452 | 2569.7938 | 5135.4585 | 1629.4001 |
| 23712 | 74.4325 | 191.3732 | 30.3205 | 247.4805 | 65.0312 |
| 6335 | 74.3728 | 136.5666 | 27.6236 | 101.1669 | 33.7386 |
| 19082 | 74.3429 | 171.3669 | 22.6879 | 197.1318 | 40.4757 |
| 23224 | 74.3130 | 399.4551 | 79.0127 | 319.2884 | 107.3610 |
| 5833 | 74.2533 | 38.1724 | 21.8087 | 71.4256 | 34.5511 |
| 20052 | 74.2234 | 103.4803 | 12.7614 | 120.5743 | 41.9604 |
| 21740 | 74.2234 | 308.8395 | 199.0278 | 439.7696 | 163.7107 |
| 14241 | 74.1637 | 106.1579 | 18.7964 | 132.1357 | 61.4963 |
| 8672 | 74.1338 | 96.5479 | 29.5129 | 137.7824 | 46.5654 |
| 16752 | 74.1039 | 18.0234 | 22.2005 | 75.5484 | 85.2097 |
| 7134 | 74.0143 | 33.7884 | 13.5400 | 50.7510 | 19.6305 |
| 8856 | 73.9564 | 102.5003 | 26.4112 | 70.1919 | 24.2732 |
| 19555 | 73.9247 | 171.3837 | 63.4120 | 387.3110 | 247.6251 |
| 9475 | 73.7157 | 96.7250 | 74.6554 | 176.1554 | 86.3752 |
| 21879 | 73.6858 | 160.5342 | 29.0914 | 128.3339 | 38.3965 |
| 23824 | 73.6858 | 323.7851 | 31.7262 | 283.4817 | 90.0957 |
| 21023 | 73.6858 | 84.6597 | 35.4292 | 112.2190 | 38.5431 |
| 14313 | 73.6559 | −2.3209 | 37.0198 | 30.4834 | 43.9658 |
| 24721 | 73.5962 | 26.0903 | 8.3129 | 39.6233 | 16.6559 |
| 9277 | 73.5364 | 151.3106 | 18.4538 | 134.8811 | 42.4967 |
| 9150 | 73.5364 | 1309.8984 | 152.4534 | 1125.9564 | 262.8034 |
| 6291 | 73.4170 | 173.6273 | 74.2361 | 259.9613 | 96.0243 |
| 6965 | 73.4170 | 151.3818 | 12.6941 | 68.6449 | 25.8273 |
| 14223 | 73.3871 | 1119.3547 | 111.9032 | 1124.2595 | 233.3335 |
| 7258 | 73.3871 | 211.9798 | 27.0084 | 237.1541 | 78.4932 |
| 16656 | 73.2676 | 840.1154 | 178.6984 | 709.0587 | 151.4252 |
| 10665 | 73.2676 | 228.5429 | 62.7885 | 155.9417 | 65.9592 |
| 4944 | 73.2676 | 889.2758 | 140.7190 | 751.6468 | 288.6840 |
| 22587 | 73.2378 | 104.6780 | 18.5016 | 135.6731 | 33.9942 |
| 10319 | 73.1183 | 56.5545 | 33.2719 | 97.6325 | 35.0433 |
| 22014 | 73.0884 | 38.5019 | 17.2074 | 59.5901 | 32.3597 |
| 23829 | 73.0884 | 55.7927 | 13.6425 | 72.5715 | 38.5074 |
| 3519 | 73.0884 | 293.0677 | 106.9134 | 493.0188 | 269.0770 |
| 11630 | 73.0585 | 321.4721 | 47.5804 | 281.0560 | 62.5046 |

TABLE 5I

Carcinogen NonGenotoxic
Timepoint(s): Various

| GLGC ID NO. | LDA Score | Mean Tox | SD Tox | Mean Nontox | SD Nontox |
|---|---|---|---|---|---|
| 426 | 77.3124 | 1565.2891 | 235.3417 | 2629.7619 | 1314.8392 |
| 7914 | 75.6721 | 45.3587 | 15.0070 | 76.1196 | 35.4010 |
| 1611 | 75.0816 | 99.5156 | 20.8133 | 69.0913 | 33.4436 |
| 10744 | 74.8215 | 16.7976 | 10.2152 | 53.8582 | 48.6612 |
| 23524 | 74.4912 | 557.3039 | 122.2340 | 389.9234 | 194.0749 |
| 14970 | 74.3089 | 34.4168 | 12.1177 | 60.0015 | 25.5899 |
| 21014 | 74.3013 | 483.3280 | 183.4214 | 840.5592 | 439.7860 |
| 923 | 74.0735 | 297.9388 | 111.4610 | 189.6752 | 109.1328 |
| 23709 | 73.7451 | 39.4808 | 10.8866 | 62.5106 | 28.0650 |
| 16809 | 73.6217 | 91.9632 | 31.3442 | 62.4932 | 25.3156 |
| 19222 | 73.5704 | 1033.9584 | 166.1523 | 858.0964 | 180.7030 |
| 2830 | 73.1375 | 138.9585 | 25.3332 | 177.3637 | 42.3178 |
| 15313 | 72.9724 | 424.7222 | 113.5965 | 296.7680 | 169.7572 |
| 23522 | 72.9458 | 327.7718 | 64.5295 | 249.2933 | 78.5694 |
| 16730 | 72.6857 | 310.8457 | 74.9618 | 222.8116 | 103.7592 |
| 11755 | 72.4522 | 514.2567 | 134.4946 | 690.3041 | 306.3471 |
| 18396 | 72.4237 | 619.0002 | 250.2477 | 387.6439 | 194.6268 |
| 2098 | 72.3041 | 268.4192 | 33.8056 | 230.1320 | 51.3695 |
| 427 | 72.2262 | 974.6124 | 268.0116 | 1738.9419 | 929.3503 |
| 21012 | 72.0876 | 675.4791 | 281.2246 | 1239.1398 | 631.1980 |
| 46 | 71.9927 | 16.0595 | 5.8110 | 47.5494 | 66.6594 |
| 12118 | 71.9927 | 87.2585 | 17.8647 | 122.5675 | 72.5711 |
| 10743 | 71.9661 | 31.8768 | 12.1268 | 71.7377 | 54.7546 |
| 15281 | 71.7820 | 717.1088 | 178.3643 | 539.7166 | 172.7950 |
| 15312 | 71.7744 | 295.6093 | 70.5494 | 217.1474 | 127.1500 |
| 17316 | 71.4156 | 87.1439 | 64.1839 | 33.4513 | 23.6689 |
| 135 | 71.2200 | 15.6452 | 6.3474 | 24.2274 | 18.9870 |
| 19696 | 71.2105 | 18.8612 | 5.0150 | 22.1785 | 10.5418 |
| 20735 | 71.0966 | 1313.5520 | 294.6071 | 1004.4481 | 345.4266 |
| 18715 | 71.0871 | 421.2594 | 106.1449 | 328.4941 | 92.4641 |
| 11852 | 71.0700 | 106.5358 | 62.4719 | 148.6009 | 54.2793 |
| 23417 | 70.9846 | 577.6227 | 93.3104 | 484.6179 | 126.9563 |
| 1885 | 70.9333 | 40.2338 | 7.1334 | 48.5536 | 17.6758 |
| 12013 | 70.8897 | 98.0127 | 15.0784 | 86.4707 | 23.0552 |
| 4091 | 70.8897 | 1115.9206 | 104.0044 | 1147.6314 | 211.0428 |
| 2629 | 70.8346 | 346.2609 | 172.0784 | 194.4599 | 114.9334 |
| 1306 | 70.6713 | 189.6084 | 53.2566 | 150.6405 | 58.4723 |
| 12041 | 70.6201 | 327.3121 | 62.9137 | 286.7904 | 72.9648 |
| 15647 | 70.5764 | 69.8606 | 23.3710 | 47.3942 | 27.1177 |
| 16257 | 70.5593 | 151.0016 | 51.9217 | 214.8488 | 82.9137 |
| 1288 | 70.4815 | 28.0820 | 19.1030 | 43.0552 | 21.8314 |
| 25531 | 70.4720 | 29.1810 | 9.3232 | 21.8074 | 10.7119 |
| 6626 | 70.2821 | 38.9126 | 13.3470 | 62.1339 | 31.3297 |
| 4407 | 70.2612 | 311.0388 | 170.9739 | 170.3074 | 85.9478 |
| 20056 | 70.1872 | 36.6297 | 9.0819 | 88.6816 | 101.8032 |
| 21670 | 70.1853 | 154.8137 | 40.1090 | 118.8195 | 44.6328 |
| 17115 | 70.1606 | 12.3097 | 8.6004 | 24.9802 | 17.4501 |
| 15011 | 70.1151 | 230.3376 | 61.4151 | 168.4621 | 59.6748 |
| 1678 | 70.0391 | 16.8811 | 19.2324 | 40.8021 | 42.5325 |
| 17130 | 70.0030 | 251.7097 | 50.9038 | 199.1394 | 57.7162 |
| 1949 | 69.9594 | 109.0666 | 36.2044 | 77.6339 | 37.8864 |
| 14956 | 69.9328 | 259.4496 | 86.4724 | 190.1046 | 86.7438 |
| 17258 | 69.9176 | 74.0971 | 17.4857 | 94.9190 | 30.4814 |
| 21663 | 69.9081 | 537.1242 | 84.3156 | 437.8069 | 126.6048 |
| 16381 | 69.8568 | 351.0631 | 75.9432 | 433.2856 | 121.1154 |
| 11494 | 69.7923 | 410.4557 | 265.8113 | 161.2046 | 130.0820 |
| 21375 | 69.7600 | 55.5268 | 14.6314 | 43.3020 | 16.3546 |
| 24196 | 69.6708 | 42.1588 | 33.1330 | 17.7577 | 16.6264 |
| 17225 | 69.6556 | 540.9403 | 116.0462 | 412.7988 | 125.5183 |
| 8768 | 69.5436 | 73.8560 | 16.5729 | 49.1913 | 20.8646 |
| 17541 | 69.5265 | 2067.8646 | 732.4052 | 2977.7681 | 1073.2410 |
| 21989 | 69.4904 | 140.0504 | 30.9096 | 110.3857 | 34.3179 |
| 21239 | 69.4733 | 542.1887 | 135.2228 | 418.6204 | 145.6524 |
| 11959 | 69.4316 | 49.1713 | 22.3025 | 70.0875 | 29.5601 |
| 18561 | 69.3689 | 91.3253 | 25.7999 | 70.4600 | 25.0625 |
| 20836 | 69.3442 | 48.3925 | 25.8640 | 28.5369 | 28.9954 |
| 19486 | 69.3272 | 44.6398 | 6.5265 | 42.9134 | 13.7793 |
| 18108 | 69.3082 | 868.1026 | 188.2671 | 703.6517 | 178.2542 |
| 17657 | 69.2835 | 42.2339 | 18.1527 | 24.5145 | 26.2489 |
| 1501 | 69.2835 | 1801.5911 | 413.7369 | 2226.3743 | 567.1930 |
| 14346 | 69.2664 | 501.0062 | 154.6454 | 735.1026 | 322.2353 |
| 110 | 69.2493 | 154.5173 | 46.3229 | 235.4297 | 132.1636 |
| 17891 | 69.2284 | 74.6543 | 30.3483 | 53.3207 | 18.7673 |
| 15103 | 69.1886 | 167.9559 | 16.3036 | 186.1990 | 31.9904 |
| 968 | 69.1715 | 17.9437 | 10.8034 | 38.3064 | 39.6289 |
| 11115 | 69.1278 | 434.6300 | 207.8529 | 734.6330 | 428.1666 |
| 2628 | 69.0898 | 357.3981 | 201.2494 | 179.6773 | 129.8103 |
| 8599 | 69.0557 | 56.9760 | 22.8753 | 40.0873 | 18.2564 |
| 23678 | 69.0462 | 180.8171 | 83.0312 | 118.1017 | 49.2380 |
| 591 | 69.0291 | 50.7716 | 21.3695 | 36.8278 | 16.7314 |
| 17635 | 69.0234 | 173.0292 | 70.3075 | 278.4918 | 132.8801 |
| 24326 | 68.9702 | 1001.3873 | 224.4017 | 821.4422 | 255.3810 |
| 2413 | 68.9607 | 839.7426 | 177.4180 | 763.1567 | 149.3177 |
| 21415 | 68.8677 | 323.1220 | 71.4837 | 290.0135 | 115.6219 |
| 23523 | 68.8392 | 742.3617 | 175.5474 | 571.9101 | 175.5542 |
| 108 | 68.8240 | 1193.3846 | 294.2555 | 1584.3725 | 619.7328 |
| 20753 | 68.8127 | 507.1867 | 142.4630 | 357.8658 | 114.3601 |
| 13381 | 68.7785 | 67.0461 | 15.8022 | 50.0889 | 15.0261 |
| 1504 | 68.7519 | 28.6525 | 17.0700 | 16.8490 | 15.4093 |
| 17532 | 68.7367 | 139.4473 | 40.2685 | 197.8014 | 73.6459 |
| 25814 | 68.6854 | 15.9174 | 11.3162 | 24.6039 | 24.7085 |
| 19086 | 68.6836 | 543.5658 | 123.4357 | 396.8220 | 160.8217 |
| 1813 | 68.6475 | 121.7731 | 82.3294 | 49.8011 | 62.6542 |
| 21373 | 68.5962 | 92.6968 | 57.5675 | 110.1719 | 48.1928 |
| 8417 | 68.5279 | 2290.0555 | 657.4674 | 2916.3223 | 724.4898 |
| 17793 | 68.5184 | 561.2507 | 123.2376 | 479.4849 | 119.6203 |
| 12014 | 68.5108 | 340.2261 | 36.0200 | 294.1228 | 66.6509 |
| 24377 | 68.4766 | 131.2880 | 28.7078 | 163.4738 | 44.3396 |
| 14295 | 68.4652 | 47.6375 | 21.0871 | 33.3200 | 16.4353 |
| 19091 | 68.4595 | 22.0954 | 12.3780 | 9.8743 | 21.0604 |
| 23541 | 80.7488 | 389.0134 | 78.5263 | 276.0834 | 188.1152 |
| 2781 | 78.1877 | 243.6250 | 81.6965 | 135.9895 | 92.6394 |
| 2825 | 77.3903 | 208.6985 | 30.0997 | 166.0270 | 51.3248 |
| 12965 | 76.9213 | 379.1866 | 101.2874 | 262.2117 | 148.2137 |
| 22833 | 76.6081 | 2234.7520 | 408.5146 | 1761.0039 | 412.7920 |
| 6251 | 76.1486 | 254.7936 | 50.0228 | 199.0332 | 64.9497 |
| 14693 | 76.1315 | 193.4697 | 33.5226 | 145.3618 | 51.6572 |
| 9615 | 76.0689 | 207.9436 | 90.5954 | 99.0942 | 62.9219 |
| 2655 | 75.6455 | 1253.3919 | 318.0891 | 935.8570 | 472.4684 |
| 6037 | 75.4291 | 48.4181 | 11.2132 | 64.3156 | 24.9297 |
| 3246 | 75.4006 | 168.4394 | 84.1004 | 101.3443 | 53.8931 |
| 11411 | 75.2715 | 510.0323 | 83.6789 | 410.6979 | 88.4719 |
| 24373 | 75.2373 | 275.0545 | 62.0909 | 205.4112 | 74.0727 |
| 21125 | 74.9601 | 2.6259 | 43.7214 | 51.9581 | 53.1404 |
| 8053 | 74.9317 | 400.1971 | 183.5222 | 204.9923 | 109.7847 |
| 11729 | 74.8026 | 279.5722 | 57.1007 | 224.7545 | 51.9525 |
| 23538 | 74.7665 | 684.1492 | 406.6216 | 346.5193 | 189.8017 |
| 6796 | 74.6469 | 628.7568 | 128.0689 | 475.1618 | 150.6853 |
| 6347 | 74.5861 | 264.1187 | 48.6459 | 211.1626 | 55.0363 |
| 22249 | 74.5614 | 16.2916 | 8.0521 | 29.9080 | 25.7983 |
| 12344 | 74.2918 | 17.0302 | 33.1653 | 66.3052 | 55.5421 |
| 5979 | 74.2899 | 331.7130 | 95.6766 | 228.3325 | 78.9827 |
| 23159 | 74.1950 | 740.6166 | 269.2627 | 560.8609 | 277.9340 |
| 15238 | 74.1703 | 159.8950 | 35.8210 | 220.0789 | 72.7921 |
| 3791 | 73.9710 | 95.2971 | 34.1698 | 147.8200 | 59.8737 |
| 11574 | 73.9539 | 25.0970 | 4.9497 | 33.6909 | 16.9735 |
| 10378 | 73.8324 | 85.3606 | 41.8637 | 234.7308 | 230.8210 |
| 2702 | 73.7773 | 1147.5617 | 361.3406 | 808.7231 | 288.6290 |
| 18944 | 73.5609 | 505.7535 | 135.9740 | 382.4302 | 119.7749 |
| 12698 | 73.4641 | 305.4891 | 282.0615 | 87.5844 | 147.9020 |
| 21157 | 73.3103 | 899.4863 | 129.0193 | 749.9085 | 174.7521 |
| 10960 | 73.3008 | 851.7557 | 124.3815 | 709.9585 | 131.9220 |
| 15183 | 73.2420 | 247.6782 | 58.2776 | 327.0655 | 136.6331 |
| 17793 | 73.1888 | 168.3601 | 43.3853 | 119.0541 | 54.8453 |
| 22751 | 73.1793 | 551.2006 | 134.0933 | 407.2220 | 127.2271 |
| 3256 | 73.0939 | 1914.2192 | 320.8595 | 1834.9720 | 630.4221 |
| 6188 | 73.0502 | 116.3074 | 54.9689 | 186.3460 | 74.1599 |
| 13916 | 73.0160 | 17.1069 | 5.3972 | 26.0873 | 13.7376 |
| 15089 | 72.9116 | 242.1569 | 61.0897 | 321.1083 | 89.1023 |
| 16128 | 72.9021 | 333.4375 | 62.2365 | 285.6093 | 64.8268 |
| 5037 | 72.8850 | 264.5917 | 45.3503 | 215.8808 | 56.1978 |
| 5152 | 72.8679 | 39.8253 | 15.1765 | 69.5128 | 33.1805 |
| 2897 | 72.8414 | 155.2392 | 36.5856 | 119.0337 | 40.2604 |
| 3143 | 72.8338 | 184.8524 | 34.7533 | 232.1910 | 58.4461 |
| 15180 | 72.6686 | 433.3097 | 90.3367 | 582.6600 | 166.4453 |
| 5169 | 72.6591 | 1325.6211 | 209.9997 | 1043.5554 | 272.3334 |

TABLE 5I-continued

Carcinogen NonGenotoxic
Timepoint(s): Various

| GLGC ID NO. | LDA Score | Mean Tox | SD Tox | Mean Nontox | SD Nontox |
|---|---|---|---|---|---|
| 22753 | 72.6515 | 107.5712 | 61.9766 | 215.4830 | 127.5789 |
| 23515 | 72.5623 | 576.4423 | 139.6959 | 476.0867 | 98.0923 |
| 11714 | 72.5281 | 177.6447 | 171.6322 | 249.0504 | 124.5480 |
| 17771 | 72.4427 | 2159.2067 | 386.4512 | 2054.2468 | 815.8330 |
| 3290 | 72.4237 | 440.3324 | 110.5847 | 311.8567 | 109.3535 |
| 23526 | 72.3724 | 73.6378 | 34.0150 | 40.5673 | 38.0821 |
| 10934 | 72.3477 | 297.6086 | 34.8981 | 261.3496 | 73.2444 |
| 6765 | 72.3212 | 69.2235 | 41.3525 | 114.7086 | 50.8155 |
| 3413 | 72.3193 | 337.6277 | 124.2069 | 214.5591 | 93.6161 |
| 18854 | 72.3136 | 40.9238 | 15.0169 | 66.8699 | 36.6686 |
| 23355 | 72.3041 | 563.4203 | 95.2185 | 429.6735 | 170.9487 |
| 11901 | 72.1997 | 595.5279 | 153.4657 | 470.0125 | 172.0909 |
| 7503 | 72.1807 | 63.5349 | 47.8919 | 20.4677 | 38.0240 |
| 3088 | 72.1123 | 14.0014 | 16.8703 | 30.0985 | 19.8400 |
| 19075 | 72.0155 | 521.0717 | 204.6176 | 333.5380 | 166.7353 |
| 22517 | 72.0155 | 123.5176 | 87.2933 | 45.0664 | 72.8326 |
| 7161 | 71.9737 | 201.8178 | 37.7424 | 159.3389 | 49.1048 |
| 2596 | 71.9490 | 39.3573 | 23.1379 | 87.1516 | 70.7501 |
| 8880 | 71.9396 | 15.3790 | 4.9144 | 22.9069 | 12.4954 |
| 15282 | 71.9301 | 392.7707 | 99.0346 | 300.6089 | 104.6035 |
| 8048 | 71.9206 | 115.1714 | 39.4363 | 72.4331 | 35.2047 |
| 7451 | 71.9206 | 1067.4514 | 213.0032 | 828.9363 | 232.2553 |
| 11502 | 71.8864 | 677.5299 | 169.5668 | 894.4400 | 195.7554 |
| 26132 | 71.6965 | 5.9417 | 11.1080 | 20.5897 | 17.8668 |
| 16489 | 71.6529 | 401.5719 | 50.6946 | 341.4572 | 76.9729 |
| 10308 | 71.5997 | 1427.3718 | 287.7471 | 1169.4545 | 278.6840 |
| 8759 | 71.5466 | 227.1212 | 144.8096 | 92.0506 | 143.0580 |
| 7887 | 71.5143 | 473.0938 | 70.0664 | 393.0943 | 115.1516 |
| 8850 | 71.4782 | 123.8255 | 40.3949 | 96.8260 | 43.0510 |

TABLE 5J

CCL4
Timepoint(s): 24 hrs

| GLGC ID NO. | LDA Score | Mean Tox | SD Tox | Mean Nontox | SD Nontox |
|---|---|---|---|---|---|
| 16018 | 99.0610 | 201.2833 | 3.2755 | 102.7067 | 48.1870 |
| 11735 | 98.8850 | 43.2633 | 0.2743 | 33.7812 | 14.2237 |
| 14881 | 98.3568 | 40.7800 | 10.0106 | 438.1132 | 277.3671 |
| 17281 | 98.0634 | 61.4100 | 2.5270 | 156.2975 | 82.8662 |
| 12014 | 97.9460 | 341.6300 | 1.4030 | 295.6871 | 66.3907 |
| 15364 | 97.8873 | 136.5567 | 0.6385 | 145.8706 | 60.7470 |
| 1311 | 97.8286 | 12.6833 | 0.5886 | 28.4515 | 15.1076 |
| 18361 | 97.5352 | 1312.5200 | 12.5141 | 1265.7645 | 455.9408 |
| 5616 | 97.3005 | 1222.2200 | 15.0065 | 1063.0951 | 466.3967 |
| 8097 | 97.2418 | 1410.9967 | 20.4926 | 1038.7649 | 277.9270 |
| 17995 | 97.1831 | 52.8600 | 10.4473 | 546.6622 | 370.3403 |
| 18606 | 97.0070 | 2692.6567 | 31.9905 | 2180.1483 | 576.5711 |
| 16304 | 96.9484 | 86.7467 | 11.0373 | 316.6155 | 161.7488 |
| 16416 | 96.9484 | 618.9633 | 137.7148 | 276.7073 | 106.3692 |
| 16661 | 96.8897 | 147.5800 | 0.9100 | 158.6020 | 39.5085 |
| 18318 | 96.7136 | 136.3467 | 10.2234 | 80.4257 | 185.6093 |
| 15445 | 96.5962 | 111.2600 | 2.3586 | 165.2464 | 59.5137 |
| 10878 | 96.5962 | 2657.9100 | 105.8000 | 1853.7359 | 417.0332 |
| 20854 | 96.3615 | 27.3033 | 1.2023 | 77.5018 | 56.8434 |
| 15123 | 96.3615 | 13.8667 | 2.3394 | 179.1745 | 253.0522 |
| 1392 | 96.3615 | 49.5033 | 0.9800 | 68.9234 | 47.7370 |
| 9134 | 96.3028 | 732.3100 | 5.5687 | 692.9557 | 154.8544 |
| 1562 | 96.1854 | 121.7900 | 20.4557 | 321.6082 | 128.5988 |
| 16469 | 96.1268 | 1166.7267 | 118.7491 | 697.5225 | 190.3211 |
| 4723 | 96.1268 | 752.0700 | 33.6542 | 517.2429 | 169.6074 |
| 2853 | 96.0094 | 442.7700 | 38.5360 | 243.6627 | 88.4571 |
| 20705 | 95.9507 | 1.3500 | 5.7653 | 125.6746 | 150.3179 |
| 15087 | 95.9507 | 270.2267 | 16.7431 | 185.4703 | 49.5642 |
| 18396 | 95.9507 | 442.7600 | 10.9135 | 396.1392 | 201.9888 |
| 16037 | 95.7746 | 416.8233 | 5.0126 | 352.9917 | 77.2087 |
| 16215 | 95.7160 | 1566.7867 | 232.4363 | 935.3804 | 229.7645 |
| 4412 | 95.5986 | 330.1367 | 3.6182 | 302.4723 | 74.5075 |

TABLE 5J-continued

CCL4
Timepoint(s): 24 hrs

| GLGC ID NO. | LDA Score | Mean Tox | SD Tox | Mean Nontox | SD Nontox |
|---|---|---|---|---|---|
| 20914 | 95.4225 | 149.3200 | 5.1012 | 195.6573 | 186.6204 |
| 5351 | 95.3638 | 2048.8000 | 177.6306 | 1381.7535 | 292.8524 |
| 16854 | 95.3638 | 268.7500 | 4.6190 | 219.7943 | 48.3998 |
| 488 | 95.3638 | 1725.1300 | 98.1951 | 1425.9514 | 1090.9905 |
| 21585 | 95.3052 | 405.3600 | 50.0407 | 229.6060 | 73.5575 |
| 4011 | 95.2465 | 58.0433 | 8.8137 | 347.4221 | 238.8098 |
| 21372 | 95.2465 | 45.5033 | 1.3372 | 35.8876 | 26.0368 |
| 19422 | 95.2465 | 63.3333 | 1.4851 | 57.7290 | 27.6839 |
| 25567 | 95.2465 | 523.3167 | 12.5871 | 429.2630 | 183.4545 |
| 23380 | 95.1878 | 1854.1500 | 105.6388 | 1371.5402 | 277.9388 |
| 3717 | 95.1878 | 624.2200 | 22.1887 | 427.9026 | 142.2693 |
| 21586 | 95.1291 | 279.3800 | 44.3825 | 135.9909 | 58.5758 |
| 18060 | 95.0704 | 231.0433 | 8.2019 | 174.0539 | 38.5995 |
| 16047 | 95.0117 | 57.3567 | 2.4201 | 91.3889 | 36.3882 |
| 9124 | 95.0117 | 835.0733 | 121.4578 | 516.5943 | 132.2459 |
| 9254 | 95.0117 | 117.9933 | 1.8170 | 104.0935 | 30.3058 |
| 1797 | 94.8944 | 68.5400 | 17.4960 | 587.9907 | 482.7306 |
| 6980 | 94.8944 | 73.0067 | 2.4278 | 50.1029 | 20.8845 |
| 15495 | 94.8357 | 84.2367 | 0.9551 | 81.4091 | 32.3177 |
| 6598 | 94.7770 | 76.1467 | 4.5097 | 123.1365 | 74.1942 |
| 14346 | 94.7770 | 389.9067 | 31.0330 | 727.5258 | 320.5451 |
| 14184 | 94.7183 | 357.1433 | 42.8011 | 150.7908 | 89.1831 |
| 1173 | 94.6596 | 17.6767 | 5.0776 | 203.0221 | 188.0714 |
| 23344 | 94.6596 | 574.9167 | 33.5420 | 383.9570 | 112.1732 |
| 16300 | 94.6009 | 90.9067 | 1.7015 | 107.2408 | 37.6187 |
| 17676 | 94.5423 | 189.7967 | 19.5421 | 907.9402 | 765.3018 |
| 18730 | 94.5423 | 511.2033 | 41.4935 | 1239.3735 | 594.9388 |
| 14185 | 94.3662 | 706.9467 | 141.3543 | 274.3518 | 176.8237 |
| 19161 | 94.3662 | 3732.8467 | 179.6023 | 2565.6287 | 667.4871 |
| 18005 | 94.3662 | 92.6333 | 3.1436 | 112.1576 | 49.0545 |
| 18895 | 94.2488 | 217.0533 | 3.3701 | 204.9477 | 48.5364 |
| 5257 | 94.2488 | 34.2300 | 1.0159 | 35.5388 | 14.7131 |
| 11849 | 94.1901 | 1927.0867 | 44.2798 | 1592.1114 | 343.2244 |
| 17393 | 94.1315 | 565.2733 | 10.4548 | 482.2538 | 120.7980 |
| 25087 | 94.0728 | 5.5400 | 0.4854 | 44.1112 | 66.2711 |
| 4541 | 94.0728 | 363.5300 | 10.4079 | 273.9518 | 89.0017 |
| 25705 | 93.9554 | 2715.6400 | 317.6756 | 1877.2627 | 387.1775 |
| 25550 | 93.8967 | 86.0667 | 4.2001 | 125.7042 | 46.6156 |
| 17896 | 93.7793 | 105.2767 | 10.5987 | 65.8496 | 20.2247 |
| 10340 | 93.7793 | 85.8467 | 3.0201 | 65.4407 | 26.8182 |
| 20879 | 93.6620 | 3.6833 | 3.0104 | 56.7792 | 48.8189 |
| 20299 | 93.5446 | 32.0867 | 5.9955 | 110.2824 | 66.9010 |
| 23274 | 93.5446 | 1287.8800 | 141.6039 | 947.8714 | 180.9517 |
| 8266 | 93.5446 | 1097.3767 | 89.2920 | 2084.5792 | 955.6196 |
| 19392 | 93.4859 | 2407.7400 | 75.7722 | 1964.0608 | 337.3118 |
| 19053 | 93.3685 | 68.5367 | 12.1177 | 32.3303 | 61.8496 |
| 20746 | 93.3685 | 836.2733 | 68.3471 | 564.4849 | 308.6037 |
| 22321 | 93.2512 | 1700.6000 | 358.1856 | 830.8087 | 433.6174 |
| 15313 | 93.2512 | 369.4533 | 17.4237 | 301.3179 | 169.9444 |
| 15325 | 93.2512 | 43.3433 | 5.9547 | 102.0727 | 46.1943 |
| 3908 | 93.1925 | 679.3533 | 61.1075 | 480.0417 | 98.1093 |
| 1000 | 93.1925 | 21.9933 | 1.1826 | 18.3299 | 13.1438 |
| 20000 | 93.1338 | 86.3767 | 4.1605 | 61.0038 | 28.7883 |
| 23130 | 93.0751 | 335.9833 | 10.2306 | 402.4429 | 142.4560 |
| 19212 | 93.0164 | 10.5633 | 1.3499 | 30.4209 | 20.4002 |
| 15174 | 93.0164 | 53.0800 | 3.0867 | 52.0072 | 47.9677 |
| 2854 | 92.9577 | 1102.1500 | 156.9971 | 709.4020 | 204.7611 |
| 1588 | 92.9577 | 198.2500 | 20.1815 | 451.1864 | 265.0350 |
| 31 | 92.9577 | 90.9667 | 63.7948 | 107.0184 | 32.5531 |
| 17426 | 92.8991 | 546.5067 | 26.5020 | 419.9411 | 85.7936 |
| 18618 | 92.8991 | 1715.2567 | 89.7794 | 2257.7515 | 364.5200 |
| 7459 | 92.8991 | 890.6500 | 78.9262 | 1497.1910 | 429.2561 |
| 12041 | 92.7817 | 373.4067 | 15.7008 | 288.0074 | 72.9373 |
| 22889 | 92.7817 | 40.9867 | 1.4110 | 30.1428 | 16.7596 |
| 22927 | 92.7230 | 91.9100 | 25.4006 | 49.9802 | 20.5196 |
| 11980 | 92.7230 | 15.2167 | 0.8240 | 23.8832 | 13.8382 |
| 225 | 92.7230 | 44.3033 | 47.0457 | 54.0625 | 28.6723 |
| 3844 | 92.6643 | 100.3833 | 86.1885 | 75.6906 | 39.3774 |
| 24745 | 99.5305 | 1347.4433 | 2.6505 | 1473.5288 | 269.9788 |
| 11322 | 99.5305 | 613.6367 | 0.8075 | 534.4156 | 127.2307 |
| 7365 | 99.0610 | 143.4167 | 0.1877 | 159.3237 | 46.2780 |
| 23449 | 98.9437 | 889.2867 | 5.9680 | 660.4035 | 488.2434 |
| 19379 | 98.7676 | 1377.2167 | 62.0723 | 805.5494 | 182.5837 |

TABLE 5J-continued

CCL4
Timepoint(s): 24 hrs

| GLGC ID NO. | LDA Score | Mean Tox | SD Tox | Mean Nontox | SD Nontox |
|---|---|---|---|---|---|
| 18833 | 98.7089 | 59.6000 | 2.4358 | 143.2568 | 51.1938 |
| 23451 | 98.7089 | 424.1633 | 1.6376 | 438.7323 | 112.0533 |
| 19765 | 98.5915 | 441.5933 | 2.6732 | 407.6325 | 155.3143 |
| 12114 | 98.5915 | 192.1500 | 3.5246 | 313.3429 | 87.9000 |
| 11227 | 98.4742 | 522.7733 | 33.7540 | 307.7420 | 76.4337 |
| 2093 | 98.4155 | 422.0267 | 7.8550 | 511.7709 | 414.1157 |
| 17790 | 98.2981 | 1204.9133 | 8.0732 | 879.1097 | 269.8916 |
| 11486 | 98.2394 | 27.0900 | 0.3306 | 19.9288 | 15.3515 |
| 15946 | 98.2394 | 201.1067 | 7.8272 | 121.7659 | 39.4038 |
| 3729 | 98.2394 | 86.7233 | 1.8955 | 127.5472 | 28.4437 |
| 22857 | 98.1221 | 207.5333 | 2.9159 | 135.8711 | 84.8037 |
| 6165 | 98.0634 | 173.4567 | 3.8588 | 321.5716 | 132.9262 |
| 10315 | 98.0047 | 309.5500 | 7.2554 | 189.9283 | 61.4921 |
| 14098 | 97.9460 | 76.1800 | 1.1871 | 140.7065 | 62.8484 |
| 19249 | 97.9460 | 714.1500 | 10.4534 | 486.0734 | 243.1020 |
| 17168 | 97.6526 | 683.0933 | 10.2322 | 485.5208 | 146.7510 |
| 16625 | 97.6526 | 305.0100 | 2.4534 | 288.0411 | 73.0714 |
| 5215 | 97.6526 | 24.4467 | 2.7857 | 61.3010 | 23.1241 |
| 2625 | 97.5939 | 97.5900 | 0.6031 | 88.4887 | 19.6875 |
| 4724 | 97.5939 | 763.7433 | 11.2496 | 566.4501 | 215.1385 |
| 13052 | 97.5352 | 300.6300 | 2.3010 | 360.1793 | 86.7998 |
| 13990 | 97.5352 | 479.9300 | 3.8651 | 407.4319 | 81.3524 |
| 18367 | 97.5352 | 373.4800 | 4.6881 | 296.1079 | 55.0063 |
| 17024 | 97.4765 | 58.3167 | 1.7974 | 32.6953 | 22.3561 |
| 19535 | 97.4765 | 688.5867 | 86.7748 | 202.0047 | 182.1642 |
| 10100 | 97.4765 | 67.8533 | 1.6160 | 40.1785 | 22.7303 |
| 20645 | 97.4178 | 36.8133 | 0.3753 | 33.3767 | 14.7035 |
| 12122 | 97.4178 | 21.9667 | 1.2256 | 7.1344 | 24.3419 |
| 13035 | 97.3005 | 44.0200 | 0.5935 | 30.4112 | 14.4919 |
| 11615 | 97.3005 | 895.6167 | 5.2616 | 806.1136 | 184.4951 |
| 26151 | 97.2418 | 367.5367 | 44.5682 | 170.5539 | 71.9917 |
| 11301 | 97.1244 | 40.7233 | 1.6065 | 53.9911 | 48.2487 |
| 10780 | 97.1244 | 16.7733 | 0.3044 | 20.8276 | 14.8042 |
| 22257 | 97.0070 | 29.1967 | 6.3342 | 84.8407 | 27.5134 |
| 16736 | 96.9484 | 89.2467 | 1.4561 | 70.7825 | 31.5498 |
| 18697 | 96.9484 | 178.3400 | 1.5380 | 200.5583 | 78.4862 |
| 22680 | 96.9484 | 136.4433 | 2.3739 | 102.9215 | 47.0356 |
| 3291 | 96.8897 | 21.7600 | 0.6696 | 11.1940 | 20.2863 |
| 4607 | 96.8897 | 10.3067 | 3.2426 | 49.3947 | 22.3200 |
| 2993 | 96.7723 | 1297.6567 | 21.8138 | 970.4896 | 219.1361 |
| 3309 | 96.7136 | 317.4267 | 3.5915 | 294.4337 | 89.3443 |
| 13977 | 96.5962 | 320.0733 | 6.1183 | 477.8334 | 154.8851 |
| 14284 | 96.5376 | 136.5033 | 1.5502 | 133.2043 | 43.8789 |
| 16345 | 96.5376 | 1600.2500 | 97.8873 | 1002.7436 | 276.8050 |
| 4203 | 96.5376 | 63.2133 | 7.1125 | 206.5786 | 109.4530 |
| 14286 | 96.4789 | 52.5600 | 0.8903 | 48.4113 | 24.3332 |
| 4145 | 96.4789 | 2583.7633 | 23.8899 | 2175.5863 | 578.9178 |
| 14608 | 96.4789 | 244.5067 | 3.5509 | 181.6088 | 76.4391 |
| 6723 | 96.4202 | 260.9567 | 11.9510 | 154.9894 | 58.5559 |
| 5833 | 96.4202 | 91.6800 | 2.5018 | 70.6517 | 34.6925 |
| 23800 | 96.4202 | 25.0067 | 5.5003 | 87.2830 | 40.7663 |
| 8275 | 96.3615 | 67.0367 | 0.9793 | 77.4654 | 40.9891 |
| 5495 | 96.3615 | 27.4500 | 2.6577 | 77.4369 | 40.8209 |
| 19563 | 96.3615 | 78.4300 | 2.0436 | 52.5950 | 28.7734 |
| 10459 | 96.3028 | 87.3533 | 1.5653 | 72.2571 | 36.9208 |
| 21296 | 96.3028 | 105.9167 | 2.0321 | 91.8855 | 40.1033 |
| 3256 | 96.2441 | 1800.1467 | 29.0896 | 1838.0711 | 622.7833 |
| 5878 | 96.2441 | 1113.9500 | 23.3055 | 852.8406 | 186.1921 |
| 13606 | 96.1854 | 84.0200 | 1.5879 | 100.4287 | 37.0208 |
| 13310 | 96.1854 | 42.8067 | 2.2144 | 35.2296 | 51.9579 |
| 5887 | 96.1854 | 22.1800 | 2.3807 | 5.1228 | 57.3070 |
| 16003 | 96.1854 | 84.8300 | 2.7477 | 51.1626 | 35.6561 |
| 6673 | 96.1854 | 564.6033 | 8.6446 | 641.0482 | 283.6174 |
| 8025 | 96.1854 | 1245.0700 | 96.8954 | 704.2772 | 245.4521 |
| 7831 | 96.1854 | 595.5300 | 90.6852 | 376.0061 | 73.8722 |
| 17890 | 96.1268 | 33.8733 | 0.5442 | 43.7176 | 27.5395 |
| 6329 | 96.1268 | 2124.9167 | 48.2204 | 2294.6689 | 1068.6253 |
| 3660 | 96.1268 | 133.2633 | 3.6048 | 117.1526 | 79.8816 |
| 16311 | 96.0681 | 447.2167 | 12.3221 | 711.4749 | 323.8264 |
| 15907 | 96.0681 | 90.4233 | 4.9883 | 159.1253 | 50.7112 |

TABLE 5K

CHLORPROMAZINE
Timepoint(s): 3, 6, 24 hrs

| GLGC ID NO. | LDA Score | Mean Tox | SD Tox | Mean Nontox | SD Nontox |
|---|---|---|---|---|---|
| 25845 | 96.8235 | 61.7126 | 2.3799 | 43.5652 | 24.6823 |
| 25278 | 95.4118 | 56.5892 | 1.8342 | 41.0622 | 16.9702 |
| 20745 | 95.1176 | 784.9972 | 133.6882 | 411.6433 | 221.7418 |
| 1969 | 94.1176 | 80.0502 | 9.8163 | 52.1590 | 48.5537 |
| 15763 | 93.9412 | 24.3202 | 1.7616 | 13.2666 | 9.9374 |
| 19726 | 93.2941 | 137.6672 | 8.4542 | 102.2940 | 41.6228 |
| 24484 | 92.8824 | 104.3350 | 7.3347 | 73.9573 | 30.5980 |
| 15296 | 92.8235 | 784.4408 | 21.2975 | 676.4598 | 194.9081 |
| 25607 | 92.5882 | 186.9160 | 36.4290 | 63.0252 | 95.7433 |
| 25593 | 92.2941 | 118.3620 | 8.6812 | 83.4292 | 43.7964 |
| 24504 | 92.2353 | 84.1726 | 5.7298 | 62.5784 | 29.9288 |
| 15700 | 92.0588 | 74.3284 | 4.9498 | 54.6930 | 34.0139 |
| 16273 | 92.0000 | 93.5906 | 12.2044 | 57.8917 | 33.5057 |
| 16807 | 91.8824 | 177.3762 | 87.5765 | 874.0151 | 712.9315 |
| 503 | 91.7059 | 76.5594 | 3.9177 | 63.5658 | 19.2373 |
| 17758 | 91.5882 | 4.2128 | 0.8602 | 56.4252 | 229.5024 |
| 25568 | 91.5882 | 335.2620 | 15.2228 | 252.5841 | 113.4440 |
| 11892 | 91.5294 | 76.1600 | 7.2351 | 53.5710 | 26.2828 |
| 15580 | 91.2941 | 198.6780 | 108.7933 | 954.7729 | 601.3826 |
| 7637 | 91.2941 | 44.7778 | 2.0991 | 46.6076 | 17.1554 |
| 1336 | 91.2941 | 99.2778 | 4.1282 | 107.5818 | 31.4895 |
| 25513 | 91.1176 | 906.2274 | 53.9009 | 761.9096 | 325.8052 |
| 10625 | 91.0588 | 4.9316 | 5.5482 | 89.3554 | 102.4556 |
| 11989 | 91.0588 | 59.2232 | 9.1364 | 39.8846 | 23.4319 |
| 15127 | 91.0588 | 1724.2328 | 140.5552 | 1252.1302 | 500.1843 |
| 21396 | 90.9412 | 63.6908 | 3.9710 | 80.9826 | 49.2184 |
| 15510 | 90.8824 | 45.2702 | 7.6542 | 76.5925 | 25.4894 |
| 3865 | 90.8824 | 79.0148 | 2.6037 | 83.4557 | 28.3275 |
| 19795 | 90.8235 | 58.7550 | 4.8722 | 32.9449 | 27.9157 |
| 25254 | 90.7647 | 22.6156 | 5.3795 | 9.8087 | 13.1586 |
| 26047 | 90.7059 | 51.1446 | 7.2236 | 168.7138 | 200.7995 |
| 3910 | 90.7059 | 112.5130 | 24.7973 | 67.9576 | 28.0138 |
| 15348 | 90.6471 | 372.4036 | 20.9626 | 289.3569 | 59.5261 |
| 23491 | 90.4118 | 319.0662 | 40.4604 | 224.9020 | 88.2105 |
| 22865 | 90.4118 | 38.0764 | 3.9384 | 64.6772 | 23.4925 |
| 15579 | 90.3529 | 74.0460 | 56.2382 | 599.4210 | 505.1424 |
| 5497 | 90.2941 | 81.4788 | 15.5784 | 212.6287 | 135.2936 |
| 20493 | 90.2353 | 57.8022 | 10.8691 | 109.2519 | 46.8144 |
| 17346 | 90.1176 | 86.5488 | 8.0661 | 67.1442 | 30.7022 |
| 4346 | 90.1176 | 36.7792 | 2.1673 | 31.1202 | 12.9036 |
| 18368 | 90.0588 | 131.2218 | 9.0651 | 183.5459 | 50.6317 |
| 1538 | 90.0000 | 45.9038 | 15.1540 | 24.9244 | 32.0193 |
| 18564 | 90.0000 | 122.5354 | 8.7343 | 116.7661 | 47.0351 |
| 19671 | 90.0000 | 28.9852 | 2.4000 | 24.0637 | 14.1088 |
| 10320 | 89.9412 | 64.3176 | 9.7111 | 40.7421 | 26.0095 |
| 15342 | 89.9412 | 34.8068 | 3.0111 | 26.3494 | 15.1316 |
| 24766 | 89.9412 | 48.4916 | 6.4090 | 31.0942 | 18.1691 |
| 16624 | 89.8235 | 40.8434 | 2.9800 | 29.6602 | 18.0015 |
| 5618 | 89.7647 | 55.2498 | 7.1880 | 44.8410 | 44.3755 |
| 4748 | 89.7647 | 114.7102 | 40.6066 | 451.7638 | 360.7772 |
| 200 | 89.7647 | 64.6400 | 3.9044 | 52.4733 | 22.8435 |
| 16564 | 89.7059 | 100.7614 | 21.6395 | 169.9522 | 58.0278 |
| 16333 | 89.7059 | 35.1562 | 4.7522 | 25.9317 | 16.1000 |
| 15898 | 89.7059 | 20.6748 | 1.9673 | 15.7526 | 8.6520 |
| 405 | 89.7059 | 81.5054 | 18.9776 | 216.9587 | 115.4319 |
| 3240 | 89.7059 | 31.1786 | 3.6822 | 21.1787 | 12.8463 |
| 17078 | 89.7059 | 559.2618 | 16.9501 | 581.3948 | 139.0914 |
| 13450 | 89.6471 | 77.1658 | 8.5366 | 59.8118 | 26.1621 |
| 20313 | 89.4706 | 40.0272 | 3.7725 | 27.4294 | 14.3554 |
| 4749 | 89.4118 | 259.7420 | 59.0791 | 706.7230 | 504.9030 |
| 18023 | 89.4118 | 72.0302 | 7.6242 | 54.2988 | 25.4004 |
| 20583 | 89.3529 | 80.8728 | 13.8489 | 47.0803 | 29.0662 |
| 16635 | 89.2941 | 46.3628 | 19.6429 | 214.7971 | 138.9843 |
| 4714 | 89.2941 | 60.3908 | 6.7579 | 105.5119 | 54.4325 |
| 20930 | 89.1176 | 156.6378 | 28.0897 | 66.9267 | 85.1822 |
| 20876 | 89.1176 | 1359.7652 | 93.7617 | 1796.3519 | 416.1591 |
| 2384 | 89.1176 | 133.2338 | 24.8647 | 287.0999 | 166.2281 |
| 4257 | 89.0588 | 42.4916 | 7.4292 | 24.7181 | 15.0473 |
| 10819 | 89.0588 | 2379.7160 | 104.9025 | 2799.0268 | 738.4398 |
| 1570 | 89.0000 | 753.0378 | 89.7160 | 555.7858 | 166.7507 |
| 303 | 89.0000 | 45.1602 | 6.4148 | 31.8760 | 18.9900 |
| 16850 | 88.9412 | 21.7054 | 5.3358 | 12.1232 | 13.0392 |
| 20029 | 88.9412 | 20.7132 | 3.2468 | 12.0555 | 6.7426 |

TABLE 5K-continued

CHLORPROMAZINE
Timepoint(s): 3, 6, 24 hrs

| GLGC ID NO. | LDA Score | Mean Tox | SD Tox | Mean Nontox | SD Nontox |
|---|---|---|---|---|---|
| 15384 | 88.8824 | 74.4910 | 16.6397 | 48.2706 | 32.7962 |
| 25769 | 88.8824 | 317.9452 | 49.3446 | 232.7935 | 115.2437 |
| 455 | 88.8824 | 460.4418 | 99.5529 | 237.3197 | 146.3524 |
| 24425 | 88.8824 | 48.6216 | 5.3033 | 32.0412 | 21.5373 |
| 5617 | 88.7647 | 131.6944 | 68.5437 | 77.3230 | 101.5942 |
| 15069 | 88.7647 | 1029.2880 | 168.6680 | 763.7784 | 348.4664 |
| 11889 | 88.7647 | 36.1030 | 6.5536 | 22.8260 | 12.8903 |
| 17350 | 88.7059 | 47.3812 | 3.0498 | 41.8325 | 22.6382 |
| 5496 | 88.6471 | 86.5876 | 11.5875 | 164.7579 | 97.6430 |
| 17256 | 88.6471 | 5.2310 | 7.3474 | 56.0238 | 48.6234 |
| 32 | 88.5882 | 23.5556 | 6.6391 | 50.7615 | 27.3877 |
| 6626 | 88.5882 | 66.6232 | 5.5513 | 61.2332 | 31.2424 |
| 24883 | 88.5882 | 4.1360 | 6.8705 | 33.6922 | 24.0649 |
| 17439 | 88.5294 | 169.0584 | 20.3624 | 125.8160 | 51.7868 |
| 25460 | 88.4706 | 1215.0768 | 252.6216 | 867.3221 | 452.6767 |
| 18625 | 88.4706 | 125.7806 | 14.0600 | 96.2823 | 41.0829 |
| 24645 | 88.4706 | 75.3280 | 10.1167 | 115.7069 | 43.8617 |
| 4684 | 88.4118 | 45.6832 | 5.0990 | 57.9724 | 33.9022 |
| 15886 | 88.4118 | 285.0912 | 12.8015 | 242.2170 | 55.9808 |
| 16463 | 88.3529 | 59.4254 | 7.8903 | 41.0472 | 17.6215 |
| 25196 | 88.3529 | 38.0170 | 6.3063 | 22.5474 | 31.5080 |
| 21072 | 88.3529 | −0.7052 | 7.9013 | 25.4456 | 29.3969 |
| 25130 | 88.2353 | 131.7430 | 43.6527 | 74.2702 | 47.9788 |
| 10523 | 88.2353 | 35.7604 | 4.2793 | 27.7224 | 13.2297 |
| 17258 | 88.2353 | 102.7654 | 4.5607 | 94.0890 | 30.4290 |
| 1024 | 88.1176 | 31.7864 | 4.7018 | 22.2329 | 10.0318 |
| 15755 | 88.1176 | 65.4488 | 8.4331 | 104.9755 | 45.3863 |
| 19296 | 97.2941 | 189.9730 | 1.0031 | 186.7824 | 49.0322 |
| 14426 | 96.7647 | 31.3270 | 3.2420 | 77.5749 | 43.9195 |
| 23533 | 96.2353 | 172.0558 | 3.2475 | 126.7680 | 44.0547 |
| 12354 | 95.7059 | 327.5316 | 68.5630 | 153.0292 | 76.0381 |
| 15004 | 94.6471 | 496.5340 | 107.1557 | 262.0746 | 92.1475 |
| 12335 | 94.6471 | 207.9458 | 9.4933 | 134.3424 | 86.2787 |
| 19200 | 94.2941 | 380.0348 | 37.9959 | 228.2142 | 84.7042 |
| 9039 | 94.2353 | 77.5794 | 3.8210 | 46.0538 | 23.1881 |
| 22357 | 94.1176 | 1253.9860 | 17.9207 | 1319.7477 | 374.9694 |
| 9747 | 94.0000 | 104.4682 | 7.8856 | 39.2608 | 50.5684 |
| 8072 | 93.9412 | 16.7592 | 1.6705 | 27.9103 | 24.0093 |
| 3867 | 93.8235 | 47.2514 | 1.1865 | 38.3943 | 16.2266 |
| 12173 | 93.8235 | 32.0728 | 2.0233 | 17.4961 | 22.1939 |
| 3269 | 93.8235 | 47.4144 | 2.1273 | 33.6477 | 17.8781 |
| 20580 | 93.5294 | 139.7300 | 50.1044 | 70.3728 | 31.0538 |
| 20577 | 93.4706 | 197.7778 | 30.4737 | 70.1446 | 83.0611 |
| 6843 | 93.4118 | 454.4368 | 19.6934 | 341.1251 | 123.9641 |
| 10512 | 93.0588 | 95.8134 | 20.0957 | 49.6846 | 54.4947 |
| 633 | 92.9412 | 176.2368 | 19.1319 | 289.8834 | 95.5636 |
| 12140 | 92.9412 | 61.0412 | 8.3508 | 122.9711 | 57.6614 |
| 4740 | 92.8235 | 195.3764 | 27.0739 | 105.4906 | 46.8162 |
| 5910 | 92.7647 | 137.5406 | 4.7144 | 151.4205 | 56.2963 |
| 2619 | 92.7059 | 119.8652 | 6.1805 | 183.2241 | 56.6529 |
| 13558 | 92.5882 | 43.5528 | 10.2178 | 14.1823 | 21.8613 |
| 17555 | 92.5882 | 151.3618 | 5.3888 | 118.6249 | 38.1952 |
| 22185 | 92.4706 | 74.6302 | 25.9685 | 16.0859 | 32.6138 |
| 2688 | 92.4118 | 168.7418 | 3.9512 | 167.8800 | 47.7374 |
| 21869 | 92.4118 | 73.9806 | 5.0400 | 45.2440 | 27.6883 |
| 6836 | 92.4118 | 49.9832 | 4.4363 | 25.3347 | 22.5025 |
| 4994 | 92.2941 | 20.5412 | 11.6401 | 99.4351 | 54.4171 |
| 15084 | 92.1176 | 79.2754 | 10.3476 | 50.5767 | 45.2601 |
| 15582 | 92.0000 | 208.4404 | 107.7237 | 1666.7608 | 1549.0887 |
| 21587 | 92.0000 | 255.9174 | 27.6546 | 145.6375 | 72.8952 |
| 4936 | 92.0000 | 451.1840 | 22.2058 | 700.4327 | 245.0445 |
| 2921 | 91.9412 | 6.8556 | 20.8178 | 105.5568 | 72.3998 |
| 11419 | 91.8824 | 41.6156 | 5.2514 | 74.9265 | 33.9950 |
| 7497 | 91.7059 | 504.7084 | 86.7264 | 886.0931 | 228.0081 |
| 18411 | 91.7059 | 123.0802 | 7.1474 | 121.5159 | 67.4125 |
| 4959 | 91.7059 | 54.8622 | 6.1037 | 31.8762 | 17.7569 |
| 15329 | 91.6471 | 21.6830 | 3.0708 | 5.4081 | 30.9445 |
| 24156 | 91.5294 | 53.5152 | 6.2308 | 24.0392 | 22.3617 |
| 11952 | 91.4706 | 49.7710 | 8.1807 | 7.5132 | 73.2079 |
| 12196 | 91.3529 | 492.2936 | 23.8208 | 619.5163 | 103.8602 |
| 20992 | 91.2941 | 190.7370 | 14.3386 | 143.2408 | 47.4415 |
| 1937 | 91.2353 | 1290.9086 | 245.2469 | 790.3732 | 330.3806 |
| 9828 | 91.1765 | 79.3456 | 7.1913 | 53.1167 | 57.5459 |
| 13690 | 91.0588 | 53.3618 | 8.2049 | 24.0088 | 40.5915 |
| 12706 | 91.0588 | 109.5786 | 7.1657 | 77.8529 | 32.5610 |
| 4279 | 91.0000 | 75.2412 | 5.9424 | 52.9655 | 29.0747 |
| 14000 | 91.0000 | 71.4472 | 7.5144 | 33.6695 | 33.3071 |
| 3683 | 91.0000 | 34.0736 | 5.0770 | 2.8114 | 33.7632 |
| 9543 | 90.9412 | 174.9230 | 14.3543 | 121.6465 | 54.5476 |
| 13064 | 90.8235 | 36.8520 | 4.9241 | 19.0385 | 19.7297 |
| 5709 | 90.8235 | 39.1282 | 4.3808 | 23.2561 | 23.2334 |
| 3801 | 90.7647 | 97.0108 | 13.8435 | 71.7459 | 66.7963 |
| 13046 | 90.7059 | 71.9916 | 8.6273 | 44.3298 | 26.7371 |
| 14837 | 90.6471 | 226.3512 | 56.8086 | 113.0195 | 124.5462 |
| 17054 | 90.6471 | 1108.3922 | 50.0373 | 1433.9992 | 331.2486 |
| 2046 | 90.5882 | 203.3286 | 24.6980 | 142.2909 | 54.2032 |
| 4595 | 90.5882 | 163.8730 | 18.8209 | 108.9718 | 87.7655 |
| 24007 | 90.5882 | 267.5926 | 13.7270 | 221.3553 | 66.0724 |
| 2220 | 90.4706 | 153.2868 | 73.3527 | 141.4536 | 43.6054 |
| 11374 | 90.4706 | 88.0218 | 8.0991 | 57.8246 | 20.5614 |
| 4703 | 90.4706 | 231.0480 | 37.8352 | 588.9483 | 315.8416 |
| 14880 | 90.4118 | 167.0852 | 14.4825 | 101.7130 | 59.0292 |

TABLE 5L

CHOLESTASIS
Timepoint(s): Various

| GLGC ID NO. | LDA Score | Mean Tox | SD Tox | Mean Nontox | SD Nontox |
|---|---|---|---|---|---|
| 4574 | 79.4006 | 165.6841 | 73.0821 | 331.3880 | 126.9282 |
| 9109 | 78.4889 | 97.3125 | 30.5322 | 150.7592 | 43.5812 |
| 20746 | 78.0482 | 961.7283 | 481.9595 | 553.0097 | 293.3602 |
| 15203 | 77.4241 | 322.0486 | 57.5614 | 253.1301 | 57.5049 |
| 25777 | 77.0692 | 2583.5935 | 642.0815 | 1724.5393 | 545.4002 |
| 13283 | 77.0414 | 68.6493 | 33.7083 | 147.3881 | 71.4774 |
| 24327 | 77.0089 | 1454.6249 | 424.0160 | 1014.1260 | 331.3298 |
| 14633 | 76.5055 | 267.8437 | 139.9260 | 496.6602 | 203.3762 |
| 16180 | 76.4313 | 50.9894 | 25.8351 | 96.1543 | 42.9019 |
| 21653 | 76.0903 | 662.1445 | 112.6740 | 513.1436 | 142.8306 |
| 12639 | 75.9233 | 3407.5353 | 750.9890 | 2714.8084 | 600.4977 |
| 1435 | 75.6890 | 1273.9597 | 425.5582 | 922.0724 | 269.2273 |
| 12848 | 75.4129 | 22.4765 | 11.4949 | 39.7327 | 17.4894 |
| 14495 | 75.4129 | 68.2163 | 31.3494 | 144.6767 | 75.9445 |
| 16929 | 75.0719 | 2388.7566 | 410.1245 | 1967.3278 | 393.1108 |
| 19825 | 75.0441 | 25.8068 | 19.0747 | 74.0879 | 55.6843 |
| 25071 | 74.8444 | 713.5386 | 278.6210 | 408.8477 | 256.4053 |
| 21078 | 74.8028 | 75.5586 | 29.9258 | 138.0262 | 75.8398 |
| 3910 | 74.7912 | 102.2325 | 40.8331 | 67.1514 | 27.0510 |
| 4573 | 74.6428 | 593.1724 | 208.5124 | 850.2013 | 240.8445 |
| 25702 | 74.6033 | 2209.7507 | 422.7364 | 1703.8710 | 358.5456 |
| 17913 | 74.5360 | 289.9709 | 50.0715 | 229.6569 | 62.5636 |
| 24649 | 74.4549 | 67.4977 | 20.6058 | 93.0963 | 26.3805 |
| 24645 | 74.4015 | 66.5062 | 29.6118 | 117.0064 | 43.3451 |
| 20405 | 74.3342 | 119.4956 | 69.3862 | 221.6113 | 96.3071 |
| 5497 | 74.3273 | 95.5495 | 51.6700 | 215.5096 | 135.4780 |
| 5496 | 74.2670 | 84.4658 | 33.0445 | 166.8046 | 97.8464 |
| 5622 | 74.1602 | 817.6813 | 332.3639 | 1333.4749 | 439.3256 |
| 17764 | 74.0071 | 3399.3966 | 860.8262 | 2501.0974 | 621.0387 |
| 11852 | 73.9793 | 95.6598 | 37.3724 | 148.6376 | 54.8563 |
| 20939 | 73.9607 | 824.3269 | 308.9971 | 538.4651 | 169.1885 |
| 15239 | 73.8796 | 2029.4460 | 539.5724 | 1639.0083 | 411.6352 |
| 1598 | 73.8587 | 402.1292 | 218.8234 | 278.1716 | 273.0912 |
| 6055 | 73.8517 | 139.3522 | 121.4838 | 319.9356 | 162.0739 |
| 575 | 73.7381 | 126.3094 | 124.8938 | 170.5755 | 103.3838 |
| 32 | 73.6917 | 18.6938 | 28.3557 | 51.6032 | 26.7678 |
| 15618 | 73.6453 | 420.5873 | 136.6370 | 261.6468 | 121.4600 |
| 6538 | 73.6453 | 148.8832 | 65.3860 | 117.4932 | 43.6633 |
| 18107 | 73.4110 | 982.5329 | 237.4508 | 786.0224 | 162.1233 |
| 15391 | 73.3831 | 1908.3296 | 319.0412 | 1618.8990 | 322.5136 |
| 18611 | 73.2231 | 3708.1375 | 996.5390 | 2780.4319 | 782.4267 |
| 15876 | 73.1488 | 3462.6941 | 620.1241 | 2824.3522 | 559.2189 |

TABLE 5L-continued

CHOLESTASIS
Timepoint(s): Various

| GLGC ID NO. | LDA Score | Mean Tox | SD Tox | Mean Nontox | SD Nontox |
|---|---|---|---|---|---|
| 13646 | 73.1094 | 2004.4324 | 415.1948 | 1607.6490 | 274.5982 |
| 17075 | 73.1024 | 920.5510 | 201.8759 | 741.5989 | 157.2949 |
| 15580 | 73.0676 | 378.3579 | 321.3056 | 968.2908 | 600.5079 |
| 1394 | 73.0421 | 36.6140 | 13.7114 | 24.7541 | 10.8882 |
| 25719 | 73.0282 | 3327.8048 | 633.0755 | 2746.2097 | 601.8796 |
| 563 | 72.9934 | 284.5637 | 183.0894 | 588.4595 | 353.8856 |
| 20493 | 72.9609 | 57.5665 | 40.4174 | 110.5626 | 46.1389 |
| 8597 | 72.8333 | 22.1950 | 24.9393 | 43.9053 | 29.4270 |
| 1529 | 72.8264 | 69.3517 | 28.4358 | 115.2634 | 46.8012 |
| 573 | 72.7591 | 26.7293 | 22.6775 | 81.6119 | 58.9865 |
| 2853 | 72.6942 | 378.0776 | 133.5195 | 240.1676 | 84.0917 |
| 20745 | 72.6408 | 676.4795 | 345.3671 | 405.5890 | 213.3168 |
| 16564 | 72.5991 | 114.9801 | 52.8632 | 171.2589 | 57.4702 |
| 1045 | 72.5596 | 104.4333 | 29.8514 | 84.0269 | 27.0164 |
| 25691 | 72.5063 | 2940.2627 | 571.1903 | 2235.4627 | 438.1596 |
| 492 | 72.4645 | 247.0318 | 64.0840 | 197.9152 | 90.7431 |
| 844 | 72.4251 | 100.3562 | 37.5163 | 143.5931 | 38.1988 |
| 2629 | 72.4042 | 243.9301 | 77.6442 | 198.7680 | 121.8019 |
| 24693 | 72.4042 | 323.5360 | 302.7960 | 784.7289 | 485.3481 |
| 23180 | 72.3926 | 1836.4734 | 366.3788 | 1358.7049 | 263.1749 |
| 2854 | 72.3323 | 1036.2847 | 321.5506 | 700.5712 | 192.7564 |
| 10109 | 72.3114 | 3790.5750 | 765.7910 | 3009.3772 | 683.8815 |
| 25643 | 72.1374 | 754.1131 | 221.0002 | 540.1335 | 205.8014 |
| 1571 | 72.0910 | 772.2885 | 240.8039 | 571.0819 | 167.8718 |
| 17100 | 72.0701 | 2607.5015 | 509.0910 | 2099.3222 | 449.5789 |
| 402 | 72.0493 | 523.2053 | 317.9222 | 1091.4447 | 528.6485 |
| 10540 | 71.9681 | 14.1985 | 10.7970 | 30.6215 | 21.4369 |
| 21654 | 71.9565 | 1128.0539 | 243.4005 | 847.3962 | 218.5679 |
| 23610 | 71.9286 | 91.3460 | 28.4258 | 70.9267 | 32.3441 |
| 4749 | 71.9147 | 278.5170 | 184.3303 | 717.4569 | 505.6846 |
| 1570 | 71.8962 | 717.5533 | 183.2231 | 551.9019 | 164.1171 |
| 20716 | 71.8892 | 296.8224 | 153.0559 | 529.4607 | 178.5379 |
| 21975 | 71.8475 | −1.1538 | 21.6590 | 31.3715 | 52.3861 |
| 16417 | 71.7547 | 210.9638 | 48.1214 | 163.9326 | 51.2645 |
| 16562 | 71.7477 | 98.3105 | 32.7625 | 148.8998 | 50.3522 |
| 25559 | 71.7083 | 226.0653 | 79.4783 | 164.8562 | 79.9303 |
| 23660 | 71.7013 | 790.7892 | 304.0453 | 1003.4002 | 277.4715 |
| 12349 | 71.6735 | 19.7650 | 25.9062 | 54.3144 | 57.4899 |
| 1347 | 71.6410 | 3000.2530 | 523.9789 | 2506.4735 | 524.5446 |
| 24886 | 71.6340 | 2953.1643 | 435.2977 | 2493.4437 | 488.2991 |
| 17648 | 71.6132 | 18.6935 | 17.8222 | 42.9121 | 25.9864 |
| 15617 | 71.5876 | 285.1742 | 83.4584 | 200.0278 | 88.6341 |
| 815 | 71.5807 | 3498.3003 | 645.6523 | 2927.3095 | 648.8950 |
| 5667 | 71.5412 | 2295.8955 | 432.4384 | 1836.2420 | 340.8936 |
| 2384 | 71.4995 | 124.6602 | 103.7609 | 291.2665 | 165.2499 |
| 20735 | 71.3533 | 1351.6455 | 419.4091 | 1005.4906 | 341.0272 |
| 4426 | 71.3533 | 365.8114 | 88.4254 | 274.7155 | 75.1694 |
| 19073 | 71.3464 | 550.0102 | 106.5871 | 459.4606 | 100.3010 |
| 19377 | 71.2930 | 272.7882 | 61.7753 | 224.4176 | 51.1114 |
| 19423 | 71.2513 | 70.6737 | 25.2362 | 122.3912 | 59.6004 |
| 20810 | 71.2327 | 4060.2385 | 950.3280 | 3121.1506 | 813.3690 |
| 570 | 71.1863 | 334.3847 | 109.7790 | 256.7642 | 79.4442 |
| 17765 | 71.1863 | 2420.2170 | 715.0608 | 1862.2464 | 451.7154 |
| 20464 | 71.1376 | 102.8750 | 104.3153 | 260.9183 | 161.5037 |
| 15579 | 71.1306 | 197.6970 | 217.1262 | 608.8516 | 506.6977 |
| 794 | 71.1306 | 28.2883 | 13.3216 | 58.3205 | 33.3486 |
| 19241 | 71.1121 | 258.4010 | 71.3619 | 192.8832 | 68.2241 |
| 16204 | 71.0982 | 2196.0532 | 368.7722 | 1860.3855 | 376.9708 |
| 20553 | 79.6279 | 124.2669 | 41.7055 | 181.9377 | 49.3149 |
| 4900 | 78.9645 | 308.1547 | 40.3865 | 412.3240 | 102.7843 |
| 6291 | 78.8972 | 164.6954 | 52.7937 | 261.0746 | 95.9925 |
| 2855 | 78.2082 | 1208.1731 | 192.2500 | 907.9505 | 210.3230 |
| 21649 | 77.9878 | 805.8189 | 377.6339 | 397.1322 | 212.6387 |
| 3995 | 77.8185 | 149.9227 | 59.8344 | 268.7370 | 114.4310 |
| 22050 | 77.5239 | 151.5247 | 151.8725 | 388.6408 | 200.2444 |
| 3674 | 76.7932 | 149.3300 | 40.6021 | 215.1673 | 67.1620 |
| 965 | 76.3176 | 64.8423 | 43.0603 | 147.2185 | 76.7402 |
| 19456 | 76.2457 | 382.0009 | 259.0254 | 149.7466 | 133.7086 |
| 19544 | 76.2109 | 1843.3524 | 322.2852 | 1429.3090 | 371.0082 |
| 17049 | 76.0230 | 52.8462 | 38.8063 | 95.8793 | 44.4573 |
| 5833 | 75.7145 | 37.4847 | 16.1724 | 71.7680 | 34.5678 |
| 23504 | 75.6890 | 730.8308 | 164.0784 | 537.0571 | 138.8860 |
| 10986 | 75.5869 | 43.4525 | 27.6036 | 92.4370 | 51.6479 |
| 14033 | 75.5335 | 151.6182 | 34.9164 | 205.4173 | 61.8036 |
| 12719 | 75.5150 | 232.6865 | 95.9466 | 147.3161 | 66.6184 |
| 2768 | 75.2320 | 558.6567 | 259.5941 | 954.2630 | 413.1299 |
| 16 | 75.1647 | 216.5342 | 97.3646 | 332.0541 | 130.6371 |
| 5779 | 75.1113 | 226.9808 | 49.7330 | 292.1105 | 70.1655 |
| 2242 | 74.9374 | 223.8753 | 138.9898 | 497.3607 | 255.1369 |
| 8949 | 74.7309 | 1350.8827 | 329.1735 | 993.5350 | 278.9012 |
| 14919 | 74.5500 | 60.6374 | 43.4818 | 28.7839 | 35.6413 |
| 13622 | 74.5221 | 147.4579 | 75.0775 | 90.0309 | 109.2600 |
| 2702 | 74.4363 | 1231.1581 | 408.9965 | 808.5549 | 285.2637 |
| 19193 | 74.3945 | 181.9765 | 37.9980 | 229.4206 | 50.1151 |
| 5431 | 74.3157 | 1098.8572 | 497.3058 | 516.4719 | 334.4323 |
| 3302 | 74.2739 | 58.9605 | 43.8855 | 106.7758 | 48.5110 |
| 4048 | 74.2623 | 732.2437 | 543.7110 | 285.2242 | 261.5850 |
| 15474 | 74.2414 | 1098.2943 | 241.0116 | 864.9816 | 195.0165 |
| 6479 | 74.2206 | 268.3006 | 232.2732 | 426.3749 | 207.2021 |
| 15665 | 74.2136 | 432.2400 | 77.6883 | 535.8324 | 108.1791 |
| 19200 | 74.0744 | 344.9336 | 132.0672 | 225.4692 | 80.8763 |
| 21023 | 73.9863 | 69.9582 | 29.0981 | 112.9460 | 38.2104 |
| 23505 | 73.7195 | 1789.3384 | 607.7433 | 1280.9872 | 293.3750 |
| 7420 | 73.7102 | 211.6594 | 32.4429 | 283.3052 | 110.0999 |
| 18390 | 73.6708 | 14.4472 | 12.3332 | 35.0634 | 20.8541 |
| 4049 | 73.5989 | 1299.0377 | 795.5471 | 588.8484 | 412.1115 |
| 11640 | 73.5177 | 65.1928 | 26.9805 | 41.7007 | 21.5126 |
| 3143 | 73.4226 | 181.0684 | 47.5773 | 231.9670 | 58.0737 |
| 2308 | 73.4040 | 153.4243 | 68.6211 | 91.1303 | 65.9566 |
| 21454 | 73.3692 | 146.0104 | 61.7547 | 204.6728 | 67.4720 |
| 23278 | 73.2695 | 114.0732 | 31.9096 | 85.3375 | 32.1554 |
| 6828 | 73.1952 | 200.7637 | 119.3367 | 329.7947 | 142.9792 |
| 3909 | 73.1628 | 174.8668 | 53.9992 | 116.8775 | 45.4056 |
| 6102 | 73.1280 | 119.9355 | 29.3398 | 159.8837 | 43.1765 |
| 10549 | 73.1164 | 265.7053 | 151.1481 | 149.6598 | 79.3839 |
| 633 | 73.0816 | 185.7067 | 76.8983 | 292.4652 | 94.4339 |
| 3969 | 73.0676 | 40.0970 | 30.9291 | 93.6168 | 52.8788 |
| 4230 | 73.0421 | 493.7389 | 109.2841 | 410.9791 | 85.5778 |
| 6717 | 72.9470 | 130.3063 | 68.1654 | 229.4734 | 100.1114 |

TABLE 5M

CI-1000
Timepoint(s): 24 hrs

| GLGC ID NO. | LDA Score | Mean Tox | SD Tox | Mean Nontox | SD Nontox |
|---|---|---|---|---|---|
| 670 | 99.7653 | 109.2667 | 1.4250 | 313.2507 | 123.6200 |
| 5049 | 99.6479 | 255.5433 | 0.9943 | 177.3817 | 40.2066 |
| 1583 | 99.4131 | 245.6533 | 4.2244 | 122.4281 | 42.2862 |
| 1571 | 99.2958 | 1228.2500 | 29.9785 | 574.9081 | 169.7658 |
| 1378 | 99.2371 | 98.1567 | 7.5540 | 43.6701 | 14.4101 |
| 5496 | 99.1784 | 49.0667 | 1.5494 | 164.7065 | 97.4735 |
| 1728 | 99.1197 | 390.6900 | 10.3068 | 227.4793 | 89.7786 |
| 14934 | 99.0023 | 171.4667 | 2.8567 | 112.6667 | 24.9171 |
| 574 | 99.0023 | 4432.0900 | 433.0419 | 2041.0439 | 559.2697 |
| 10544 | 99.0023 | 702.1267 | 28.7354 | 466.2711 | 88.2788 |
| 21794 | 98.9437 | 5.9200 | 1.4409 | 51.9048 | 27.6480 |
| 1348 | 98.9437 | 71.9967 | 2.6695 | 34.6180 | 15.8705 |
| 6343 | 98.9437 | 51.9167 | 0.2376 | 41.2834 | 12.6676 |
| 15205 | 98.8263 | 136.0033 | 0.5450 | 110.1822 | 28.2962 |
| 1798 | 98.6502 | 347.1167 | 18.1798 | 1201.4371 | 660.9475 |
| 24814 | 98.5329 | 389.9067 | 22.2973 | 242.4929 | 50.7766 |
| 23250 | 98.5329 | 317.7900 | 34.5316 | 184.5249 | 32.2940 |
| 16947 | 98.4742 | 147.5900 | 6.7977 | 346.3244 | 139.5571 |
| 16164 | 98.4742 | 1717.2267 | 19.0810 | 1282.2552 | 248.2322 |
| 18498 | 98.4155 | 412.3833 | 23.2977 | 237.9374 | 55.0359 |
| 798 | 98.4155 | 128.0433 | 16.3359 | 52.3820 | 22.1796 |
| 22576 | 98.4155 | 484.4533 | 5.2279 | 711.5532 | 187.8862 |
| 23166 | 98.3568 | 758.8567 | 5.8728 | 555.8734 | 136.3963 |
| 15087 | 98.3568 | 279.6733 | 7.6845 | 185.4370 | 49.5093 |
| 16006 | 98.3568 | 341.7733 | 31.6536 | 152.3438 | 61.3565 |

TABLE 5M-continued

CI-1000
Timepoint(s): 24 hrs

| GLGC ID NO. | LDA Score | Mean Tox | SD Tox | Mean Nontox | SD Nontox |
| --- | --- | --- | --- | --- | --- |
| 13283 | 98.3568 | 44.9933 | 2.4919 | 145.3458 | 71.7815 |
| 17956 | 98.2981 | 167.2833 | 1.7321 | 121.9187 | 30.9906 |
| 20801 | 98.2981 | 441.4867 | 15.5470 | 223.4285 | 103.5682 |
| 20701 | 98.2394 | 78.4500 | 6.5257 | 399.3628 | 199.3835 |
| 25594 | 98.2394 | 700.5833 | 17.1686 | 495.3327 | 96.3041 |
| 24554 | 98.1808 | 25.3833 | 1.2726 | 8.3882 | 9.9661 |
| 108 | 98.1808 | 773.3800 | 30.0161 | 1572.5431 | 614.3471 |
| 20664 | 98.0634 | 373.3533 | 7.0277 | 632.8882 | 324.0494 |
| 20755 | 98.0634 | 2569.4500 | 1103.5913 | 1186.1377 | 361.2377 |
| 20939 | 97.9460 | 971.5300 | 40.5873 | 545.6637 | 180.0993 |
| 1570 | 97.9460 | 1078.9433 | 92.2747 | 555.1012 | 164.3824 |
| 16024 | 97.9460 | 520.0167 | 175.9134 | 192.3830 | 82.5085 |
| 21154 | 97.9460 | 116.8600 | 67.0157 | 41.5287 | 15.9550 |
| 16025 | 97.8873 | 313.1433 | 73.8778 | 123.5085 | 60.4607 |
| 17115 | 97.8286 | -3.3700 | 1.9489 | 24.6041 | 17.3169 |
| 22282 | 97.7700 | 289.0300 | 24.6275 | 144.5153 | 45.1435 |
| 1146 | 97.7700 | 65.9467 | 2.7375 | 36.8626 | 18.4065 |
| 17649 | 97.7113 | 25.2833 | 1.7044 | 72.0728 | 33.2749 |
| 626 | 97.7113 | 300.2133 | 58.0755 | 88.9194 | 74.2778 |
| 4439 | 97.7113 | 108.7500 | 17.9984 | 243.5820 | 73.9585 |
| 16993 | 97.6526 | 34.6133 | 2.3544 | 111.5754 | 66.0610 |
| 16780 | 97.6526 | 85.6667 | 3.4591 | 174.8928 | 96.3966 |
| 20468 | 97.6526 | 61.3867 | 1.5039 | 39.4093 | 13.2797 |
| 590 | 97.6526 | 120.0800 | 41.8952 | 47.2379 | 17.4948 |
| 16026 | 97.5939 | 501.4433 | 107.8294 | 165.7790 | 89.4589 |
| 25680 | 97.5352 | 731.8500 | 13.9577 | 1070.4154 | 308.0196 |
| 797 | 97.5352 | 182.6967 | 38.4154 | 83.5112 | 32.5417 |
| 1292 | 97.5352 | 287.3300 | 64.0326 | 143.1721 | 40.0082 |
| 25559 | 97.4765 | 413.7433 | 45.6196 | 165.8478 | 79.3219 |
| 220 | 97.4765 | 62.7800 | 8.3060 | 16.6729 | 17.7958 |
| 13090 | 97.4765 | 53.6700 | 1.3599 | 79.6554 | 44.4111 |
| 11296 | 97.4178 | 207.5767 | 19.8887 | 114.2760 | 38.6626 |
| 18083 | 97.4178 | 64.3867 | 3.2809 | 44.9517 | 64.7309 |
| 23070 | 97.3592 | 373.7700 | 19.8960 | 239.4271 | 58.1083 |
| 23522 | 97.3592 | 522.0300 | 168.1060 | 251.2805 | 77.5466 |
| 4500 | 97.3005 | 91.2867 | 12.2044 | 34.2459 | 25.6602 |
| 16507 | 97.3005 | 244.4500 | 57.3410 | 102.5853 | 36.6316 |
| 17933 | 97.3005 | 375.1967 | 7.3511 | 248.4946 | 135.1609 |
| 16400 | 97.1831 | 4552.8167 | 41.4097 | 5000.0182 | 1710.9174 |
| 4234 | 97.1831 | 1167.4333 | 69.4723 | 726.1453 | 170.3302 |
| 14965 | 97.1244 | -11.7567 | 2.1011 | 46.4480 | 74.1618 |
| 16331 | 97.1244 | 187.0333 | 36.4728 | 427.8147 | 123.5245 |
| 16422 | 97.1244 | 32.8667 | 2.7575 | 10.9854 | 13.4247 |
| 2439 | 97.0657 | 89.5267 | 0.9563 | 74.6812 | 19.1225 |
| 20944 | 97.0657 | 1657.5900 | 37.1916 | 1253.9953 | 273.6565 |
| 20016 | 97.0657 | 111.7333 | 9.9230 | 65.6507 | 19.2915 |
| 3896 | 97.0657 | -42.0067 | 6.5541 | 26.0443 | 43.2103 |
| 22927 | 97.0070 | 23.5600 | 0.8418 | 50.2208 | 20.6457 |
| 18770 | 97.0070 | 1279.4833 | 57.8708 | 814.8949 | 196.9496 |
| 20462 | 97.0070 | 2309.8967 | 30.3477 | 1700.8470 | 409.7434 |
| 6980 | 97.0070 | 16.4400 | 2.7944 | 50.3021 | 20.8320 |
| 14822 | 96.8897 | 697.1700 | 115.6587 | 333.6376 | 103.9976 |
| 15662 | 96.8897 | 298.1233 | 104.8819 | 144.6780 | 42.7375 |
| 15203 | 96.8897 | 354.5367 | 10.7799 | 254.8762 | 58.4835 |
| 24423 | 96.8310 | 68.9967 | 1.1002 | 59.7184 | 32.5583 |
| 15348 | 96.7723 | 416.6400 | 17.2558 | 289.3961 | 59.3279 |
| 4314 | 96.7723 | 49.1567 | 8.1657 | 163.7525 | 83.7373 |
| 16367 | 96.7136 | 93.6633 | 46.5769 | 624.0589 | 286.3909 |
| 10154 | 96.7136 | 542.9100 | 52.2330 | 256.3417 | 108.2705 |
| 1004 | 96.7136 | 142.6600 | 41.8361 | 73.6771 | 19.8325 |
| 25251 | 96.7136 | 1880.0567 | 314.3731 | 1122.2207 | 270.4215 |
| 15862 | 96.7136 | 272.1700 | 12.8224 | 157.6527 | 80.2857 |
| 13646 | 96.6549 | 2437.1900 | 244.1212 | 1616.8365 | 283.8840 |
| 11690 | 96.6549 | 411.9900 | 48.6256 | 249.1199 | 60.9719 |
| 19073 | 96.6549 | 788.7100 | 155.6956 | 461.0645 | 99.6541 |
| 23524 | 96.6549 | 1013.8800 | 305.6420 | 394.0130 | 190.7106 |
| 24469 | 96.5962 | 2134.1067 | 132.5766 | 1502.8377 | 249.5406 |
| 15661 | 96.5962 | 97.4267 | 37.1834 | 29.5261 | 26.1288 |
| 15925 | 96.5376 | 154.8867 | 1.8963 | 176.8176 | 53.3741 |
| 20586 | 96.5376 | 44.1067 | 5.7000 | 141.7868 | 69.2698 |
| 18727 | 96.5376 | 1450.8800 | 101.6631 | 879.3348 | 227.3248 |
| 21064 | 96.5376 | 291.1633 | 63.4738 | 161.7798 | 43.1976 |
| 12580 | 96.4789 | 37.5533 | 3.7391 | 19.9032 | 6.8123 |
| 17549 | 96.4789 | 1296.6000 | 126.6526 | 866.5677 | 161.9721 |
| 573 | 96.4202 | 8.6367 | 2.2945 | 80.1940 | 58.9212 |
| 13614 | 99.7653 | 51.4367 | 0.6045 | 178.4272 | 62.9327 |
| 11610 | 99.5305 | 570.7167 | 19.9658 | 248.0251 | 85.5200 |
| 9309 | 99.5305 | 142.4767 | 0.1106 | 177.9681 | 68.9937 |
| 18777 | 99.3545 | 195.2400 | 10.9760 | 42.6115 | 54.1772 |
| 22310 | 99.2958 | 316.3067 | 1.0624 | 236.1521 | 65.5293 |
| 22102 | 99.2958 | 633.5467 | 26.2193 | 357.9602 | 99.6842 |
| 3501 | 99.1197 | 61.2333 | 2.8761 | 132.3045 | 35.4217 |
| 15663 | 99.1197 | 575.4267 | 17.3292 | 320.7241 | 95.9910 |
| 18278 | 99.1197 | 30.2633 | 5.3071 | -16.0733 | 31.9931 |
| 23521 | 99.1197 | 60.4533 | 1.9468 | 275.4023 | 250.8535 |
| 23860 | 99.0023 | 310.3067 | 34.2716 | 155.6076 | 53.0030 |
| 6996 | 99.0023 | 165.6633 | 21.3460 | 52.7652 | 33.0613 |
| 14521 | 98.9437 | 198.1933 | 4.4558 | 404.1931 | 113.9929 |
| 5899 | 98.9437 | 33.5000 | 1.8694 | 133.6170 | 73.2164 |
| 21747 | 98.8263 | 330.9267 | 10.0221 | 577.5927 | 117.6615 |
| 6033 | 98.7676 | 72.8967 | 12.1374 | 234.5824 | 89.9683 |
| 9845 | 98.7676 | 126.4867 | 2.2293 | 219.0457 | 145.8746 |
| 22915 | 98.7089 | 409.8567 | 8.9472 | 270.5227 | 67.0960 |
| 23630 | 98.7089 | 789.8200 | 15.8398 | 572.6460 | 88.5943 |
| 4636 | 98.5915 | 424.3433 | 37.2686 | 167.6131 | 106.7794 |
| 2382 | 98.5915 | 33.0133 | 0.4244 | 38.8910 | 30.3760 |
| 24501 | 98.5329 | 2075.2267 | 251.8815 | 1157.4128 | 234.9732 |
| 15403 | 98.4155 | 546.1933 | 46.7329 | 280.4099 | 85.4148 |
| 18524 | 98.4155 | 233.6633 | 14.6275 | 765.1900 | 330.9064 |
| 2909 | 98.4155 | 422.4233 | 2.8325 | 554.7932 | 128.3919 |
| 15685 | 98.3568 | 1989.9867 | 311.4854 | 741.8780 | 307.4329 |
| 13919 | 98.2981 | 64.7367 | 3.1163 | 120.7609 | 33.6779 |
| 6291 | 98.2981 | 87.3167 | 13.8000 | 258.7453 | 96.0150 |
| 9500 | 98.2394 | 66.0900 | 1.3126 | 7.2284 | 51.3678 |
| 13169 | 98.2394 | 173.3367 | 15.4458 | 95.8285 | 22.8417 |
| 10920 | 98.2394 | -1.0367 | 2.1789 | 85.9320 | 76.8110 |
| 2933 | 98.2394 | 16.1500 | 0.5568 | 35.5228 | 18.3151 |
| 12563 | 98.1808 | 634.3933 | 111.9324 | 329.1652 | 79.9587 |
| 13346 | 98.1221 | 474.6867 | 12.4790 | 300.5931 | 84.1555 |
| 5044 | 98.1221 | 161.4467 | 18.7470 | 80.3131 | 25.7622 |
| 23738 | 98.1221 | 290.9200 | 2.6960 | 239.5445 | 129.5699 |
| 10986 | 98.0634 | 12.0067 | 3.0410 | 91.2254 | 51.6411 |
| 18383 | 98.0634 | 210.0600 | 8.3092 | 383.9724 | 106.3083 |
| 6224 | 98.0047 | 150.6700 | 23.3596 | 56.7133 | 28.0139 |
| 19371 | 98.0047 | 24.8700 | 4.2551 | 68.5993 | 25.1045 |
| 10138 | 98.0047 | 43.7667 | 0.3850 | 41.5785 | 19.7245 |
| 22994 | 98.0047 | 83.8300 | 2.2727 | 37.1601 | 36.9991 |
| 8395 | 98.0047 | 10.1200 | 4.8138 | 78.3065 | 55.3462 |
| 3246 | 97.9460 | 236.8700 | 24.9178 | 103.3871 | 56.2319 |
| 26184 | 97.9460 | 126.0933 | 11.4259 | 259.9223 | 69.6064 |
| 17365 | 97.9460 | 113.6667 | 10.3302 | 32.2327 | 56.7916 |
| 5258 | 97.9460 | 68.1000 | 10.8405 | 191.4370 | 56.1991 |
| 5615 | 97.9460 | 127.1533 | 7.1602 | 71.2396 | 37.1519 |
| 2267 | 97.8873 | 415.0967 | 49.5361 | 200.1208 | 65.6690 |
| 7926 | 97.8873 | 49.1133 | 1.4162 | 87.4598 | 25.8601 |
| 6717 | 97.8286 | 59.7300 | 7.3683 | 227.0449 | 100.4030 |
| 2911 | 97.8286 | 39.1667 | 9.9651 | 285.6090 | 178.9471 |
| 3631 | 97.8286 | 235.6533 | 18.8155 | 149.6967 | 30.5550 |
| 4650 | 97.7113 | 398.0633 | 39.7717 | 224.8837 | 54.6099 |
| 13563 | 97.7113 | 194.5233 | 26.8819 | 465.4959 | 150.1683 |
| 2250 | 97.7113 | 3776.5600 | 1073.1660 | 1640.6670 | 668.9172 |

TABLE 5N

CI-1000
Timepoint(s): 3, 6 hrs

| GLGC ID NO. | LDA Score | Mean Tox | SD Tox | Mean Nontox | SD Nontox |
| --- | --- | --- | --- | --- | --- |
| 24431 | 97.4706 | 1034.1400 | 108.6216 | 399.8884 | 305.4188 |
| 2413 | 96.4118 | 1028.7020 | 34.2481 | 764.4779 | 150.1153 |
| 13282 | 96.2941 | 28.6100 | 0.5787 | 45.0436 | 23.3164 |

TABLE 5N-continued

CI-1000
Timepoint(s): 3, 6 hrs

| GLGC ID NO. | LDA Score | Mean Tox | SD Tox | Mean Nontox | SD Nontox |
|---|---|---|---|---|---|
| 804 | 96.0588 | 1769.3440 | 160.7889 | 990.3905 | 374.3138 |
| 12041 | 95.4706 | 335.3120 | 4.9795 | 288.0305 | 73.1125 |
| 6598 | 95.1765 | 322.1120 | 66.4455 | 121.8002 | 72.5937 |
| 20443 | 95.0588 | 123.5800 | 1.7404 | 136.5106 | 38.2741 |
| 18615 | 94.7059 | 2381.5580 | 109.8609 | 1712.8194 | 372.8216 |
| 888 | 94.4118 | 95.2700 | 4.9641 | 155.8538 | 51.7529 |
| 923 | 94.2353 | 419.3100 | 39.8759 | 192.4002 | 110.0052 |
| 20930 | 94.0588 | −1.7760 | 9.0345 | 67.8586 | 85.3116 |
| 18302 | 94.0588 | 183.6780 | 5.6032 | 137.1737 | 73.1820 |
| 24785 | 93.8824 | 32.2480 | 3.1239 | 58.3371 | 24.4316 |
| 15300 | 93.5882 | 841.9220 | 49.8646 | 641.4178 | 346.5659 |
| 23368 | 93.5294 | 5.9340 | 3.3979 | 42.4058 | 35.1429 |
| 904 | 93.3529 | 27.3180 | 4.3288 | 49.3116 | 13.0483 |
| 1141 | 93.3529 | 147.2860 | 10.0730 | 224.4452 | 56.6941 |
| 24670 | 93.3529 | 161.1580 | 4.8217 | 174.5034 | 65.2681 |
| 353 | 93.1765 | 677.5700 | 85.8249 | 411.4283 | 247.9680 |
| 25799 | 93.0000 | 92.9600 | 8.6253 | 213.7970 | 141.3837 |
| 652 | 93.0000 | 76.3920 | 19.1592 | 313.1565 | 220.3620 |
| 19173 | 92.9412 | 14.7680 | 4.4595 | 34.4182 | 13.9837 |
| 13930 | 92.8235 | 257.4600 | 16.2507 | 198.2846 | 97.9649 |
| 16164 | 92.7647 | 1646.1880 | 87.4699 | 1281.6496 | 248.2284 |
| 16524 | 92.4118 | 19.1060 | 2.9601 | 38.0547 | 14.7745 |
| 5005 | 92.4118 | 33.3640 | 4.0239 | 13.9322 | 12.8438 |
| 15996 | 92.3529 | 521.2080 | 124.9346 | 245.8453 | 153.7129 |
| 18628 | 92.3529 | 3628.6260 | 143.6978 | 2825.7367 | 653.5794 |
| 15190 | 92.2353 | 6553.7540 | 728.4085 | 3985.2090 | 1983.2836 |
| 13477 | 92.1765 | 15.9540 | 3.3237 | 36.7683 | 15.1090 |
| 14971 | 92.0000 | 58.0280 | 2.7318 | 55.1424 | 20.5960 |
| 15421 | 91.8824 | 270.8100 | 44.7634 | 420.9979 | 90.8706 |
| 21400 | 91.8235 | 153.0840 | 38.3839 | 348.6602 | 149.9489 |
| 4956 | 91.7059 | 76.0100 | 15.7049 | 197.4789 | 91.7442 |
| 23000 | 91.5882 | 19.1720 | 6.4099 | 42.4005 | 13.6129 |
| 23522 | 91.4118 | 387.8460 | 54.1446 | 251.4328 | 78.9276 |
| 6780 | 91.4118 | 369.5900 | 11.8564 | 468.2767 | 160.8321 |
| 24247 | 91.1176 | 26.1900 | 4.6793 | 76.9325 | 79.6843 |
| 24219 | 91.1176 | 862.7020 | 121.3547 | 604.0197 | 179.9719 |
| 10623 | 91.0588 | 148.1620 | 45.5201 | 67.9046 | 58.4806 |
| 16610 | 90.9412 | 646.1140 | 58.1148 | 435.6391 | 145.0453 |
| 1301 | 90.8824 | 813.4660 | 48.5109 | 1314.6762 | 1212.6114 |
| 17920 | 90.8824 | 33.0140 | 4.4513 | 61.3899 | 23.5226 |
| 18362 | 90.8235 | 29.4700 | 7.8319 | 64.0001 | 23.8261 |
| 15735 | 90.7647 | 58.3820 | 7.8455 | 103.9030 | 35.5648 |
| 4957 | 90.7059 | 64.5240 | 9.5019 | 148.2250 | 68.0133 |
| 25481 | 90.6471 | 4715.0720 | 442.9352 | 3277.9920 | 967.5329 |
| 24607 | 90.4706 | 12.2300 | 1.7371 | 48.9413 | 42.7736 |
| 25050 | 90.4118 | 5403.0820 | 1055.6950 | 3336.5601 | 1262.1018 |
| 23883 | 90.4118 | 47.5660 | 10.3078 | 166.5156 | 118.5817 |
| 15703 | 90.2941 | 56.9740 | 13.6309 | 27.3566 | 16.5405 |
| 798 | 90.2941 | 62.0640 | 3.3320 | 52.5921 | 22.6561 |
| 11483 | 90.2353 | 713.5020 | 204.1242 | 392.8079 | 252.7852 |
| 16192 | 90.2353 | 15.8940 | 3.6655 | 28.2224 | 9.5890 |
| 13974 | 90.1765 | 534.6420 | 153.0097 | 913.7961 | 255.9098 |
| 17728 | 90.1176 | 5830.3140 | 771.1900 | 3980.5134 | 1034.8309 |
| 6109 | 90.1176 | 4895.2420 | 428.0896 | 3319.0653 | 1560.8639 |
| 25319 | 89.9412 | 9029.9740 | 884.8943 | 6306.5330 | 2503.0127 |
| 20718 | 89.8824 | 13.9980 | 5.5288 | 34.7498 | 16.3231 |
| 22999 | 89.8235 | 9.1620 | 5.4009 | 27.7722 | 12.5563 |
| 14015 | 89.8235 | −5.7920 | 9.6701 | 36.3026 | 52.4709 |
| 11852 | 89.7647 | 62.5200 | 23.8315 | 147.5237 | 54.9023 |
| 15862 | 89.7059 | 107.1480 | 6.2026 | 158.3539 | 80.5730 |
| 7176 | 89.6471 | 307.7920 | 15.2426 | 306.0791 | 134.9802 |
| 7459 | 89.5294 | 2098.2180 | 304.3621 | 1491.5148 | 428.2679 |
| 10625 | 89.5294 | 166.5520 | 52.1349 | 88.4047 | 102.4229 |
| 4186 | 89.4706 | 5662.6760 | 558.7624 | 4098.0811 | 1196.6038 |
| 19421 | 89.2941 | 6704.2300 | 946.7344 | 4435.3045 | 1607.0724 |
| 13186 | 89.2353 | 3.1260 | 8.6859 | 20.3624 | 11.3186 |
| 1373 | 89.2353 | 33.9900 | 7.5279 | 67.3279 | 24.0953 |
| 3513 | 89.1765 | 134.0540 | 8.2603 | 190.2385 | 66.9083 |
| 4243 | 89.1765 | 63.0400 | 12.2477 | 122.6823 | 46.5055 |
| 1159 | 88.9412 | 184.9080 | 36.4153 | 301.8924 | 90.3406 |
| 17147 | 88.8235 | 2852.6380 | 403.6589 | 1699.7616 | 968.9198 |
| 15997 | 88.7647 | 549.4660 | 188.0514 | 289.8793 | 218.2025 |
| 15023 | 88.7647 | 235.6260 | 49.0838 | 361.0430 | 83.3063 |
| 15767 | 88.7647 | 50.0960 | 6.8920 | 83.0854 | 29.5677 |
| 2968 | 88.7059 | 1259.1420 | 191.8247 | 658.3778 | 476.9341 |
| 10624 | 88.5882 | 165.3360 | 41.6917 | 97.2620 | 96.1943 |
| 10622 | 88.5294 | 122.8620 | 46.1321 | 45.9580 | 98.8111 |
| 1153 | 88.5294 | 205.7600 | 11.8571 | 183.6851 | 103.0918 |
| 15187 | 88.4118 | 31.6500 | 14.3440 | 91.9392 | 50.2737 |
| 18494 | 88.3529 | 91.6680 | 9.6136 | 129.0817 | 49.3112 |
| 25568 | 88.2353 | 90.3700 | 77.7225 | 254.0246 | 112.8068 |
| 19530 | 88.1765 | −5.0800 | 8.4039 | 20.3713 | 29.6535 |
| 18719 | 88.1765 | 163.2420 | 20.7948 | 129.2359 | 94.9131 |
| 23950 | 88.0000 | 92.2500 | 3.8588 | 87.2017 | 24.6582 |
| 844 | 87.9412 | 139.2860 | 4.8886 | 142.2959 | 38.9852 |
| 520 | 87.9412 | 55.3640 | 6.1238 | 32.0487 | 28.9950 |
| 354 | 87.8824 | 730.3560 | 158.3495 | 511.9149 | 323.0557 |
| 20590 | 87.7647 | 314.6420 | 23.3622 | 262.2327 | 86.5809 |
| 2009 | 87.6471 | 12.3500 | 1.8548 | 27.0938 | 21.9744 |
| 1120 | 87.6471 | 16.2640 | 2.3289 | 23.8793 | 12.1322 |
| 6980 | 87.5882 | 20.1980 | 12.4517 | 50.3597 | 20.8085 |
| 15301 | 87.5882 | 362.7080 | 57.8896 | 269.2646 | 181.4033 |
| 19020 | 87.5882 | 56.9120 | 2.6764 | 58.3371 | 19.0458 |
| 1888 | 87.5294 | 178.7420 | 51.1160 | 106.6637 | 62.8830 |
| 1655 | 87.5294 | 15.2420 | 4.8562 | 29.8666 | 13.8015 |
| 18419 | 87.5294 | 442.8260 | 61.6724 | 639.7023 | 149.3196 |
| 1540 | 87.5294 | 41.2500 | 12.9064 | 97.7301 | 49.3266 |
| 18658 | 98.1765 | 2315.9540 | 371.8218 | 889.9863 | 356.0617 |
| 23030 | 97.1765 | 79.3620 | 24.6053 | 362.4642 | 189.7508 |
| 7414 | 97.1176 | 956.9020 | 37.4384 | 619.9796 | 161.1593 |
| 23538 | 96.4706 | 1000.5520 | 202.8691 | 355.3829 | 205.9637 |
| 15608 | 96.4706 | 1954.3840 | 286.1675 | 1272.9904 | 250.5551 |
| 13619 | 95.8235 | 949.0520 | 333.2540 | 287.0541 | 235.7976 |
| 15644 | 95.7647 | 2590.9860 | 410.5826 | 1507.3891 | 392.3679 |
| 18271 | 95.4118 | 43.6100 | 25.1680 | 182.2875 | 79.9073 |
| 22586 | 95.4118 | 7160.8860 | 370.5684 | 3812.6195 | 3591.4430 |
| 17506 | 95.0588 | 1809.8800 | 593.6427 | 473.8423 | 404.5598 |
| 12129 | 95.0000 | 99.2360 | 1.9519 | 92.4325 | 35.9305 |
| 15645 | 94.9412 | 2319.3640 | 418.6155 | 1318.2232 | 413.7231 |
| 15277 | 94.5882 | 2591.2200 | 246.1259 | 1970.2948 | 279.9681 |
| 18518 | 94.5294 | 155.0500 | 2.7510 | 155.2614 | 61.3857 |
| 8214 | 94.3529 | 86.7840 | 24.9473 | −2.4802 | 50.1150 |
| 6171 | 94.2941 | 10.2500 | 4.0686 | 70.1403 | 87.0632 |
| 23963 | 94.2353 | 36.1120 | 29.1626 | 23.0925 | 17.6345 |
| 15377 | 94.1765 | 99.1080 | 26.6616 | 51.7428 | 22.9047 |
| 24166 | 94.1176 | 299.4360 | 29.0826 | 435.5466 | 84.8758 |
| 8472 | 93.9412 | 46.6220 | 3.1565 | 5.5747 | 52.4482 |
| 3489 | 93.7647 | 1646.9340 | 155.3216 | 1166.8770 | 237.0691 |
| 9521 | 93.7647 | 393.0400 | 24.0117 | 282.2748 | 72.5988 |
| 15684 | 93.7059 | 1399.2220 | 93.6975 | 1015.7591 | 221.9420 |
| 11446 | 93.7059 | 662.9320 | 33.0635 | 491.7734 | 107.5781 |
| 13000 | 93.6471 | 124.9960 | 19.1307 | 253.0844 | 89.7414 |
| 9569 | 93.4118 | 29.5060 | 3.1637 | 55.9737 | 28.7660 |
| 23029 | 93.4118 | 155.7880 | 58.5653 | 538.1063 | 265.2547 |
| 19367 | 93.2941 | 3100.0280 | 351.7345 | 1360.8888 | 1336.4107 |
| 24685 | 92.2353 | 633.9500 | 16.3760 | 592.4747 | 157.4125 |
| 7584 | 93.1176 | 385.3660 | 12.0288 | 567.7686 | 307.9080 |
| 21861 | 93.0588 | 464.3760 | 59.5905 | 324.2710 | 73.3725 |
| 7970 | 93.0588 | 49.5940 | 9.6545 | 94.8524 | 30.5912 |
| 14083 | 92.8824 | 155.9720 | 9.3969 | 253.3763 | 86.8349 |
| 1802 | 92.8235 | 125.2780 | 35.9462 | 311.7226 | 135.5350 |
| 23567 | 92.6471 | 414.9280 | 141.1465 | 148.1559 | 163.7202 |
| 7888 | 92.6471 | 1220.2820 | 61.8934 | 872.6283 | 219.2270 |
| 1649 | 92.6471 | 85.3660 | 3.6099 | 68.2389 | 33.8666 |
| 22995 | 92.5882 | 91.3300 | 22.9725 | 314.3172 | 210.7428 |
| 11178 | 92.5882 | 336.0900 | 20.1139 | 520.0071 | 175.1173 |
| 17361 | 92.5294 | 189.7800 | 25.3171 | 83.2950 | 60.6835 |
| 11941 | 92.4706 | 20.4920 | 0.8482 | 24.6151 | 14.9378 |
| 19016 | 92.4118 | 250.1760 | 10.8302 | 338.7179 | 106.5135 |
| 22030 | 92.3529 | 10602.2940 | 1345.7602 | 6778.9575 | 2054.0896 |
| 10569 | 92.2941 | 502.6840 | 75.5339 | 351.5089 | 82.5322 |
| 17235 | 92.2353 | 88.3420 | 11.3560 | 54.9210 | 34.1944 |
| 4900 | 92.1765 | 275.8660 | 24.3842 | 409.9404 | 102.7885 |
| 14455 | 92.0588 | 54.0180 | 15.5339 | 149.7569 | 78.6527 |
| 11088 | 91.8235 | 5.1720 | 15.1860 | 44.2996 | 22.4361 |
| 5193 | 91.7647 | 3602.6300 | 209.7557 | 2738.5793 | 540.1233 |

TABLE 5N-continued

CI-1000
Timepoint(s): 3, 6 hrs

| GLGC ID NO. | LDA Score | Mean Tox | SD Tox | Mean Nontox | SD Nontox |
|---|---|---|---|---|---|
| 5712 | 91.7059 | 392.8300 | 50.5521 | 261.8838 | 71.1319 |
| 22969 | 91.7059 | 258.2040 | 63.3190 | 457.5266 | 115.8489 |
| 18505 | 91.7059 | 112.6400 | 19.3380 | 189.1628 | 54.2937 |
| 7755 | 91.7059 | 39.2520 | 7.6683 | 6.6065 | 34.5529 |
| 19731 | 91.7059 | 719.2800 | 48.0556 | 755.0722 | 490.6361 |
| 4197 | 91.4706 | 136.1840 | 18.8341 | 82.4122 | 31.9984 |
| 19429 | 91.4118 | 3400.9380 | 682.0782 | 1941.4323 | 882.5320 |
| 11714 | 91.4118 | 85.2340 | 25.2796 | 247.3258 | 126.9750 |
| 3250 | 91.4118 | 187.9300 | 11.0272 | 137.4563 | 72.3509 |
| 23338 | 91.3529 | 5599.8240 | 557.8960 | 4352.5030 | 771.4137 |
| 14324 | 91.3529 | 40.9240 | 10.0128 | 17.9795 | 19.9128 |
| 2750 | 91.2941 | 1719.8800 | 85.9817 | 1326.5228 | 563.4849 |
| 12733 | 91.1176 | 25.9460 | 17.5704 | 66.9655 | 24.8429 |
| 23276 | 91.1176 | 2266.6460 | 273.3790 | 1774.1728 | 301.3673 |

TABLE 5O

CLOFIBRATE
Timepoint(s): 24 hrs

| GLGC ID NO. | LDA Score | Mean Tox | SD Tox | Mean Nontox | SD Nontox |
|---|---|---|---|---|---|
| 25370 | 99.8239 | 311.8467 | 14.7162 | 66.7698 | 46.7448 |
| 17758 | 99.8239 | 1484.9367 | 35.5040 | 51.0888 | 212.9279 |
| 15580 | 99.4131 | 3614.5000 | 294.1663 | 940.9705 | 582.1453 |
| 16150 | 99.3545 | 1416.9233 | 129.2865 | 252.2391 | 172.7053 |
| 1858 | 99.3545 | 1456.6233 | 148.6207 | 39.0594 | 191.4676 |
| 16148 | 99.1784 | 2925.9933 | 362.2280 | 478.7869 | 333.3867 |
| 21014 | 99.1784 | 256.7467 | 5.5982 | 829.1977 | 437.6232 |
| 21302 | 99.1784 | 204.1567 | 0.5686 | 168.9794 | 49.0536 |
| 20713 | 99.1197 | 1915.0867 | 359.7308 | 126.8056 | 215.3496 |
| 20711 | 99.1197 | 586.9700 | 149.8880 | 8.3325 | 60.7773 |
| 20715 | 99.1197 | 1310.0800 | 219.5631 | 81.9242 | 135.3678 |
| 18958 | 99.1197 | 307.4900 | 32.8201 | 86.3942 | 68.4554 |
| 18293 | 99.0610 | 2921.4433 | 342.8213 | 645.2560 | 352.8351 |
| 18687 | 99.0610 | 2848.0633 | 174.5659 | 518.2885 | 408.5049 |
| 10538 | 99.0023 | 231.7200 | 37.4664 | 2.0664 | 42.1288 |
| 20714 | 99.0023 | 1509.4933 | 408.6101 | 145.8500 | 174.3141 |
| 15579 | 99.0023 | 2944.3933 | 295.4255 | 588.0808 | 486.2991 |
| 16546 | 98.9437 | 415.7033 | 61.5219 | 97.0600 | 60.4733 |
| 21729 | 98.9437 | 2302.3933 | 281.6638 | 446.2456 | 352.9565 |
| 20555 | 98.9437 | 492.0300 | 70.2561 | 80.4587 | 76.5101 |
| 18686 | 98.9437 | 3137.7533 | 244.7693 | 555.7317 | 460.5067 |
| 1857 | 98.9437 | 1227.1867 | 368.1320 | 24.2703 | 177.2000 |
| 397 | 98.9437 | 164.9133 | 10.9240 | 48.3111 | 50.0019 |
| 20925 | 98.8850 | 1708.2167 | 318.4780 | 222.7321 | 234.3041 |
| 20983 | 98.8850 | 1014.9533 | 151.8518 | 122.5533 | 122.3082 |
| 1977 | 98.8263 | 842.4900 | 80.8425 | 285.7435 | 127.2878 |
| 20380 | 98.8263 | 50.3800 | 2.6850 | 16.8992 | 33.2319 |
| 20856 | 98.7676 | 140.2700 | 26.0010 | 10.4283 | 33.2004 |
| 20986 | 98.7676 | 280.6633 | 55.9224 | 45.7790 | 48.7949 |
| 2009 | 98.7089 | 95.6167 | 15.6032 | 26.7660 | 21.5824 |
| 22602 | 98.7089 | 157.2800 | 24.4252 | −3.8102 | 50.6844 |
| 25024 | 98.7089 | 215.6167 | 0.7975 | 238.9243 | 114.6886 |
| 7756 | 98.6502 | 126.9633 | 51.1648 | 4.2381 | 23.7070 |
| 22603 | 98.5915 | 253.8800 | 35.1630 | 89.7054 | 50.0036 |
| 15411 | 98.5915 | 474.4133 | 68.3408 | 133.1873 | 81.6197 |
| 3512 | 98.5329 | 286.7700 | 20.7478 | 145.5881 | 45.2875 |
| 18957 | 98.5329 | 345.4500 | 75.9671 | 115.6158 | 76.4210 |
| 25139 | 98.5329 | 103.9833 | 38.6077 | 18.5096 | 32.0832 |
| 16721 | 98.5329 | 264.7433 | 23.0703 | 123.0053 | 48.1139 |
| 21078 | 98.4742 | 424.6367 | 72.3067 | 135.1108 | 73.6978 |
| 17516 | 98.4155 | 361.7900 | 33.8513 | 135.6898 | 59.6643 |
| 20554 | 98.4155 | 315.7433 | 39.7215 | 108.3109 | 66.3005 |
| 23699 | 98.3568 | 1662.7767 | 293.6926 | 286.8568 | 287.2334 |
| 23698 | 98.3568 | 1872.3367 | 415.4765 | 195.1894 | 334.5919 |
| 25070 | 98.3568 | 510.4167 | 43.5974 | 170.2965 | 89.7222 |
| 18315 | 98.3568 | 379.2633 | 116.2721 | 53.7338 | 88.1943 |
| 20984 | 98.2981 | 1065.5900 | 314.8301 | 146.2886 | 136.6783 |

TABLE 5O-continued

CLOFIBRATE
Timepoint(s): 24 hrs

| GLGC ID NO. | LDA Score | Mean Tox | SD Tox | Mean Nontox | SD Nontox |
|---|---|---|---|---|---|
| 16527 | 98.2981 | 19.5000 | 0.1389 | 24.8876 | 9.7830 |
| 18174 | 98.2981 | 328.4900 | 10.9222 | 211.3600 | 48.0452 |
| 1715 | 98.2981 | 249.4267 | 9.5596 | 562.4097 | 242.6824 |
| 2006 | 98.2981 | 116.7333 | 20.3078 | 20.3160 | 38.0566 |
| 4290 | 98.2394 | 376.7400 | 36.3953 | 127.9873 | 76.4010 |
| 19053 | 98.2394 | 145.8500 | 40.1692 | 32.0581 | 61.4902 |
| 9931 | 98.1808 | 581.4800 | 85.5557 | 198.2790 | 102.2310 |
| 16807 | 98.1808 | 4542.9433 | 787.8720 | 857.0080 | 678.7946 |
| 3424 | 98.1808 | 55.5300 | 0.4937 | 51.1832 | 20.7301 |
| 18316 | 98.1808 | 513.7133 | 128.4682 | 80.9484 | 119.2604 |
| 26051 | 98.1808 | 92.5167 | 12.7587 | 35.1585 | 16.9151 |
| 17599 | 98.1221 | 51.2267 | 0.6637 | 68.8484 | 35.9760 |
| 1728 | 98.0634 | 583.5767 | 66.8869 | 226.8001 | 87.7289 |
| 16768 | 98.0634 | 569.0667 | 106.0019 | 233.9901 | 83.5077 |
| 17933 | 98.0634 | 670.3333 | 75.5866 | 247.4554 | 132.9788 |
| 2008 | 98.0634 | 167.5833 | 68.6829 | 13.5658 | 42.7014 |
| 25055 | 98.0634 | 557.1800 | 199.4789 | 90.1653 | 157.8776 |
| 17353 | 98.0634 | 103.5400 | 6.9651 | 53.0758 | 38.4569 |
| 16767 | 98.0047 | 729.4433 | 124.8927 | 298.3743 | 110.9879 |
| 12158 | 98.0047 | 558.5433 | 204.2970 | 84.3025 | 159.0230 |
| 1410 | 98.0047 | 64.1433 | 31.5373 | 5.8281 | 11.6490 |
| 21372 | 97.9460 | 136.4133 | 30.5468 | 35.5675 | 25.3046 |
| 21730 | 97.9460 | 390.6233 | 64.7786 | 147.3605 | 65.6999 |
| 15927 | 97.9460 | 123.3700 | 5.9328 | 60.3285 | 22.8563 |
| 2007 | 97.9460 | 158.7933 | 80.3758 | −6.5083 | 47.9151 |
| 18319 | 97.9460 | 220.7733 | 75.4024 | 34.7310 | 56.9464 |
| 14987 | 97.8873 | 1299.8400 | 38.2050 | 847.9103 | 209.1571 |
| 12155 | 97.8873 | 590.8167 | 197.1797 | 81.5618 | 165.4572 |
| 14595 | 97.7700 | 570.5133 | 139.2412 | 108.9367 | 95.7190 |
| 12156 | 97.7700 | 1125.6433 | 397.0994 | 196.2346 | 280.1831 |
| 18083 | 97.7113 | 255.6367 | 52.5636 | 44.2783 | 63.4666 |
| 12157 | 97.7113 | 1353.1700 | 527.7352 | 174.1501 | 351.3879 |
| 12364 | 97.7113 | 338.5867 | 4.8757 | 234.0912 | 72.0455 |
| 15247 | 97.6526 | 346.6833 | 61.0427 | 86.4852 | 65.8812 |
| 17686 | 97.6526 | 1339.5567 | 72.1853 | 796.6160 | 208.1209 |
| 1562 | 97.6526 | 132.1433 | 9.7431 | 321.5717 | 128.6570 |
| 1598 | 97.5939 | 185.8700 | 2.1898 | 282.2793 | 272.7496 |
| 18317 | 97.5939 | 140.9367 | 67.5328 | 1.9712 | 55.2919 |
| 20384 | 97.5939 | 279.7533 | 72.4739 | 103.3865 | 69.6206 |
| 15741 | 97.5939 | 476.2200 | 11.2392 | 334.4652 | 172.5231 |
| 17934 | 97.5352 | 699.5533 | 107.9980 | 282.9463 | 132.3935 |
| 14421 | 97.5352 | 233.6833 | 3.0466 | 296.7079 | 85.2673 |
| 1258 | 97.4765 | 38.0300 | 2.3123 | 5.8578 | 18.8050 |
| 20914 | 97.4765 | 609.3033 | 54.5163 | 194.0376 | 184.9919 |
| 14621 | 97.4765 | 358.4033 | 75.0661 | 185.6716 | 48.4406 |
| 17554 | 97.4178 | 1305.0867 | 199.3923 | 426.8948 | 265.8351 |
| 1058 | 97.3592 | 73.8733 | 3.4902 | 181.3813 | 114.2464 |
| 3439 | 97.3005 | 118.0433 | 19.2757 | 49.2642 | 18.6145 |
| 22918 | 97.3005 | 424.8267 | 105.6679 | 181.3232 | 64.0446 |
| 16305 | 97.3005 | 483.6100 | 29.7459 | 267.5474 | 116.5921 |
| 23625 | 97.2418 | 58.4067 | 4.6581 | 10.0970 | 27.2943 |
| 16930 | 97.1831 | 624.9333 | 8.5900 | 611.6005 | 337.2550 |
| 17421 | 97.1831 | 368.2733 | 31.6143 | 207.7418 | 59.3039 |
| 7123 | 99.8826 | 55.8400 | 0.9998 | −4.1686 | 41.9738 |
| 3519 | 99.8239 | 38.1900 | 4.4612 | 490.3960 | 267.3276 |
| 2813 | 99.7653 | 1096.7600 | 24.1409 | 539.6765 | 206.7517 |
| 12160 | 99.4131 | 1389.3767 | 62.5809 | 337.6827 | 318.4692 |
| 3260 | 99.3545 | 684.5567 | 66.0123 | 198.4989 | 93.1318 |
| 19302 | 99.1784 | 85.4733 | 12.2274 | 16.4792 | 24.4911 |
| 3917 | 99.1197 | 2866.8900 | 148.8604 | 862.1701 | 505.7676 |
| 16533 | 99.1197 | 241.0633 | 1.6043 | 384.1025 | 145.8376 |
| 6380 | 99.0023 | 1430.6733 | 198.7886 | 221.7456 | 171.4922 |
| 6821 | 99.0023 | 284.2100 | 22.1768 | 66.1969 | 72.9430 |
| 22416 | 99.0023 | 674.3833 | 100.0630 | 96.8322 | 90.3434 |
| 3860 | 98.9437 | 896.5467 | 107.3461 | 309.0303 | 129.9294 |
| 5602 | 98.8850 | 928.2033 | 90.6587 | 116.3652 | 146.9399 |
| 6231 | 98.8850 | 57.3500 | 0.4115 | 88.3962 | 40.4889 |
| 16190 | 98.8850 | 835.4533 | 82.7975 | 289.6993 | 126.7727 |
| 21010 | 98.8850 | 1508.1900 | 98.9161 | 745.8994 | 218.4343 |
| 17935 | 98.8850 | 1866.9533 | 173.8040 | 678.9870 | 328.3465 |
| 9196 | 98.8263 | 355.3567 | 9.4751 | 216.7616 | 63.5039 |
| 10909 | 98.7676 | 3162.6233 | 151.9082 | 1845.7547 | 401.2905 |
| 6805 | 98.7676 | 68.7300 | 0.3045 | 60.1948 | 19.7184 |

TABLE 5O-continued

CLOFIBRATE
Timepoint(s): 24 hrs

| GLGC ID NO. | LDA Score | Mean Tox | SD Tox | Mean Nontox | SD Nontox |
|---|---|---|---|---|---|
| 19993 | 98.7089 | 764.1867 | 82.2544 | 317.9153 | 115.1916 |
| 2888 | 98.7089 | 3507.0500 | 243.6588 | 1116.4575 | 603.3123 |
| 14267 | 98.6502 | 1738.6967 | 234.0992 | 634.8278 | 257.1005 |
| 24070 | 98.6502 | 346.2900 | 3.4814 | 479.8097 | 112.9374 |
| 15582 | 98.5915 | 10463.1100 | 3121.3073 | 1627.2295 | 1452.3617 |
| 5887 | 98.5329 | 217.9267 | 84.4135 | 4.4335 | 55.7518 |
| 26109 | 98.5329 | 945.4767 | 284.7551 | 85.3862 | 161.4116 |
| 6473 | 98.4742 | 74.9233 | 2.8917 | 63.1931 | 68.6283 |
| 18962 | 98.4742 | 2826.8400 | 178.8931 | 1315.6841 | 508.2349 |
| 12095 | 98.4742 | 3138.2000 | 758.2331 | 534.9212 | 625.0790 |
| 21355 | 98.4155 | 2073.7667 | 212.6345 | 428.2977 | 439.9687 |
| 12215 | 98.4155 | 267.0167 | 104.2771 | 47.4720 | 45.7414 |
| 21815 | 98.4155 | 670.4867 | 21.7670 | 421.5964 | 117.4892 |
| 22554 | 98.4155 | 657.0567 | 180.7998 | 198.7374 | 147.2395 |
| 18685 | 98.4155 | 102.2067 | 9.8153 | 23.0781 | 28.2075 |
| 18891 | 98.4155 | 519.8067 | 137.2382 | 84.9752 | 97.4413 |
| 3662 | 98.3568 | 171.5067 | 1.3204 | 102.0769 | 110.4175 |
| 23629 | 98.2981 | 370.2900 | 67.7560 | 126.3809 | 52.7398 |
| 3926 | 98.2981 | 373.1767 | 20.1195 | 168.7968 | 74.3529 |
| 18790 | 98.2981 | 151.4167 | 0.9135 | 168.7307 | 61.3388 |
| 2841 | 98.2981 | 374.1467 | 90.0881 | 76.5498 | 60.3917 |
| 16547 | 98.2394 | 1048.9700 | 142.9137 | 353.7458 | 189.8064 |
| 16704 | 98.2394 | 807.1033 | 240.8412 | 160.1485 | 155.1060 |
| 21164 | 98.2394 | 584.4867 | 111.7308 | 232.2055 | 95.0463 |
| 14834 | 98.2394 | 181.2100 | 2.3390 | 120.6343 | 45.2374 |
| 4271 | 98.2394 | 253.0567 | 93.0423 | 42.6125 | 51.3202 |
| 18890 | 98.2394 | 1140.8500 | 394.7012 | 241.0915 | 191.5364 |
| 4196 | 98.2394 | 117.7167 | 51.3730 | −10.8776 | 36.3011 |

TABLE 5P

CPA
Timepoint(s): 3, 6 hrs

| GLGC ID NO. | LDA Score | Mean Tox | SD Tox | Mean Nontox | SD Nontox |
|---|---|---|---|---|---|
| 22412 | 93.5807 | 1127.5593 | 135.6596 | 687.4510 | 451.5874 |
| 11852 | 92.8740 | 63.5175 | 12.4266 | 147.6167 | 54.8840 |
| 17427 | 91.8139 | 288.7758 | 22.3737 | 545.7705 | 232.8601 |
| 21373 | 91.8139 | 62.8538 | 5.1620 | 109.8476 | 48.6611 |
| 21693 | 91.8139 | 350.0607 | 14.3228 | 336.2803 | 137.1833 |
| 10744 | 91.3428 | 11.8537 | 3.3892 | 52.7582 | 48.3445 |
| 15265 | 91.3428 | 698.1018 | 113.4264 | 488.8045 | 114.8047 |
| 15350 | 91.1072 | 140.5443 | 5.2490 | 120.3136 | 42.2019 |
| 17921 | 90.9894 | 57.3560 | 7.7306 | 119.3111 | 66.1701 |
| 923 | 90.8716 | 385.0977 | 58.9354 | 192.3747 | 110.1966 |
| 17304 | 90.7538 | 28.4153 | 4.6158 | 63.4429 | 37.3422 |
| 10743 | 90.4594 | 22.5848 | 3.6659 | 70.5827 | 54.3412 |
| 23249 | 90.2827 | 124.6202 | 36.7508 | 68.4783 | 43.9673 |
| 7395 | 89.8704 | 707.1298 | 29.6068 | 769.5506 | 200.0454 |
| 1466 | 89.6938 | 1789.1223 | 234.4692 | 1258.4357 | 627.4737 |
| 4395 | 89.6938 | 86.0050 | 2.8422 | 96.5399 | 29.5506 |
| 18640 | 89.6349 | 122.8850 | 10.9108 | 171.3774 | 37.3643 |
| 1337 | 89.3993 | 81.5243 | 7.0307 | 119.0836 | 32.3865 |
| 20514 | 89.1637 | 132.8838 | 6.4362 | 108.4319 | 29.0938 |
| 25233 | 89.0459 | 50.0303 | 4.3968 | 75.3696 | 44.1437 |
| 15301 | 88.8987 | 868.4626 | 345.0675 | 265.5803 | 172.5029 |
| 14353 | 88.8693 | 133.1302 | 15.6083 | 95.3744 | 34.8615 |
| 15300 | 88.8398 | 1708.3037 | 686.8036 | 635.0588 | 331.0936 |
| 2134 | 88.8104 | 107.1275 | 4.8931 | 116.4131 | 30.9380 |
| 4487 | 88.4570 | 53.1490 | 5.9876 | 48.8293 | 40.5729 |
| 14970 | 88.1037 | 24.3523 | 8.9594 | 59.2892 | 25.5903 |
| 2078 | 88.1037 | 219.6467 | 8.7928 | 240.6535 | 62.8268 |
| 17815 | 88.1037 | 20.4982 | 2.1789 | 31.8945 | 15.8000 |
| 15801 | 88.1037 | 21.2353 | 2.4151 | 34.8124 | 15.2621 |
| 4002 | 87.9859 | 65.3008 | 5.7888 | 99.8615 | 37.5638 |
| 23248 | 87.9270 | 72.9943 | 19.1606 | 39.8388 | 37.0968 |
| 1390 | 87.8681 | 99.8233 | 25.5902 | 54.8503 | 52.0856 |
| 14138 | 87.8681 | 14.1375 | 5.5560 | 28.8755 | 10.6648 |

TABLE 5P-continued

CPA
Timepoint(s): 3, 6 hrs

| GLGC ID NO. | LDA Score | Mean Tox | SD Tox | Mean Nontox | SD Nontox |
|---|---|---|---|---|---|
| 19472 | 87.8092 | 908.1577 | 62.9893 | 734.8511 | 157.8265 |
| 25430 | 87.6325 | 210.8078 | 15.6788 | 220.6985 | 100.0435 |
| 18617 | 87.5736 | 463.2307 | 47.0050 | 348.8150 | 158.3572 |
| 9428 | 87.5147 | 45.7513 | 4.7585 | 64.3242 | 17.0707 |
| 22413 | 87.4558 | 654.5188 | 131.1352 | 465.2526 | 283.3242 |
| 15083 | 87.3969 | 28.7328 | 3.1989 | 20.5312 | 10.8788 |
| 1567 | 87.2792 | 14.9968 | 2.5137 | 28.3072 | 16.7925 |
| 4003 | 87.2792 | 111.5562 | 16.1788 | 187.1887 | 73.9261 |
| 19381 | 87.2203 | 29.7638 | 6.0615 | 52.0743 | 28.0603 |
| 24783 | 87.1614 | 90.4567 | 4.7331 | 95.3836 | 32.4994 |
| 1598 | 87.1319 | 808.9702 | 303.4781 | 278.2165 | 268.6375 |
| 10098 | 87.0436 | 78.7097 | 3.8361 | 87.0675 | 23.5298 |
| 4450 | 86.8669 | 34.3027 | 7.9808 | 57.3945 | 17.9199 |
| 322 | 86.8080 | 192.3548 | 46.0267 | 168.4940 | 180.1103 |
| 21042 | 86.7491 | 104.1663 | 13.6867 | 65.7023 | 35.3412 |
| 133 | 86.7491 | 116.3353 | 13.3287 | 89.0245 | 73.1417 |
| 764 | 86.7491 | 23.8823 | 2.8761 | 39.4303 | 17.5398 |
| 20026 | 86.7491 | 69.1867 | 4.8564 | 76.9460 | 33.5429 |
| 10509 | 86.6902 | 13.2412 | 4.5900 | 34.7968 | 19.6105 |
| 3858 | 86.5724 | 19.1113 | 1.9848 | 28.3475 | 11.9202 |
| 21707 | 86.5724 | 229.9568 | 32.3462 | 146.0480 | 82.4704 |
| 15054 | 86.2780 | 93.7728 | 13.6184 | 140.4136 | 41.6656 |
| 1063 | 86.2485 | 149.3288 | 44.9457 | 55.2649 | 36.7255 |
| 20357 | 85.9835 | 52.5280 | 3.9112 | 63.0873 | 33.8292 |
| 5747 | 85.9835 | 265.6762 | 13.2182 | 296.5204 | 71.1036 |
| 20799 | 85.9246 | 519.2567 | 22.8434 | 492.3279 | 111.5609 |
| 24861 | 85.9246 | 24.4133 | 5.7195 | 62.7094 | 42.5149 |
| 18716 | 85.9246 | 61.2885 | 4.2598 | 64.5778 | 24.3073 |
| 16249 | 85.8657 | 103.3362 | 35.5373 | 70.2610 | 64.8823 |
| 19702 | 85.8657 | 5.9595 | 3.9737 | 20.5451 | 18.8994 |
| 17382 | 85.8657 | 158.1082 | 37.8933 | 276.3096 | 104.0833 |
| 12041 | 85.8657 | 326.1800 | 18.7156 | 288.0394 | 73.1620 |
| 15360 | 85.8068 | 166.3585 | 10.1641 | 192.4487 | 61.8643 |
| 18349 | 85.6890 | 305.0238 | 52.5981 | 223.2757 | 92.4045 |
| 961 | 85.6890 | 150.7850 | 47.4763 | 282.6609 | 119.6223 |
| 16468 | 85.6890 | 502.2205 | 32.5844 | 519.8535 | 169.0701 |
| 5317 | 85.5713 | 588.6635 | 59.8739 | 693.5204 | 480.0899 |
| 15740 | 85.5713 | 114.0592 | 45.7053 | 352.6048 | 227.2514 |
| 9896 | 85.5713 | 767.0785 | 32.5212 | 746.0632 | 176.1830 |
| 22918 | 85.5124 | 134.5270 | 12.0650 | 182.5143 | 65.8373 |
| 19050 | 85.5124 | 79.4268 | 6.3404 | 80.9097 | 30.0720 |
| 6892 | 85.5124 | 65.4438 | 4.7027 | 76.2795 | 28.6106 |
| 4574 | 85.5124 | 265.1087 | 25.8686 | 326.7819 | 129.1273 |
| 11384 | 85.4535 | 21.0497 | 5.0728 | 31.7264 | 8.8003 |
| 17204 | 85.4535 | 869.0613 | 78.3640 | 1023.5516 | 269.4653 |
| 3865 | 85.4535 | 90.2352 | 6.2610 | 83.3816 | 28.3369 |
| 16385 | 85.4535 | 52.6325 | 5.2521 | 65.0346 | 24.1396 |
| 2830 | 85.4535 | 139.2768 | 8.3344 | 176.1853 | 42.4611 |
| 17997 | 85.3357 | 32.1122 | 5.3518 | 49.7896 | 24.1812 |
| 15421 | 85.2768 | 312.7872 | 38.4804 | 420.8782 | 91.2034 |
| 1813 | 85.2473 | 190.3855 | 53.4867 | 51.5203 | 63.9436 |
| 16237 | 85.2179 | 31.9697 | 3.7499 | 41.3731 | 21.4588 |
| 9929 | 85.1001 | 115.7317 | 27.7917 | 230.7509 | 125.9464 |
| 15299 | 85.0707 | 1021.7645 | 493.2505 | 391.1357 | 305.0813 |
| 23058 | 85.0412 | 10.2483 | 3.3435 | 20.5299 | 10.5735 |
| 1859 | 85.0412 | 24.7162 | 7.1411 | 44.8545 | 25.7765 |
| 15065 | 85.0412 | 1626.4242 | 51.6739 | 1533.4387 | 237.0429 |
| 25701 | 84.9823 | 62.5983 | 7.3026 | 87.8287 | 26.0931 |
| 17119 | 84.9823 | 36.1155 | 4.5865 | 58.4534 | 27.5581 |
| 1977 | 84.9234 | 144.8638 | 52.7220 | 288.7064 | 131.1712 |
| 16562 | 84.9234 | 85.9415 | 25.0402 | 147.7955 | 50.5242 |
| 13682 | 84.9234 | 379.1212 | 27.6433 | 367.5142 | 117.4440 |
| 409 | 84.8645 | 42.7907 | 3.7695 | 57.9804 | 18.0765 |
| 15620 | 84.8057 | 35.5610 | 6.9256 | 60.0280 | 25.6311 |
| 22822 | 84.7468 | 429.1208 | 51.0752 | 551.2440 | 112.0350 |
| 6505 | 84.7468 | 291.3338 | 28.0623 | 371.3828 | 107.5898 |
| 15186 | 84.7468 | 91.2365 | 7.3397 | 114.4785 | 42.6276 |
| 12241 | 96.0542 | 188.2453 | 27.1001 | 71.8070 | 54.5590 |
| 23538 | 95.6419 | 898.4440 | 418.9555 | 355.3445 | 204.9339 |
| 23104 | 95.5241 | 110.2058 | 21.6092 | 37.4120 | 41.0414 |
| 4917 | 95.5241 | 56.0450 | 3.5156 | 111.4324 | 48.2444 |
| 18271 | 94.9352 | 63.3168 | 16.0896 | 182.3116 | 80.0464 |
| 10641 | 94.6996 | 247.5530 | 29.4475 | 140.2629 | 58.0238 |

TABLE 5P-continued

CPA
Timepoint(s): 3, 6 hrs

| GLGC ID NO. | LDA Score | Mean Tox | SD Tox | Mean Nontox | SD Nontox |
|---|---|---|---|---|---|
| 2702 | 94.3463 | 1215.2992 | 103.7984 | 818.6211 | 297.5347 |
| 17419 | 94.3463 | 575.1595 | 22.9764 | 396.6882 | 122.9476 |
| 15229 | 93.6396 | 28.8687 | 11.4505 | −0.2550 | 17.4502 |
| 15553 | 93.4629 | 612.6315 | 72.3804 | 416.0397 | 109.1771 |
| 6284 | 93.4040 | 22.9415 | 3.9528 | 46.2227 | 19.0673 |
| 12482 | 93.2273 | 40.7012 | 2.4657 | 60.8810 | 57.2533 |
| 8132 | 93.2273 | 254.5405 | 10.4483 | 184.5154 | 53.7274 |
| 2809 | 92.9329 | 142.8957 | 27.7012 | 84.6133 | 31.1948 |
| 9712 | 92.6384 | 33.2257 | 7.2070 | 85.4964 | 42.9667 |
| 5203 | 92.6384 | 54.9182 | 3.3346 | 79.2144 | 24.9854 |
| 3356 | 92.2261 | 566.2232 | 18.4679 | 468.5973 | 150.6453 |
| 9277 | 91.8728 | 199.2807 | 17.4186 | 134.7743 | 41.9742 |
| 22084 | 91.5783 | 70.5940 | 6.6385 | 111.5554 | 34.5551 |
| 10090 | 91.5783 | 3.1720 | 9.6298 | 49.5668 | 33.2090 |
| 18574 | 91.5783 | 214.7955 | 11.1944 | 279.2698 | 51.9580 |
| 18390 | 91.4605 | 7.5762 | 3.7336 | 34.6263 | 20.8933 |
| 22210 | 91.2250 | 755.6450 | 103.7570 | 530.5854 | 130.2167 |
| 19938 | 90.8127 | 788.2693 | 98.4764 | 528.5212 | 141.7086 |
| 17618 | 90.6360 | 123.8568 | 4.0646 | 149.6395 | 32.8621 |
| 7111 | 90.6360 | 207.9167 | 15.0404 | 273.7780 | 52.0534 |
| 22416 | 90.5771 | 30.7443 | 8.8503 | 99.3401 | 96.7307 |
| 20620 | 90.2827 | 37.6255 | 4.1899 | 57.1850 | 28.6997 |
| 6454 | 90.1060 | 631.0925 | 48.3969 | 469.2270 | 105.7770 |
| 12731 | 90.0471 | 254.0265 | 58.9735 | 102.1312 | 103.9434 |
| 11446 | 89.9882 | 660.0192 | 85.5647 | 491.5924 | 107.3364 |
| 23350 | 89.9882 | 189.9230 | 9.3693 | 225.2275 | 56.0363 |
| 18235 | 89.8704 | 64.0578 | 6.9852 | 93.0946 | 25.2113 |
| 11502 | 89.8704 | 669.0290 | 48.2972 | 887.8573 | 198.8849 |
| 26064 | 89.8704 | 167.9388 | 6.8488 | 191.1827 | 73.7287 |
| 12616 | 89.7527 | 16.0208 | 3.0191 | 28.8799 | 18.9245 |
| 13129 | 89.6938 | 35.4065 | 2.9943 | 34.6713 | 25.5884 |
| 19995 | 89.6349 | 22.4903 | 5.4530 | 32.3832 | 63.5385 |
| 16088 | 89.6349 | 131.1570 | 11.1411 | 182.5977 | 48.5917 |
| 5494 | 89.5171 | 218.2197 | 33.9335 | 142.3331 | 68.6098 |
| 7414 | 89.4582 | 839.2802 | 82.2847 | 620.4140 | 162.1681 |
| 22415 | 89.3993 | 3778.0120 | 742.8499 | 2120.6600 | 1254.2668 |
| 4916 | 89.3993 | 17.5637 | 6.9990 | 53.9860 | 28.8164 |
| 20687 | 89.3404 | 140.5003 | 17.5675 | 238.0900 | 89.8516 |
| 9475 | 89.3404 | 68.9792 | 21.7701 | 175.2288 | 86.6938 |
| 9983 | 89.3404 | 71.8940 | 3.7545 | 94.4446 | 27.0007 |
| 15938 | 89.2815 | 113.2452 | 10.6076 | 158.1012 | 38.4451 |
| 22443 | 89.2815 | 233.1810 | 30.7187 | 166.9082 | 123.6661 |
| 17632 | 89.2226 | 123.3417 | 9.4991 | 85.4347 | 35.9971 |
| 24288 | 89.2226 | 61.4605 | 6.4906 | 39.3367 | 18.9636 |
| 24070 | 89.2226 | 530.1833 | 22.4547 | 478.9819 | 113.3202 |
| 22056 | 89.2226 | 1802.8800 | 91.5507 | 1909.3581 | 481.5938 |
| 14449 | 89.1637 | 15.9823 | 2.0429 | 22.8692 | 19.3368 |
| 16338 | 89.0459 | 170.5025 | 21.8708 | 115.0753 | 40.6387 |
| 16053 | 89.0459 | 709.9675 | 103.3186 | 460.3173 | 203.1860 |
| 6898 | 88.9870 | 80.0023 | 3.4948 | 94.1351 | 31.2348 |
| 7724 | 88.9870 | 107.7635 | 9.5625 | 88.3169 | 33.5861 |
| 14589 | 88.9282 | 347.9898 | 32.4203 | 294.5916 | 141.4829 |
| 7224 | 88.8693 | 516.9022 | 35.6486 | 462.2831 | 167.1778 |
| 11732 | 88.8104 | 23.3618 | 5.7022 | 7.3092 | 14.2492 |
| 22453 | 88.7515 | 59.6845 | 12.4937 | 94.5985 | 26.7784 |
| 18156 | 88.7515 | 49.8368 | 3.9268 | 62.1932 | 40.3136 |
| 9588 | 88.6337 | 26.8055 | 9.6616 | −20.3271 | 35.3081 |
| 23852 | 88.6337 | 82.1110 | 40.0930 | 205.3185 | 84.4766 |
| 15172 | 88.5159 | 493.7010 | 36.1240 | 393.6016 | 114.6133 |
| 6329 | 88.4570 | 2439.2237 | 168.3088 | 2293.0474 | 1070.4157 |
| 18932 | 88.4570 | 22.4808 | 6.2624 | 50.8212 | 28.2685 |
| 3201 | 88.3981 | 119.6852 | 11.3115 | 96.3528 | 45.2290 |
| 20553 | 88.3392 | 106.6995 | 23.5750 | 180.7033 | 49.8297 |
| 11525 | 88.3392 | 186.3997 | 16.6302 | 255.8760 | 62.4409 |
| 15577 | 88.3392 | 1522.2555 | 88.3661 | 1442.1552 | 441.5868 |
| 23456 | 88.2803 | 115.3662 | 15.6595 | 167.3335 | 45.3647 |
| 7745 | 88.2803 | 317.2235 | 31.0554 | 279.5446 | 136.6239 |
| 5683 | 88.2214 | 138.1932 | 14.3435 | 96.5277 | 32.0377 |
| 17680 | 88.1625 | 1419.5577 | 138.0836 | 1004.1005 | 317.1966 |

TABLE 5Q

DICLOFENAC
Timepoint(s): 24 hrs

| GLGC ID NO. | LDA Score | Mean Tox | SD Tox | Mean Nontox | SD Nontox |
|---|---|---|---|---|---|
| 16108 | 99.9413 | 262.6767 | 9.4241 | 130.6255 | 26.0670 |
| 12788 | 99.8826 | 105.2200 | 4.0654 | 12.2412 | 22.3975 |
| 19831 | 99.7653 | 295.4533 | 15.2742 | 107.0780 | 30.8440 |
| 18468 | 99.7653 | 217.3300 | 4.9501 | 66.8071 | 47.1252 |
| 15487 | 99.7066 | 184.3267 | 4.5509 | 92.4424 | 31.3691 |
| 16416 | 99.7066 | 709.8500 | 13.7428 | 276.3873 | 105.4039 |
| 23949 | 99.6479 | 176.0833 | 38.1087 | 58.2929 | 15.1933 |
| 16109 | 99.6479 | 682.0967 | 59.0879 | 296.5891 | 83.3425 |
| 15087 | 99.5892 | 318.6133 | 2.5647 | 185.2999 | 49.1941 |
| 18060 | 99.5892 | 266.0167 | 1.7936 | 173.9308 | 38.3627 |
| 14332 | 99.5892 | 28.7667 | 0.8303 | 84.9370 | 51.2555 |
| 6968 | 99.5305 | 66.6400 | 6.3804 | 154.9307 | 34.0216 |
| 24196 | 99.4718 | 112.6067 | 9.9714 | 18.3402 | 17.2368 |
| 1466 | 99.4718 | 6214.3233 | 1170.1373 | 1244.7227 | 551.9550 |
| 17517 | 99.4718 | 2260.9667 | 370.7248 | 546.9565 | 147.2898 |
| 15154 | 99.4131 | 1284.3433 | 191.0028 | 480.7099 | 162.7620 |
| 15932 | 99.4131 | 349.2267 | 45.3397 | 135.5688 | 34.0779 |
| 17884 | 99.4131 | 279.5433 | 29.3035 | 118.3868 | 31.6189 |
| 7602 | 99.4131 | 1032.7867 | 142.8627 | 348.3716 | 91.9344 |
| 1624 | 99.4131 | 54.1900 | 5.1738 | 138.4919 | 34.2813 |
| 699 | 99.3545 | 131.5100 | 6.9219 | 344.7215 | 110.0629 |
| 24195 | 99.3545 | 78.4000 | 22.0253 | −3.9721 | 16.7872 |
| 6362 | 99.3545 | 181.6467 | 14.9433 | 76.0896 | 29.2703 |
| 11493 | 99.2958 | 320.1867 | 37.4460 | 32.9403 | 50.8959 |
| 9527 | 99.2371 | 6.8200 | 0.3297 | 27.5534 | 16.0898 |
| 10306 | 99.1784 | 2096.3300 | 361.0449 | 648.5352 | 224.3538 |
| 20719 | 99.1784 | 338.1467 | 84.5782 | 99.3377 | 30.7008 |
| 17885 | 99.1197 | 725.6833 | 136.3395 | 247.3416 | 69.8406 |
| 20735 | 99.1197 | 2313.2267 | 163.4511 | 1011.4493 | 340.3786 |
| 19326 | 99.0610 | 359.8633 | 58.0325 | 149.9240 | 42.1937 |
| 16119 | 99.0023 | 19.9767 | 0.2359 | 57.3351 | 35.3164 |
| 18327 | 99.0023 | 166.8700 | 25.9027 | 51.8620 | 21.2571 |
| 20600 | 99.0023 | 35.6167 | 5.7810 | 212.9031 | 192.2030 |
| 22739 | 98.9437 | 237.2733 | 14.8159 | 115.1230 | 33.3217 |
| 18469 | 98.9437 | 112.4967 | 13.9007 | 33.4491 | 17.5752 |
| 23950 | 98.9437 | 236.4933 | 43.1258 | 86.7057 | 22.8829 |
| 1571 | 98.8850 | 1172.5900 | 51.5007 | 575.1040 | 170.4750 |
| 16367 | 98.8850 | 169.9700 | 14.5836 | 623.7902 | 286.8608 |
| 21103 | 98.8850 | 389.5233 | 60.7115 | 177.3793 | 49.3847 |
| 5655 | 98.8850 | 91.5233 | 10.3413 | 22.7893 | 21.0442 |
| 1973 | 98.8850 | 73.2533 | 27.3053 | 264.5682 | 75.3572 |
| 25652 | 98.8850 | 104.4100 | 44.6306 | 18.0562 | 11.2892 |
| 24536 | 98.8263 | 3684.5567 | 721.3126 | 1387.2326 | 425.2253 |
| 24665 | 98.8263 | 557.3000 | 152.8151 | 107.6067 | 74.9965 |
| 5656 | 98.8263 | 96.8667 | 12.7698 | 39.2514 | 12.2985 |
| 20443 | 98.8263 | 275.0333 | 28.2966 | 135.9470 | 37.3178 |
| 24885 | 98.7676 | 3258.2800 | 68.1985 | 2076.6222 | 502.2023 |
| 7096 | 98.7676 | 156.6833 | 16.3696 | 58.3153 | 24.0875 |
| 25260 | 98.7676 | 199.5767 | 39.2803 | 63.9379 | 27.9105 |
| 1598 | 98.7089 | 2261.2200 | 522.0235 | 274.9718 | 244.7970 |
| 11494 | 98.7089 | 949.9200 | 211.0720 | 167.7890 | 137.5266 |
| 11153 | 98.7089 | 105.8933 | 13.4936 | 277.4587 | 83.7212 |
| 21102 | 98.7089 | 220.8600 | 56.5936 | 61.6536 | 23.1949 |
| 765 | 98.7089 | −8.6333 | 4.7498 | 22.1721 | 14.7762 |
| 25691 | 98.5915 | 3766.8633 | 181.3287 | 2251.5785 | 450.5015 |
| 20803 | 98.5915 | 551.2900 | 1.3097 | 522.7399 | 128.0870 |
| 20994 | 98.5915 | 345.5267 | 24.6122 | 158.5445 | 59.3910 |
| 25313 | 98.5329 | 442.6467 | 160.0461 | 183.8938 | 63.1301 |
| 1058 | 98.5329 | 29.9100 | 12.7890 | 181.5361 | 114.0689 |
| 19781 | 98.4742 | 9.8767 | 0.5561 | 36.4140 | 25.2147 |
| 18069 | 98.4742 | 141.5800 | 37.5591 | 27.6363 | 24.0765 |
| 16825 | 98.4742 | 196.6367 | 63.3572 | 45.4445 | 23.1327 |
| 18647 | 98.4742 | 1543.4200 | 350.1783 | 442.8530 | 210.3097 |
| 21707 | 98.4742 | 480.3600 | 100.2809 | 145.4618 | 80.0949 |
| 3512 | 98.4155 | 276.2100 | 16.8023 | 145.6253 | 45.4029 |
| 11210 | 98.4155 | 122.4367 | 19.3103 | 37.5813 | 18.6018 |
| 2367 | 98.4155 | 104.8400 | 7.6764 | 207.7478 | 53.5412 |
| 20734 | 98.4155 | 1981.3667 | 106.5315 | 965.1727 | 333.4310 |
| 22903 | 98.4155 | 323.6200 | 8.3818 | 206.5544 | 53.3563 |
| 15281 | 98.3568 | 1092.1567 | 200.9835 | 544.4340 | 173.1754 |
| 17657 | 98.3568 | 116.9633 | 37.5118 | 24.8545 | 25.6083 |
| 20601 | 98.3568 | 97.5500 | 21.0673 | 381.6790 | 303.8763 |
| 463 | 98.2981 | 83.1433 | 7.4122 | 41.1223 | 13.3364 |

TABLE 5Q-continued

DICLOFENAC
Timepoint(s): 24 hrs

| GLGC ID NO. | LDA Score | Mean Tox | SD Tox | Mean Nontox | SD Nontox |
|---|---|---|---|---|---|
| 18578 | 98.2981 | 37.6767 | 5.2853 | 137.7602 | 102.2865 |
| 23282 | 98.2981 | 903.4667 | 161.1567 | 432.6129 | 89.8193 |
| 15933 | 98.2981 | 383.1667 | 73.4013 | 173.1382 | 42.1212 |
| 23274 | 98.2981 | 1319.6833 | 39.2758 | 947.7594 | 180.8513 |
| 11152 | 98.2981 | 17.4733 | 6.9543 | 96.9594 | 45.7025 |
| 1858 | 98.2981 | 296.3200 | 109.0061 | 43.1450 | 208.6092 |
| 1869 | 98.2394 | 80.2433 | 14.5395 | 703.9560 | 394.0265 |
| 23248 | 98.2394 | 214.3833 | 84.2552 | 39.4577 | 35.4542 |
| 9254 | 98.2394 | 45.0433 | 5.7977 | 104.3503 | 30.1113 |
| 8097 | 98.2394 | 1960.3533 | 223.1961 | 1036.8306 | 273.1629 |
| 18726 | 98.1221 | 58.9367 | 6.6889 | 194.6925 | 85.2564 |
| 17634 | 98.1221 | −9.0567 | 5.1344 | 83.4851 | 63.7521 |
| 1070 | 98.1221 | 73.6467 | 32.0118 | −2.9400 | 15.5261 |
| 17916 | 98.0634 | 135.1533 | 16.6003 | 63.5390 | 19.5113 |
| 659 | 98.0634 | 98.8300 | 10.1501 | 43.0532 | 16.6373 |
| 8829 | 98.0634 | 1723.2833 | 319.9892 | 775.8092 | 221.8899 |
| 3131 | 98.0047 | 31.7667 | 3.7346 | 102.0925 | 52.6305 |
| 8592 | 98.0047 | 70.3300 | 8.6944 | 153.6617 | 49.8128 |
| 8898 | 97.9460 | 495.6567 | 36.2144 | 872.7606 | 191.6260 |
| 19942 | 97.9460 | 318.8033 | 56.2034 | 146.0960 | 41.9082 |
| 13543 | 97.9460 | 582.3767 | 98.5960 | 320.5599 | 69.7998 |
| 25513 | 97.8873 | 3112.2933 | 1717.2420 | 754.4806 | 282.0908 |
| 26033 | 97.8873 | 134.2867 | 37.6508 | 13.2036 | 33.0809 |
| 18430 | 97.8873 | 291.5600 | 122.2924 | 71.9104 | 41.8628 |
| 17378 | 97.8873 | 630.6667 | 215.8998 | 218.2343 | 67.5782 |
| 2744 | 97.8873 | 643.8033 | 187.0776 | 314.1227 | 83.8839 |
| 15189 | 97.8286 | 11711.3967 | 1685.4384 | 3855.1649 | 2027.8392 |
| 8062 | 99.8826 | 220.4833 | 11.5721 | 501.1573 | 93.3942 |
| 7584 | 99.8826 | 46.9800 | 40.9716 | 568.5319 | 306.3005 |
| 9259 | 99.7653 | 53.6733 | 2.7703 | 13.1555 | 14.6680 |
| 16756 | 99.7066 | 1286.0133 | 30.7180 | 665.5618 | 128.7828 |
| 10308 | 99.5892 | 2296.4000 | 118.4885 | 1175.1734 | 275.6680 |
| 6005 | 99.5892 | 591.2200 | 25.7498 | 1475.1649 | 307.9363 |
| 16063 | 99.5892 | 272.2167 | 22.5764 | 97.4105 | 49.4760 |
| 18417 | 99.5892 | 1076.9667 | 153.9791 | 333.7123 | 152.3269 |
| 8167 | 99.5305 | 765.0067 | 9.2115 | 433.4956 | 172.4484 |
| 15900 | 99.5305 | 923.1633 | 56.8189 | 426.9497 | 90.3111 |
| 23320 | 99.5305 | 30.4267 | 26.3660 | 293.2477 | 93.6614 |
| 10446 | 99.4718 | 174.9900 | 4.5640 | 56.4811 | 48.4426 |
| 17887 | 99.4718 | 268.6433 | 17.8188 | 551.7264 | 116.6793 |
| 6392 | 99.4131 | 738.0133 | 69.8306 | 327.1317 | 71.4237 |
| 17768 | 99.4131 | 1571.4367 | 238.8069 | 598.5951 | 140.7505 |
| 18565 | 99.3545 | 58.2767 | 9.9327 | 268.1059 | 110.9410 |
| 23824 | 99.2958 | 731.9400 | 73.1746 | 282.7541 | 85.4782 |
| 23162 | 99.2958 | 32.0067 | 12.8015 | 420.7301 | 302.0449 |
| 13461 | 99.2958 | 236.4100 | 24.6253 | 27.3512 | 33.6029 |
| 16905 | 99.2958 | 1.3467 | 1.8068 | 59.3420 | 29.6663 |
| 11502 | 99.2371 | 394.1267 | 30.2032 | 888.0548 | 197.2449 |
| 24338 | 99.2371 | 126.2800 | 3.8211 | 238.9567 | 49.2417 |
| 3875 | 99.2371 | 229.2767 | 0.7414 | 176.4909 | 42.1222 |
| 23370 | 99.2371 | 2.9867 | 3.6322 | 137.0977 | 74.6839 |
| 2750 | 99.1784 | 4545.3433 | 1188.5866 | 1317.4974 | 527.0546 |
| 1506 | 99.1197 | 1341.1133 | 401.1156 | 425.0811 | 88.1039 |
| 4952 | 99.1197 | 3111.8967 | 570.5449 | 930.6166 | 350.7298 |
| 19271 | 99.1197 | 633.3433 | 35.5834 | 278.9459 | 94.9226 |
| 16253 | 99.1197 | 39.6467 | 37.9096 | 290.2083 | 79.6585 |
| 16 | 99.1197 | 34.8900 | 30.3617 | 329.5752 | 130.2743 |
| 23159 | 99.1197 | 840.3633 | 738.5439 | 566.6281 | 277.2732 |
| 23076 | 99.0610 | 686.8900 | 67.5499 | 304.6201 | 87.1310 |
| 13029 | 99.0610 | 74.7267 | 4.0795 | 185.9500 | 64.3329 |
| 8775 | 99.0610 | 183.4767 | 19.8248 | 77.4781 | 23.7123 |
| 11465 | 99.0610 | −1.2800 | 20.1586 | 154.6933 | 79.1419 |
| 6479 | 99.0023 | 76.8267 | 7.8311 | 422.7819 | 208.9902 |
| 24375 | 99.0023 | 945.6167 | 40.8373 | 513.2084 | 155.0174 |
| 2296 | 99.0023 | 130.9300 | 14.2069 | 478.2559 | 182.7008 |
| 18650 | 99.0023 | 8784.9833 | 2859.2117 | 1791.0108 | 833.1561 |
| 2639 | 99.0023 | −2.7933 | 6.8981 | 146.4013 | 77.7145 |
| 18696 | 99.0023 | 46.5533 | 40.5799 | 236.0620 | 58.1105 |
| 23015 | 98.9437 | 88.9733 | 18.4162 | 9.0373 | 22.6441 |
| 18996 | 98.9437 | 75.5933 | 11.1745 | 206.7382 | 65.4538 |
| 6615 | 98.9437 | −28.2467 | 9.9820 | 74.8563 | 77.3219 |
| 5157 | 98.9437 | 2.3333 | 2.1808 | 39.0753 | 17.7202 |
| 9796 | 98.8850 | 218.1300 | 2.4483 | 123.7953 | 56.4548 |
| 18649 | 98.8850 | 579.9267 | 165.2774 | 119.2347 | 73.0703 |
| 14388 | 98.8850 | 1.5500 | 9.3881 | 121.0299 | 48.5354 |
| 17647 | 98.8850 | 18.5067 | 3.1696 | 57.5042 | 20.2955 |
| 21766 | 98.8850 | 22.8967 | 22.9000 | 152.0058 | 48.1511 |
| 23369 | 98.8850 | −20.3967 | 18.0798 | 131.7584 | 80.3646 |
| 24229 | 98.8263 | 219.3200 | 55.1317 | 1969.0252 | 1246.5959 |
| 4179 | 98.8263 | 615.1967 | 330.3182 | 257.0174 | 78.2319 |
| 9546 | 98.7676 | 119.3600 | 2.3157 | 189.2764 | 48.5388 |

TABLE 5R

DICLOFENAC
Timepoint(s): 3, 6 hrs

| GLGC ID NO. | LDA Score | Mean Tox | SD Tox | Mean Nontox | SD Nontox |
|---|---|---|---|---|---|
| 15997 | 98.0588 | 826.0340 | 59.0069 | 288.2524 | 215.5546 |
| 4843 | 97.3529 | 171.4200 | 5.7703 | 270.8865 | 61.1961 |
| 21423 | 97.2353 | 767.1960 | 3.3008 | 837.8807 | 180.4670 |
| 16982 | 97.0000 | 5283.9420 | 1607.9535 | 1604.3032 | 936.2529 |
| 15995 | 96.5294 | 554.2340 | 54.8668 | 230.5582 | 172.2650 |
| 3562 | 96.4706 | 31.7660 | 3.2035 | 15.2120 | 11.6375 |
| 6535 | 95.5294 | 244.6100 | 5.2007 | 319.3652 | 65.6488 |
| 23716 | 95.3529 | 125.2560 | 20.6795 | 69.9142 | 23.2349 |
| 16825 | 95.2941 | 105.0640 | 30.7344 | 45.6274 | 24.5193 |
| 409 | 95.1176 | 49.8340 | 0.7321 | 57.9211 | 18.1022 |
| 15642 | 94.7647 | 1667.7720 | 237.8846 | 928.0718 | 322.7991 |
| 15437 | 94.3529 | 38.3060 | 9.6020 | 15.0678 | 13.0954 |
| 20714 | 93.9412 | 193.3060 | 14.3504 | 150.3837 | 193.3552 |
| 803 | 93.8824 | 1490.3960 | 277.2356 | 698.1026 | 358.7400 |
| 15956 | 93.8235 | 79.6120 | 5.1388 | 132.9290 | 46.4166 |
| 25701 | 93.4706 | 50.7440 | 5.4983 | 87.8688 | 26.0119 |
| 16844 | 93.2941 | 535.9560 | 20.7578 | 794.7663 | 275.2608 |
| 4647 | 93.1765 | 110.5720 | 15.7483 | 213.8609 | 64.1971 |
| 619 | 93.1176 | 34.8560 | 4.2013 | 98.4216 | 66.1255 |
| 764 | 93.1176 | 23.5260 | 1.3006 | 39.4141 | 17.5368 |
| 15050 | 93.0000 | 266.1380 | 7.0540 | 291.6265 | 64.7396 |
| 7898 | 92.9412 | 4403.5940 | 356.9157 | 3210.8833 | 1139.2300 |
| 22646 | 92.7647 | 128.8320 | 7.2978 | 171.8450 | 65.2188 |
| 16901 | 92.7059 | 81.2320 | 14.8642 | 166.2463 | 71.1474 |
| 24423 | 92.5294 | 28.0960 | 5.1840 | 59.9372 | 32.5082 |
| 1285 | 92.2941 | 57.0920 | 6.7314 | 103.8595 | 35.7669 |
| 16683 | 92.2353 | 215.6160 | 12.7928 | 293.6630 | 83.3773 |
| 18078 | 92.1176 | 13.9440 | 5.6452 | 49.8211 | 33.5197 |
| 17148 | 92.0588 | 4046.1240 | 582.7279 | 2107.7443 | 1194.3925 |
| 20467 | 92.0588 | 34.8760 | 3.3449 | 11.9471 | 20.7112 |
| 1797 | 92.0000 | 1285.7880 | 256.0118 | 582.0526 | 480.9576 |
| 804 | 91.9412 | 1677.1100 | 257.0225 | 990.9331 | 375.1230 |
| 15115 | 91.9412 | 46.3800 | 1.7899 | 59.9389 | 19.0711 |
| 1727 | 91.8235 | 803.9620 | 121.0124 | 423.6740 | 287.1111 |
| 16836 | 91.4706 | 90.4640 | 5.8017 | 124.3075 | 27.2421 |
| 354 | 91.4118 | 851.4500 | 161.0263 | 511.2026 | 322.4322 |
| 21980 | 91.4118 | 132.1880 | 8.0094 | 185.6866 | 49.5955 |
| 24205 | 91.3529 | 35.0700 | 11.6433 | 73.0909 | 23.8926 |
| 24707 | 91.2941 | 270.2980 | 42.9794 | 179.3491 | 101.2649 |
| 23213 | 91.2941 | 9.7320 | 3.5110 | 30.4460 | 15.9136 |
| 2012 | 91.2353 | 53.6220 | 10.9376 | 116.7216 | 43.8181 |
| 18209 | 91.2353 | 123.6600 | 8.4619 | 173.5175 | 51.8796 |
| 8267 | 91.1176 | 232.4960 | 42.0362 | 239.6952 | 294.4274 |
| 1031 | 91.1176 | 15.3760 | 2.7154 | 32.8070 | 15.5966 |
| 20849 | 91.0588 | 407.9500 | 19.8822 | 521.9688 | 141.6467 |
| 19411 | 91.0588 | 42.3540 | 1.9420 | 36.9832 | 14.3037 |
| 17147 | 91.0000 | 3311.7880 | 514.8764 | 1697.0607 | 964.8008 |
| 21800 | 91.0000 | 41.5840 | 11.7546 | 84.7011 | 26.9030 |
| 7459 | 90.8824 | 2186.5640 | 351.2291 | 1490.9951 | 427.3068 |
| 20082 | 90.8824 | 701.9300 | 82.3412 | 453.9414 | 166.6937 |
| 2013 | 90.8824 | 8.5880 | 7.2691 | 53.8190 | 35.6289 |
| 20700 | 90.8824 | 3895.1080 | 214.2973 | 3023.2394 | 1101.1035 |
| 8268 | 90.7647 | 445.5080 | 130.0038 | 385.7590 | 495.4453 |

TABLE 5R-continued

DICLOFENAC
Timepoint(s): 3, 6 hrs

| GLGC ID NO. | LDA Score | Mean Tox | SD Tox | Mean Nontox | SD Nontox |
|---|---|---|---|---|---|
| 11153 | 90.7059 | 196.8420 | 11.6490 | 277.3274 | 84.2096 |
| 1804 | 90.6471 | 9842.6460 | 1999.5708 | 6177.5933 | 2275.0163 |
| 8266 | 90.6471 | 2769.4120 | 236.9014 | 2077.0665 | 956.9428 |
| 25681 | 90.4706 | 6266.0780 | 588.7647 | 4419.9264 | 1287.5265 |
| 18142 | 90.2941 | 4775.1940 | 826.5869 | 3111.3518 | 1001.5151 |
| 8269 | 90.2941 | 373.3020 | 96.8474 | 335.8584 | 373.0083 |
| 21905 | 90.2941 | 41.3340 | 0.9663 | 48.1480 | 12.0710 |
| 16274 | 90.2353 | 5973.9420 | 591.2444 | 4181.5126 | 1399.0804 |
| 21115 | 90.1176 | 113.6260 | 44.0196 | 40.2685 | 45.8280 |
| 1973 | 90.0588 | 157.9380 | 26.0719 | 264.5202 | 75.8486 |
| 23368 | 90.0000 | 10.0920 | 4.3366 | 42.3814 | 35.1663 |
| 10499 | 89.9412 | 40.1980 | 2.0628 | 34.6105 | 22.6457 |
| 1801 | 89.8824 | 136.5820 | 12.9346 | 101.4897 | 28.4994 |
| 16210 | 89.8824 | 126.2400 | 15.5000 | 195.8952 | 51.3143 |
| 17374 | 89.8824 | 141.0000 | 10.6360 | 198.2308 | 49.9360 |
| 4010 | 89.8235 | 1750.3140 | 481.7182 | 779.0223 | 546.1410 |
| 16963 | 89.5294 | 9365.1780 | 1170.0742 | 6138.1053 | 2562.4978 |
| 15367 | 89.4706 | 103.8940 | 51.0395 | 228.4754 | 75.8962 |
| 10660 | 89.3529 | 84.7740 | 9.9643 | 62.6999 | 19.8069 |
| 16275 | 89.3529 | 6163.8140 | 672.3289 | 4309.8834 | 1441.4075 |
| 20713 | 89.3529 | 166.1120 | 22.0551 | 132.8860 | 240.9176 |
| 5666 | 89.3529 | 65.5660 | 6.5915 | 102.3993 | 39.6963 |
| 1141 | 89.2941 | 149.5540 | 20.7324 | 224.4319 | 56.6984 |
| 22726 | 89.2941 | 566.6960 | 17.2844 | 579.9561 | 134.1612 |
| 16871 | 89.2353 | 8.5760 | 3.1918 | 23.3039 | 13.3647 |
| 19469 | 89.1765 | 186.6180 | 15.0968 | 137.1066 | 41.2378 |
| 18403 | 89.1176 | 25.5880 | 1.9054 | 41.1171 | 37.8502 |
| 24113 | 89.1176 | 40.6980 | 5.1053 | 24.6835 | 17.7599 |
| 3549 | 89.0000 | 253.3740 | 30.6081 | 359.6218 | 79.4862 |
| 15410 | 88.8235 | 146.7280 | 18.7641 | 207.8692 | 49.0726 |
| 13339 | 88.8235 | 265.7660 | 30.8467 | 377.7149 | 87.3945 |
| 14185 | 88.8235 | 209.2080 | 19.7348 | 276.2619 | 178.9361 |
| 23361 | 88.8235 | 186.0120 | 8.4288 | 176.1679 | 76.4973 |
| 20930 | 88.7647 | −50.5620 | 72.3773 | 68.1456 | 84.8508 |
| 1805 | 88.7059 | 3751.3400 | 460.6071 | 2687.2374 | 890.1063 |
| 5319 | 88.7059 | 26.2060 | 2.0242 | 33.2407 | 14.6119 |
| 17314 | 88.6471 | 151.6320 | 40.8978 | 85.4482 | 48.8598 |
| 16681 | 88.5882 | 91.5760 | 21.1308 | 209.2707 | 118.7555 |
| 13480 | 88.5882 | 217.0060 | 20.7764 | 326.2735 | 98.8945 |
| 17815 | 88.5294 | 17.1920 | 2.4698 | 31.9005 | 15.7794 |
| 16013 | 88.5294 | 71.7880 | 3.6470 | 57.0533 | 15.0736 |
| 21109 | 88.4706 | 25.9380 | 7.6953 | 52.6209 | 20.2821 |
| 16806 | 88.4706 | 31.5800 | 5.9544 | 16.0287 | 19.7782 |
| 25730 | 88.4706 | 261.5740 | 34.1185 | 185.2594 | 114.8378 |
| 3438 | 88.4118 | 58.3800 | 17.2085 | 137.4567 | 59.3245 |
| 18450 | 88.4118 | 535.6320 | 17.4988 | 561.9067 | 125.5953 |
| 6499 | 88.3529 | 20.3440 | 3.4192 | 8.1612 | 12.9363 |
| 3806 | 97.8235 | 130.8280 | 1.2853 | 115.6202 | 49.6683 |
| 12698 | 97.5882 | 829.2720 | 429.5174 | 91.4250 | 147.4799 |
| 5952 | 96.4118 | 615.5480 | 66.1849 | 288.8192 | 163.2359 |
| 5953 | 96.0588 | 864.8480 | 150.7258 | 337.0063 | 167.7559 |
| 21561 | 95.7647 | 118.0140 | 36.1715 | 41.4323 | 28.1473 |
| 3311 | 95.6471 | 46.5060 | 5.0135 | 18.0603 | 19.6836 |
| 24163 | 95.4706 | 678.1280 | 47.5902 | 428.0980 | 132.0047 |
| 3759 | 95.4118 | 485.5780 | 59.8923 | 270.6568 | 87.9803 |
| 11256 | 95.4118 | 1.2920 | 6.8877 | 51.3665 | 26.3472 |
| 23650 | 95.2353 | 221.8460 | 21.5557 | 416.0473 | 135.5475 |
| 22666 | 95.0588 | 423.1080 | 85.2730 | 185.4106 | 115.1999 |
| 14561 | 94.9412 | 311.8480 | 36.7591 | 194.2015 | 53.7826 |
| 10367 | 94.8824 | 120.3600 | 18.2285 | 69.4403 | 24.2994 |
| 8522 | 94.8824 | 342.8440 | 75.3336 | 146.7467 | 75.4350 |
| 22995 | 94.7647 | 84.7320 | 18.8671 | 314.3560 | 210.7030 |
| 21395 | 94.3529 | 34.0540 | 2.6598 | 19.9917 | 11.0623 |
| 22667 | 94.3529 | 382.1560 | 73.1890 | 177.7571 | 104.2186 |
| 24336 | 94.3529 | 133.6900 | 6.1743 | 94.3027 | 38.3550 |
| 13370 | 94.2941 | −2.8540 | 11.4398 | 50.3266 | 28.4989 |
| 2383 | 94.0588 | 125.8400 | 16.2193 | 73.4904 | 27.6864 |
| 8224 | 94.0588 | 79.6840 | 14.1875 | 40.8168 | 33.0448 |
| 18565 | 93.9412 | 142.0080 | 15.7648 | 268.1071 | 111.3459 |
| 20036 | 93.8235 | 42.4280 | 4.3887 | 23.2912 | 17.2434 |
| 15500 | 93.6471 | 347.3040 | 10.2662 | 450.1255 | 95.1827 |
| 22535 | 93.6471 | 1107.8800 | 109.9265 | 745.1345 | 217.8967 |
| 806 | 93.5882 | 5143.5800 | 584.2847 | 2834.4181 | 1194.4464 |
| 23858 | 93.5882 | 259.4360 | 21.1028 | 175.0844 | 65.7803 |
| 3375 | 93.5882 | 743.2500 | 243.2110 | 368.8931 | 188.4166 |
| 19782 | 93.5294 | 446.6920 | 87.8661 | 189.6888 | 130.8051 |
| 7503 | 93.4706 | 73.4260 | 6.9356 | 21.7775 | 39.1796 |
| 6060 | 93.3529 | 143.4620 | 14.0556 | 239.8987 | 65.2990 |
| 13097 | 93.3529 | 327.6080 | 33.0708 | 59.2905 | 176.6047 |
| 13634 | 93.2941 | 4970.6460 | 458.2785 | 2856.1650 | 1040.4350 |
| 7054 | 93.2941 | 106.2580 | 13.9637 | 46.5483 | 42.6082 |
| 23657 | 93.2353 | 76.4320 | 14.6981 | 173.5696 | 67.4407 |
| 1924 | 93.1765 | 607.2200 | 84.7294 | 376.3173 | 109.8602 |
| 3641 | 93.1765 | 151.6080 | 14.6941 | 100.2653 | 52.0244 |
| 2102 | 93.1176 | 201.1640 | 19.4746 | 391.7164 | 166.6497 |
| 10767 | 93.0588 | 131.8180 | 5.7552 | 92.3528 | 41.6437 |
| 26149 | 93.0000 | 574.7160 | 156.5629 | 225.8444 | 361.2938 |
| 8153 | 92.9412 | 35.6380 | 9.9614 | 75.1321 | 22.8981 |
| 14803 | 92.9412 | 102.7480 | 7.7188 | 64.0599 | 30.1321 |
| 17722 | 92.8824 | 358.4340 | 19.4289 | 260.7384 | 65.6894 |
| 1923 | 92.8824 | 556.0920 | 53.0151 | 347.1122 | 159.1480 |
| 24604 | 92.8824 | 169.2980 | 25.8446 | 79.5402 | 72.7852 |
| 22876 | 92.7647 | 171.1600 | 31.9013 | 104.4064 | 35.5726 |
| 9000 | 92.7647 | 358.8980 | 25.7662 | 252.5714 | 58.5053 |
| 5977 | 92.6471 | 186.0860 | 6.9527 | 151.7047 | 39.6018 |
| 4703 | 92.6471 | 572.1520 | 26.7575 | 586.9418 | 317.0299 |
| 11636 | 92.5294 | 106.6080 | 38.9173 | −7.2448 | 93.3543 |
| 22276 | 92.5294 | 26.7380 | 3.3845 | 52.4777 | 24.4458 |
| 13666 | 92.4706 | 27.2520 | 7.5626 | 4.3979 | 14.9311 |
| 3542 | 92.4706 | 92.9880 | 6.7277 | 63.7227 | 26.3338 |
| 8062 | 92.4706 | 361.0980 | 25.2365 | 500.9905 | 94.3565 |
| 3598 | 92.4706 | 41.2500 | 12.2239 | 18.3980 | 14.5737 |
| 19591 | 92.4118 | 127.9460 | 16.2099 | 240.7742 | 81.1001 |
| 21600 | 92.3529 | 58.5040 | 8.8910 | 34.1521 | 46.0072 |
| 19383 | 92.2941 | 80.7100 | 29.2760 | 141.6222 | 32.9633 |
| 7460 | 92.2941 | 10091.8120 | 685.0072 | 6851.4357 | 2367.8821 |
| 18230 | 92.2353 | 88.4940 | 4.8816 | 83.5810 | 34.4264 |
| 4521 | 92.2353 | 204.0200 | 16.5341 | 304.7366 | 86.4336 |
| 8512 | 92.2353 | 28.8380 | 6.9534 | 7.9364 | 14.0049 |
| 14937 | 92.1176 | 17.5720 | 10.5584 | 61.5092 | 29.7618 |
| 26218 | 92.1176 | 496.4460 | 34.3047 | 362.3677 | 165.2483 |
| 16128 | 92.1176 | 347.6820 | 114.2463 | 287.0447 | 64.8866 |
| 18222 | 92.0588 | 17.6340 | 2.8184 | 29.1755 | 22.5905 |
| 11367 | 92.0000 | 183.7920 | 11.0895 | 266.9373 | 72.3475 |
| 10315 | 92.0000 | 298.1620 | 38.2427 | 189.7138 | 61.3591 |

TABLE 5S

DIFLUNISAL
Timepoint(s): 6, 24 hrs

| GLGC ID NO. | LDA Score | Mean Tox | SD Tox | Mean Nontox | SD Nontox |
|---|---|---|---|---|---|
| 12070 | 95.2353 | 63.3516 | 5.0048 | 35.0426 | 17.6927 |
| 12788 | 94.6471 | 46.2570 | 6.9659 | 12.3693 | 22.9425 |
| 19675 | 94.1765 | 31.8754 | 2.3512 | 13.5278 | 16.0099 |
| 17541 | 94.1176 | 2527.1340 | 54.1627 | 2946.1637 | 1078.7944 |
| 11984 | 93.9412 | 35.2354 | 4.7433 | 83.4905 | 35.4211 |
| 20767 | 93.8235 | 492.4424 | 127.4043 | 260.7840 | 119.1007 |
| 24453 | 93.8235 | 15.1770 | 4.1172 | 39.2706 | 18.4295 |
| 14822 | 93.4706 | 548.9346 | 84.6067 | 333.6542 | 105.0370 |
| 16346 | 93.4706 | 265.5758 | 34.3532 | 160.5167 | 65.9398 |
| 20359 | 93.4118 | 26.1094 | 2.3408 | 52.2256 | 28.0084 |
| 18192 | 93.3529 | 33.2954 | 4.6936 | 17.8724 | 10.5658 |
| 7064 | 93.1765 | 2238.6596 | 142.9295 | 1579.0463 | 406.6310 |
| 1045 | 93.0588 | 108.3092 | 6.4735 | 84.5083 | 27.3299 |
| 21015 | 93.0000 | 2880.4512 | 289.3375 | 4929.6664 | 1485.1979 |
| 13683 | 92.8824 | 186.9748 | 5.8468 | 236.9892 | 54.6557 |
| 21097 | 92.6471 | 824.7478 | 51.3347 | 691.8976 | 479.2111 |
| 14066 | 92.5882 | 65.7756 | 4.1972 | 100.2692 | 28.4131 |
| 24490 | 92.5294 | 24.7240 | 4.3812 | 55.3548 | 25.9396 |
| 16697 | 92.4706 | 16.1002 | 0.7866 | 25.2675 | 14.3291 |

TABLE 5S-continued

DIFLUNISAL
Timepoint(s): 6, 24 hrs

| GLGC ID NO. | LDA Score | Mean Tox | SD Tox | Mean Nontox | SD Nontox |
|---|---|---|---|---|---|
| 17604 | 92.4118 | 136.1668 | 12.7776 | 90.9499 | 28.4317 |
| 17530 | 92.4118 | 62.1444 | 17.8968 | 148.7118 | 65.5848 |
| 13646 | 92.4118 | 2003.4206 | 90.0018 | 1617.4579 | 287.0186 |
| 15052 | 92.2353 | 460.7888 | 111.2337 | 894.1052 | 251.8300 |
| 21866 | 92.2353 | 110.8446 | 6.8622 | 169.9155 | 56.8940 |
| 16947 | 92.2353 | 212.5984 | 20.9935 | 346.4096 | 139.8368 |
| 8317 | 92.1765 | 183.1958 | 5.7401 | 244.3411 | 102.2489 |
| 1546 | 91.5882 | 66.3914 | 5.2118 | 108.0682 | 45.6862 |
| 20192 | 91.5294 | 18.9402 | 1.3924 | 32.9884 | 19.3228 |
| 1567 | 91.4118 | 7.9818 | 2.1125 | 28.3328 | 16.7478 |
| 16257 | 91.2353 | 94.5538 | 21.5005 | 213.1527 | 82.5703 |
| 25405 | 91.1765 | 59.7474 | 8.9092 | 51.5183 | 37.9142 |
| 2632 | 91.1176 | 356.2594 | 47.7952 | 269.1014 | 51.7615 |
| 18369 | 90.8824 | 33.8492 | 2.8943 | 43.8158 | 39.9268 |
| 15667 | 90.5294 | 1660.9784 | 168.0180 | 2687.4202 | 869.5041 |
| 15011 | 90.4706 | 205.2998 | 12.0578 | 170.5749 | 60.9648 |
| 1288 | 90.4118 | 7.0232 | 13.9453 | 42.7035 | 21.7840 |
| 1583 | 90.4118 | 165.1708 | 15.3889 | 122.6115 | 42.8267 |
| 20653 | 90.4118 | 18.0720 | 1.4335 | 29.3127 | 18.8056 |
| 818 | 90.4118 | 1273.8784 | 241.4537 | 2884.3043 | 1768.6393 |
| 19650 | 90.3529 | 79.6952 | 27.7541 | 16.8221 | 41.5008 |
| 20939 | 90.2941 | 759.2784 | 99.9913 | 545.9102 | 181.2209 |
| 4439 | 90.2941 | 130.2570 | 39.4109 | 243.7727 | 73.9240 |
| 1311 | 90.1765 | 37.8100 | 3.0168 | 28.3408 | 15.1356 |
| 18501 | 90.1176 | 325.2736 | 40.7792 | 177.8471 | 108.1244 |
| 17271 | 90.0588 | 32.3204 | 4.2980 | 22.3272 | 9.0356 |
| 11755 | 90.0588 | 345.6334 | 91.9849 | 685.7039 | 303.2027 |
| 1623 | 90.0000 | 63.1434 | 2.8573 | 53.9278 | 13.9368 |
| 24545 | 90.0000 | 33.6966 | 1.9916 | 37.2921 | 19.1178 |
| 15203 | 89.9412 | 309.0782 | 16.7837 | 254.9091 | 58.6951 |
| 11905 | 89.9412 | 27.1464 | 4.7626 | 57.9067 | 27.2194 |
| 15069 | 89.8824 | 632.2906 | 23.1296 | 766.1136 | 349.0963 |
| 13499 | 89.8824 | 69.0778 | 5.9918 | 86.7119 | 55.1050 |
| 14964 | 89.7647 | 134.4992 | 9.5713 | 296.6224 | 224.8588 |
| 180 | 89.7647 | 17.4974 | 1.5899 | 20.5597 | 14.8596 |
| 17061 | 89.7059 | 173.1178 | 28.9576 | 270.6493 | 69.5579 |
| 25168 | 89.6471 | 19.7000 | 13.0775 | 23.7797 | 9.1425 |
| 24253 | 89.6471 | 13.2066 | 7.7438 | 36.5161 | 16.0792 |
| 9183 | 89.6471 | 32.7810 | 2.2456 | 25.8186 | 17.2458 |
| 811 | 89.5882 | 47.0396 | 12.5280 | 93.4614 | 41.9238 |
| 19 | 89.5882 | 905.6292 | 48.7496 | 711.4101 | 213.6619 |
| 18911 | 89.5882 | 17.8428 | 1.3425 | 27.0422 | 13.3972 |
| 21951 | 89.5294 | 209.3348 | 38.2333 | 139.5234 | 49.5815 |
| 4307 | 89.5294 | 31.0162 | 10.9186 | 8.0462 | 15.4679 |
| 812 | 89.5294 | 26.1996 | 6.5135 | 54.7962 | 23.8784 |
| 2078 | 89.4118 | 153.0102 | 29.7976 | 241.0208 | 62.4225 |
| 12859 | 89.3529 | 51.0708 | 3.2438 | 72.9180 | 39.8200 |
| 15807 | 89.3529 | 23.0504 | 3.8111 | 48.5270 | 24.0075 |
| 24707 | 89.2353 | 84.4012 | 12.4593 | 180.4426 | 101.2768 |
| 194 | 89.1765 | 25.5176 | 3.1026 | 39.7126 | 13.1077 |
| 19190 | 89.1176 | 543.5510 | 40.8529 | 714.8037 | 240.5928 |
| 23044 | 89.1176 | 80.0686 | 8.2207 | 121.6296 | 36.5878 |
| 3847 | 89.0588 | 55.8592 | 9.0776 | 37.1163 | 15.8048 |
| 9090 | 89.0588 | 27.4382 | 3.6594 | 32.3384 | 55.0390 |
| 19962 | 89.0588 | 138.6404 | 22.5334 | 234.5901 | 76.1791 |
| 21665 | 88.9412 | 147.4540 | 15.4606 | 101.7692 | 37.5863 |
| 15309 | 88.8824 | 23.3434 | 4.0006 | 12.8790 | 8.3255 |
| 11153 | 88.8235 | 184.1906 | 19.2511 | 277.4018 | 84.1262 |
| 3446 | 88.7647 | 55.2722 | 7.2078 | 37.8205 | 16.0156 |
| 21794 | 88.7059 | 22.3216 | 6.9784 | 51.1955 | 27.7184 |
| 820 | 88.7059 | 385.3910 | 127.1368 | 1033.1495 | 717.4806 |
| 15648 | 88.6471 | 94.2888 | 10.7951 | 69.1923 | 20.3168 |
| 22412 | 88.5882 | 908.1716 | 183.6259 | 689.2592 | 452.4591 |
| 352 | 88.4706 | 285.9932 | 68.3947 | 184.7932 | 129.1681 |
| 18561 | 88.4706 | 105.3094 | 13.8563 | 71.0405 | 25.3075 |
| 15185 | 88.4118 | 31.5366 | 8.0907 | 10.9244 | 20.9318 |
| 17494 | 88.4118 | 38.4202 | 2.4226 | 29.8873 | 9.0877 |
| 13486 | 88.3529 | 38.1386 | 2.6642 | 25.4303 | 22.4339 |
| 4524 | 88.3529 | 95.4054 | 8.4959 | 71.2510 | 30.9057 |
| 15188 | 88.2353 | 126.6662 | 19.8373 | 181.9760 | 42.0077 |
| 626 | 88.1765 | 172.1156 | 52.0451 | 89.1758 | 75.1153 |
| 22408 | 88.1765 | 17.7466 | 25.0260 | 78.2545 | 40.7207 |
| 4178 | 88.1765 | 59.8510 | 14.8219 | 178.4091 | 126.0765 |
| 2008 | 88.1176 | 208.7984 | 168.8219 | 12.9610 | 39.5414 |
| 5837 | 88.1176 | 38.1172 | 19.8903 | 90.2958 | 41.0217 |
| 14633 | 88.0588 | 228.8268 | 98.3976 | 491.2366 | 204.9908 |
| 347 | 88.0588 | 95.5734 | 13.0116 | 63.6631 | 23.0370 |
| 16081 | 88.0000 | 1888.0332 | 261.0421 | 1171.0972 | 591.5437 |
| 7636 | 88.0000 | 45.3042 | 2.2922 | 43.3031 | 14.6011 |
| 13283 | 88.0000 | 65.6356 | 17.0042 | 145.4605 | 71.8438 |
| 2007 | 87.9412 | 205.4314 | 187.9590 | -7.1716 | 44.5153 |
| 9192 | 98.7647 | 2006.9858 | 106.7482 | 839.5277 | 438.3161 |
| 2964 | 97.8235 | 186.8372 | 6.3988 | 112.5089 | 37.5268 |
| 8759 | 96.9412 | 335.2268 | 48.8306 | 95.7051 | 144.5517 |
| 5695 | 96.7647 | 85.4190 | 24.4462 | 236.9429 | 76.2305 |
| 17935 | 96.5882 | 1553.6122 | 280.9959 | 678.0350 | 329.0066 |
| 20570 | 96.1176 | 3.0714 | 7.6800 | 50.0833 | 29.2768 |
| 7382 | 96.0588 | -9.4288 | 3.9608 | 45.5191 | 45.8034 |
| 8164 | 95.8235 | 200.1424 | 29.3881 | 106.9377 | 42.4610 |
| 19200 | 95.7059 | 334.9614 | 15.0501 | 228.4794 | 85.1417 |
| 14763 | 95.4118 | 1512.2030 | 257.3450 | 548.1563 | 558.9338 |
| 7837 | 95.1765 | 38.8110 | 18.2225 | 120.0461 | 40.8680 |
| 19359 | 94.8824 | 288.3560 | 26.4518 | 551.8001 | 192.8928 |
| 5143 | 94.8235 | 20.7216 | 3.2214 | 71.9196 | 51.5329 |
| 26190 | 94.8235 | 22.8532 | 28.4634 | -173.1287 | 115.5066 |
| 7136 | 94.8235 | 266.0740 | 42.8303 | 154.3756 | 45.2995 |
| 4067 | 94.7647 | 579.8630 | 53.5513 | 344.0955 | 146.0932 |
| 18562 | 94.7059 | 1232.3766 | 112.9914 | 759.0060 | 238.7734 |
| 5440 | 94.7059 | 189.3476 | 6.6274 | 141.9659 | 43.0389 |
| 22455 | 94.6471 | 38.8196 | 3.4435 | -53.4345 | 98.2019 |
| 15078 | 94.6471 | 37.2582 | 5.4201 | 11.1867 | 20.3680 |
| 21806 | 94.5294 | 51.0342 | 5.9769 | 98.5681 | 34.3375 |
| 21911 | 94.3529 | 321.7406 | 30.2190 | 185.6694 | 73.3081 |
| 2340 | 94.1765 | 259.0990 | 127.6402 | -70.6144 | 152.6079 |
| 13382 | 94.1176 | 343.2174 | 13.1956 | 220.5227 | 94.7822 |
| 18800 | 94.0000 | 632.8844 | 104.3312 | 258.4023 | 185.9765 |
| 8177 | 94.0000 | 94.9558 | 25.7513 | 203.9911 | 67.6946 |
| 6005 | 93.8235 | 957.4342 | 112.1538 | 1475.0905 | 310.1174 |
| 18660 | 93.8235 | 124.0768 | 11.2236 | 72.3478 | 48.3039 |
| 6027 | 93.8235 | 26.0710 | 2.4110 | 40.5009 | 39.0253 |
| 16027 | 93.8235 | 303.0852 | 74.2470 | 183.4181 | 55.7070 |
| 10315 | 93.7647 | 123.6040 | 5.3365 | 190.7406 | 61.7590 |
| 3710 | 93.7647 | 641.5420 | 110.3017 | 340.3629 | 340.9695 |
| 23589 | 93.6471 | 320.1448 | 13.2548 | 253.7553 | 46.7819 |
| 14911 | 93.6471 | 261.5928 | 21.2739 | 147.7991 | 78.6971 |
| 6567 | 93.5882 | 506.7868 | 48.9622 | 306.1224 | 127.7585 |
| 19138 | 93.5882 | 84.3866 | 3.2953 | 52.5895 | 33.6356 |
| 4903 | 93.5882 | 89.9200 | 6.4695 | 102.3104 | 76.4568 |
| 11467 | 93.5882 | 69.7822 | 12.4648 | 166.2600 | 62.8517 |
| 15398 | 93.5294 | 152.3436 | 5.7683 | 197.7754 | 68.0217 |
| 19569 | 93.4118 | 17.0946 | 2.4935 | 34.3102 | 35.5661 |
| 1397 | 93.3529 | 142.4742 | 10.6471 | 92.4016 | 31.1975 |
| 15113 | 93.3529 | 150.9540 | 5.2513 | 197.0510 | 46.9189 |
| 15034 | 93.2941 | 269.3444 | 12.2565 | 202.8800 | 58.5584 |
| 22372 | 93.1765 | 511.6662 | 63.7172 | 306.7661 | 131.2313 |
| 13175 | 93.0588 | 67.5620 | 10.5579 | 127.5979 | 41.2576 |
| 7316 | 93.0588 | 141.9784 | 2.9108 | 140.7572 | 44.3238 |
| 10984 | 93.0000 | 48.2624 | 13.8706 | 177.1566 | 111.6760 |
| 22998 | 93.0000 | 543.5000 | 41.0215 | 739.8577 | 163.0880 |
| 10084 | 92.9412 | 120.0752 | 16.1757 | 215.0305 | 77.1877 |
| 14396 | 92.8824 | 156.4794 | 18.7109 | 100.9410 | 27.0645 |
| 21514 | 92.8824 | 23.6656 | 2.8412 | 48.4436 | 24.5171 |
| 15452 | 92.8235 | 131.1638 | 6.2968 | 193.9633 | 70.2376 |
| 24214 | 92.7647 | 240.9492 | 60.2774 | 140.6843 | 56.2277 |
| 3345 | 92.7059 | 4.4426 | 12.1618 | 76.4941 | 47.1224 |
| 3153 | 92.5882 | 76.8642 | 6.4521 | 38.6780 | 34.0635 |
| 19014 | 92.4706 | 494.8382 | 29.3428 | 329.3718 | 113.8280 |
| 26245 | 92.4706 | 11.6822 | 3.1375 | 31.3113 | 37.2043 |
| 2688 | 92.4706 | 186.2738 | 5.5836 | 167.7769 | 47.7157 |
| 2270 | 92.4706 | 30.8320 | 5.7131 | -23.4557 | 43.1378 |
| 21469 | 92.4118 | 128.1122 | 35.0018 | 355.6238 | 159.7565 |
| 22619 | 92.3529 | 568.4140 | 30.0158 | 417.8284 | 89.9944 |
| 7916 | 92.3529 | 368.0892 | 15.3328 | 374.1506 | 164.5796 |
| 4882 | 92.2353 | 34.9422 | 1.8540 | 34.8439 | 24.7268 |
| 26120 | 92.2353 | 6.9288 | 2.2022 | 28.8906 | 31.8223 |
| 22987 | 92.1176 | 103.8536 | 26.3785 | 222.3339 | 71.0458 |

TABLE 5S-continued

DIFLUNISAL
Timepoint(s): 6, 24 hrs

| GLGC ID NO. | LDA Score | Mean Tox | SD Tox | Mean Nontox | SD Nontox |
|---|---|---|---|---|---|
| 7597 | 92.0000 | 32.7838 | 3.0133 | 58.5247 | 25.8125 |
| 24144 | 92.0000 | 61.3754 | 10.6895 | 136.7466 | 58.3981 |
| 21631 | 91.8824 | 732.2908 | 83.7954 | 494.0285 | 120.7966 |
| 17320 | 91.8235 | 295.6072 | 42.3511 | 174.3459 | 87.8626 |
| 10550 | 91.8235 | 284.6434 | 16.8039 | 212.8800 | 63.9879 |
| 4797 | 91.8235 | 77.4712 | 3.4307 | 95.6796 | 38.8925 |
| 13153 | 91.7647 | 159.0886 | 6.3694 | 143.8821 | 58.0508 |
| 4949 | 91.7059 | 117.0008 | 10.4755 | 206.6451 | 85.5300 |

TABLE 5T

Direct Acting
Timepoint(s): Various

| GLGC ID NO. | LDA Score | Mean Tox | SD Tox | Mean Nontox | SD Nontox |
|---|---|---|---|---|---|
| 1460 | 78.0061 | 2772.0344 | 418.3982 | 2081.3470 | 701.9019 |
| 6671 | 76.6028 | 163.6525 | 47.4216 | 112.8390 | 48.9860 |
| 25666 | 76.1350 | 318.0080 | 101.8883 | 197.6342 | 114.2224 |
| 1588 | 75.6135 | 711.0096 | 276.6873 | 437.5033 | 257.8769 |
| 445 | 75.5291 | 150.7079 | 57.7930 | 87.8718 | 47.9790 |
| 1970 | 75.3221 | 345.2053 | 143.9769 | 193.8149 | 107.1326 |
| 25491 | 75.3067 | 61.9489 | 25.2396 | 42.1772 | 19.9596 |
| 15123 | 75.2607 | 537.0802 | 364.1056 | 161.0001 | 232.5289 |
| 23783 | 75.1534 | 293.2268 | 91.3369 | 391.6374 | 94.2907 |
| 1300 | 74.0644 | 247.7533 | 88.7628 | 147.9501 | 90.3450 |
| 24518 | 73.9954 | 496.1655 | 111.5237 | 617.0582 | 147.8008 |
| 338 | 73.9494 | 40.8700 | 44.6628 | −1.3243 | 35.0846 |
| 15126 | 73.6273 | 2568.6575 | 635.4246 | 1855.4425 | 625.2933 |
| 17090 | 73.5046 | 142.6248 | 25.4290 | 112.7600 | 44.4131 |
| 25747 | 73.4279 | 2805.3986 | 700.1920 | 1999.2969 | 728.9757 |
| 444 | 73.3589 | 131.8101 | 46.3733 | 78.5789 | 38.1213 |
| 18085 | 73.3589 | 69.0946 | 53.9484 | 9.0098 | 42.5357 |
| 8384 | 73.0675 | 156.0429 | 112.0438 | 58.7472 | 71.0046 |
| 446 | 72.9064 | 132.3679 | 47.0624 | 72.6773 | 38.0900 |
| 25729 | 72.8451 | 155.3433 | 84.0500 | 83.8447 | 62.7639 |
| 25676 | 72.7837 | 34.9856 | 26.3741 | 14.4144 | 19.7638 |
| 1187 | 72.7377 | 69.3701 | 21.3655 | 42.9265 | 27.2544 |
| 3202 | 72.6457 | 1131.1437 | 227.5498 | 894.2170 | 199.8777 |
| 21238 | 72.4463 | 172.3199 | 71.4810 | 102.9537 | 72.0320 |
| 8386 | 72.3926 | 417.7814 | 272.1282 | 179.6393 | 184.2552 |
| 25746 | 72.3543 | 30.4264 | 13.9522 | 18.8831 | 10.1956 |
| 1063 | 72.2929 | 95.1991 | 44.2919 | 53.9975 | 36.1768 |
| 6891 | 72.2853 | 450.0432 | 142.9820 | 627.8129 | 164.8870 |
| 13348 | 72.2699 | 61.0085 | 28.2661 | 34.4595 | 24.9177 |
| 18539 | 72.2623 | 287.0815 | 93.6075 | 188.8673 | 106.8342 |
| 25203 | 72.1702 | 82.5551 | 26.3105 | 56.8873 | 32.7829 |
| 6377 | 72.0322 | 1054.3565 | 423.7833 | 709.7934 | 404.0542 |
| 16565 | 72.0245 | 51.6099 | 25.8426 | 34.4237 | 18.9921 |
| 11940 | 72.0245 | 35.4292 | 12.5390 | 51.7935 | 16.0967 |
| 19321 | 72.0015 | 253.1205 | 49.9506 | 300.8031 | 52.5854 |
| 23000 | 71.9939 | 32.4504 | 7.3248 | 42.7463 | 13.7565 |
| 4178 | 71.8865 | 282.6365 | 126.9271 | 172.5663 | 123.7993 |
| 16248 | 71.8788 | 355.5179 | 240.7884 | 143.4115 | 138.8458 |
| 1409 | 71.8712 | 89.6070 | 32.3546 | 116.9523 | 39.2719 |
| 19712 | 71.8482 | 14.7985 | 9.9706 | 29.0985 | 16.9052 |
| 1311 | 71.7868 | 44.8013 | 17.3852 | 27.5910 | 14.5318 |
| 18538 | 71.7485 | 138.5459 | 59.8052 | 87.6643 | 62.5910 |
| 690 | 71.7025 | 84.0918 | 40.2324 | 54.1355 | 41.7830 |
| 19391 | 71.6488 | 544.2599 | 183.6326 | 397.8064 | 202.7880 |
| 25730 | 71.6028 | 263.6364 | 114.4060 | 181.8809 | 113.3837 |
| 15291 | 71.5798 | 190.8637 | 73.3399 | 129.8885 | 71.2060 |
| 25689 | 71.5644 | 3130.8667 | 638.6884 | 2421.2255 | 665.8935 |
| 3879 | 71.4954 | 1101.2675 | 368.1483 | 1460.5049 | 430.1355 |
| 5358 | 71.4724 | 151.8394 | 61.6605 | 90.5235 | 48.9000 |
| 1514 | 71.4647 | 192.2563 | 56.7415 | 144.9331 | 64.6090 |
| 1323 | 71.4110 | 218.6332 | 163.9493 | 76.3589 | 126.3460 |
| 25743 | 71.3574 | 294.1714 | 128.1386 | 186.1187 | 137.7854 |
| 25087 | 71.2960 | 64.2700 | 54.2143 | 42.9798 | 66.5951 |

TABLE 5T-continued

Direct Acting
Timepoint(s): Various

| GLGC ID NO. | LDA Score | Mean Tox | SD Tox | Mean Nontox | SD Nontox |
|---|---|---|---|---|---|
| 25608 | 71.2883 | 77.4945 | 38.5944 | 48.8664 | 34.0944 |
| 18277 | 71.2500 | 1640.0467 | 268.3997 | 1383.9259 | 325.8152 |
| 1969 | 71.2423 | 110.2643 | 77.2067 | 49.4783 | 44.7815 |
| 19745 | 71.1656 | 109.5278 | 44.7146 | 154.0061 | 53.9977 |
| 7927 | 71.1120 | 25.6238 | 14.9896 | 46.7257 | 28.2804 |
| 22661 | 71.0199 | 672.9903 | 143.9379 | 832.4725 | 170.5368 |
| 23129 | 71.0123 | 59.6918 | 17.8133 | 41.4435 | 20.3097 |
| 23037 | 70.9586 | 43.2596 | 25.2384 | 24.2986 | 17.6043 |
| 1324 | 70.9433 | 294.9960 | 172.0744 | 145.3064 | 124.4591 |
| 11260 | 70.8819 | 129.8748 | 58.3672 | 84.9624 | 56.0088 |
| 22845 | 70.8589 | 756.2657 | 183.8088 | 902.5055 | 199.4631 |
| 24867 | 70.8359 | 32.2736 | 24.7106 | 11.1363 | 15.1718 |
| 25605 | 70.8282 | 46.8015 | 18.2125 | 34.6704 | 17.1400 |
| 20938 | 70.7975 | 464.0342 | 80.8710 | 552.6502 | 102.9566 |
| 15191 | 70.7822 | 3463.0763 | 890.2747 | 3008.0421 | 1454.5613 |
| 17279 | 70.7362 | 34.8530 | 31.0360 | 10.5617 | 24.9541 |
| 15127 | 70.7362 | 1940.1414 | 628.6780 | 1221.2591 | 468.2481 |
| 25405 | 70.5982 | 77.4133 | 76.3230 | 50.2979 | 37.4492 |
| 12058 | 70.5828 | 54.2055 | 53.7014 | 15.0351 | 18.0428 |
| 25250 | 70.5598 | 711.2286 | 284.9142 | 910.4036 | 237.0648 |
| 25467 | 70.5291 | 106.2761 | 62.5733 | 57.8556 | 41.9509 |
| 1447 | 70.5291 | 342.4567 | 69.6884 | 423.1239 | 83.9005 |
| 1198 | 70.5061 | 251.0025 | 114.1773 | 153.0402 | 68.2062 |
| 651 | 70.4908 | 266.2135 | 126.8894 | 160.6008 | 104.6503 |
| 20429 | 70.4908 | 341.8336 | 179.8125 | 227.0279 | 160.2347 |
| 1501 | 70.4678 | 2661.7777 | 482.5796 | 2188.3262 | 562.6359 |
| 17886 | 70.4525 | 537.6807 | 94.0340 | 657.2049 | 139.8227 |
| 16602 | 70.3681 | 86.2603 | 49.2723 | 46.4570 | 36.3935 |
| 20664 | 70.3528 | 915.9442 | 361.7027 | 618.0405 | 315.6000 |
| 7062 | 70.3451 | 811.6378 | 301.4519 | 460.6393 | 219.6379 |
| 1601 | 70.2914 | 117.4900 | 50.8275 | 75.3705 | 46.3862 |
| 762 | 70.2914 | 501.9725 | 266.1240 | 835.7857 | 392.9219 |
| 21403 | 70.2837 | 103.1469 | 28.3508 | 125.8484 | 30.0781 |
| 691 | 70.2684 | 245.7613 | 111.4102 | 169.3340 | 102.2363 |
| 652 | 70.1840 | 542.6822 | 268.1221 | 300.4389 | 211.6563 |
| 322 | 70.1764 | 453.0281 | 306.6202 | 154.7048 | 158.5520 |
| 15032 | 70.1687 | 39.5654 | 9.9443 | 48.8803 | 12.5488 |
| 14330 | 70.1610 | 566.0493 | 282.6249 | 321.5301 | 220.6335 |
| 16074 | 70.1610 | 224.5576 | 33.6972 | 270.0489 | 46.4614 |
| 17562 | 70.1457 | 1039.4147 | 455.4380 | 632.7315 | 370.5153 |
| 11691 | 70.1380 | 114.2379 | 85.9547 | 50.7095 | 50.0146 |
| 16468 | 70.1150 | 386.4281 | 164.4934 | 526.2722 | 166.0573 |
| 17560 | 70.0844 | 1667.3999 | 605.5901 | 1146.7647 | 508.8432 |
| 4385 | 70.0537 | 73.4367 | 98.1722 | −13.7106 | 107.7644 |
| 18160 | 70.0460 | 69.5166 | 41.6438 | 42.4443 | 45.9888 |
| 16560 | 69.9847 | 91.7705 | 24.9155 | 70.4373 | 22.1498 |
| 21211 | 69.9847 | 237.2893 | 91.3341 | 302.0582 | 103.4050 |
| 14677 | 76.8175 | 226.4802 | 94.2721 | 130.7408 | 70.3183 |
| 7289 | 76.7945 | 66.4335 | 43.5346 | 26.2553 | 28.6286 |
| 19042 | 75.4294 | 764.6695 | 197.6382 | 550.6440 | 196.3235 |
| 22677 | 75.0920 | 640.3721 | 178.5112 | 440.4358 | 185.8366 |
| 18522 | 74.9387 | 165.6100 | 47.0982 | 224.4660 | 62.4617 |
| 7049 | 74.9156 | 63.3588 | 22.4719 | 100.2767 | 34.8250 |
| 21166 | 74.6472 | 572.3624 | 179.8096 | 389.7818 | 128.1167 |
| 8874 | 74.1334 | 244.7663 | 159.9602 | 92.3652 | 127.7202 |
| 11416 | 74.1181 | 139.3572 | 34.2949 | 182.6391 | 47.4479 |
| 17907 | 74.0031 | 159.1774 | 29.1194 | 131.2366 | 26.5256 |
| 883 | 73.9801 | 645.7663 | 114.3476 | 534.3579 | 115.5307 |
| 10676 | 73.8190 | 215.8286 | 57.4994 | 151.6517 | 61.9846 |
| 7288 | 73.6426 | 186.0698 | 82.0909 | 99.8218 | 62.5537 |
| 18823 | 73.6043 | 41.9236 | 18.4083 | 23.5281 | 15.1999 |
| 17614 | 73.6043 | 238.0642 | 81.0835 | 157.0430 | 58.1117 |
| 7620 | 73.5813 | 190.4424 | 45.8414 | 242.8727 | 53.9034 |
| 2205 | 73.5353 | 601.9484 | 146.8377 | 733.9714 | 148.1360 |
| 6879 | 73.5199 | 133.2869 | 79.0576 | 58.8169 | 43.7317 |
| 2708 | 73.5046 | 561.0369 | 151.1371 | 417.6276 | 128.6458 |
| 5698 | 73.3052 | 1821.0836 | 287.1025 | 1483.4993 | 311.3358 |
| 24286 | 73.2975 | 1523.6897 | 356.1530 | 1296.7997 | 546.5833 |
| 4291 | 73.1595 | 15.2767 | 9.1685 | 26.7335 | 13.9714 |
| 20905 | 73.0828 | 687.0505 | 115.3659 | 562.4923 | 132.4808 |
| 23038 | 73.0061 | 128.0230 | 138.1663 | −8.0072 | 92.5607 |
| 7916 | 72.9755 | 487.6208 | 157.6953 | 368.5443 | 162.4711 |
| 23966 | 72.9294 | 1527.8882 | 460.8033 | 1071.9727 | 380.5524 |

TABLE 5T-continued

Direct Acting
Timepoint(s): Various

| GLGC ID NO. | LDA Score | Mean Tox | SD Tox | Mean Nontox | SD Nontox |
|---|---|---|---|---|---|
| 22639 | 72.8911 | 472.0675 | 91.0750 | 598.2740 | 151.9917 |
| 12413 | 72.7914 | 134.4668 | 47.4991 | 91.2602 | 45.4854 |
| 12096 | 72.7531 | 177.8423 | 52.4670 | 120.1984 | 57.1088 |
| 8430 | 72.7454 | 67.7433 | 25.0253 | 98.5498 | 35.4876 |
| 16682 | 72.4923 | 210.3590 | 135.5825 | 92.5217 | 86.4764 |
| 21993 | 72.4156 | 442.9238 | 166.3707 | 284.4425 | 118.8870 |
| 22885 | 72.3083 | 2802.1857 | 552.8879 | 2167.6809 | 682.5731 |
| 15129 | 72.3006 | 625.2782 | 147.3869 | 844.0684 | 300.6038 |
| 2101 | 72.2699 | 220.4294 | 61.0309 | 303.3754 | 85.1474 |
| 19230 | 72.1626 | 137.0527 | 134.7081 | 294.5181 | 150.3926 |
| 10999 | 72.0475 | 141.0720 | 71.9572 | 77.4906 | 52.1271 |
| 17168 | 72.0015 | 340.4776 | 121.0427 | 493.3667 | 144.4351 |
| 7208 | 71.8252 | 489.1369 | 131.2646 | 374.9993 | 108.6546 |
| 2459 | 71.8098 | 141.8293 | 146.6439 | 25.4166 | 46.8212 |
| 19995 | 71.7638 | 90.0621 | 70.6634 | 29.4795 | 61.6077 |
| 4475 | 71.7638 | 107.7123 | 24.7017 | 144.0825 | 38.8189 |
| 11554 | 71.7638 | 201.0677 | 33.5106 | 255.4199 | 69.0579 |
| 16404 | 71.7331 | 155.6695 | 44.0809 | 109.2780 | 47.9210 |
| 23530 | 71.6564 | 104.6629 | 24.4867 | 139.1343 | 36.3881 |
| 22451 | 71.6028 | 69.1535 | 24.5231 | 95.2000 | 34.8339 |
| 22368 | 71.6028 | 1161.8998 | 299.5927 | 866.0810 | 292.9774 |
| 3710 | 71.5337 | 756.7761 | 475.8329 | 321.7731 | 319.6267 |
| 26371 | 71.5031 | 155.5071 | 56.0494 | 105.0600 | 58.6637 |
| 22536 | 71.4340 | 2267.2147 | 652.4740 | 1524.3402 | 526.3075 |

TABLE 5U

DMN
Timepoint(s): 24 hrs

| GLGC ID NO. | LDA Score | Mean Tox | SD Tox | Mean Nontox | SD Nontox |
|---|---|---|---|---|---|
| 25713 | 100.0000 | 27.3605 | 0.0049 | 37.9180 | 20.9751 |
| 21203 | 100.0000 | 78.6280 | 0.1018 | 42.4337 | 12.8564 |
| 17206 | 100.0000 | 228.6210 | 0.4087 | 138.1831 | 44.2412 |
| 51 | 100.0000 | 76.2445 | 5.9107 | 5.0897 | 8.7576 |
| 19864 | 100.0000 | 181.9585 | 16.3688 | 25.1109 | 10.8778 |
| 10540 | 100.0000 | 151.2540 | 6.3823 | 29.8380 | 20.5773 |
| 16576 | 100.0000 | 144.0390 | 0.2531 | 39.9686 | 14.8719 |
| 4325 | 100.0000 | 100.3480 | 0.2008 | 36.7876 | 11.9500 |
| 19177 | 100.0000 | 84.6875 | 0.0304 | 38.1897 | 20.3820 |
| 17587 | 100.0000 | 128.8265 | 0.0771 | 215.5694 | 51.9546 |
| 15862 | 100.0000 | 24.4945 | 1.1250 | 158.3676 | 80.2662 |
| 52 | 99.9414 | 243.6805 | 27.1508 | 72.9953 | 26.0619 |
| 21162 | 99.9414 | 80.7670 | 0.0750 | 40.2826 | 64.3215 |
| 24849 | 99.9414 | 28.2960 | 0.0552 | 22.9676 | 16.8589 |
| 16176 | 99.9414 | 92.0610 | 8.2505 | 16.5472 | 10.7680 |
| 776 | 99.9414 | 147.6990 | 2.8779 | 34.4475 | 20.3330 |
| 15706 | 99.9414 | 124.2995 | 2.5180 | 36.7814 | 14.5256 |
| 16457 | 99.9414 | 392.5980 | 0.0580 | 290.4067 | 77.5500 |
| 534 | 99.9414 | 1064.2960 | 0.7567 | 2332.4966 | 967.9459 |
| 16520 | 99.9414 | 281.3855 | 1.9311 | 1105.9252 | 461.7484 |
| 3815 | 99.9414 | 333.0130 | 12.6120 | 151.1011 | 41.4568 |
| 2577 | 99.9414 | 297.6585 | 0.0813 | 177.4394 | 46.7446 |
| 20093 | 99.9414 | 68.3940 | 0.0057 | 69.8793 | 27.8315 |
| 16566 | 99.9414 | 56.3270 | 0.0325 | 42.0637 | 18.3435 |
| 25808 | 99.8828 | 13.7850 | 0.0552 | 68.6572 | 80.6780 |
| 18226 | 99.8828 | 501.0420 | 2.4904 | 265.6737 | 57.6133 |
| 23060 | 99.8828 | 28.6760 | 0.0311 | −1.2395 | 20.7075 |
| 22567 | 99.8828 | 82.0270 | 0.5614 | 176.4554 | 44.5287 |
| 25512 | 99.8828 | 187.1625 | 0.0403 | 174.2063 | 98.9227 |
| 9125 | 99.8828 | 909.3570 | 0.3946 | 780.1771 | 161.6328 |
| 17173 | 99.8242 | 170.3235 | 0.8620 | 102.6385 | 25.7534 |
| 463 | 99.8242 | 73.0270 | 0.1881 | 41.1953 | 13.4760 |
| 23678 | 99.8242 | 261.1310 | 0.7043 | 120.1191 | 51.8217 |
| 13723 | 99.8242 | 376.1000 | 30.8610 | 84.4885 | 59.8956 |
| 8879 | 99.8242 | 221.0910 | 4.4307 | 88.8893 | 29.0785 |
| 21099 | 99.8242 | 28.6830 | 0.0099 | 28.9031 | 11.6935 |
| 25538 | 99.8242 | 43.6045 | 0.0163 | 54.0500 | 21.9139 |

TABLE 5U-continued

DMN
Timepoint(s): 24 hrs

| GLGC ID NO. | LDA Score | Mean Tox | SD Tox | Mean Nontox | SD Nontox |
|---|---|---|---|---|---|
| 16959 | 99.8242 | 713.0585 | 0.9963 | 435.1765 | 95.7903 |
| 20681 | 99.8242 | 268.0875 | 1.4899 | 161.5667 | 44.2089 |
| 20820 | 99.8242 | 441.3230 | 0.9433 | 289.1172 | 74.5748 |
| 16899 | 99.8242 | 61.7400 | 1.0663 | 22.0537 | 15.6581 |
| 7897 | 99.7655 | 2160.5265 | 4.6830 | 3034.2572 | 980.8469 |
| 61 | 99.7655 | 14.7535 | 0.0134 | 22.2295 | 10.6097 |
| 21204 | 99.7655 | 165.2350 | 1.9163 | 76.2124 | 26.2167 |
| 4057 | 99.7655 | 28.6300 | 2.7280 | 93.2256 | 28.0421 |
| 1418 | 99.7655 | 20.8430 | 1.1908 | 63.7119 | 22.8357 |
| 5661 | 99.7655 | 34.9515 | 0.1308 | 5.6950 | 26.4443 |
| 997 | 99.7069 | 27.6805 | 0.0728 | 32.4751 | 24.0788 |
| 8768 | 99.7069 | 124.0185 | 2.0202 | 59.8267 | 20.6847 |
| 19120 | 99.7069 | 208.0060 | 13.5043 | 66.3128 | 33.7230 |
| 15956 | 99.6483 | 367.3635 | 28.2411 | 132.0668 | 45.0891 |
| 25644 | 99.6483 | 409.7955 | 0.7347 | 339.6840 | 148.8807 |
| 24442 | 99.6483 | 12.5120 | 0.0311 | 30.4670 | 16.2145 |
| 2114 | 99.6483 | 51.0740 | 0.1061 | 31.4045 | 15.8459 |
| 4656 | 99.6483 | 63.3705 | 0.0728 | 59.8314 | 24.0429 |
| 14542 | 99.6483 | 57.9350 | 0.2602 | 22.3173 | 27.9054 |
| 19199 | 99.6483 | 132.9415 | 7.7845 | 48.1370 | 17.3099 |
| 15819 | 99.6483 | 20.2630 | 0.0523 | 12.7227 | 12.8332 |
| 24540 | 99.6483 | 36.0110 | 6.6694 | 2.7729 | 6.3991 |
| 12370 | 99.5897 | 58.7615 | 0.1605 | 92.1828 | 72.0999 |
| 24883 | 99.5897 | 10.3730 | 0.1216 | 33.5736 | 24.1068 |
| 17303 | 99.5897 | 38.1985 | 0.0573 | 41.0092 | 15.9294 |
| 15426 | 99.5897 | 444.7295 | 12.6919 | 239.2431 | 53.5831 |
| 18663 | 99.5897 | 1171.4220 | 18.9830 | 683.7521 | 172.9040 |
| 20126 | 99.5897 | 403.7935 | 3.1261 | 158.6551 | 167.6957 |
| 20579 | 99.5897 | 116.7810 | 30.6913 | −8.6682 | 21.7539 |
| 24651 | 99.5311 | 167.9615 | 3.8728 | 90.7041 | 22.9352 |
| 768 | 99.5311 | 79.2445 | 0.5183 | 211.2762 | 116.5352 |
| 5319 | 99.5311 | 74.8760 | 3.2272 | 33.1018 | 14.4556 |
| 1959 | 99.5311 | 330.3495 | 20.4531 | 1342.1689 | 854.3625 |
| 20438 | 99.5311 | 617.2545 | 28.8125 | 307.4408 | 83.9904 |
| 115 | 99.5311 | 52.8930 | 0.1004 | 58.5412 | 25.6974 |
| 16414 | 99.5311 | 34.7185 | 0.0686 | 41.8295 | 23.7064 |
| 1885 | 99.5311 | 51.1715 | 0.0728 | 48.2353 | 17.4862 |
| 3548 | 99.5311 | 280.5650 | 0.6732 | 215.2980 | 49.3444 |
| 17309 | 99.5311 | 77.9270 | 0.2107 | 59.8717 | 15.5407 |
| 18864 | 99.4725 | 117.0395 | 0.1648 | 144.9309 | 33.2411 |
| 14504 | 99.4725 | 52.8135 | 0.8634 | 178.4602 | 110.1545 |
| 20162 | 99.4725 | 281.9085 | 5.4101 | 76.0633 | 83.6833 |
| 13681 | 99.4725 | 32.9630 | 0.0323 | 66.0781 | 23.7046 |
| 15790 | 99.4725 | 72.4130 | 0.1344 | 51.0703 | 22.2470 |
| 17586 | 99.4725 | 33.3265 | 10.8689 | 158.5821 | 44.3925 |
| 4228 | 99.4725 | 398.1900 | 4.3643 | 193.6577 | 76.5714 |
| 20779 | 99.4725 | 368.2370 | 20.0323 | 896.7227 | 267.1937 |
| 20755 | 99.4725 | 2179.0060 | 45.5588 | 1188.6748 | 370.9628 |
| 14979 | 99.4725 | 21.5100 | 0.0679 | 22.0780 | 11.0537 |
| 17517 | 99.4725 | 726.1975 | 1.3626 | 552.5644 | 179.5244 |
| 21643 | 99.4138 | 2102.1300 | 4.4110 | 2300.1230 | 625.2893 |
| 556 | 99.4138 | 168.3630 | 1.0338 | 264.5077 | 89.4104 |
| 15660 | 99.4138 | 130.6170 | 1.8752 | 64.0020 | 30.9894 |
| 13323 | 99.4138 | 94.9700 | 0.4709 | 50.4040 | 33.3464 |
| 15470 | 99.4138 | 333.1695 | 0.6626 | 353.6006 | 94.0953 |
| 21586 | 99.4138 | 21.0970 | 7.4402 | 136.7646 | 58.9276 |
| 108 | 99.4138 | 731.4825 | 14.6817 | 1571.7044 | 614.4663 |
| 23699 | 99.3552 | 170.3400 | 0.3719 | 291.9691 | 298.6916 |
| 16698 | 99.3552 | 27.7150 | 0.1994 | 11.9061 | 8.2982 |
| 242 | 99.3552 | 53.6150 | 0.1174 | 43.5077 | 16.8298 |
| 24767 | 99.3552 | 156.1225 | 11.3880 | 60.2149 | 22.9960 |
| 358 | 99.2966 | 230.0405 | 5.9192 | 732.9759 | 316.9146 |
| 16376 | 99.2966 | 37.4105 | 0.0785 | 31.0601 | 16.6241 |
| 22174 | 100.0000 | 205.6700 | 3.3474 | 94.9925 | 26.9727 |
| 8027 | 100.0000 | 122.2760 | 9.9646 | 18.2553 | 13.8968 |
| 6147 | 100.0000 | 200.8985 | 0.0347 | 100.6404 | 30.4775 |
| 17474 | 100.0000 | 1291.5670 | 5.7318 | 679.3195 | 163.1374 |
| 13985 | 100.0000 | 244.5035 | 0.0078 | 275.2951 | 262.2200 |
| 13153 | 100.0000 | 190.0490 | 0.0113 | 143.8630 | 57.9187 |
| 6799 | 100.0000 | 123.7440 | 0.0057 | 103.1598 | 42.7064 |
| 9325 | 100.0000 | 144.3870 | 0.0127 | 209.5860 | 71.9568 |
| 10991 | 100.0000 | 912.0790 | 0.7071 | 627.7052 | 111.7686 |
| 1440 | 100.0000 | 135.7105 | 0.4533 | 76.5043 | 23.0366 |

TABLE 5U-continued

DMN
Timepoint(s): 24 hrs

| GLGC ID NO. | LDA Score | Mean Tox | SD Tox | Mean Nontox | SD Nontox |
|---|---|---|---|---|---|
| 22970 | 100.0000 | 103.2145 | 1.2042 | −2.9767 | 38.8720 |
| 21572 | 100.0000 | 724.1235 | 0.0389 | 780.8137 | 210.3820 |
| 26084 | 100.0000 | 565.9055 | 7.4522 | 158.4507 | 84.7587 |
| 24151 | 100.0000 | 90.6905 | 0.0007 | 36.2019 | 19.6956 |
| 21353 | 100.0000 | 2035.0175 | 16.5753 | 793.3389 | 212.7487 |
| 17738 | 100.0000 | 125.1550 | 2.5498 | 20.0347 | 26.2476 |
| 24555 | 100.0000 | 61.8395 | 0.0092 | 38.0776 | 33.3072 |
| 19561 | 100.0000 | 188.2150 | 0.0665 | 308.2321 | 125.4348 |
| 6667 | 99.9414 | 212.1885 | 12.4514 | 116.3236 | 28.0924 |
| 19034 | 99.9414 | 26.2820 | 0.0552 | 9.2506 | 11.8086 |
| 17528 | 99.9414 | 141.0645 | 0.2440 | 246.1902 | 51.7181 |
| 6558 | 99.9414 | 318.3495 | 0.4137 | 540.1442 | 124.1451 |
| 8418 | 99.9414 | 285.7685 | 0.0290 | 373.9372 | 132.4638 |
| 8086 | 99.9414 | 11.0890 | 0.0198 | 49.6469 | 43.4989 |
| 17529 | 99.9414 | 78.5900 | 0.0297 | 80.0136 | 24.8642 |
| 6492 | 99.9414 | 44.7450 | 0.0537 | 17.8360 | 25.5044 |
| 18379 | 99.9414 | 401.3960 | 0.0820 | 373.0676 | 85.5194 |
| 4747 | 99.9414 | 299.9595 | 4.0722 | 98.5272 | 39.9667 |
| 9906 | 99.9414 | 75.3555 | 0.0361 | 14.9610 | 33.8130 |
| 17513 | 99.9414 | 55.9815 | 0.0078 | 78.4821 | 33.9200 |
| 22701 | 99.9414 | 26.4200 | 0.0071 | 28.4175 | 28.1892 |
| 23759 | 99.9414 | 227.1575 | 1.6157 | 100.4637 | 34.9568 |
| 22769 | 99.9414 | 69.7425 | 0.0233 | 102.3249 | 56.9026 |
| 18876 | 99.9414 | 658.4180 | 0.1909 | 691.4859 | 191.9322 |
| 3104 | 99.8828 | 126.2635 | 0.1789 | 63.9632 | 29.5988 |
| 13062 | 99.8828 | 84.5605 | 0.0728 | 92.5682 | 35.6931 |
| 23081 | 99.8828 | 51.5620 | 1.5910 | 15.7782 | 16.0691 |
| 8604 | 99.8828 | 34.6835 | 0.0163 | 25.3206 | 15.0015 |
| 21806 | 99.8828 | 66.7775 | 0.0304 | 98.3640 | 34.4372 |
| 4655 | 99.8828 | 19.4510 | 0.0042 | 28.0757 | 23.9776 |
| 7873 | 99.8828 | 36.7330 | 0.0339 | 40.1959 | 19.0815 |
| 18961 | 99.8828 | 1000.3145 | 17.5921 | 423.7977 | 125.6934 |
| 5453 | 99.8828 | 39.2675 | 0.0332 | 58.8653 | 45.4817 |
| 18110 | 99.8828 | 111.8010 | 0.0297 | 127.8006 | 36.8793 |
| 13678 | 99.8242 | 20.6130 | 0.0396 | 25.6403 | 25.5890 |
| 10458 | 99.8242 | 83.7235 | 0.0149 | 118.7926 | 44.4066 |
| 21592 | 99.8242 | 398.8370 | 0.9829 | 596.3255 | 212.3377 |
| 22957 | 99.8242 | 1379.7135 | 44.9246 | 597.2299 | 222.2204 |
| 8856 | 99.8242 | 130.9280 | 0.3323 | 70.7312 | 24.5996 |
| 14130 | 99.8242 | 143.9970 | 0.1909 | 83.5191 | 47.5646 |
| 21085 | 99.8242 | 102.9440 | 0.7905 | 57.8865 | 22.0833 |
| 6332 | 99.8242 | 54.4380 | 0.0311 | 52.9086 | 25.0094 |
| 13758 | 99.8242 | 113.0065 | 3.0003 | 46.9544 | 18.7290 |
| 13044 | 99.8242 | 89.2195 | 0.0431 | 104.2351 | 55.0868 |
| 3347 | 99.8242 | 27.8610 | 0.2857 | 9.6364 | 11.6084 |
| 2954 | 99.8242 | 608.3940 | 20.3321 | 198.1768 | 123.3631 |
| 9121 | 99.8242 | 190.8800 | 5.1817 | 72.1073 | 28.6426 |
| 23557 | 99.8242 | 225.1705 | 1.5450 | 104.3797 | 42.3266 |
| 2583 | 99.8242 | 1221.1515 | 0.9581 | 1640.1026 | 563.0633 |
| 21479 | 99.8242 | 77.2270 | 0.2121 | 33.1952 | 27.8112 |
| 23468 | 99.8242 | 582.9730 | 5.8308 | 326.1892 | 89.1417 |
| 15615 | 99.8242 | 6717.9282 | 4.9201 | 7829.1500 | 2565.7516 |
| 16528 | 99.8242 | 115.7955 | 0.2765 | 54.4483 | 24.5751 |
| 8191 | 99.8242 | 77.8235 | 0.0262 | 84.4481 | 23.9191 |

TABLE 5V

ESTRADIOL
Timepoint(s): 24 hrs

| GLGC ID NO. | LDA Score | Mean Tox | SD Tox | Mean Nontox | SD Nontox |
|---|---|---|---|---|---|
| 15777 | 99.7653 | 36.6367 | 0.0351 | 35.6415 | 15.0059 |
| 20090 | 99.3545 | 193.2800 | 0.3315 | 192.6974 | 49.6871 |
| 15115 | 99.1784 | 72.8633 | 0.3057 | 59.8138 | 19.0615 |
| 7602 | 99.1197 | 440.9400 | 1.4725 | 350.4556 | 100.5816 |
| 670 | 99.0610 | 181.3033 | 2.8415 | 312.9971 | 123.9643 |
| 570 | 98.4742 | 387.7267 | 8.1677 | 258.6718 | 81.3305 |
| 1796 | 98.4155 | 363.5067 | 110.5558 | 68.2220 | 63.3756 |

TABLE 5V-continued

ESTRADIOL
Timepoint(s): 24 hrs

| GLGC ID NO. | LDA Score | Mean Tox | SD Tox | Mean Nontox | SD Nontox |
|---|---|---|---|---|---|
| 24577 | 98.4155 | 2776.3600 | 24.2750 | 2172.7274 | 532.0246 |
| 20587 | 98.3568 | 220.3533 | 2.6533 | 251.9247 | 123.5360 |
| 25921 | 98.0634 | 35.1533 | 0.2701 | 38.9430 | 20.5406 |
| 20973 | 97.8873 | 208.5700 | 0.9656 | 198.6188 | 55.2730 |
| 23523 | 97.7700 | 561.2133 | 2.9980 | 578.3497 | 178.7237 |
| 3149 | 97.5352 | 71.7933 | 4.9072 | 6.7880 | 30.4294 |
| 12360 | 97.5352 | 29.9867 | 0.3395 | 30.7709 | 18.6078 |
| 13369 | 97.3592 | 256.2667 | 1.5351 | 229.4971 | 52.8205 |
| 6581 | 97.2418 | 30.3933 | 0.3782 | 32.4896 | 17.9967 |
| 25064 | 97.1831 | 3001.1467 | 55.1190 | 2135.9668 | 510.3086 |
| 25209 | 96.9484 | 185.1867 | 1.0489 | 173.0567 | 35.4292 |
| 21066 | 96.9484 | 287.6767 | 16.2441 | 184.8943 | 43.9803 |
| 15927 | 96.9484 | 82.0933 | 1.6819 | 60.4739 | 23.1258 |
| 23699 | 96.7723 | 546.6033 | 98.7900 | 290.7870 | 298.5019 |
| 20983 | 96.7723 | 173.0633 | 12.7458 | 125.5177 | 133.4269 |
| 16870 | 96.5376 | 20.9567 | 0.3232 | 16.9734 | 8.3221 |
| 16712 | 96.4789 | 659.8833 | 29.3393 | 454.6113 | 96.9406 |
| 11844 | 96.4202 | 8.5300 | 0.9207 | 21.9737 | 22.1481 |
| 16965 | 96.4202 | 252.4700 | 2.7239 | 241.8907 | 67.5973 |
| 24506 | 96.3028 | 21.5933 | 0.7490 | 47.1508 | 69.7279 |
| 1262 | 96.3028 | 27.4000 | 0.8002 | 42.6101 | 24.3312 |
| 5034 | 96.3028 | 1318.5767 | 19.3753 | 1039.3599 | 286.9719 |
| 3858 | 96.3028 | 32.7033 | 0.5727 | 28.2671 | 11.9223 |
| 16664 | 96.2441 | 19.2400 | 0.4151 | 20.0313 | 11.5476 |
| 17894 | 96.1854 | 125.7667 | 7.6916 | 81.5875 | 21.3502 |
| 25088 | 96.1268 | 38.8333 | 0.8100 | 29.7323 | 26.4770 |
| 164 | 96.0681 | 513.0767 | 6.5530 | 594.5647 | 137.9015 |
| 23226 | 96.0681 | 25.7433 | 1.2173 | 57.3303 | 24.4815 |
| 17829 | 96.0094 | 32.8600 | 1.2739 | 76.4422 | 81.3698 |
| 17758 | 96.0094 | 127.6933 | 49.3470 | 55.8678 | 229.2153 |
| 12859 | 95.8333 | 65.8400 | 0.9725 | 72.8148 | 39.8066 |
| 16807 | 95.8333 | 1302.3367 | 96.6403 | 868.4186 | 713.6275 |
| 395 | 95.7746 | 28.1067 | 0.6133 | 36.2480 | 26.6193 |
| 18501 | 95.7746 | 135.0300 | 3.1900 | 178.8630 | 108.5883 |
| 28 | 95.6573 | 23.2000 | 0.7892 | 58.7510 | 45.9171 |
| 25664 | 95.5986 | 24.1533 | 2.4310 | 144.8591 | 201.9602 |
| 20914 | 95.5986 | 679.4700 | 294.5337 | 193.7906 | 183.8539 |
| 1498 | 95.5986 | 1.4500 | 2.7635 | 22.5316 | 17.8642 |
| 20919 | 95.5399 | 477.5400 | 8.8549 | 485.4211 | 187.8234 |
| 11494 | 95.4812 | 133.2400 | 2.1389 | 170.6646 | 145.4726 |
| 1394 | 95.4225 | 53.7267 | 10.7183 | 25.0140 | 11.0395 |
| 15360 | 95.2465 | 241.4267 | 5.7794 | 192.0925 | 61.7288 |
| 25496 | 95.1878 | 93.2100 | 0.9924 | 104.5824 | 25.4717 |
| 20194 | 95.1291 | 37.3933 | 3.6295 | 16.4569 | 10.6660 |
| 2121 | 95.0117 | 15.5933 | 0.4102 | 20.2698 | 8.2986 |
| 24407 | 94.9531 | 36.9333 | 0.6966 | 33.4512 | 12.6278 |
| 20153 | 94.8944 | 169.2700 | 11.8703 | 319.6265 | 120.5809 |
| 19834 | 94.8944 | 463.9267 | 26.9481 | 314.7107 | 80.0148 |
| 1058 | 94.8357 | 74.2533 | 6.9996 | 181.3800 | 114.2473 |
| 13091 | 94.8357 | 295.1333 | 50.0086 | 171.7328 | 54.5103 |
| 964 | 94.7770 | 28.8400 | 1.0368 | 36.9314 | 34.3498 |
| 18726 | 94.7770 | 139.4333 | 4.9413 | 194.4090 | 85.5735 |
| 4280 | 94.7770 | 292.4600 | 53.3118 | 718.1788 | 282.6733 |
| 25325 | 94.7183 | 470.4533 | 38.1299 | 978.0563 | 543.6698 |
| 25292 | 94.6596 | 55.6900 | 2.4538 | 90.0709 | 40.0263 |
| 16354 | 94.6596 | 101.0767 | 4.9526 | 68.6735 | 93.7445 |
| 20772 | 94.6009 | 164.1367 | 8.3877 | 115.9224 | 32.6219 |
| 3512 | 94.5423 | 200.3033 | 11.2446 | 145.8926 | 45.9488 |
| 20464 | 94.4836 | 101.0233 | 10.3469 | 256.6584 | 162.3352 |
| 15539 | 94.4836 | 20.4833 | 1.2925 | 16.7992 | 17.4982 |
| 10623 | 94.4249 | 43.6333 | 1.5101 | 68.4611 | 58.7974 |
| 53 | 94.4249 | 41.6567 | 1.0849 | 69.7079 | 44.3659 |
| 15239 | 94.3662 | 2151.0367 | 75.4487 | 1649.1201 | 420.7544 |
| 1201 | 94.3075 | 55.8800 | 1.7875 | 81.6363 | 44.3806 |
| 15106 | 94.2488 | 5469.5900 | 227.0968 | 4021.2397 | 1010.1486 |
| 4325 | 94.2488 | 32.4167 | 0.7123 | 36.9522 | 12.3437 |
| 20519 | 94.2488 | 199.4800 | 4.3927 | 176.1894 | 67.3224 |
| 21054 | 94.1315 | 80.7567 | 7.7974 | 173.7877 | 99.6279 |
| 10016 | 94.1315 | 260.8467 | 3.8202 | 231.7377 | 66.4078 |
| 1390 | 94.0728 | 26.4267 | 2.1274 | 55.2671 | 52.1384 |
| 1126 | 94.0728 | 63.0933 | 1.5841 | 50.2154 | 18.8851 |
| 6406 | 94.0141 | 200.0833 | 5.5546 | 251.4822 | 97.4498 |
| 12580 | 94.0141 | 30.1300 | 1.9959 | 19.9293 | 6.8673 |

TABLE 5V-continued

ESTRADIOL
Timepoint(s): 24 hrs

| GLGC ID NO. | LDA Score | Mean Tox | SD Tox | Mean Nontox | SD Nontox |
|---|---|---|---|---|---|
| 8768 | 93.9554 | 56.5267 | 1.5875 | 59.9890 | 20.9280 |
| 25204 | 93.9554 | 52.0000 | 6.6651 | 106.4409 | 56.3832 |
| 17729 | 93.9554 | 2602.3967 | 50.0897 | 2188.6019 | 430.5881 |
| 15312 | 93.9554 | 280.4267 | 12.0938 | 219.8715 | 126.5192 |
| 1525 | 93.8380 | 26.4500 | 1.0376 | 18.9245 | 10.5674 |
| 193 | 93.7793 | 14.0500 | 0.6451 | 27.4841 | 32.9704 |
| 24513 | 93.7793 | 16.9067 | 0.7009 | 20.5966 | 20.6945 |
| 21730 | 93.7793 | 232.2367 | 24.9819 | 147.9182 | 67.1400 |
| 1561 | 93.7207 | 59.6700 | 18.5670 | 247.8616 | 146.8644 |
| 25964 | 93.6620 | 5.0133 | 2.4803 | 54.7197 | 47.0318 |
| 4426 | 93.6620 | 431.1533 | 38.5810 | 276.9446 | 76.7217 |
| 23491 | 93.6620 | 256.0800 | 9.2831 | 225.3448 | 88.4238 |
| 690 | 93.6033 | 31.8033 | 0.9229 | 55.6205 | 42.2173 |
| 4678 | 93.6033 | −0.3433 | 5.3020 | 28.7520 | 27.9267 |
| 16590 | 93.5446 | 27.7600 | 0.8754 | 29.7352 | 30.3229 |
| 200 | 93.5446 | 60.9600 | 1.8003 | 52.5148 | 22.8315 |
| 18844 | 93.4272 | 90.8733 | 11.6151 | 52.2494 | 19.9976 |
| 21848 | 93.3685 | 397.2467 | 25.5448 | 281.8091 | 70.7683 |
| 968 | 93.3099 | 45.8467 | 5.3084 | 37.5151 | 39.1903 |
| 4373 | 93.3099 | 290.5000 | 5.8868 | 292.4321 | 67.4272 |
| 16140 | 98.9437 | 144.4767 | 1.0337 | 114.2484 | 64.8719 |
| 7179 | 98.8850 | 31.0933 | 0.3213 | 26.0635 | 33.7012 |
| 22805 | 98.8263 | 355.8267 | 0.9804 | 371.7700 | 89.8950 |
| 3584 | 98.8263 | 55.3600 | 0.3477 | 38.4291 | 23.1974 |
| 19105 | 98.6502 | 2188.1600 | 15.1648 | 1651.5165 | 389.7850 |
| 17545 | 98.5329 | 12.7733 | 4.7240 | 105.8884 | 57.6631 |
| 10367 | 98.5329 | 88.2200 | 0.9111 | 69.6730 | 24.5880 |
| 13058 | 98.4742 | 42.4267 | 1.0410 | 9.3654 | 23.7996 |
| 11404 | 98.2981 | 547.7067 | 4.5172 | 431.6338 | 125.6589 |
| 23009 | 98.1808 | −5.9300 | 0.7594 | 24.2772 | 32.3308 |
| 7691 | 98.0634 | 4.3800 | 2.0627 | 53.2877 | 56.3273 |
| 12453 | 98.0634 | 55.1367 | 0.3453 | 46.6005 | 28.0025 |
| 13173 | 97.7113 | 102.1967 | 0.7150 | 81.1901 | 58.0766 |
| 6483 | 97.6526 | 570.9133 | 3.7477 | 578.6329 | 135.2430 |
| 22600 | 97.5939 | 79.9033 | 1.3147 | 110.3617 | 52.0828 |
| 21355 | 97.5939 | 731.8967 | 62.8514 | 433.0226 | 450.4076 |
| 14776 | 97.4765 | 81.2567 | 0.5823 | 87.7682 | 26.7101 |
| 5715 | 97.4765 | 85.6467 | 1.8230 | 138.4224 | 70.5134 |
| 9569 | 97.2418 | 38.8900 | 0.5565 | 55.8785 | 28.7865 |
| 5834 | 97.1831 | 24.1400 | 1.4438 | 6.8363 | 12.0327 |
| 6132 | 97.1244 | 116.7000 | 1.5788 | 167.3389 | 70.6646 |
| 3357 | 97.1244 | 22.2967 | 0.9844 | 22.7320 | 38.6371 |
| 13838 | 97.0657 | 152.2400 | 0.9789 | 175.8677 | 33.1388 |
| 5277 | 97.0657 | −11.3567 | 2.4721 | 20.3192 | 51.9831 |
| 22532 | 97.0070 | −14.4367 | 4.3245 | 28.5391 | 31.4396 |
| 10123 | 96.8897 | 42.8967 | 3.6328 | 7.1414 | 33.5318 |
| 18404 | 96.7723 | 421.3467 | 2.0216 | 438.6721 | 88.3349 |
| 22645 | 96.7136 | 129.9933 | 1.3411 | 126.2877 | 37.6962 |
| 4089 | 96.6549 | 21.4033 | 0.8615 | 40.5899 | 35.3357 |
| 22361 | 96.6549 | 69.3567 | 1.7208 | 44.3362 | 25.6596 |
| 22636 | 96.6549 | 120.3333 | 1.5454 | 133.1039 | 53.4829 |
| 17339 | 96.5962 | 115.9833 | 3.2244 | 268.5033 | 296.6351 |
| 24050 | 96.5376 | 396.4867 | 20.5215 | 201.1032 | 135.7277 |
| 5336 | 96.4789 | 27.8433 | 0.8900 | 18.9348 | 12.2811 |
| 18909 | 96.4789 | 191.1533 | 10.8717 | 365.5577 | 199.0844 |
| 4847 | 96.4202 | 61.1500 | 2.0092 | 34.3076 | 18.6931 |
| 20396 | 96.4202 | 492.7833 | 7.2476 | 423.6362 | 93.4288 |
| 23851 | 96.3028 | 262.2467 | 6.9065 | 370.0065 | 162.8297 |
| 13657 | 96.3028 | 161.2767 | 2.4825 | 162.7452 | 70.8310 |
| 8872 | 96.1854 | 1084.5367 | 12.1680 | 932.2225 | 246.5842 |
| 7743 | 96.1854 | 54.6267 | 1.3155 | 90.2927 | 58.4759 |
| 13573 | 96.1854 | 109.5967 | 1.2531 | 98.8511 | 38.7330 |
| 19621 | 96.1854 | 1.8533 | 3.4065 | 57.4855 | 55.4767 |
| 6786 | 96.1854 | 124.8000 | 3.1056 | 172.2546 | 59.7745 |
| 6784 | 96.1854 | −15.2000 | 4.3791 | 22.1502 | 22.3818 |
| 7192 | 96.0681 | 46.3133 | 1.4080 | 39.3881 | 28.4581 |
| 6726 | 96.0681 | 22.4700 | 1.3657 | 11.6330 | 23.0024 |
| 17440 | 96.0094 | 170.3767 | 3.1841 | 146.8999 | 43.2394 |
| 24251 | 95.8920 | 1.8533 | 2.1523 | 69.8215 | 88.3056 |
| 24259 | 95.8920 | 47.3133 | 8.7157 | 9.4562 | 18.4446 |
| 13426 | 95.8333 | 758.2933 | 11.5759 | 617.6211 | 154.1638 |
| 7579 | 95.7746 | 23.2800 | 1.9203 | 42.2562 | 51.2330 |
| 14841 | 95.7746 | 160.6333 | 1.6758 | 146.3993 | 38.2831 |
| 13237 | 95.7746 | 30.6867 | 1.3051 | 10.3230 | 23.6487 |
| 11127 | 95.7746 | 69.3267 | 1.0729 | 67.6546 | 26.4007 |
| 10531 | 95.7746 | 44.8300 | 1.3517 | 31.7646 | 11.6661 |
| 12717 | 95.7160 | 43.1567 | 20.4871 | 2.3161 | 14.7785 |
| 9702 | 95.6573 | 41.0100 | 1.0053 | 33.4895 | 21.7603 |
| 4585 | 95.6573 | 1507.8000 | 16.7397 | 1350.0070 | 325.5768 |

TABLE 5W

ESTRADIOL
Timepoint(s): 3, 6 hrs

| GLGC ID NO. | LDA Score | Mean Tox | SD Tox | Mean Nontox | SD Nontox |
|---|---|---|---|---|---|
| 14015 | 95.9364 | 7.4500 | 2.0757 | 36.2586 | 52.5492 |
| 20601 | 94.9352 | 125.8983 | 25.4022 | 382.4826 | 304.1164 |
| 15190 | 94.6996 | 9167.3150 | 1934.8056 | 3963.7132 | 1940.8538 |
| 15191 | 94.2285 | 6864.4833 | 1750.4759 | 3002.2267 | 1397.7873 |
| 15189 | 94.0518 | 8412.9000 | 1402.9765 | 3850.7153 | 2047.7123 |
| 17764 | 93.6396 | 3869.5183 | 558.6225 | 2518.9364 | 638.5703 |
| 3015 | 93.0506 | 5202.7150 | 503.9416 | 3390.1757 | 1054.1117 |
| 16210 | 92.8151 | 123.3500 | 11.7221 | 195.9977 | 51.2635 |
| 20865 | 92.6973 | 66.9350 | 6.4646 | 34.1428 | 23.7925 |
| 17469 | 92.6973 | 34.2417 | 3.7311 | 72.1749 | 33.2967 |
| 20600 | 92.0495 | 62.7683 | 16.8436 | 213.3377 | 192.4126 |
| 25682 | 91.9906 | 51.3317 | 2.3507 | 73.2853 | 30.4119 |
| 16023 | 91.7550 | 30.1083 | 7.3382 | 81.9804 | 37.8459 |
| 24430 | 91.6372 | 38.1517 | 4.0548 | 23.5251 | 14.7870 |
| 23310 | 91.4605 | 39.0817 | 8.2286 | 91.1889 | 36.4372 |
| 2040 | 91.1072 | 71.6667 | 10.4802 | 131.2543 | 44.8144 |
| 4647 | 91.0483 | 109.0367 | 23.1612 | 213.9934 | 64.1036 |
| 14882 | 90.9305 | 319.5850 | 34.2503 | 354.9272 | 236.4545 |
| 16681 | 90.8716 | 72.3300 | 27.2077 | 209.5454 | 118.6008 |
| 23301 | 90.8716 | 81.1167 | 16.7956 | 146.4708 | 39.2242 |
| 18582 | 90.8127 | 91.5150 | 12.8252 | 169.8251 | 58.5977 |
| 20519 | 90.6360 | 252.8333 | 24.5334 | 175.7301 | 67.1192 |
| 17997 | 90.5183 | 16.9633 | 5.9458 | 49.8967 | 24.0680 |
| 19112 | 90.4005 | 35.5283 | 9.3830 | 79.6818 | 35.5738 |
| 17815 | 90.3416 | 11.3500 | 4.5647 | 31.9591 | 15.7313 |
| 18043 | 90.2238 | 245.5817 | 47.5548 | 134.7912 | 78.5740 |
| 24649 | 90.1060 | 70.6117 | 4.8791 | 92.4713 | 26.6086 |
| 3455 | 90.1060 | 574.6933 | 55.7057 | 428.9242 | 167.2514 |
| 11966 | 89.9882 | 98.9950 | 5.8306 | 133.2732 | 36.6442 |
| 22918 | 89.7527 | 125.3867 | 8.7212 | 182.5789 | 65.7887 |
| 17082 | 89.6938 | 28.3333 | 9.8518 | 58.3442 | 23.4933 |
| 18108 | 89.5760 | 891.1683 | 39.6411 | 708.5249 | 181.2037 |
| 4523 | 89.5171 | 7.2717 | 3.5616 | 24.6725 | 13.8623 |
| 17959 | 89.3993 | 37.0300 | 6.3590 | 60.3188 | 33.2192 |
| 4243 | 89.2226 | 56.5200 | 17.9940 | 122.7986 | 46.4123 |
| 23709 | 89.1637 | 22.5133 | 10.6099 | 61.9253 | 27.8480 |
| 862 | 89.1048 | 334.7233 | 8.6048 | 302.8110 | 69.5750 |
| 6013 | 88.9870 | 568.5733 | 42.3269 | 525.9798 | 271.0971 |
| 15997 | 88.9282 | 544.8900 | 128.1960 | 289.6059 | 218.3472 |
| 15203 | 88.9282 | 327.9733 | 32.4177 | 254.7117 | 58.5132 |
| 12700 | 88.9282 | 880.9300 | 72.1025 | 665.0876 | 313.7196 |
| 19227 | 88.8693 | 73.3533 | 15.9414 | 122.9497 | 34.1755 |
| 17779 | 88.8693 | 288.3767 | 15.0954 | 357.5955 | 74.5108 |
| 16301 | 88.8104 | 288.1717 | 85.2848 | 145.0101 | 147.1031 |
| 23980 | 88.8104 | 17.7383 | 10.3327 | 60.5939 | 30.6058 |
| 15265 | 88.7515 | 643.7250 | 59.8111 | 489.1888 | 115.6497 |
| 23543 | 88.7515 | 231.1900 | 16.3098 | 341.3952 | 126.4711 |
| 25209 | 88.6337 | 124.6350 | 17.6923 | 173.4418 | 35.2364 |
| 4327 | 88.5748 | 442.2050 | 17.9482 | 330.4861 | 116.1841 |
| 21800 | 88.4570 | 46.7767 | 11.8329 | 84.7152 | 26.9302 |
| 4486 | 88.4570 | 31.9617 | 4.4646 | 50.8492 | 17.9376 |
| 20628 | 88.3392 | 43.4383 | 9.8886 | 376.2653 | 452.1360 |
| 2641 | 88.3392 | 17.7533 | 15.6835 | 49.3137 | 20.7293 |
| 1877 | 88.2803 | 163.2117 | 16.1524 | 227.8820 | 68.7031 |
| 9929 | 88.2803 | 122.0517 | 16.3367 | 230.7063 | 125.9980 |

TABLE 5W-continued

ESTRADIOL
Timepoint(s): 3, 6 hrs

| GLGC ID NO. | LDA Score | Mean Tox | SD Tox | Mean Nontox | SD Nontox |
|---|---|---|---|---|---|
| 17507 | 88.2214 | 237.0767 | 54.3189 | 412.3749 | 117.7954 |
| 11611 | 88.2214 | 50.6167 | 4.5348 | 79.1007 | 38.5138 |
| 4517 | 88.1625 | 34.3217 | 5.0384 | 57.4682 | 20.9413 |
| 17308 | 88.1037 | 26.9183 | 3.8748 | 42.0561 | 13.3979 |
| 488 | 87.9270 | 289.5633 | 98.5507 | 1435.0396 | 1088.8220 |
| 17512 | 87.9270 | 168.3700 | 16.1437 | 228.7933 | 48.9760 |
| 16524 | 87.8681 | 18.0950 | 6.6030 | 38.0841 | 14.7521 |
| 16456 | 87.8681 | 104.5783 | 19.3414 | 172.6927 | 51.8747 |
| 1291 | 87.8681 | 158.4083 | 12.6852 | 207.6356 | 46.7060 |
| 405 | 87.8681 | 295.6917 | 40.5922 | 215.6046 | 115.7355 |
| 5317 | 87.8681 | 680.1450 | 79.1924 | 692.8739 | 480.1527 |
| 17754 | 87.8681 | 254.4750 | 45.7479 | 464.5748 | 162.9727 |
| 9841 | 87.8681 | 808.0567 | 54.0168 | 793.1243 | 299.4511 |
| 10660 | 87.8092 | 74.0483 | 5.6834 | 62.7497 | 19.8749 |
| 17587 | 87.8092 | 243.4000 | 11.4723 | 215.1684 | 52.1856 |
| 20724 | 87.8092 | 24.6900 | 3.9911 | 46.5246 | 20.6937 |
| 23522 | 87.7503 | 261.7233 | 13.8876 | 252.1634 | 79.7373 |
| 16510 | 87.6914 | 89.1083 | 11.1366 | 173.8814 | 80.4262 |
| 25400 | 87.6325 | 977.9383 | 166.8075 | 602.1520 | 308.2381 |
| 446 | 87.5736 | 85.6417 | 7.9352 | 75.3979 | 40.6649 |
| 18564 | 87.4558 | 76.6950 | 6.1079 | 117.0832 | 46.9445 |
| 18032 | 87.3380 | −11.2967 | 19.4382 | 30.5344 | 29.9177 |
| 16708 | 87.3380 | 198.6383 | 15.1582 | 260.9401 | 84.7186 |
| 5107 | 87.3380 | 49.8333 | 6.1750 | 81.4311 | 31.7077 |
| 8097 | 87.3380 | 1237.4800 | 59.8942 | 1038.6759 | 278.7603 |
| 18180 | 87.2792 | 16.3083 | 5.4291 | 35.8572 | 16.0527 |
| 25706 | 87.2497 | 48.9150 | 38.7615 | 3.9442 | 26.7475 |
| 10185 | 87.1025 | 12.9467 | 3.4184 | 28.1031 | 16.0516 |
| 10498 | 87.1025 | 3546.8800 | 249.7858 | 2898.8479 | 679.2523 |
| 4011 | 87.1025 | 627.7050 | 93.7796 | 344.4187 | 238.5615 |
| 3027 | 87.1025 | 2856.4400 | 146.2722 | 2342.0446 | 599.1069 |
| 15135 | 87.0436 | 2505.8533 | 236.7948 | 1888.6190 | 484.5209 |
| 1169 | 86.9258 | 87.7100 | 18.2772 | 179.3153 | 85.2398 |
| 2505 | 86.9258 | 220.0700 | 21.9212 | 223.3024 | 105.7846 |
| 16929 | 86.9258 | 2345.7183 | 128.1357 | 1977.5596 | 400.1011 |
| 23987 | 86.8080 | 67.5050 | 3.9536 | 85.4625 | 31.3117 |
| 17649 | 86.7491 | 6.1433 | 8.9355 | 29.7468 | 17.6809 |
| 22858 | 86.6902 | 57.8650 | 17.7896 | 99.9260 | 31.0688 |
| 15137 | 86.6902 | 1755.9750 | 92.8778 | 1537.6931 | 344.9392 |
| 20896 | 86.6313 | 13.8617 | 5.6783 | 30.6364 | 16.2931 |
| 18810 | 86.5724 | 338.9633 | 50.9081 | 476.7480 | 104.8706 |
| 1973 | 86.4547 | 169.2583 | 34.4704 | 264.5657 | 75.8865 |
| 15800 | 86.4547 | 40.8267 | 2.9786 | 53.0703 | 24.1713 |
| 1899 | 86.4547 | 10.6300 | 5.1894 | 34.2449 | 30.3228 |
| 357 | 86.3958 | 80.2850 | 15.6870 | 56.9612 | 29.4959 |
| 19092 | 95.6419 | 7921.6467 | 357.8214 | 5100.5972 | 1408.9156 |
| 21740 | 95.1708 | 274.3017 | 15.5394 | 438.1631 | 165.4757 |
| 3708 | 95.0530 | 553.3800 | 144.3885 | 213.4637 | 128.0729 |
| 3376 | 94.4641 | −0.0550 | 14.9486 | 23.6759 | 12.4331 |
| 16569 | 94.2285 | 113.8867 | 10.0209 | 176.0609 | 37.8706 |
| 12802 | 93.8163 | 763.6800 | 198.2722 | 423.6223 | 152.7835 |
| 5208 | 93.6985 | 5540.8483 | 699.7549 | 2636.9835 | 1336.9699 |
| 16111 | 93.2273 | 165.9617 | 15.6154 | 274.2269 | 75.1231 |
| 22060 | 92.8740 | −34.4800 | 11.5351 | 27.0342 | 40.1355 |
| 2141 | 92.8740 | 260.0383 | 19.8404 | 425.3062 | 134.2690 |
| 6521 | 92.8151 | 257.2733 | 24.1022 | 172.2920 | 52.7422 |
| 13634 | 92.6973 | 4998.8967 | 697.5690 | 2853.4748 | 1037.1945 |
| 2099 | 92.6973 | 1183.3100 | 74.0262 | 843.9261 | 202.1175 |
| 23530 | 92.6384 | 115.1167 | 4.2949 | 137.6799 | 36.7196 |
| 14622 | 92.4617 | 214.5950 | 34.7123 | 104.3705 | 64.8573 |
| 2246 | 92.2261 | 42.2367 | 13.1786 | 105.1049 | 59.9889 |
| 6440 | 92.2261 | 817.7067 | 28.3416 | 629.2167 | 169.1190 |
| 2603 | 92.1084 | 187.2217 | 16.4073 | 148.2182 | 98.9022 |
| 14424 | 91.9906 | 3469.5183 | 591.3573 | 1747.8921 | 866.4359 |
| 17117 | 91.9906 | 2741.2250 | 254.4631 | 1959.9885 | 423.6502 |
| 26327 | 91.9317 | 24.3500 | 9.7483 | 6.0159 | 10.8045 |
| 13633 | 91.9317 | 2747.1833 | 350.6961 | 1641.9758 | 611.4978 |
| 10176 | 91.8139 | 188.3367 | 18.8885 | 301.5238 | 84.9322 |
| 8477 | 91.7550 | 775.0450 | 159.1300 | 516.7410 | 143.2798 |
| 3133 | 91.7550 | 189.0850 | 17.4704 | 272.7943 | 59.1762 |
| 4001 | 91.6961 | 112.1867 | 7.5530 | 200.2757 | 81.7460 |
| 9432 | 91.6961 | 91.0833 | 17.7474 | 39.2321 | 30.5978 |
| 11446 | 91.5783 | 598.4833 | 25.5114 | 492.0273 | 108.0746 |
| 22969 | 91.5194 | 298.9050 | 30.3133 | 457.4737 | 116.2176 |
| 18669 | 91.5194 | 73.8200 | 13.1564 | 163.2855 | 65.3211 |
| 10269 | 91.4605 | 5046.7200 | 255.4008 | 3899.5250 | 800.9538 |
| 14051 | 91.2839 | 503.6483 | 58.7577 | 342.7065 | 111.3031 |
| 11421 | 91.2250 | 107.7850 | 12.0373 | 171.8655 | 43.2103 |
| 3417 | 91.1661 | 1580.3250 | 95.2824 | 1145.3441 | 328.1766 |
| 22957 | 90.8716 | 814.4950 | 53.0541 | 597.5378 | 225.1902 |
| 23477 | 90.7538 | 61.3617 | 3.5295 | 80.8098 | 46.3543 |
| 10087 | 90.6949 | 177.9333 | 11.2364 | 287.9610 | 134.6420 |
| 15246 | 90.6360 | 48.9150 | 21.0242 | 83.9365 | 21.8349 |
| 9492 | 90.6360 | 49.3467 | 7.4073 | 83.4706 | 24.3122 |
| 2610 | 90.6360 | 3087.4400 | 313.3123 | 2514.2944 | 1640.2004 |
| 3079 | 90.5183 | 175.1517 | 12.3758 | 279.3907 | 117.6706 |
| 22876 | 90.4594 | 158.6733 | 22.1152 | 104.4160 | 35.6967 |
| 14328 | 90.4594 | 96.5933 | 14.1784 | 165.1451 | 51.8878 |
| 15179 | 90.4005 | 2.7333 | 13.3405 | 40.7851 | 28.6783 |
| 12622 | 90.4005 | −21.2333 | 12.8254 | 31.0369 | 35.8592 |
| 14734 | 90.4005 | 28.0500 | 7.0327 | 3.7592 | 31.8280 |
| 3139 | 90.2238 | 5172.0167 | 987.4111 | 3291.9580 | 1106.2295 |
| 8322 | 90.2238 | 21.7950 | 15.8146 | 59.2176 | 23.9984 |
| 22885 | 90.1649 | 3311.5850 | 440.0017 | 2189.4909 | 685.1268 |
| 5637 | 90.1649 | 9.9950 | 17.9449 | 65.6686 | 36.4965 |
| 6291 | 90.1649 | 156.0150 | 16.9060 | 258.8655 | 96.3304 |
| 11404 | 90.1060 | 615.9567 | 75.2152 | 430.7413 | 124.9767 |
| 17479 | 90.1060 | 64.3667 | 9.3776 | 93.1423 | 46.1995 |
| 22688 | 90.1060 | 55.0767 | 23.0803 | 189.5870 | 109.3148 |
| 16175 | 89.9882 | 7824.7950 | 863.4867 | 5453.2757 | 1369.8089 |
| 17755 | 89.9293 | 122.5617 | 19.3752 | 236.8155 | 112.2481 |
| 4335 | 89.8704 | 102.1133 | 7.1788 | 118.5110 | 56.0123 |
| 3612 | 89.8115 | 241.6800 | 53.8698 | 115.6380 | 75.4673 |
| 24721 | 89.6938 | 18.6450 | 5.7678 | 39.4846 | 16.5963 |
| 10195 | 89.6349 | 185.3217 | 26.6365 | 315.3553 | 103.1341 |
| 2416 | 89.6349 | 236.1717 | 27.1880 | 417.8900 | 147.0255 |
| 2299 | 89.5760 | 110.9150 | 10.2370 | 154.6761 | 84.8877 |
| 7111 | 89.5171 | 200.0783 | 24.7526 | 273.8334 | 51.9571 |
| 15148 | 89.5171 | 488.4500 | 19.8265 | 548.5374 | 166.0336 |
| 22600 | 89.4582 | 191.0683 | 33.1576 | 109.6837 | 51.6960 |
| 22914 | 89.4582 | 570.2717 | 38.2628 | 768.0887 | 473.1840 |
| 3737 | 89.4582 | 35.8600 | 6.7825 | 21.1929 | 24.0766 |

TABLE 5X

GEMFIBROZIL
Timepoint(s): 24 hrs

| GLGC ID NO. | LDA Score | Mean Tox | SD Tox | Mean Nontox | SD Nontox |
|---|---|---|---|---|---|
| 891 | 100.0000 | 57.9780 | 22.7123 | 792.5727 | 364.9740 |
| 21103 | 100.0000 | 352.7470 | 2.4593 | 177.7142 | 50.3071 |
| 17999 | 100.0000 | 72.2140 | 15.7246 | 967.7092 | 260.3414 |
| 16204 | 100.0000 | 3140.5050 | 1.3633 | 1867.6155 | 376.3425 |
| 17913 | 100.0000 | 629.6300 | 7.1729 | 230.5575 | 60.1008 |
| 4461 | 100.0000 | −30.1605 | 2.6920 | 27.9762 | 13.5366 |
| 18152 | 100.0000 | 148.4440 | 0.0608 | 71.0558 | 18.2764 |
| 20700 | 100.0000 | 660.5955 | 0.3727 | 3033.8896 | 1095.2713 |
| 18000 | 100.0000 | 150.0980 | 3.5836 | 1238.8431 | 346.4943 |
| 19087 | 100.0000 | 34.8370 | 0.0014 | 22.6736 | 12.8198 |
| 24825 | 100.0000 | 166.1255 | 0.3189 | 853.1212 | 419.9981 |
| 15864 | 100.0000 | 105.6765 | 0.0191 | 163.5531 | 58.6481 |
| 15376 | 100.0000 | 429.1690 | 1.0140 | 243.0715 | 64.8875 |
| 24862 | 100.0000 | −14.1915 | 0.6357 | 131.7352 | 54.7681 |
| 18313 | 100.0000 | 38.6850 | 0.0198 | 26.0188 | 44.0744 |
| 11938 | 100.0000 | 526.7985 | 7.4112 | 1143.7574 | 277.9033 |
| 16400 | 100.0000 | 766.9855 | 120.8735 | 5008.3705 | 1697.7519 |
| 10503 | 100.0000 | 14.9175 | 1.0274 | 183.5102 | 121.4959 |
| 17257 | 99.9414 | −22.3100 | 1.0409 | 33.2762 | 24.3056 |
| 14934 | 99.9414 | 148.3030 | 0.1428 | 112.7899 | 25.0864 |
| 24626 | 99.9414 | 3517.2184 | 21.3384 | 2114.1016 | 353.6343 |
| 25479 | 99.9414 | 90.9970 | 7.5646 | 436.7929 | 163.5942 |

TABLE 5X-continued

GEMFIBROZIL
Timepoint(s): 24 hrs

| GLGC ID NO. | LDA Score | Mean Tox | SD Tox | Mean Nontox | SD Nontox |
|---|---|---|---|---|---|
| 11905 | 99.9414 | 85.7420 | 0.0382 | 57.6611 | 27.2409 |
| 21834 | 99.9414 | 39.0690 | 0.0566 | 10.7834 | 18.6882 |
| 23058 | 99.9414 | 0.0170 | 0.1838 | 20.5057 | 10.5402 |
| 18079 | 99.9414 | 211.2360 | 1.3873 | 112.9897 | 53.4861 |
| 17729 | 99.9414 | 3740.7170 | 9.3678 | 2186.4180 | 424.4259 |
| 4412 | 99.9414 | 553.1410 | 3.3927 | 301.9819 | 73.4835 |
| 16918 | 99.9414 | 5112.4294 | 19.5873 | 3017.7011 | 882.9682 |
| 16417 | 99.9414 | 260.2670 | 0.2998 | 165.1403 | 51.6355 |
| 17281 | 99.9414 | 17.1160 | 0.6421 | 156.2902 | 82.7344 |
| 10016 | 99.9414 | 241.9885 | 0.0403 | 231.8160 | 66.3897 |
| 4352 | 99.9414 | 26.6335 | 0.3458 | −2.0568 | 11.7466 |
| 20896 | 99.8828 | −10.3445 | 1.7034 | 30.6145 | 16.2001 |
| 1516 | 99.8828 | 61.4820 | 0.6265 | 23.8791 | 19.5909 |
| 427 | 99.8828 | 631.8890 | 2.5682 | 1712.8640 | 924.2715 |
| 14959 | 99.8828 | 2597.5034 | 10.3697 | 1630.0084 | 408.4468 |
| 8097 | 99.8828 | 1657.9465 | 2.7641 | 1038.6223 | 277.0228 |
| 18001 | 99.8828 | 33.0820 | 8.0907 | 358.0646 | 124.4128 |
| 656 | 99.8828 | 70.6805 | 0.0290 | 100.4979 | 28.2091 |
| 14996 | 99.8828 | −8.3695 | 0.1351 | 44.1282 | 42.8789 |
| 15932 | 99.8828 | 328.4995 | 1.4149 | 135.8679 | 35.1857 |
| 7875 | 99.8828 | 112.6540 | 0.8316 | 55.4683 | 18.6672 |
| 10306 | 99.8828 | 2064.2914 | 21.0145 | 650.3076 | 230.7671 |
| 19335 | 99.8828 | 528.6560 | 2.4141 | 336.4630 | 93.1191 |
| 16516 | 99.8828 | −5.6190 | 0.3578 | 26.9786 | 20.7532 |
| 16615 | 99.8828 | 41.4290 | 0.9532 | 6.4854 | 5.8430 |
| 556 | 99.8828 | 33.0355 | 4.0708 | 264.8250 | 88.8258 |
| 18060 | 99.8828 | 301.7945 | 1.9170 | 173.9549 | 38.2289 |
| 16367 | 99.8242 | −32.8460 | 3.5497 | 623.7337 | 286.1924 |
| 21400 | 99.8242 | 63.1650 | 2.3688 | 348.1832 | 149.8176 |
| 14970 | 99.8242 | 10.9805 | 0.7205 | 59.1567 | 25.6000 |
| 18358 | 99.8242 | 884.1855 | 3.5178 | 504.6891 | 126.5067 |
| 20848 | 99.8242 | 1625.2790 | 20.1865 | 981.3555 | 197.5591 |
| 17635 | 99.8242 | 76.4400 | 1.1271 | 275.0091 | 132.3821 |
| 504 | 99.8242 | 20.3465 | 0.0318 | 14.2702 | 8.5690 |
| 15154 | 99.8242 | 1077.6445 | 40.0951 | 482.1367 | 167.2712 |
| 16482 | 99.8242 | 268.7165 | 0.6611 | 189.1817 | 44.7613 |
| 19831 | 99.8242 | 233.8855 | 8.0858 | 107.4432 | 32.2145 |
| 7637 | 99.8242 | 108.1690 | 1.1837 | 46.4525 | 16.8638 |
| 19870 | 99.8242 | 92.9975 | 3.6579 | 31.1070 | 13.7351 |
| 1285 | 99.8242 | 203.2245 | 1.7176 | 103.3524 | 35.5581 |
| 26053 | 99.8242 | 414.8170 | 0.9815 | 186.2617 | 152.0722 |
| 1639 | 99.8242 | 45.6460 | 0.6208 | 114.1141 | 36.1955 |
| 18490 | 99.7655 | 201.0005 | 0.4236 | 135.6860 | 33.0218 |
| 23950 | 99.7655 | 191.8915 | 7.7082 | 86.9859 | 24.0886 |
| 25799 | 99.7655 | 128.9675 | 0.1322 | 213.2875 | 141.3784 |
| 25480 | 99.7655 | 25.8080 | 0.0396 | 29.7690 | 28.3762 |
| 25204 | 99.7655 | 15.2615 | 0.3048 | 106.4632 | 56.2704 |
| 18038 | 99.7655 | 12.3210 | 0.1923 | 45.6149 | 22.5872 |
| 626 | 99.7655 | 559.0200 | 27.6705 | 88.5603 | 71.8056 |
| 25962 | 99.7655 | 127.7795 | 0.1888 | 83.8237 | 41.8055 |
| 15688 | 99.7655 | 29.0325 | 0.1945 | 11.4954 | 12.3693 |
| 1041 | 99.7655 | 21.2510 | 0.0806 | 3.3769 | 9.3395 |
| 12932 | 99.7655 | 51.0405 | 0.4023 | 0.4111 | 24.2421 |
| 21014 | 99.7655 | 130.6825 | 8.4054 | 828.8222 | 437.3759 |
| 16922 | 99.7655 | 161.5700 | 2.0266 | 362.6156 | 127.0364 |
| 17204 | 99.7655 | 346.9705 | 44.9939 | 1024.0512 | 267.2032 |
| 25802 | 99.7655 | 647.1835 | 0.4618 | 648.2659 | 152.4099 |
| 20982 | 99.7069 | 251.8350 | 2.6927 | 103.2733 | 34.6272 |
| 1004 | 99.7069 | 167.0760 | 5.6908 | 73.7007 | 19.8296 |
| 15281 | 99.7069 | 1274.7875 | 40.5463 | 544.6479 | 172.7761 |
| 20698 | 99.7069 | −7.8545 | 1.5677 | 374.4346 | 210.0279 |
| 21657 | 99.7069 | 285.7650 | 15.1490 | 887.6602 | 405.3258 |
| 16013 | 99.7069 | 76.1980 | 0.0877 | 57.0948 | 15.0628 |
| 13008 | 99.7069 | 53.3435 | 1.7204 | 280.4627 | 160.8363 |
| 1175 | 99.7069 | −21.5575 | 0.1549 | 42.5681 | 75.8417 |
| 20283 | 99.7069 | 219.0165 | 0.5070 | 145.6425 | 55.3122 |
| 6110 | 99.7069 | 49.4900 | 0.0919 | 33.7993 | 20.8643 |
| 25680 | 99.7069 | 415.6810 | 9.4116 | 1070.7598 | 306.8587 |
| 2367 | 99.7069 | 62.5365 | 4.8826 | 207.7263 | 53.3965 |
| 428 | 99.7069 | 408.6365 | 7.9387 | 1933.4240 | 962.2181 |
| 240 | 99.7069 | 300.4635 | 0.1718 | 254.7996 | 100.1273 |
| 22862 | 99.7069 | 7.0705 | 2.0556 | 153.7047 | 89.6820 |
| 1562 | 99.7069 | 106.2345 | 2.3568 | 321.4104 | 128.6502 |
| 1450 | 99.6483 | 42.9430 | 2.0902 | 14.6996 | 8.0472 |
| 6968 | 99.6483 | 103.0745 | 0.4038 | 154.7418 | 34.3119 |
| 1785 | 99.6483 | 148.1300 | 4.9568 | 55.9406 | 21.5427 |
| 19252 | 99.6483 | 1285.1655 | 2.7839 | 983.2921 | 239.1590 |
| 4433 | 99.6483 | 201.6470 | 0.7255 | 129.7774 | 34.0644 |
| 21414 | 100.0000 | 45.1120 | 0.5473 | 192.2360 | 94.3847 |
| 6018 | 100.0000 | 69.6890 | 0.5374 | 1089.9992 | 1181.9021 |
| 15315 | 100.0000 | 6093.8755 | 0.6401 | 4650.7826 | 1113.8360 |
| 22744 | 100.0000 | 17.3685 | 0.0177 | 55.0555 | 18.1037 |
| 11127 | 100.0000 | 17.2830 | 0.1471 | 67.7786 | 26.2720 |
| 6175 | 100.0000 | 24.4395 | 0.0035 | 26.6274 | 16.7868 |
| 20910 | 100.0000 | 1510.6615 | 12.9054 | 885.0722 | 178.9333 |
| 7983 | 100.0000 | 152.0685 | 0.8450 | 62.2263 | 20.0220 |
| 3677 | 100.0000 | 427.8770 | 0.8358 | 189.7970 | 57.0601 |
| 23424 | 100.0000 | 2145.3285 | 0.6258 | 1354.3276 | 355.6500 |
| 23162 | 100.0000 | 19.8825 | 0.1237 | 420.3028 | 302.1243 |
| 9312 | 100.0000 | 5.7465 | 0.0417 | 34.1231 | 16.2666 |
| 18002 | 100.0000 | 98.5510 | 6.7939 | 1301.3013 | 483.4690 |
| 23159 | 100.0000 | 1594.2170 | 40.8312 | 565.1815 | 275.4117 |
| 18826 | 100.0000 | 6289.1785 | 90.8187 | 1819.3408 | 901.9448 |
| 9829 | 100.0000 | 1064.3615 | 2.2550 | 82.1876 | 93.1961 |
| 4039 | 100.0000 | 227.4660 | 5.1463 | 64.6316 | 31.5157 |
| 15373 | 100.0000 | 1327.1115 | 9.6952 | 529.4636 | 193.9368 |
| 5809 | 100.0000 | 63.4430 | 0.0028 | 44.1631 | 33.3037 |
| 2141 | 100.0000 | 142.6990 | 0.4695 | 424.8063 | 133.9793 |
| 7781 | 100.0000 | 23.0380 | 0.0156 | 6.0301 | 14.7202 |
| 14263 | 100.0000 | 196.1725 | 0.2708 | 108.4057 | 65.0468 |
| 19105 | 99.9414 | 3294.8090 | 82.6764 | 1649.5509 | 382.6456 |
| 6016 | 99.9414 | 85.4555 | 1.1335 | 513.5949 | 235.0521 |
| 23824 | 99.9414 | 608.1620 | 10.9022 | 283.5709 | 88.1566 |
| 13502 | 99.9414 | 413.4770 | 13.8310 | 162.2846 | 54.6755 |
| 16616 | 99.9414 | 570.9840 | 22.8169 | 160.3559 | 73.0640 |
| 12916 | 99.9414 | 18.6380 | 0.0028 | 20.4862 | 19.1484 |
| 4719 | 99.9414 | 27.0475 | 0.0078 | 63.9708 | 26.4701 |
| 9079 | 99.9414 | 67.0295 | 1.0359 | 326.6761 | 227.2947 |
| 2296 | 99.9414 | 72.8825 | 5.8372 | 477.9848 | 182.7014 |
| 13928 | 99.9414 | 17.6405 | 0.1181 | 57.5238 | 29.0990 |
| 2267 | 99.9414 | 456.4670 | 0.9376 | 200.2759 | 65.7386 |
| 11274 | 99.9414 | 77.5365 | 0.0742 | 131.8063 | 41.2690 |
| 3981 | 99.9414 | −13.1520 | 1.6461 | 205.9330 | 218.6302 |
| 17592 | 99.9414 | 253.1340 | 0.2758 | 130.9571 | 53.2344 |
| 6872 | 99.9414 | 1287.8465 | 8.2668 | 526.0131 | 200.0712 |
| 23521 | 99.9414 | 95.1755 | 0.0431 | 275.0689 | 250.8783 |
| 19249 | 99.9414 | 1624.6035 | 28.5848 | 484.2061 | 236.9923 |
| 3326 | 99.9414 | 39.1305 | 0.0318 | 7.2682 | 20.8794 |
| 2787 | 99.9414 | 387.7805 | 0.7220 | 596.8751 | 167.0026 |
| 13286 | 99.9414 | 78.7540 | 0.3776 | 289.7144 | 154.6678 |
| 10641 | 99.9414 | 482.7420 | 1.4397 | 140.2145 | 56.2296 |
| 10941 | 99.8828 | 26.7435 | 0.0799 | 11.8085 | 18.6362 |
| 2339 | 99.8828 | 274.2035 | 0.4900 | 542.1906 | 158.9192 |
| 7223 | 99.8828 | 67.9885 | 2.4940 | 234.5974 | 66.0002 |
| 19669 | 99.8828 | 17.4295 | 0.0686 | 66.4653 | 30.7736 |
| 15085 | 99.8828 | 457.2490 | 1.5118 | 1017.9023 | 337.7514 |
| 10825 | 99.8828 | 559.3730 | 16.1602 | 209.5752 | 63.2411 |
| 7691 | 99.8828 | 2.8740 | 0.1499 | 53.2339 | 56.3161 |
| 4401 | 99.8828 | 10.9095 | 0.2878 | 44.3672 | 17.1855 |
| 19822 | 99.8828 | 274.5565 | 0.3712 | 423.1763 | 104.8925 |
| 10902 | 99.8828 | 310.5465 | 3.3623 | 7.3221 | 106.2591 |
| 19009 | 99.8828 | 2882.6265 | 160.9990 | 1069.2950 | 283.4635 |
| 26173 | 99.8828 | 328.3225 | 1.8166 | 154.3181 | 56.7976 |
| 21894 | 99.8828 | 533.9345 | 10.3937 | 177.6775 | 84.9097 |
| 15751 | 99.8828 | 31.7410 | 0.0057 | 37.4075 | 15.9568 |
| 23749 | 99.8828 | 245.9940 | 2.5428 | 115.7091 | 42.5860 |
| 4107 | 99.8828 | 68.2995 | 0.3104 | 204.6376 | 86.2987 |

TABLE 5Y

GEMFIBROZIL
Timepoint(s): 3, 6 hrs

| GLGC ID NO. | LDA Score | Mean Tox | SD Tox | Mean Nontox | SD Nontox |
|---|---|---|---|---|---|
| 16192 | 95.8235 | 26.0524 | 0.3105 | 28.1627 | 9.6372 |
| 24651 | 95.4118 | 88.5786 | 1.0425 | 90.8984 | 23.2786 |
| 21835 | 94.6471 | 23.0874 | 0.8774 | 14.5993 | 8.1355 |
| 15997 | 94.5882 | 755.6824 | 208.5589 | 288.6663 | 216.0823 |
| 4290 | 94.2353 | 167.0366 | 11.1857 | 128.6356 | 77.8630 |
| 2628 | 94.1765 | 513.9864 | 204.7688 | 184.4014 | 134.5587 |
| 20812 | 94.0588 | 3083.5518 | 70.4052 | 2972.6140 | 742.3632 |
| 13479 | 94.0000 | 174.8156 | 4.4067 | 165.1229 | 59.1525 |
| 20282 | 93.8824 | 3.8280 | 1.0575 | 34.7229 | 47.4168 |
| 18538 | 93.2941 | 50.2250 | 2.4605 | 90.2790 | 63.4608 |
| 1632 | 93.2941 | 25.9402 | 0.9927 | 33.3579 | 18.5509 |
| 14330 | 93.1176 | 283.2154 | 12.8483 | 333.2623 | 230.2419 |
| 22352 | 92.3529 | 741.7320 | 161.4476 | 436.4692 | 224.7733 |
| 24518 | 92.3529 | 619.0768 | 13.7127 | 611.3573 | 148.8992 |
| 22670 | 92.2941 | 72.3686 | 5.6363 | 51.1689 | 24.6316 |
| 11210 | 92.1765 | 67.7244 | 19.4301 | 37.7035 | 19.1317 |
| 21848 | 92.0000 | 252.5148 | 6.5262 | 282.3888 | 71.1547 |
| 12014 | 91.8824 | 347.2714 | 8.7398 | 295.5459 | 66.4043 |
| 20940 | 91.7059 | 1071.2330 | 51.3145 | 1143.4127 | 504.7973 |
| 1035 | 91.2941 | 59.3954 | 2.5539 | 58.5073 | 28.2435 |
| 18079 | 91.0588 | 138.6012 | 4.1963 | 113.0702 | 53.7555 |
| 1813 | 90.8824 | 152.7016 | 67.6086 | 51.9054 | 64.4602 |
| 23543 | 90.8824 | 276.7548 | 11.1362 | 340.9975 | 126.6418 |
| 19067 | 90.6471 | 12.3746 | 1.0643 | 25.1595 | 25.0136 |
| 20868 | 90.6471 | 22.5940 | 2.8008 | 15.5601 | 19.6739 |
| 9134 | 90.4118 | 605.3016 | 24.4099 | 693.6102 | 154.8982 |
| 1356 | 90.2941 | 15.3086 | 2.7497 | 38.7415 | 29.4538 |
| 16146 | 90.2353 | 98.1826 | 4.6022 | 75.8604 | 24.1477 |
| 16468 | 90.0588 | 529.3390 | 17.7182 | 519.6732 | 168.9895 |
| 15647 | 89.7647 | 79.8634 | 7.3649 | 48.0490 | 27.2775 |
| 25531 | 89.7059 | 36.1214 | 5.6779 | 22.0008 | 10.7202 |
| 10071 | 89.6471 | 81.6614 | 22.1625 | 43.9697 | 35.6392 |
| 21654 | 89.6471 | 1184.8664 | 150.2557 | 853.9959 | 223.4421 |
| 20549 | 89.6471 | 28.9430 | 4.3335 | 16.4473 | 19.2909 |
| 17060 | 89.5294 | 44.7930 | 5.5842 | 55.5395 | 43.5963 |
| 21589 | 89.4706 | 125.9200 | 18.6847 | 84.1155 | 27.4426 |
| 21707 | 89.4118 | 215.0292 | 18.7593 | 146.2346 | 82.5806 |
| 4539 | 89.3529 | 25.3444 | 3.6142 | 9.6372 | 14.8622 |
| 20719 | 89.2941 | 138.3752 | 13.3743 | 99.9510 | 33.9549 |
| 13973 | 89.2353 | 30.1746 | 2.6480 | 57.7344 | 32.5529 |
| 18597 | 89.1765 | 1107.1500 | 48.2089 | 1079.1061 | 373.1218 |
| 17161 | 89.1765 | 2744.3006 | 134.6568 | 2232.8815 | 738.2172 |
| 6403 | 89.1176 | 177.9958 | 7.4319 | 174.0769 | 50.6689 |
| 21955 | 89.0588 | 68.1074 | 8.8779 | 38.8995 | 28.7519 |
| 17709 | 89.0000 | 108.5914 | 8.2726 | 89.5435 | 46.8767 |
| 1977 | 88.8824 | 414.9094 | 63.1999 | 286.9487 | 131.2726 |
| 4527 | 88.8235 | 74.9966 | 12.1418 | 50.6772 | 24.6847 |
| 14261 | 88.8235 | 23.7634 | 2.0656 | 34.5420 | 17.5595 |
| 70 | 88.8235 | 123.2140 | 10.0378 | 106.3738 | 50.7063 |
| 4312 | 88.7647 | 53.9818 | 8.4032 | 137.5738 | 142.6727 |
| 18583 | 88.7059 | 38.9130 | 11.7078 | 19.1538 | 13.4573 |
| 412 | 88.7059 | 4975.9194 | 360.0045 | 4394.9721 | 1655.5159 |
| 18714 | 88.6471 | 451.7764 | 29.9084 | 391.4240 | 143.9549 |
| 18445 | 88.5882 | 125.5272 | 11.5614 | 273.5453 | 163.3329 |
| 16381 | 88.5294 | 321.8074 | 17.3590 | 430.8460 | 120.7778 |
| 23226 | 88.4706 | 69.6244 | 3.9014 | 57.1465 | 24.5621 |
| 10498 | 88.4706 | 2971.5530 | 123.6171 | 2902.9946 | 681.2160 |
| 15411 | 88.4118 | 212.9686 | 45.0772 | 133.9224 | 83.9780 |
| 1113 | 88.4118 | 29.3590 | 2.5920 | 25.8072 | 20.3150 |
| 19018 | 88.2353 | 231.7870 | 17.3511 | 200.1697 | 102.2140 |
| 24471 | 88.1765 | 31.3008 | 7.7348 | 26.7249 | 25.0803 |
| 25505 | 88.1765 | 19.2532 | 1.2415 | 24.1520 | 12.2595 |
| 1126 | 88.1176 | 54.4044 | 2.5282 | 50.2362 | 18.9195 |
| 25518 | 88.0000 | 36.9104 | 3.1513 | 41.2061 | 20.0131 |
| 15434 | 87.8824 | 177.8866 | 107.4986 | 49.9605 | 28.6816 |
| 20844 | 87.8824 | 2268.2508 | 118.4658 | 2082.1467 | 642.2616 |
| 10260 | 87.8235 | 55.5444 | 4.9421 | 83.3242 | 31.8393 |
| 17494 | 87.8235 | 23.3910 | 1.5573 | 29.9757 | 9.0980 |
| 23084 | 87.8235 | 22.5278 | 1.7396 | 20.5828 | 14.0740 |
| 15437 | 87.7647 | 70.7694 | 40.7655 | 14.8768 | 12.2052 |
| 442 | 87.7647 | 14.7536 | 1.5554 | 24.5677 | 12.4089 |
| 16147 | 87.7647 | 27.1532 | 4.0071 | 42.9308 | 17.5802 |
| 19241 | 87.7059 | 251.9096 | 29.0674 | 194.5401 | 69.2356 |
| 19391 | 87.7059 | 359.1440 | 25.0126 | 404.9257 | 204.7553 |
| 23524 | 87.6471 | 521.8950 | 39.4063 | 395.4485 | 194.7519 |
| 15829 | 87.5294 | 292.4126 | 164.0932 | 26.7817 | 75.2457 |
| 15372 | 87.5294 | 520.2096 | 22.2412 | 428.2622 | 96.7533 |
| 25689 | 87.4118 | 2667.3282 | 146.6749 | 2453.1727 | 682.7294 |
| 14951 | 87.3529 | −2.8730 | 14.0012 | 34.1179 | 34.7728 |
| 4378 | 87.3529 | 63.6198 | 9.4185 | 42.5137 | 22.3089 |
| 15137 | 87.2941 | 1069.8870 | 138.1188 | 1541.9857 | 343.2685 |
| 1099 | 87.2353 | 93.3982 | 6.2595 | 85.4352 | 33.5609 |
| 20248 | 87.1765 | 28.1572 | 3.3711 | 27.5553 | 17.2393 |
| 2010 | 87.1765 | 3127.7042 | 217.0105 | 2933.6622 | 1113.4032 |
| 17757 | 87.1765 | 68.7980 | 5.7684 | 84.2577 | 29.5837 |
| 17316 | 87.1176 | 160.4396 | 98.9052 | 34.7257 | 25.6670 |
| 20987 | 87.1176 | 166.3364 | 8.0886 | 190.9699 | 42.8722 |
| 24185 | 87.1176 | 76.3350 | 3.4399 | 73.7984 | 21.2096 |
| 695 | 87.0000 | 66.4954 | 5.1065 | 54.8316 | 26.8517 |
| 1859 | 86.9412 | 33.1778 | 4.3151 | 44.7810 | 25.8054 |
| 18031 | 86.8824 | 149.5292 | 9.5226 | 145.5405 | 50.2935 |
| 9537 | 86.8824 | 59.8876 | 4.4348 | 44.0915 | 19.2299 |
| 4294 | 86.8235 | 30.1152 | 4.5674 | 23.9149 | 17.1394 |
| 24473 | 86.7647 | 203.2812 | 18.5571 | 178.4669 | 64.6842 |
| 14185 | 86.7647 | 330.5408 | 54.0110 | 275.5481 | 178.9270 |
| 18100 | 86.7059 | 111.0264 | 6.5239 | 110.0394 | 40.0557 |
| 4957 | 86.7059 | 67.8362 | 15.3129 | 148.2055 | 68.0318 |
| 15767 | 86.7059 | 71.7004 | 4.5321 | 82.9583 | 29.6649 |
| 16148 | 86.6471 | 681.9648 | 157.7688 | 486.2290 | 363.9556 |
| 22169 | 86.6471 | 56.9494 | 6.3717 | 42.5139 | 12.3694 |
| 22522 | 96.8235 | 74.8670 | 13.1507 | 158.7987 | 42.9206 |
| 9271 | 96.5882 | 19.3582 | 2.5251 | 48.3498 | 29.6000 |
| 18350 | 96.1765 | 483.7604 | 97.2371 | 230.1633 | 81.8518 |
| 2231 | 95.1765 | 96.1968 | 10.1687 | 234.5461 | 112.9411 |
| 19503 | 95.1176 | 28.1032 | 0.7837 | 27.2246 | 16.8340 |
| 12047 | 95.0588 | 82.5824 | 7.3468 | 46.3194 | 21.3626 |
| 22586 | 94.9412 | 7082.6896 | 410.8100 | 3813.0795 | 3591.8467 |
| 11502 | 94.7059 | 502.6166 | 111.8388 | 888.5788 | 197.3000 |
| 6585 | 94.5882 | 1668.3652 | 395.7349 | 485.2994 | 535.5038 |
| 5953 | 94.5294 | 698.1506 | 88.6908 | 337.9868 | 170.5397 |
| 22980 | 94.2353 | 140.1904 | 8.8311 | 94.6526 | 31.6648 |
| 2539 | 94.1176 | 84.2148 | 4.9265 | 81.5631 | 62.2187 |
| 6476 | 93.8824 | 87.1606 | 6.4243 | 47.0861 | 37.7315 |
| 12795 | 93.5882 | 65.8048 | 16.1058 | 8.3429 | 31.4612 |
| 8143 | 93.4118 | 497.2378 | 92.7314 | 236.5242 | 137.1192 |
| 4707 | 93.4118 | 70.5974 | 2.0542 | 68.9675 | 32.7414 |
| 14298 | 93.2941 | 318.3108 | 34.1131 | 188.4397 | 97.4695 |
| 22171 | 93.0588 | 523.7928 | 33.8739 | 368.9414 | 97.8386 |
| 20524 | 93.0588 | 66.0146 | 8.4943 | 35.0581 | 19.9586 |
| 20918 | 93.0000 | 55.3676 | 48.2257 | 120.9113 | 43.3572 |
| 9942 | 93.0000 | 668.9648 | 17.8820 | 649.4574 | 208.8295 |
| 22111 | 92.9412 | 223.3540 | 10.9983 | 166.4401 | 57.2748 |
| 2704 | 92.8824 | −0.9652 | 22.5092 | 70.8519 | 42.1017 |
| 9419 | 92.8235 | 14.5084 | 0.9160 | 20.1123 | 10.9146 |
| 2249 | 92.7647 | 58.0682 | 4.4170 | 34.9093 | 17.0172 |
| 10024 | 92.7647 | 45.1246 | 1.8499 | 39.8009 | 24.3970 |
| 24373 | 92.7059 | 352.3202 | 38.4587 | 207.1689 | 74.1531 |
| 23595 | 92.6471 | 99.3968 | 12.8051 | 52.3067 | 28.6214 |
| 21164 | 92.4706 | 274.4614 | 7.9488 | 233.2003 | 97.5254 |
| 5255 | 92.4706 | 433.6690 | 88.5946 | 207.4231 | 102.6722 |
| 8707 | 92.4706 | 470.3854 | 25.8874 | 342.0778 | 88.0795 |
| 5242 | 92.3529 | 88.0082 | 3.0155 | 82.0582 | 32.8720 |
| 21504 | 92.2941 | 493.1012 | 30.2263 | 751.6040 | 274.6158 |
| 19367 | 92.1765 | 2665.7216 | 301.7146 | 1363.4436 | 1339.3755 |
| 14230 | 92.1176 | 73.9098 | 5.4211 | 47.2590 | 23.3927 |
| 4849 | 92.1176 | 1394.6232 | 26.7648 | 1415.8893 | 318.3375 |
| 24200 | 92.0588 | 805.8238 | 72.4410 | 537.1142 | 159.1310 |
| 14589 | 91.9412 | 583.7412 | 148.8885 | 293.2676 | 139.3614 |
| 6796 | 91.8235 | 747.1966 | 97.9739 | 479.3440 | 151.5700 |
| 8274 | 91.7647 | 209.3936 | 14.0560 | 149.8646 | 44.6497 |
| 23124 | 91.7059 | 70.2404 | 13.9117 | 120.8428 | 34.9208 |
| 17823 | 91.5294 | 558.6944 | 14.8250 | 553.7988 | 133.1730 |
| 10869 | 91.4706 | 248.1242 | 89.9937 | 77.7430 | 96.8148 |
| 23587 | 91.4706 | 228.9080 | 18.8750 | 161.0235 | 47.9041 |
| 14303 | 91.4706 | 379.2070 | 15.4531 | 360.0660 | 124.7831 |
| 4521 | 91.4706 | 235.8458 | 11.7881 | 304.5494 | 86.6208 |

TABLE 5Y-continued

GEMFIBROZIL
Timepoint(s): 3, 6 hrs

| GLGC ID NO. | LDA Score | Mean Tox | SD Tox | Mean Nontox | SD Nontox |
|---|---|---|---|---|---|
| 14258 | 91.4706 | 215.1518 | 6.8913 | 175.3964 | 49.0046 |
| 3457 | 91.4118 | 36.6412 | 4.9377 | 62.2120 | 21.6901 |
| 8049 | 91.4118 | 96.3554 | 3.6622 | 108.8027 | 42.7195 |
| 8715 | 91.4118 | 114.7808 | 28.7192 | 369.3070 | 266.6937 |
| 17773 | 91.3529 | 480.8214 | 83.5156 | 309.3781 | 100.5674 |
| 23099 | 91.2353 | 288.7692 | 13.2244 | 254.0847 | 112.0855 |
| 6382 | 91.1765 | 491.1246 | 27.1535 | 330.4612 | 170.2312 |
| 12731 | 91.1176 | 232.1998 | 33.6727 | 102.4383 | 104.2591 |
| 19624 | 91.1176 | 248.9984 | 17.0238 | 235.1748 | 130.1171 |
| 3362 | 91.0588 | 45.5940 | 13.2879 | 87.4348 | 27.7746 |
| 19561 | 91.0588 | 326.5228 | 16.1238 | 307.8421 | 125.7779 |
| 13515 | 91.0000 | 361.4700 | 9.5936 | 299.9174 | 106.4200 |
| 22666 | 90.8824 | 323.6434 | 103.1470 | 185.9957 | 116.0819 |
| 8850 | 90.8235 | 147.6210 | 25.3208 | 97.5437 | 43.1598 |
| 8501 | 90.8235 | 53.7868 | 4.5417 | 87.8370 | 31.9776 |
| 19075 | 90.7647 | 588.9430 | 132.3429 | 339.0957 | 171.0943 |
| 14492 | 90.7647 | 454.1514 | 62.6555 | 268.5095 | 103.0903 |
| 13009 | 90.7647 | 64.6190 | 6.8333 | 107.2373 | 49.0046 |
| 22933 | 90.7647 | 1458.7786 | 161.0636 | 776.5016 | 606.3624 |
| 12241 | 90.7059 | 149.4844 | 31.6464 | 72.1720 | 55.0721 |
| 19783 | 90.5882 | 684.7546 | 29.4488 | 726.3348 | 208.0541 |
| 14149 | 90.5882 | 268.1370 | 45.0320 | 183.7671 | 50.3125 |
| 21661 | 90.4706 | 686.1798 | 36.7479 | 1086.3829 | 589.5578 |
| 2093 | 90.4706 | 1083.2606 | 123.2140 | 508.0925 | 412.2086 |
| 18406 | 90.4118 | 91.6354 | 12.2445 | 49.1050 | 27.8390 |
| 11542 | 90.4118 | 163.1946 | 5.2303 | 192.8448 | 36.1804 |
| 8431 | 90.4118 | 132.1784 | 26.5846 | 75.6269 | 39.0401 |
| 5866 | 90.4118 | 1072.7196 | 129.3060 | 730.9015 | 226.5649 |

TABLE 5Z

HEPATITIS
Timepoint(s): Various

| GLGC ID NO. | LDA Score | Mean Tox | SD Tox | Mean Nontox | SD Nontox |
|---|---|---|---|---|---|
| 12788 | 89.2114 | 63.9089 | 34.9557 | 11.1482 | 20.9174 |
| 19952 | 86.1674 | 4.4050 | 8.2814 | 29.7049 | 23.7363 |
| 2079 | 83.7139 | 114.0090 | 15.6331 | 162.8803 | 45.3009 |
| 1928 | 83.5728 | 71.7308 | 20.7410 | 127.0512 | 39.4674 |
| 16825 | 83.4709 | 114.7785 | 54.4008 | 44.0730 | 20.6616 |
| 10743 | 83.0529 | 21.9640 | 9.7889 | 71.5806 | 54.4163 |
| 18269 | 82.8020 | 117.6146 | 33.9108 | 186.0563 | 54.6026 |
| 16982 | 82.2690 | 4058.3086 | 1627.4436 | 1558.5773 | 866.3594 |
| 15767 | 81.8301 | 45.3887 | 14.6625 | 83.9292 | 29.2272 |
| 1973 | 81.5897 | 167.2445 | 49.1889 | 266.5688 | 74.9606 |
| 2629 | 81.5583 | 388.4429 | 134.0744 | 194.9359 | 116.3658 |
| 16168 | 81.2578 | 3890.6780 | 1055.8008 | 2282.2991 | 981.9310 |
| 23709 | 81.1690 | 29.9070 | 11.5706 | 62.5262 | 27.7667 |
| 1070 | 80.5759 | 29.0704 | 29.4867 | −3.5488 | 14.7903 |
| 764 | 80.3982 | 20.1445 | 7.6809 | 39.8514 | 17.4269 |
| 11153 | 80.0873 | 175.9210 | 65.1418 | 279.6470 | 82.9587 |
| 11152 | 80.0376 | 44.2105 | 26.6982 | 98.1310 | 45.4385 |
| 8317 | 79.9775 | 153.6095 | 29.9265 | 246.4819 | 102.2146 |
| 11493 | 79.9044 | 176.7860 | 142.7220 | 29.9996 | 42.8178 |
| 21154 | 79.7946 | 74.1387 | 26.7044 | 40.8988 | 15.5973 |
| 13646 | 79.7659 | 1979.7993 | 267.9795 | 1609.7607 | 281.9664 |
| 25701 | 79.7267 | 57.9422 | 14.0652 | 88.4730 | 25.8713 |
| 15309 | 79.7162 | 20.8907 | 8.0195 | 12.7204 | 8.2491 |
| 18349 | 79.6248 | 365.4965 | 119.6195 | 219.9336 | 88.4779 |
| 21380 | 79.1545 | 305.5067 | 59.1529 | 200.5509 | 66.7161 |
| 17933 | 79.0029 | 541.3936 | 232.4814 | 240.8545 | 122.0756 |
| 16381 | 78.6345 | 277.4561 | 61.6512 | 434.4310 | 119.2121 |
| 17634 | 78.3549 | 18.8527 | 23.3099 | 84.9381 | 63.7261 |
| 21115 | 78.3523 | 124.9092 | 65.5060 | 38.3695 | 43.2656 |
| 23716 | 78.2217 | 110.1323 | 47.8560 | 69.1350 | 21.5878 |
| 21800 | 78.1537 | 53.1997 | 15.2080 | 85.3128 | 26.7831 |
| 21239 | 78.0832 | 585.2732 | 141.2577 | 418.7661 | 144.7688 |
| 23130 | 77.9735 | 233.1324 | 92.6387 | 406.8837 | 140.5631 |

TABLE 5Z-continued

HEPATITIS
Timepoint(s): Various

| GLGC ID NO. | LDA Score | Mean Tox | SD Tox | Mean Nontox | SD Nontox |
|---|---|---|---|---|---|
| 14751 | 77.9421 | 65.8565 | 18.1193 | 38.9691 | 16.2123 |
| 17316 | 77.9212 | 83.3056 | 38.2968 | 34.1382 | 26.6599 |
| 11494 | 77.8506 | 565.7846 | 431.8977 | 159.6069 | 110.8822 |
| 17815 | 77.6939 | 17.3178 | 7.2890 | 32.2153 | 15.7582 |
| 353 | 77.6808 | 852.9399 | 425.5131 | 400.8225 | 230.1746 |
| 15394 | 77.6730 | 557.7780 | 124.0581 | 407.1655 | 131.0936 |
| 17934 | 77.6207 | 517.9127 | 219.6789 | 277.9530 | 125.5943 |
| 11849 | 77.4509 | 2177.2773 | 490.0260 | 1577.1428 | 324.0204 |
| 15187 | 77.2628 | 40.5859 | 21.9039 | 92.9965 | 50.1820 |
| 5667 | 77.2314 | 2235.2120 | 348.2134 | 1839.5770 | 346.9847 |
| 1214 | 77.0929 | 11.7991 | 7.9550 | 34.1197 | 25.2526 |
| 14970 | 76.9518 | 26.9058 | 15.8550 | 59.9324 | 25.3271 |
| 15023 | 76.9022 | 279.9478 | 42.7704 | 362.5311 | 83.4497 |
| 17657 | 76.8395 | 68.2021 | 42.1245 | 23.9883 | 24.6140 |
| 765 | 76.7820 | 6.4086 | 8.7280 | 22.4968 | 14.7673 |
| 10744 | 76.6722 | 15.9966 | 9.3123 | 53.4795 | 48.5483 |
| 22822 | 76.4397 | 458.3923 | 157.3067 | 552.9301 | 109.7061 |
| 19422 | 76.3718 | 34.4817 | 10.7889 | 58.3918 | 27.6854 |
| 11852 | 76.3195 | 91.9410 | 73.1384 | 148.5494 | 53.8293 |
| 2628 | 76.1784 | 436.1843 | 213.0145 | 179.4218 | 127.9568 |
| 1694 | 76.1497 | 3266.1452 | 538.6948 | 2456.2282 | 608.9672 |
| 13574 | 76.0399 | 174.6385 | 32.3433 | 222.9816 | 40.7918 |
| 11202 | 76.0007 | 60.8169 | 15.4505 | 80.5847 | 21.9097 |
| 20735 | 75.9981 | 1593.2100 | 520.8997 | 1000.0609 | 328.8578 |
| 17532 | 75.9798 | 99.2118 | 55.2783 | 198.2824 | 72.1557 |
| 25075 | 75.9485 | 358.3473 | 124.9477 | 221.4098 | 91.4913 |
| 21989 | 75.9380 | 175.5415 | 54.4137 | 109.7255 | 32.2207 |
| 4449 | 75.9197 | 4.5093 | 16.6691 | 30.5364 | 22.8176 |
| 11975 | 75.9093 | 28.3813 | 17.9498 | 7.1502 | 18.7183 |
| 17214 | 75.8988 | 435.9610 | 118.3101 | 301.8016 | 107.3091 |
| 16918 | 75.8884 | 4185.9263 | 1129.8202 | 2990.4419 | 858.8276 |
| 16382 | 75.8309 | 23.2828 | 8.0570 | 41.8032 | 21.3413 |
| 1813 | 75.7786 | 129.2527 | 63.2652 | 50.3729 | 63.6738 |
| 24377 | 75.7499 | 122.5253 | 14.7475 | 163.3678 | 44.3076 |
| 5319 | 75.7003 | 19.5563 | 9.4048 | 33.5767 | 14.5193 |
| 1159 | 75.6480 | 208.9188 | 126.1152 | 303.7595 | 88.1086 |
| 24196 | 75.6166 | 64.8069 | 50.4236 | 17.3955 | 14.4434 |
| 13647 | 75.5879 | 2814.1592 | 558.1760 | 2102.3020 | 483.2906 |
| 21670 | 75.5879 | 183.7840 | 61.9944 | 118.4080 | 43.1473 |
| 11895 | 75.5696 | 48.2860 | 16.1650 | 74.8018 | 23.7806 |
| 12070 | 75.4677 | 55.6364 | 20.0168 | 34.6434 | 17.3853 |
| 19087 | 75.4285 | 36.8420 | 11.2203 | 22.3112 | 12.6426 |
| 20734 | 75.3972 | 1478.0642 | 476.9719 | 954.6584 | 322.7892 |
| 15560 | 75.3867 | 136.4606 | 64.6114 | 65.8373 | 38.1477 |
| 15587 | 75.3083 | 24.5722 | 15.1460 | 6.9829 | 16.4106 |
| 16929 | 75.2979 | 2484.3886 | 384.2647 | 1966.2037 | 391.5165 |
| 591 | 75.2665 | 58.7470 | 25.6707 | 36.7582 | 16.4524 |
| 777 | 75.1777 | 39.5563 | 31.1584 | 54.8434 | 23.8927 |
| 21625 | 75.1280 | 3148.2362 | 1006.6053 | 3884.1949 | 871.0939 |
| 11210 | 75.0862 | 70.7739 | 30.7697 | 36.9697 | 18.0365 |
| 1141 | 75.0287 | 168.1481 | 32.5545 | 225.5378 | 56.5967 |
| 18043 | 75.0261 | 279.9371 | 159.1732 | 131.5777 | 71.6814 |
| 22124 | 75.0261 | 236.9994 | 99.5636 | 127.5256 | 53.5048 |
| 18582 | 75.0078 | 130.1573 | 70.3324 | 170.3570 | 58.0896 |
| 22538 | 74.9791 | 73.5550 | 28.4115 | 113.5704 | 39.1371 |
| 16947 | 74.9686 | 221.1714 | 111.0490 | 349.0676 | 138.9967 |
| 2696 | 74.8667 | 2149.1914 | 563.6595 | 1590.4105 | 450.1424 |
| 25686 | 74.7962 | 2235.8942 | 543.3956 | 1719.2231 | 365.4556 |
| 4360 | 74.6995 | 26.5103 | 20.1239 | 85.1898 | 86.8045 |
| 1885 | 74.6682 | 30.0602 | 12.6612 | 48.7448 | 17.3167 |
| 1624 | 74.6473 | 95.3350 | 30.3341 | 139.3809 | 33.9487 |
| 15011 | 74.6264 | 255.1473 | 64.9830 | 168.4456 | 59.0836 |
| 939 | 74.5584 | −3.3237 | 12.5385 | 21.9320 | 31.5323 |
| 22424 | 74.4879 | 18.3545 | 13.8334 | 33.2672 | 16.9093 |
| 3431 | 74.4853 | 4072.5537 | 1186.1742 | 3088.4531 | 770.4321 |
| 25170 | 74.4252 | 141.4204 | 59.1376 | 78.8219 | 31.3663 |
| 16871 | 74.4069 | 14.4121 | 15.4310 | 23.4612 | 13.2409 |
| 22084 | 85.9270 | 62.4333 | 21.8589 | 112.6180 | 33.9160 |
| 9615 | 85.5952 | 239.7869 | 67.3362 | 99.3914 | 63.3302 |
| 13634 | 84.1529 | 4996.2973 | 1519.3141 | 2809.7099 | 971.5073 |

TABLE 5Z-continued

HEPATITIS
Timepoint(s): Various

| GLGC ID NO. | LDA Score | Mean Tox | SD Tox | Mean Nontox | SD Nontox |
|---|---|---|---|---|---|
| 5084 | 83.3612 | 294.0297 | 79.4167 | 185.1205 | 51.7026 |
| 21242 | 83.3116 | 151.9625 | 138.1163 | 208.0112 | 81.1402 |
| 14666 | 83.2724 | 88.5724 | 17.7302 | 145.7812 | 43.5756 |
| 22876 | 83.0607 | 170.8576 | 54.5152 | 102.9706 | 33.4898 |
| 1923 | 82.7602 | 673.1085 | 210.4496 | 339.3562 | 148.2528 |
| 7451 | 82.6296 | 1276.6463 | 533.6247 | 825.7333 | 210.1066 |
| 4190 | 82.3892 | 182.8813 | 79.7920 | 100.9990 | 36.6637 |
| 12698 | 82.2586 | 522.7883 | 418.3798 | 83.9344 | 128.6267 |
| 11961 | 82.0600 | 98.1475 | 26.5050 | 58.7106 | 31.0382 |
| 14910 | 81.9685 | 215.6311 | 62.2588 | 142.8822 | 35.5228 |
| 14051 | 81.5975 | 628.7327 | 224.0268 | 335.9601 | 95.9742 |
| 14547 | 81.3284 | 220.7907 | 63.9512 | 114.0023 | 65.6567 |
| 20397 | 81.1376 | 974.7654 | 153.7453 | 774.6436 | 118.7249 |
| 5953 | 81.0671 | 709.9478 | 266.1126 | 329.8687 | 157.3596 |
| 22581 | 80.8163 | 115.3544 | 84.8568 | 15.8018 | 45.7313 |
| 10569 | 80.7666 | 448.5527 | 138.7773 | 349.7347 | 79.6895 |
| 21747 | 80.7379 | 423.0711 | 94.8841 | 580.9749 | 116.1321 |
| 9808 | 80.5863 | 155.3530 | 60.5416 | 83.1713 | 35.3937 |
| 4952 | 80.5759 | 1914.7353 | 721.7955 | 911.2766 | 320.8732 |
| 2702 | 80.5759 | 1408.8263 | 614.4806 | 805.1660 | 267.8061 |
| 17722 | 80.5367 | 362.9406 | 82.0372 | 258.5002 | 63.2102 |
| 8917 | 80.5262 | 123.2635 | 51.6397 | 52.1895 | 42.8320 |
| 6567 | 80.3459 | 502.0158 | 191.2852 | 301.9130 | 121.9880 |
| 1924 | 80.3459 | 572.4492 | 186.9756 | 372.2831 | 103.3418 |
| 7733 | 80.3172 | 140.1477 | 32.7510 | 213.2120 | 52.7084 |
| 8164 | 80.2153 | 186.3179 | 70.8419 | 105.3034 | 39.8558 |
| 24629 | 80.1369 | 203.5259 | 87.3549 | 346.9567 | 103.8286 |
| 2226 | 80.0768 | 95.3712 | 40.4278 | 176.2061 | 57.3069 |
| 16727 | 80.0455 | 431.0766 | 129.8563 | 263.3046 | 90.2573 |
| 7414 | 79.9958 | 864.2771 | 186.1109 | 615.2510 | 156.9504 |
| 3191 | 79.9749 | 1548.5947 | 581.4653 | 1017.8877 | 286.4492 |
| 13757 | 79.9462 | 59.0958 | 28.8379 | 111.6187 | 34.2196 |
| 14095 | 79.9070 | 20.9630 | 11.3822 | 48.5823 | 23.8510 |
| 15553 | 79.7345 | 603.1631 | 198.1433 | 412.2846 | 102.2321 |
| 16216 | 79.7345 | 1758.9173 | 910.6985 | 886.2697 | 409.7602 |
| 8205 | 79.7162 | 110.0101 | 40.6081 | 184.1397 | 55.9573 |
| 4067 | 79.6744 | 614.4872 | 278.7040 | 338.0376 | 134.3023 |
| 23424 | 79.4941 | 2060.6129 | 610.1403 | 1336.7043 | 327.4386 |
| 6306 | 79.4759 | 66.4447 | 23.8610 | 40.9871 | 25.9631 |
| 19082 | 79.4550 | 137.7013 | 45.9370 | 198.2173 | 38.9647 |
| 24375 | 79.4445 | 790.1714 | 231.5659 | 507.1111 | 147.3358 |
| 3959 | 79.4341 | 1675.6453 | 536.7153 | 1239.4762 | 281.4694 |
| 22545 | 79.4053 | 125.2064 | 96.8505 | 211.3155 | 76.7196 |
| 6382 | 79.1440 | 538.6601 | 229.4191 | 325.6712 | 164.7698 |
| 22453 | 79.0447 | 60.4096 | 21.5456 | 95.2918 | 26.3889 |
| 17761 | 78.8749 | 33.5463 | 16.2710 | 54.0853 | 18.9386 |
| 18607 | 78.8043 | 8781.4256 | 1741.2234 | 6338.1470 | 1818.2486 |
| 21437 | 78.8043 | 1020.0419 | 267.5101 | 843.6053 | 215.4135 |
| 16688 | 78.7834 | 1020.1075 | 225.0409 | 680.5227 | 186.9957 |
| 7243 | 78.7233 | 196.0926 | 49.4628 | 133.3896 | 38.8669 |
| 16756 | 78.7024 | 932.1832 | 256.7963 | 660.4284 | 120.9812 |
| 24338 | 78.6842 | 172.3141 | 46.2951 | 240.3927 | 48.4484 |
| 23010 | 78.3941 | 17.8737 | 13.7450 | 42.0593 | 22.6612 |
| 13614 | 78.3628 | 131.4099 | 104.7556 | 179.2690 | 61.3323 |
| 19015 | 78.3549 | 102.7077 | 27.8608 | 160.4906 | 57.9619 |
| 2781 | 78.3523 | 311.2664 | 115.2499 | 135.2839 | 89.3408 |
| 24411 | 78.2321 | 585.3733 | 235.9363 | 439.4223 | 118.0186 |
| 2788 | 78.1224 | 404.1409 | 96.0448 | 251.9156 | 86.3364 |
| 22535 | 78.1015 | 1169.3110 | 438.1871 | 735.5884 | 197.9973 |
| 18507 | 78.0832 | 2235.7493 | 336.7923 | 1674.8237 | 442.4026 |
| 23224 | 78.0518 | 512.8645 | 161.7831 | 315.6715 | 100.5957 |
| 24315 | 78.0231 | 42.4720 | 17.3132 | 71.6253 | 22.1829 |
| 8924 | 78.0022 | 91.4743 | 24.2314 | 57.93791 | 20.5043 |

TABLE 5AA

GENERAL
Timepoint(s): Various

| GLGC ID NO. | LDA Score | Mean Tox | SD Tox | Mean Nontox | SD Nontox |
|---|---|---|---|---|---|
| 353 | 74.0321 | 692.7234 | 362.9495 | 349.9497 | 169.2757 |
| 1598 | 73.4710 | 599.1281 | 449.3629 | 217.3142 | 142.1956 |
| 11852 | 73.4239 | 100.5743 | 53.8028 | 154.1401 | 48.6981 |
| 20735 | 73.1696 | 1324.4889 | 395.8647 | 949.1041 | 300.8814 |
| 21882 | 73.1317 | 539.8201 | 145.0010 | 688.7161 | 144.9034 |
| 15587 | 72.7956 | 21.2525 | 20.1889 | 4.6272 | 13.9118 |
| 14633 | 72.5712 | 327.1695 | 148.2764 | 524.2631 | 194.9081 |
| 20404 | 72.4417 | 114.0670 | 110.8554 | 229.0409 | 113.5475 |
| 591 | 72.3206 | 55.0132 | 26.3119 | 34.1529 | 10.9023 |
| 22412 | 72.2057 | 1072.5428 | 530.0458 | 583.6865 | 384.8233 |
| 24431 | 72.1959 | 721.4395 | 470.8528 | 340.2377 | 221.1622 |
| 15618 | 72.0859 | 406.2550 | 176.2285 | 235.7101 | 81.9916 |
| 21090 | 72.0248 | 70.5012 | 36.2412 | 116.7641 | 46.8036 |
| 22124 | 71.9087 | 190.9316 | 74.0030 | 117.8924 | 43.8038 |
| 21989 | 71.8750 | 145.1150 | 44.2583 | 104.1433 | 27.2057 |
| 7914 | 71.8475 | 46.0402 | 22.5433 | 78.2671 | 30.6076 |
| 1548 | 71.4349 | 137.4011 | 79.3183 | 231.8854 | 89.0567 |
| 4573 | 71.3964 | 666.2563 | 208.0934 | 882.6272 | 210.8448 |
| 1868 | 71.2913 | 230.2194 | 213.8465 | 492.3068 | 251.3638 |
| 14347 | 71.2479 | 623.3370 | 248.5362 | 892.4155 | 266.5317 |
| 20405 | 71.0994 | 152.0776 | 99.0756 | 238.3884 | 95.8125 |
| 354 | 70.8249 | 868.7195 | 511.2622 | 431.7030 | 200.8464 |
| 24326 | 70.6960 | 1071.2451 | 290.6804 | 797.5744 | 193.7579 |
| 20939 | 70.5279 | 729.1519 | 256.2483 | 509.8097 | 125.1639 |
| 11483 | 70.4942 | 654.8177 | 379.8189 | 342.3612 | 171.6341 |
| 18396 | 70.4802 | 585.3864 | 243.6748 | 360.3017 | 158.1372 |
| 20650 | 70.4576 | 308.6839 | 222.0480 | 663.3898 | 384.1621 |
| 18867 | 70.4191 | 198.2808 | 111.8431 | 332.4534 | 151.3571 |
| 17532 | 70.3854 | 143.1703 | 63.3268 | 208.8527 | 72.2327 |
| 25643 | 70.2546 | 753.1101 | 271.9780 | 508.0578 | 150.4999 |
| 17075 | 70.2406 | 883.8372 | 182.6294 | 725.7951 | 135.3438 |
| 15335 | 70.0921 | 1017.7103 | 239.4712 | 800.7525 | 189.1824 |
| 15203 | 70.0823 | 304.2157 | 63.6765 | 247.8487 | 47.3821 |
| 4574 | 70.0108 | 239.1681 | 120.3283 | 342.7378 | 104.1101 |
| 16367 | 69.9820 | 398.9208 | 265.6084 | 642.3286 | 241.9901 |
| 15675 | 69.9631 | 443.0804 | 129.6439 | 552.2724 | 124.7812 |
| 15617 | 69.9289 | 286.4699 | 108.5804 | 187.2864 | 73.2466 |
| 18139 | 69.8965 | 171.5484 | 53.2971 | 224.8574 | 60.1979 |
| 17101 | 69.8482 | 590.1525 | 151.5619 | 433.3880 | 151.4834 |
| 1973 | 69.8005 | 208.0263 | 60.0121 | 281.3328 | 73.5208 |
| 1045 | 69.7944 | 110.2495 | 38.4770 | 80.7631 | 19.6760 |
| 15187 | 69.7913 | 59.2563 | 31.7309 | 103.5642 | 49.2894 |
| 20836 | 69.7620 | 52.0807 | 27.7433 | 25.1950 | 27.3040 |
| 20996 | 69.7565 | 329.6604 | 103.8115 | 236.2184 | 77.8874 |
| 24693 | 69.6660 | 438.5368 | 384.8746 | 803.8279 | 387.1573 |
| 626 | 69.5786 | 166.6740 | 106.2358 | 76.3273 | 52.3556 |
| 20649 | 69.5615 | 150.9084 | 128.4660 | 396.1615 | 325.9925 |
| 110 | 69.5615 | 151.0678 | 78.5269 | 250.1823 | 135.2514 |
| 17908 | 69.5548 | 720.3978 | 366.6415 | 394.4135 | 204.4070 |
| 15372 | 69.5364 | 507.3505 | 95.5887 | 415.5391 | 85.2431 |
| 10306 | 69.4539 | 873.1074 | 417.3683 | 606.1731 | 136.5211 |
| 13283 | 69.4264 | 95.5529 | 62.9966 | 147.5981 | 61.9523 |
| 19825 | 69.1526 | 50.8838 | 67.0311 | 76.2997 | 51.1551 |
| 12312 | 69.1300 | 50.2987 | 40.0155 | 116.9203 | 83.2128 |
| 5667 | 69.1092 | 2132.9599 | 400.8936 | 1797.5325 | 294.8194 |
| 15188 | 69.0572 | 155.6609 | 38.0339 | 189.3794 | 38.2636 |
| 17634 | 69.0004 | 40.4265 | 40.8952 | 93.4552 | 63.4947 |
| 25699 | 68.9710 | 18.5489 | 41.5945 | 59.1895 | 47.0093 |
| 17469 | 68.9521 | 49.4026 | 24.2334 | 74.2927 | 29.4056 |
| 15677 | 68.9380 | 234.6519 | 93.1734 | 355.8232 | 142.9614 |
| 21014 | 68.9191 | 494.3048 | 249.2701 | 876.6787 | 428.7473 |
| 15186 | 68.8995 | 87.0788 | 29.5946 | 124.3334 | 41.9472 |
| 805 | 68.8989 | 20.1182 | 11.8656 | 29.4041 | 11.4480 |
| 16381 | 68.8702 | 364.5739 | 130.2476 | 453.5329 | 113.7721 |
| 19073 | 68.8408 | 537.8997 | 117.9775 | 442.4556 | 88.1764 |
| 25701 | 68.8366 | 73.0012 | 28.6946 | 91.3003 | 24.6564 |
| 21400 | 68.8231 | 231.6397 | 100.2767 | 384.0433 | 156.4185 |
| 614 | 68.8078 | 275.6675 | 110.9096 | 385.0770 | 108.4595 |
| 16417 | 68.7883 | 210.8167 | 54.4458 | 158.3638 | 42.8356 |
| 21654 | 68.7736 | 1063.9668 | 258.7330 | 820.7588 | 174.7741 |
| 17913 | 68.7540 | 282.1702 | 93.5028 | 219.0866 | 46.8677 |
| 23524 | 68.7455 | 549.1319 | 191.2665 | 366.8981 | 181.0471 |
| 4002 | 68.7174 | 74.6716 | 26.6235 | 107.4937 | 36.9586 |

TABLE 5AA-continued

GENERAL
Timepoint(s): Various

| GLGC ID NO. | LDA Score | Mean Tox | SD Tox | Mean Nontox | SD Nontox |
|---|---|---|---|---|---|
| 15274 | 68.7125 | 29.5372 | 14.2193 | 47.8157 | 19.6676 |
| 20716 | 68.6734 | 374.7641 | 160.8670 | 529.0835 | 145.4192 |
| 352 | 68.6630 | 306.6724 | 192.9381 | 156.6950 | 89.7015 |
| 16947 | 68.5872 | 244.3381 | 134.3451 | 356.0835 | 121.3395 |
| 6626 | 68.5737 | 39.7689 | 16.9634 | 66.1550 | 31.5085 |
| 23716 | 68.5432 | 90.2374 | 35.2654 | 65.4019 | 16.8221 |
| 23522 | 68.4912 | 315.8414 | 82.4292 | 242.7565 | 71.1938 |
| 25039 | 68.4674 | 387.2103 | 166.7423 | 503.3856 | 147.4479 |
| 108 | 68.4533 | 1128.0051 | 390.1604 | 1557.3672 | 424.8659 |
| 23180 | 68.4283 | 1609.8222 | 381.4548 | 1323.6010 | 205.5831 |
| 15281 | 68.3757 | 683.0733 | 223.6197 | 524.9034 | 147.6041 |
| 21012 | 68.3677 | 739.9671 | 352.3844 | 1259.1706 | 570.2972 |
| 16610 | 68.3665 | 548.9744 | 149.5548 | 423.1316 | 125.9526 |
| 21670 | 68.3567 | 155.6078 | 47.1839 | 115.6712 | 38.8353 |
| 18107 | 68.2510 | 924.1819 | 202.9468 | 769.4648 | 135.0857 |
| 19824 | 68.1990 | 74.6104 | 49.6271 | 100.4621 | 43.5932 |
| 24862 | 68.1373 | 91.0102 | 39.9719 | 142.4224 | 55.4854 |
| 24649 | 68.1367 | 75.0187 | 25.8061 | 97.0217 | 25.2224 |
| 1928 | 68.1275 | 96.2260 | 33.1224 | 131.2243 | 39.0237 |
| 17806 | 68.1233 | 22.2768 | 12.6153 | 40.6960 | 23.7577 |
| 1524 | 68.1177 | 27.0611 | 27.7482 | 55.1315 | 29.3478 |
| 16929 | 68.1171 | 2287.7153 | 425.3548 | 1914.2402 | 351.2150 |
| 20973 | 68.1074 | 246.6275 | 65.4053 | 189.1352 | 45.7034 |
| 14970 | 68.0939 | 42.3349 | 24.3016 | 62.4884 | 24.1993 |
| 8317 | 68.0658 | 181.8533 | 61.7097 | 250.0281 | 91.1038 |
| 14959 | 68.0499 | 1994.335 | 4448.0566 | 1571.8780 | 352.6077 |
| 9620 | 68.0310 | 1577.5838 | 296.4106 | 1329.2951 | 260.3652 |
| 16726 | 68.0169 | 251.6105 | 84.0185 | 323.5295 | 81.2307 |
| 13646 | 68.0114 | 1851.6287 | 347.9763 | 1594.3948 | 218.7983 |
| 1495 | 67.9680 | 171.8535 | 60.4347 | 127.1234 | 36.0092 |
| 25366 | 67.9503 | 272.0973 | 135.9144 | 419.2906 | 177.7396 |
| 811 | 67.9399 | 65.5169 | 30.6198 | 90.7693 | 25.5775 |
| 1869 | 67.9209 | 433.8679 | 327.4946 | 739.7781 | 310.2369 |
| 10540 | 67.8684 | 20.1568 | 23.3063 | 34.2321 | 20.5508 |
| 24615 | 67.8629 | 2331.9255 | 566.7979 | 1893.0949 | 424.6438 |
| 14346 | 67.8543 | 503.3018 | 229.4127 | 731.9545 | 259.5389 |
| 16330 | 67.8402 | 133.8014 | 42.4711 | 189.3528 | 64.0235 |
| 19222 | 67.8152 | 982.4210 | 196.6385 | 846.7306 | 167.2438 |
| 11849 | 67.8054 | 1893.4224 | 394.3312 | 1522.1876 | 291.6655 |
| 18606 | 67.8054 | 2664.9736 | 651.9781 | 2069.8975 | 502.5380 |
| 16164 | 67.7865 | 1478.1431 | 259.1748 | 1247.1329 | 220.9209 |
| 18611 | 67.7816 | 3418.0776 | 883.3460 | 2664.3585 | 737.0040 |
| 1306 | 67.7522 | 207.1717 | 78.3694 | 142.8739 | 44.6007 |
| 17088 | 67.6563 | 474.1242 | 208.5444 | 322.1740 | 91.9528 |
| 13647 | 67.6471 | 2525.0523 | 589.3911 | 2047.6011 | 416.5734 |
| 18349 | 67.6422 | 294.1195 | 117.6643 | 207.9829 | 77.6041 |
| 25559 | 67.6373 | 230.9253 | 98.4724 | 157.5043 | 68.4359 |
| 1523 | 67.6336 | 128.1120 | 42.0616 | 164.5697 | 43.8414 |
| 4500 | 67.6226 | 59.1096 | 38.5607 | 29.0880 | 18.4448 |
| 17214 | 67.6135 | 391.6034 | 142.4139 | 285.1289 | 89.7938 |
| 18043 | 67.6086 | 205.1463 | 104.3035 | 122.5335 | 62.8304 |
| 11755 | 67.5664 | 474.8301 | 214.9675 | 684.0789 | 230.0926 |
| 22413 | 67.5414 | 678.4204 | 353.0301 | 410.7406 | 252.4150 |
| 17468 | 67.4998 | 338.5084 | 87.5959 | 427.4967 | 112.9246 |
| 16331 | 67.4900 | 349.7128 | 112.7166 | 452.7232 | 125.3677 |
| 23417 | 67.4845 | 593.2915 | 131.3584 | 474.2976 | 111.6135 |
| 1571 | 67.4790 | 722.9521 | 244.2123 | 544.2188 | 130.5005 |
| 699 | 67.4656 | 270.1676 | 78.6434 | 343.0756 | 78.6980 |
| 25691 | 67.4601 | 2599.5600 | 579.7413 | 2179.4241 | 388.8723 |
| 24442 | 67.4570 | 19.9257 | 9.3331 | 33.3109 | 16.9750 |
| 23679 | 67.4454 | 258.1254 | 131.5903 | 164.0676 | 68.0534 |
| 14138 | 67.4179 | 22.6549 | 8.9198 | 29.6368 | 9.7143 |
| 22321 | 67.3928 | 1207.5357 | 558.2971 | 788.6356 | 349.8854 |
| 12070 | 67.3928 | 49.8280 | 22.8104 | 33.6384 | 14.0420 |
| 17934 | 67.3879 | 392.4523 | 187.7043 | 263.3889 | 102.5792 |
| 16721 | 67.3843 | 99.6751 | 47.6790 | 127.8248 | 44.8695 |
| 19103 | 67.3610 | 63.4694 | 37.6263 | 116.9262 | 63.3872 |
| 16346 | 67.3543 | 217.6096 | 90.6712 | 154.6237 | 49.7685 |
| 19067 | 67.3519 | 11.4719 | 10.6897 | 27.9988 | 26.3498 |
| 43 | 67.2596 | 109.6957 | 53.4188 | 165.4349 | 56.6181 |
| 20427 | 67.2590 | 2038.7577 | 357.5337 | 1753.4943 | 286.0933 |
| 24196 | 67.2583 | 35.0973 | 31.6467 | 15.5356 | 11.0387 |
| 20701 | 67.2547 | 276.0749 | 193.6348 | 408.8686 | 181.3138 |
| 14751 | 67.2204 | 51.2111 | 20.5840 | 37.2979 | 14.7608 |
| 18419 | 67.1972 | 552.9760 | 148.6456 | 672.1064 | 139.8622 |
| 25070 | 67.1923 | 143.3052 | 96.2538 | 173.9231 | 85.1855 |
| 23248 | 67.1673 | 75.2964 | 60.5076 | 33.9812 | 25.2604 |
| 12118 | 67.1599 | 82.5634 | 28.5948 | 136.1014 | 78.2358 |
| 1531 | 67.1550 | 60.9802 | 68.8637 | 149.7093 | 115.8899 |
| 427 | 67.1550 | 1068.0988 | 589.8296 | 1801.5621 | 895.3841 |
| 135 | 67.1502 | 13.0401 | 8.8696 | 24.5275 | 16.2218 |
| 4439 | 67.1116 | 196.0337 | 59.7607 | 258.0295 | 77.5623 |
| 25363 | 67.1116 | 258.2741 | 132.4829 | 391.4265 | 167.9991 |
| 24861 | 67.0542 | 36.8638 | 27.46591 | 72.5850 | 43.8430 |
| 317 | 67.0304 | 27.6561 | 11.8993 | 40.0026 | 22.8140 |
| 21940 | 67.0249 | 150.0644 | 47.4484 | 191.9609 | 51.5529 |
| 19472 | 67.0194 | 844.2025 | 168.8416 | 713.1871 | 137.4328 |
| 819 | 67.0102 | 1132.9342 | 644.7495 | 1628.2334 | 602.9989 |
| 426 | 67.0065 | 1675.4305 | 791.9692 | 2808.9105 | 1341.4561 |
| 17269 | 66.9918 | 114.4660 | 40.4721 | 167.0644 | 60.8926 |
| 109 | 66.9576 | 2644.8533 | 889.4365 | 3481.5066 | 872.7439 |
| 25777 | 66.9185 | 2154.5140 | 680.1775 | 1654.5605 | 479.8619 |
| 23883 | 66.9154 | 103.9199 | 68.0907 | 190.1233 | 122.1829 |
| 6055 | 66.9148 | 188.8685 | 117.4532 | 345.7444 | 163.2221 |
| 17393 | 66.9136 | 570.5503 | 144.5166 | 469.7320 | 102.0186 |
| 24204 | 66.9093 | 193.8335 | 49.8923 | 146.6209 | 44.4871 |
| 111 | 66.9002 | 2186.8805 | 708.7501 | 2847.7596 | 725.7520 |
| 15239 | 66.8995 | 1925.8901 | 437.0951 | 1603.9498 | 385.4584 |
| 23058 | 66.8623 | 14.3024 | 7.8791 | 22.1936 | 10.3690 |
| 2641 | 66.8280 | 38.9280 | 21.1149 | 52.2310 | 19.4740 |
| 1583 | 66.8128 | 156.4314 | 57.7071 | 115.1150 | 34.7386 |
| 23678 | 66.7791 | 163.7960 | 69.9989 | 114.5068 | 39.6921 |
| 34301 | 66.7455 | 661.8021 | 263.6805 | 479.8976 | 142.8995 |
| 1071 | 66.7382 | 14.9317 | 15.7010 | 39.5313 | 34.5074 |
| 6108 | 66.6881 | 652.3621 | 235.1197 | 476.7377 | 135.1139 |
| 12031 | 66.6838 | 598.4982 | 130.2802 | 507.5051 | 103.3635 |
| 2854 | 66.6593 | 888.3158 | 272.7986 | 675.7638 | 158.4589 |
| 25747 | 66.6174 | 1533.5803 | 556.3787 | 2214.4017 | 753.4021 |
| 16366 | 66.6080 | 221.6847 | 108.5259 | 330.4026 | 127.9413 |
| 4449 | 66.5884 | 15.2562 | 20.5980 | 32.7416 | 21.1472 |
| 11494 | 66.5823 | 305.0818 | 260.3316 | 142.3909 | 85.8729 |
| 570 | 66.5790 | 326.5391 | 98.8342 | 247.7856 | 69.2074 |
| 20734 | 66.5542 | 1232.1162 | 391.7844 | 900.5633 | 291.6465 |
| 229 | 66.5450 | 83.7789 | 54.8800 | 119.2806 | 49.5770 |
| 17533 | 66.5365 | 56.3727 | 51.0882 | 114.2881 | 73.8841 |
| 20702 | 66.5227 | 73.9347 | 40.0039 | 47.7874 | 24.7609 |
| 12606 | 66.5120 | 104.6454 | 43.5076 | 151.9573 | 50.9873 |
| 16552 | 66.5065 | 53.5275 | 30.9350 | 75.9590 | 26.8923 |
| 2696 | 66.4967 | 1955.9891 | 547.2901 | 1525.7674 | 407.0880 |
| 20753 | 66.4967 | 459.0157 | 134.4877 | 352.4993 | 98.0205 |
| 20257 | 66.4405 | 42.4195 | 21.5003 | 66.8902 | 30.8067 |
| 20057 | 66.4167 | 27.2531 | 21.7606 | 58.1524 | 41.2157 |
| 17057 | 66.4106 | 199.4512 | 65.7071 | 147.4468 | 51.9027 |
| 4360 | 66.3928 | 33.3283 | 53.6379 | 81.9552 | 64.4548 |
| 12639 | 66.3818 | 3210.4144 | 679.9330 | 2643.1209 | 548.5944 |
| 24033 | 66.3812 | 83.8093 | 32.2152 | 65.2398 | 19.8005 |
| 15043 | 66.3623 | 264.3148 | 64.1411 | 223.6091 | 41.8365 |
| 9109 | 66.3537 | 119.7921 | 38.8113 | 152.7345 | 40.5745 |
| 16257 | 66.3390 | 162.4694 | 83.6277 | 217.5186 | 76.8000 |
| 7522 | 66.3250 | 30.0616 | 19.8065 | 47.3836 | 21.4359 |
| 16204 | 66.3146 | 2131.0644 | 412.0612 | 1834.0975 | 331.6266 |
| 11210 | 66.2901 | 50.2996 | 26.5866 | 35.7552 | 16.4904 |
| 15242 | 66.2712 | 97.1641 | 23.8141 | 82.5105 | 16.8239 |
| 20998 | 66.2486 | 472.9743 | 174.3291 | 652.7648 | 220.8584 |
| 15767 | 66.2486 | 65.8422 | 23.8211 | 88.0595 | 29.1786 |
| 7936 | 66.2437 | 16.6720 | 8.8882 | 24.0093 | 10.6619 |
| 19712 | 66.2388 | 20.3168 | 16.3903 | 28.9965 | 16.2554 |
| 17394 | 66.2376 | 1288.7090 | 353.7702 | 1008.7226 | 232.3814 |
| 18430 | 66.2278 | 113.2082 | 67.5870 | 63.9229 | 30.7741 |
| 23368 | 66.2107 | 20.3403 | 21.2345 | 47.1079 | 36.0295 |
| 1383 | 66.2052 | 111.8411 | 35.7340 | 139.4404 | 37.6883 |
| 9527 | 66.1860 | 17.9802 | 10.5450 | 28.6865 | 16.1827 |
| 17292 | 66.1477 | 78.7465 | 44.3329 | 124.2901 | 51.0124 |
| 17891 | 66.1367 | 70.3185 | 28.8003 | 50.9460 | 15.1726 |
| 11296 | 66.1080 | 146.1472 | 60.1704 | 110.0776 | 26.6982 |
| 1639 | 66.0903 | 92.0820 | 32.2680 | 119.2868 | 35.1247 |

TABLE 5AA-continued

GENERAL
Timepoint(s): Various

| GLGC ID NO. | LDA Score | Mean Tox | SD Tox | Mean Nontox | SD Nontox |
|---|---|---|---|---|---|
| 15312 | 66.0805 | 294.3315 | 103.4142 | 207.1141 | 120.2236 |
| 1159 | 66.0701 | 245.3912 | 109.5226 | 307.6586 | 76.6909 |
| 1529 | 66.0664 | 85.1275 | 35.3122 | 117.0652 | 42.9668 |
| 20082 | 66.0603 | 575.7399 | 196.1863 | 445.9630 | 136.5965 |
| 2629 | 66.0505 | 296.7655 | 164.6190 | 184.2016 | 99.5436 |
| 23312 | 66.0463 | 72.5097 | 22.4334 | 54.9709 | 18.7648 |
| 17379 | 66.0218 | 377.4942 | 134.8875 | 282.0095 | 85.7256 |
| 25686 | 65.9931 | 2035.3016 | 449.7057 | 1693.4908 | 321.9511 |
| 25550 | 65.9546 | 154.6574 | 54.8543 | 123.6021 | 41.5517 |
| 15822 | 65.9173 | 11.7022 | 17.1814 | 24.9213 | 17.8796 |
| 15876 | 65.9026 | 3230.7030 | 609.8504 | 2768.1187 | 529.8594 |
| 15024 | 65.8989 | 27.4134 | 27.9871 | 60.6851 | 46.7680 |
| 25907 | 65.8635 | 116.9683 | 71.3639 | 68.7305 | 36.9184 |
| 7784 | 65.8604 | 25.5009 | 12.8004 | 34.6472 | 14.4229 |
| 764 | 65.8604 | 28.6735 | 12.7535 | 41.5218 | 17.1244 |
| 22349 | 65.8549 | 208.7746 | 70.3545 | 259.5705 | 65.8964 |
| 15376 | 65.8397 | 294.0367 | 79.2498 | 239.5548 | 51.8214 |
| 12299 | 65.8317 | 358.7213 | 112.0020 | 502.6618 | 165.5580 |
| 1958 | 65.8311 | 1245.6992 | 578.8235 | 1730.1390 | 559.4083 |
| 15741 | 65.8225 | 237.2722 | 81.0986 | 341.6023 | 160.5494 |
| 9621 | 65.8207 | 864.7255 | 176.5473 | 740.0950 | 133.9352 |
| 24219 | 65.8060 | 742.9923 | 225.7029 | 583.7309 | 149.7714 |
| 15023 | 65.7883 | 316.4874 | 73.4033 | 374.2291 | 85.1829 |
| 20417 | 65.7633 | 351.2879 | 78.1352 | 299.4407 | 58.9483 |
| 11843 | 65.7547 | 32.2216 | 9.1279 | 38.7944 | 9.6515 |
| 21399 | 65.7455 | −20.7676 | 41.8543 | 21.2428 | 58.3237 |
| 17115 | 65.7455 | 14.0664 | 11.6067 | 26.9757 | 17.5599 |
| 20493 | 65.7449 | 76.9048 | 38.6876 | 111.3048 | 41.5636 |
| 21657 | 65.7315 | 1645.5215 | 289.3066 | 971.0064 | 414.0401 |
| 765 | 65.7168 | 13.4850 | 9.9010 | 24.3016 | 15.1275 |
| 6049 | 65.7150 | 1433.7374 | 382.7759 | 1174.5853 | 237.1500 |
| 21646 | 65.7064 | 108.2369 | 33.6061 | 135.9052 | 32.5995 |
| 1504 | 65.6813 | 29.8559 | 21.4771 | 15.1121 | 12.4453 |
| 17739 | 65.6068 | 16.9440 | 15.2770 | 44.3797 | 37.0083 |
| 6671 | 65.6068 | 88.9074 | 31.4962 | 125.2377 | 53.4872 |
| 24626 | 65.5952 | 2336.8884 | 454.1319 | 2030.0371 | 286.4623 |
| 16305 | 65.5823 | 205.1214 | 91.7889 | 268.0029 | 100.4687 |
| 5496 | 65.5774 | 111.2546 | 58.1674 | 161.9271 | 69.4038 |
| 17541 | 65.5579 | 2262.4550 | 769.8822 | 2974.8782 | 820.7942 |
| 18108 | 65.5573 | 838.4674 | 201.5580 | 693.1426 | 155.6378 |
| 2628 | 65.5328 | 303.8325 | 194.8401 | 165.2251 | 108.3583 |
| 4495 | 65.5328 | 84.5838 | 31.6614 | 61.9164 | 17.9680 |
| 22862 | 65.5249 | 93.4767 | 66.5391 | 166.3931 | 86.7807 |
| 5619 | 65.5206 | 213.0093 | 127.6901 | 404.8718 | 306.8388 |
| 22282 | 65.5090 | 184.3971 | 57.1084 | 136.7536 | 37.8320 |
| 1694 | 65.4998 | 2936.0574 | 682.9529 | 2378.7169 | 561.3930 |
| 21424 | 65.4913 | 331.9046 | 70.4474 | 400.4620 | 93.4611 |
| 23070 | 65.4906 | 282.1040 | 54.8299 | 236.2250 | 52.7888 |
| 11756 | 65.4906 | 64.1452 | 32.9564 | 89.8054 | 32.5140 |
| 18726 | 65.4674 | 141.4942 | 64.9878 | 204.1164 | 85.4717 |
| 1460 | 65.4479 | 1682.0890 | 607.0074 | 2241.3454 | 689.7468 |
| 23854 | 65.4424 | 1651.3798 | 410.7172 | 1374.9469 | 361.0096 |
| 956 | 65.4381 | 336.2637 | 146.2018 | 442.5485 | 157.1418 |
| 16180 | 65.4191 | 69.3244 | 39.8564 | 98.6787 | 40.7600 |
| 17805 | 65.4093 | 484.1715 | 232.8547 | 666.3691 | 240.1489 |
| 1466 | 65.3983 | 1811.0285 | 1113.8380 | 1143.3410 | 362.6810 |
| 4433 | 65.3892 | 151.8229 | 40.2502 | 125.6042 | 30.7430 |
| 24577 | 65.3843 | 2578.6904 | 662.9402 | 2093.4336 | 440.9315 |
| 15662 | 65.3745 | 181.4169 | 64.7198 | 140.0028 | 32.4521 |
| 21643 | 65.3653 | 2720.9056 | 723.5487 | 2211.4493 | 557.3697 |
| 1678 | 65.3427 | 16.0387 | 28.6562 | 42.5157 | 38.1464 |
| 4280 | 65.3421 | 529.0958 | 244.4002 | 729.2630 | 255.5387 |
| 1624 | 65.3134 | 115.6033 | 30.6138 | 142.4118 | 32.6309 |
| 10108 | 65.2694 | 268.3551 | 102.8174 | 193.8306 | 69.3436 |
| 24377 | 65.2657 | 141.1311 | 41.7546 | 167.3622 | 42.6768 |
| 25370 | 65.2608 | 49.9566 | 52.3378 | 71.8817 | 47.0478 |
| 10878 | 65.2602 | 2116.8728 | 431.6651 | 1804.2486 | 391.9401 |
| 17933 | 65.2498 | 368.9582 | 208.5070 | 224.9608 | 94.1969 |
| 10743 | 65.2376 | 42.1353 | 29.7913 | 81.7292 | 56.9141 |
| 19241 | 65.2358 | 241.7675 | 78.3112 | 187.7360 | 63.1238 |
| 1570 | 65.2260 | 658.9835 | 222.4912 | 542.7178 | 142.9697 |
| 22841 | 65.2070 | 296.5890 | 100.3879 | 228.5580 | 75.1357 |
| 3831 | 65.2021 | 169.6451 | 77.1730 | 121.9725 | 55.5394 |
| 10744 | 65.1850 | 26.6783 | 24.3572 | 61.6850 | 49.6437 |
| 17997 | 65.1795 | 34.3977 | 19.5209 | 51.4812 | 22.5664 |
| 15127 | 65.1704 | 1019.3167 | 362.1775 | 1365.9152 | 522.2876 |
| 13488 | 65.1502 | 21.6473 | 12.4256 | 30.2838 | 11.6022 |
| 18995 | 65.1349 | 95.5210 | 37.2191 | 71.4016 | 21.5182 |
| 16047 | 65.1318 | 74.3942 | 27.1701 | 99.2455 | 37.4243 |
| 19584 | 65.1080 | 93.1027 | 32.1607 | 122.8589 | 46.1768 |
| 1483 | 65.0921 | 15.2616 | 22.1926 | 25.8216 | 17.8058 |
| 6107 | 65.0823 | 700.2770 | 266.8170 | 504.8760 | 183.1132 |
| 23310 | 65.0689 | 315.3919 | 132.6297 | 413.2916 | 130.9768 |
| 10509 | 65.0505 | 24.4164 | 11.2900 | 34.6748 | 17.5710 |
| 18400 | 65.0438 | 71.8474 | 33.8238 | 54.3463 | 18.7985 |
| 20995 | 65.0249 | 164.2948 | 49.4718 | 125.4345 | 33.4305 |
| 690 | 65.0127 | 38.9271 | 15.9479 | 63.6641 | 47.5083 |
| 25586 | 65.0010 | 24.7780 | 14.6240 | 14.4389 | 11.7163 |
| 4952 | 78.5192 | 1380.9360 | 482.7033 | 829.8950 | 239.0741 |
| 2702 | 76.3187 | 1168.1462 | 425.2663 | 748.2829 | 193.4351 |
| 21458 | 75.6910 | 3496.8084 | 1247.3503 | 2173.4521 | 716.8293 |
| 10986 | 75.2796 | 46.6952 | 29.9517 | 94.7862 | 42.2081 |
| 18390 | 74.2968 | 17.9320 | 18.2605 | 38.1379 | 19.2291 |
| 7003 | 74.1097 | 81.0580 | 37.8317 | 126.6516 | 43.5081 |
| 5258 | 74.0566 | 136.6387 | 59.8127 | 204.5130 | 47.8069 |
| 22084 | 74.0089 | 84.7361 | 33.6910 | 119.6805 | 30.8231 |
| 14458 | 73.4520 | 687.6411 | 357.2614 | 352.4508 | 143.7027 |
| 8949 | 73.1837 | 1280.7274 | 336.7235 | 943.6344 | 221.9727 |
| 2781 | 73.1837 | 224.1226 | 119.3579 | 123.3802 | 77.3675 |
| 14181 | 73.0749 | 32.3028 | 15.9941 | 52.3541 | 22.2146 |
| 2768 | 73.0022 | 593.6722 | 356.7375 | 959.3549 | 312.4253 |
| 3934 | 72.6959 | 196.5435 | 160.6860 | 430.1645 | 211.4619 |
| 13757 | 72.6000 | 84.2381 | 25.8884 | 117.0043 | 32.4902 |
| 21457 | 72.5126 | 507.5559 | 275.3451 | 255.7491 | 134.9770 |
| 1690 | 71.9948 | 288.5526 | 94.2233 | 210.0669 | 54.3538 |
| 24338 | 71.9716 | 200.9564 | 46.8430 | 253.7590 | 44.1920 |
| 10611 | 71.8231 | 37.8823 | 45.7182 | 80.9299 | 42.4387 |
| 23299 | 71.7791 | 1843.0754 | 765.6514 | 1121.6127 | 388.9272 |
| 6828 | 71.7082 | 237.9910 | 118.6860 | 369.6981 | 134.7022 |
| 3079 | 71.6654 | 194.9861 | 83.3728 | 310.5713 | 117.2976 |
| 18115 | 71.5217 | 47.6836 | 43.9067 | 125.7368 | 78.7737 |
| 20350 | 71.4979 | 31.4581 | 29.6214 | 89.4618 | 61.6919 |
| 16 | 71.4105 | 239.1320 | 131.6956 | 337.1042 | 107.2602 |
| 10087 | 71.3109 | 181.6394 | 83.0692 | 308.3385 | 132.1895 |
| 21125 | 71.2100 | 10.3071 | 38.9491 | 57.9483 | 49.9394 |
| 7414 | 71.1898 | 762.3626 | 181.9436 | 591.3788 | 134.8170 |
| 11714 | 71.1471 | 160.0486 | 118.0430 | 246.5377 | 97.1934 |
| 2752 | 71.1281 | 207.0326 | 88.8032 | 312.7375 | 94.9099 |
| 3730 | 71.0040 | 349.3090 | 188.6175 | 640.0756 | 294.4819 |
| 2308 | 70.9783 | 161.6741 | 105.5891 | 77.8049 | 41.8595 |
| 13286 | 70.8219 | 170.3315 | 105.1703 | 311.6753 | 145.8988 |
| 22644 | 70.8213 | 43.0877 | 20.2862 | 64.7883 | 20.4637 |
| 3493 | 70.8060 | 145.1648 | 67.5713 | 89.4607 | 34.0925 |
| 15240 | 70.7974 | 520.8184 | 321.0118 | 879.7558 | 348.9597 |
| 23270 | 70.7534 | 1140.6161 | 327.2987 | 805.3361 | 218.9328 |
| 12946 | 70.7015 | 113.1662 | 53.9223 | 166.3840 | 53.9845 |
| 4177 | 70.5230 | 340.1959 | 190.5257 | 189.6575 | 77.4049 |
| 12614 | 70.5089 | 249.7121 | 87.4484 | 172.2689 | 50.9014 |
| 6334 | 70.4949 | 307.8160 | 75.8561 | 240.3516 | 59.9585 |
| 23681 | 70.4515 | 521.3721 | 150.8543 | 387.0621 | 91.9669 |
| 21023 | 70.3561 | 85.7630 | 35.6474 | 116.1509 | 35.6290 |
| 16727 | 70.3268 | 360.1987 | 115.6635 | 252.8729 | 75.1248 |
| 6188 | 70.3029 | 135.7908 | 79.0244 | 184.8474 | 50.2931 |
| 10281 | 70.1941 | 82.4835 | 93.0445 | 206.4619 | 146.0176 |
| 18909 | 70.1458 | 208.8729 | 128.8100 | 393.9070 | 181.6341 |
| 15026 | 70.0921 | 1204.7528 | 201.6337 | 1039.1938 | 147.4988 |
| 22415 | 70.0921 | 2865.8357 | 1236.6601 | 1895.7675 | 1167.9985 |
| 16216 | 70.0774 | 1349.7527 | 631.7780 | 820.8292 | 309.6302 |
| 12802 | 70.0101 | 541.9115 | 207.2651 | 389.1209 | 118.0452 |
| 2226 | 69.9441 | 130.1020 | 51.8907 | 179.6150 | 52.1077 |
| 22688 | 69.9062 | 112.7683 | 70.2995 | 215.8318 | 110.8484 |
| 4067 | 69.8903 | 474.1967 | 209.8396 | 321.1204 | 117.3232 |
| 15241 | 69.8579 | 123.0267 | 61.6666 | 192.4445 | 66.3492 |
| 12309 | 69.8152 | 70.9944 | 40.4329 | 124.8240 | 56.0139 |
| 18350 | 69.8042 | 305.0846 | 107.8385 | 211.7632 | 67.6987 |
| 18271 | 69.7956 | 131.6482 | 81.9083 | 199.1546 | 75.7482 |

TABLE 5AA-continued

GENERAL
Timepoint(s): Various

| GLGC ID NO. | LDA Score | Mean Tox | SD Tox | Mean Nontox | SD Nontox |
|---|---|---|---|---|---|
| 5079 | 69.7956 | 45.5057 | 22.9042 | 67.4864 | 24.7604 |
| 21341 | 69.7712 | 128.2900 | 155.6429 | 181.0537 | 139.8703 |
| 23558 | 69.7284 | 110.3281 | 50.1380 | 159.2115 | 53.6717 |
| 6295 | 69.7100 | 202.2616 | 113.0956 | 379.2805 | 205.4665 |
| 9312 | 69.6905 | 24.5227 | 11.8148 | 37.0343 | 14.9624 |
| 18910 | 69.6232 | 102.6376 | 85.3177 | 207.7916 | 112.9688 |
| 2587 | 69.5756 | 407.4747 | 194.0781 | 721.1407 | 343.7025 |
| 19187 | 69.5646 | 552.2678 | 193.5776 | 405.3891 | 125.4656 |
| 2296 | 69.5511 | 339.3849 | 153.2533 | 523.3942 | 171.6598 |
| 12999 | 69.4490 | 296.0335 | 125.9327 | 198.0692 | 47.2314 |
| 15684 | 69.4448 | 1192.8592 | 271.3194 | 990.1458 | 177.3934 |
| 1397 | 69.4069 | 117.2647 | 30.3089 | 88.6811 | 28.1221 |
| 23983 | 69.3500 | 143.6945 | 112.9278 | 271.3302 | 130.8724 |
| 21213 | 69.3152 | 855.7283 | 296.0551 | 631.2136 | 180.7646 |
| 3246 | 69.2864 | 152.5247 | 74.7983 | 98.8264 | 43.2822 |
| 2596 | 69.2834 | 39.7956 | 31.0793 | 91.7318 | 66.5682 |
| 4047 | 69.1856 | 1082.7120 | 589.1053 | 601.7764 | 293.7781 |
| 11934 | 69.1330 | 370.0794 | 89.7910 | 297.9478 | 58.1124 |
| 23464 | 69.1141 | 516.6542 | 144.9949 | 409.3416 | 103.9649 |
| 3081 | 69.1055 | 183.1731 | 63.6589 | 245.6238 | 74.3151 |
| 5979 | 69.0230 | 303.2753 | 98.1749 | 216.6214 | 69.4773 |
| 9547 | 69.0193 | 120.4813 | 45.8703 | 170.1889 | 58.5068 |
| 4440 | 69.0053 | 83.3528 | 33.7688 | 135.6657 | 59.4309 |
| 4828 | 68.9649 | 72.9557 | 43.0516 | 43.2301 | 18.1022 |
| 4479 | 68.9509 | 2128.2199 | 785.7217 | 1380.3135 | 481.7303 |
| 8314 | 68.9509 | 1748.7842 | 947.4333 | 1046.3157 | 509.6676 |
| 2297 | 68.8849 | 306.9007 | 143.0584 | 475.9000 | 168.5143 |
| 10080 | 68.8659 | 208.2363 | 95.3370 | 343.6579 | 134.1518 |
| 10569 | 68.8647 | 420.0206 | 111.5716 | 336.2579 | 67.4437 |
| 21740 | 68.8604 | 335.3288 | 163.6891 | 452.1302 | 141.8450 |
| 4679 | 68.8415 | 70.7112 | 35.6696 | 101.2058 | 34.0050 |
| 14664 | 68.7926 | 449.4157 | 160.0542 | 320.1835 | 79.8585 |
| 18524 | 68.7602 | 479.7140 | 242.2044 | 798.9120 | 285.7968 |
| 22076 | 68.7363 | 66.3065 | 120.1228 | 191.3693 | 148.2324 |
| 11478 | 68.7363 | 59.8391 | 30.5898 | 92.1731 | 35.3226 |
| 6240 | 68.7351 | 140.7640 | 113.8483 | 51.1735 | 72.2511 |
| 11411 | 68.7210 | 493.3294 | 101.0576 | 397.7069 | 73.6291 |
| 13634 | 68.6825 | 3734.7699 | 1259.4354 | 2601.6015 | 858.0332 |
| 21020 | 68.6728 | 137.3744 | 71.2974 | 79.3627 | 45.6250 |
| 12713 | 68.6691 | 198.3838 | 57.0308 | 252.5748 | 62.4565 |
| 19258 | 68.6593 | 64.5293 | 97.5883 | 150.9686 | 102.0385 |
| 9757 | 68.6116 | 226.8654 | 86.0729 | 317.2582 | 92.8840 |
| 16688 | 68.5915 | 873.9645 | 234.0155 | 653.3143 | 162.8972 |
| 2364 | 68.5878 | 439.3924 | 80.0675 | 525.4556 | 100.2198 |
| 17721 | 68.5878 | 84.4527 | 45.0652 | 130.3623 | 58.2006 |
| 6284 | 68.5438 | 36.9434 | 18.0322 | 47.7690 | 14.3122 |
| 20764 | 68.5291 | 75.9727 | 33.7190 | 101.4901 | 23.0193 |
| 5169 | 68.5199 | 1294.1642 | 272.2527 | 1012.3391 | 236.7067 |
| 3411 | 68.5163 | 346.3567 | 191.4244 | 563.7495 | 253.7300 |
| 5134 | 68.5096 | 57.5026 | 45.3509 | 29.8086 | 22.3481 |
| 5355 | 68.4820 | 696.3212 | 361.5834 | 1121.6300 | 396.1451 |
| 6632 | 68.4619 | 627.1740 | 191.3880 | 467.3563 | 114.3622 |
| 21056 | 68.4478 | 466.4872 | 120.8088 | 368.5099 | 93.0039 |
| 16058 | 68.4283 | 345.5074 | 141.2590 | 226.2417 | 82.5197 |
| 23499 | 68.4246 | 91.6798 | 42.0498 | 131.3763 | 45.0374 |
| 7074 | 68.4056 | 41.1339 | 16.8894 | 55.6278 | 20.2907 |
| 22543 | 68.4050 | 215.7534 | 109.1552 | 289.4168 | 98.2545 |
| 4719 | 68.3910 | 46.5350 | 23.8465 | 67.0565 | 23.9299 |
| 22503 | 68.3726 | 39.4874 | 28.2193 | 86.9832 | 55.9353 |
| 24315 | 68.3567 | 57.8882 | 26.5133 | 73.4524 | 19.6711 |
| 3990 | 68.3482 | 73.7562 | 22.7583 | 96.9086 | 26.9361 |
| 22911 | 68.3433 | 52.7237 | 32.8041 | 84.7760 | 40.2596 |
| 14313 | 68.3042 | 12.5743 | 50.5306 | 37.2762 | 40.6449 |
| 11830 | 68.2614 | 319.1448 | 101.7538 | 416.3463 | 100.9309 |
| 8715 | 68.2290 | 191.5732 | 125.2165 | 407.9751 | 283.6740 |
| 18932 | 68.2186 | 34.6703 | 23.7168 | 57.3116 | 27.7398 |
| 10920 | 68.2094 | 37.4480 | 41.9658 | 89.6100 | 62.8764 |
| 5874 | 68.2045 | 50.4558 | 21.3568 | 75.0578 | 31.4042 |
| 2729 | 68.1801 | 374.0755 | 184.9500 | 542.7368 | 186.6862 |
| 8730 | 68.1709 | 49.7271 | 19.6661 | 69.6548 | 26.3633 |
| 22558 | 68.1709 | 313.2676 | 221.3398 | 581.5696 | 296.5432 |
| 13055 | 68.1605 | 319.3971 | 171.5159 | 412.6381 | 144.6149 |
| 15416 | 68.1226 | 13.3786 | 12.6588 | 25.3575 | 14.7105 |
| 17793 | 68.1122 | 166.0617 | 62.6963 | 113.7718 | 46.7785 |
| 8436 | 68.0792 | 1117.8952 | 637.2028 | 1756.5499 | 630.8623 |
| 2911 | 68.0744 | 172.1192 | 132.4224 | 272.7135 | 115.5896 |
| 17755 | 68.0554 | 158.9817 | 100.1329 | 247.5783 | 100.8276 |
| 8500 | 68.0511 | 571.5467 | 442.3438 | 1133.4581 | 653.4591 |
| 3364 | 68.0218 | 92.4530 | 37.9342 | 132.0197 | 41.1802 |
| 13903 | 68.0016 | 74.8909 | 38.6042 | 45.1563 | 23.3742 |
| 7451 | 67.9967 | 990.0853 | 338.1618 | 784.4295 | 175.8447 |
| 14677 | 67.9937 | 97.1277 | 67.9184 | 152.7724 | 74.1339 |
| 1599 | 67.9869 | 354.9231 | 250.8783 | 157.5306 | 133.7963 |
| 12628 | 67.9698 | 72.9421 | 56.4314 | 161.8187 | 113.8184 |
| 19016 | 67.9692 | 272.3102 | 87.1540 | 348.1016 | 93.1420 |
| 24236 | 67.9154 | 210.0703 | 69.1529 | 154.6757 | 41.5715 |
| 16172 | 67.8928 | 24.6428 | 68.5319 | 120.0844 | 100.4551 |
| 22079 | 67.8824 | 1864.5198 | 777.0811 | 2472.4661 | 641.5331 |
| 6297 | 67.8635 | 73.6206 | 55.6640 | 123.7171 | 55.1561 |
| 6687 | 67.8482 | 252.5414 | 84.4886 | 193.8123 | 42.6956 |
| 13501 | 67.8433 | 77.0534 | 44.0940 | 45.1108 | 19.8796 |
| 24629 | 67.8060 | 283.5514 | 103.6825 | 367.7265 | 101.0097 |
| 21894 | 67.7956 | 249.5995 | 112.2144 | 161.1367 | 72.6780 |
| 20857 | 67.7681 | 50.4099 | 26.7199 | 72.6768 | 29.7534 |
| 8205 | 67.7583 | 143.3135 | 49.2822 | 195.6209 | 53.2744 |
| 9168 | 67.7571 | 271.1517 | 131.5232 | 173.6676 | 75.2473 |
| 7288 | 67.7302 | 64.5863 | 44.2720 | 118.8940 | 70.1369 |
| 10879 | 67.7247 | 60.8570 | 35.5292 | 90.5411 | 35.6599 |
| 17229 | 67.6997 | 905.7618 | 178.5880 | 768.8854 | 124.7699 |
| 9575 | 67.6715 | 915.2495 | 190.7941 | 746.9526 | 170.7976 |
| 16678 | 67.6483 | −18.1057 | 46.4995 | 29.3880 | 60.0088 |
| 151221 | 67.6471 | 235.8309 | 72.0374 | 269.4921 | 47.7364 |
| 2536 | 67.6196 | 128.2393 | 63.7874 | 174.5912 | 66.9057 |
| 7935 | 67.6190 | 265.8129 | 81.1131 | 335.4534 | 76.4223 |
| 5902 | 67.6037 | 84.2627 | 39.2120 | 57.7772 | 22.4187 |
| 17340 | 67.5994 | 790.0630 | 324.0040 | 976.2955 | 250.0339 |
| 19269 | 67.5799 | 1137.2970 | 280.2994 | 968.2988 | 165.5552 |
| 15959 | 67.5762 | 65.4340 | 20.4691 | 83.1028 | 21.5135 |
| 4005 | 67.5621 | 137.5915 | 88.9590 | 232.7084 | 121.1282 |
| 22753 | 67.5621 | 128.7867 | 86.6397 | 223.3912 | 117.4626 |
| 2639 | 67.5279 | 103.0229 | 76.4464 | 164.2121 | 70.8394 |
| 8795 | 67.5175 | 208.5626 | 98.1766 | 125.8190 | 60.4295 |

TABLE 5BB

HYDRAZINE
Timepoint(s): 24 hrs

| GLGC ID NO. | LDA Score | Mean Tox | SD Tox | Mean Nontox | SD Nontox |
|---|---|---|---|---|---|
| 25247 | 97.9460 | 37.0767 | 0.5814 | 53.3339 | 16.8255 |
| 1888 | 97.4765 | 113.6533 | 1.3258 | 107.0621 | 63.1462 |
| 3880 | 97.1244 | 95.7567 | 0.7557 | 92.6252 | 29.5970 |
| 11662 | 97.1244 | 84.6267 | 1.0501 | 77.5572 | 27.9175 |
| 18327 | 96.9484 | 51.6967 | 0.4065 | 52.2675 | 22.3585 |
| 2577 | 96.0094 | 155.5333 | 2.3953 | 177.7987 | 47.1143 |
| 7062 | 95.5986 | 288.5300 | 7.4707 | 477.7241 | 236.0127 |
| 16954 | 95.5986 | 264.9633 | 11.6139 | 147.2295 | 103.8173 |
| 25907 | 95.4812 | 87.2333 | 2.5134 | 80.0068 | 49.8692 |
| 20896 | 95.4225 | 29.7233 | 0.5270 | 30.5215 | 16.3305 |
| 6951 | 95.4225 | 76.0767 | 2.7062 | 71.8819 | 36.7998 |
| 25328 | 95.3052 | 57.7867 | 0.9437 | 63.0813 | 21.9695 |
| 968 | 95.1878 | 25.0033 | 1.0496 | 37.5884 | 39.1871 |
| 25649 | 95.1291 | 22.2767 | 1.5474 | 37.5620 | 28.9002 |
| 25209 | 95.1291 | 181.0867 | 2.0510 | 173.0712 | 35.4332 |
| 935 | 95.0117 | 84.1933 | 1.3105 | 76.3168 | 22.2118 |
| 20941 | 94.7770 | 992.7433 | 20.2695 | 1032.2932 | 353.3071 |
| 16115 | 94.7770 | 48.3833 | 1.4760 | 37.7177 | 17.5566 |
| 18795 | 94.7183 | 390.3567 | 8.7339 | 322.6620 | 104.0070 |
| 15872 | 94.6596 | 710.0433 | 268.2124 | 291.0634 | 134.2337 |
| 23341 | 94.6596 | 469.0733 | 8.4223 | 372.9566 | 112.7619 |
| 2846 | 94.5423 | 36.1633 | 1.0401 | 51.8978 | 19.4627 |

TABLE 5BB-continued

HYDRAZINE
Timepoint(s): 24 hrs

| GLGC ID NO. | LDA Score | Mean Tox | SD Tox | Mean Nontox | SD Nontox |
|---|---|---|---|---|---|
| 1309 | 94.5423 | 67.0933 | 1.8506 | 56.3164 | 22.8219 |
| 25425 | 94.4249 | 35.8367 | 1.1033 | 49.5267 | 25.9994 |
| 602 | 94.1901 | 39.9033 | 1.3167 | 49.2863 | 18.5145 |
| 26030 | 94.1901 | 2096.7033 | 56.8085 | 1680.9026 | 522.1836 |
| 10427 | 94.0141 | 23.7833 | 1.4340 | 3.3521 | 19.7205 |
| 15489 | 94.0141 | 70.3233 | 1.3064 | 59.2828 | 16.8143 |
| 15741 | 93.9554 | 192.5533 | 6.8674 | 335.4640 | 172.5203 |
| 14971 | 93.9554 | 45.0633 | 0.9015 | 55.1948 | 20.5650 |
| 19181 | 93.9554 | 124.8333 | 4.8168 | 91.9527 | 22.8895 |
| 21657 | 93.8967 | 578.5067 | 16.0717 | 887.3359 | 406.1971 |
| 17999 | 93.8967 | 950.7333 | 15.8186 | 965.6669 | 264.0766 |
| 20270 | 93.8380 | 55.1533 | 2.1428 | 93.3423 | 39.8536 |
| 18274 | 93.7793 | 96.6233 | 3.1602 | 74.56621 | 19.6116 |
| 5167 | 93.6620 | 7.6800 | 2.0657 | 42.7227 | 71.1021 |
| 25643 | 93.6620 | 430.4600 | 14.4180 | 547.0496 | 209.6484 |
| 18456 | 93.6620 | 52.5733 | 2.0669 | 44.9901 | 22.6192 |
| 1339 | 93.6033 | 24.5000 | 1.1459 | 18.4546 | 9.7650 |
| 25279 | 93.4859 | 368.2933 | 21.2953 | 518.1852 | 152.7293 |
| 21005 | 93.3685 | 125.2567 | 11.1090 | 83.4001 | 29.9791 |
| 15857 | 93.3685 | 167.0033 | 3.5050 | 171.8486 | 45.7847 |
| 25747 | 93.3099 | 976.7667 | 179.6152 | 2040.7425 | 745.5405 |
| 1620 | 93.3099 | 171.6267 | 3.8925 | 173.9528 | 60.1149 |
| 11940 | 93.3099 | 42.5467 | 1.3651 | 51.0578 | 16.3335 |
| 455 | 93.1925 | 182.7333 | 9.9242 | 238.8213 | 147.2915 |
| 13731 | 93.1338 | 53.2867 | 16.6290 | 22.5796 | 17.5057 |
| 1169 | 93.0751 | 135.7433 | 5.5119 | 178.8236 | 85.4068 |
| 14213 | 93.0164 | 20.5900 | 1.5045 | 2.4961 | 26.2752 |
| 17421 | 93.0164 | 228.2467 | 129.1290 | 208.2349 | 59.7431 |
| 20493 | 92.9577 | 142.1467 | 106.3012 | 108.8341 | 46.6047 |
| 15025 | 92.8991 | 8.7100 | 1.9984 | 76.0668 | 139.9238 |
| 13857 | 92.8404 | 24.9567 | 0.9209 | 33.3204 | 17.9828 |
| 13485 | 92.8404 | 25.2000 | 2.0544 | 43.4119 | 19.0244 |
| 4393 | 92.7817 | 1970.1900 | 41.8934 | 1724.5740 | 456.2191 |
| 595 | 92.7230 | 9.8400 | 0.6451 | 20.9080 | 23.6445 |
| 25148 | 92.6643 | 511.0967 | 96.2026 | 358.4566 | 90.5520 |
| 18378 | 92.6643 | 74.7900 | 40.5974 | 61.2654 | 18.1555 |
| 20410 | 92.4883 | 59.5833 | 1.6694 | 71.4859 | 46.9878 |
| 12155 | 92.4883 | −19.0933 | 8.1364 | 83.7093 | 168.3485 |
| 20312 | 92.4296 | 19.8167 | 1.4374 | 31.9382 | 12.7655 |
| 317 | 92.3709 | 12.2500 | 4.5821 | 36.8986 | 21.0418 |
| 17309 | 92.3122 | 58.9033 | 1.4200 | 59.9175 | 15.5742 |
| 18880 | 92.3122 | 38.1433 | 1.2894 | 38.2827 | 14.6705 |
| 24564 | 92.2535 | 36.2133 | 3.0365 | 27.5676 | 15.6279 |
| 20740 | 92.1362 | 1127.1233 | 89.5392 | 820.3090 | 345.3077 |
| 15803 | 92.1362 | −5.2333 | 4.8046 | 29.6186 | 26.3161 |
| 23653 | 92.0188 | 24.6667 | 42.0186 | 18.9945 | 20.2387 |
| 13646 | 92.0188 | 1826.3033 | 41.6292 | 1618.9876 | 287.9917 |
| 1573 | 92.0188 | 15.9233 | 0.6834 | 20.3821 | 10.0022 |
| 15103 | 92.0188 | 175.3967 | 2.6008 | 185.5519 | 31.7783 |
| 8182 | 91.9601 | 617.1567 | 42.3489 | 815.9132 | 301.6696 |
| 20841 | 91.8427 | 149.5833 | 9.7877 | 106.1587 | 32.9275 |
| 15839 | 91.7840 | 434.6200 | 11.9903 | 379.6704 | 118.3617 |
| 14979 | 91.7840 | 23.7900 | 1.1466 | 22.0707 | 11.0596 |
| 16155 | 91.7254 | 78.1967 | 4.2150 | 96.8869 | 55.4332 |
| 20939 | 91.6667 | 806.2700 | 114.4604 | 546.2456 | 181.1310 |
| 16997 | 91.6667 | 14.6833 | 1.0970 | 20.7622 | 13.1709 |
| 20269 | 91.6667 | 71.7333 | 3.3988 | 61.1172 | 28.6563 |
| 19997 | 91.6667 | 103.7800 | 5.4674 | 83.6345 | 42.5927 |
| 18190 | 91.6080 | 31.1767 | 2.5152 | 22.2287 | 11.4849 |
| 18001 | 91.6080 | 329.1600 | 11.2699 | 357.4035 | 125.4645 |
| 25120 | 91.6080 | 17.7867 | 0.7353 | 20.0385 | 9.9765 |
| 19710 | 91.5493 | 251.3100 | 8.9243 | 257.6204 | 98.8017 |
| 910 | 91.4906 | 152.1333 | 10.1794 | 111.0717 | 40.2252 |
| 891 | 91.4906 | 420.8600 | 41.8302 | 792.1574 | 366.2510 |
| 18305 | 91.4906 | 3836.9500 | 112.5191 | 3317.2844 | 882.0977 |
| 20430 | 91.4319 | 45.6033 | 11.4721 | 209.4796 | 180.3662 |
| 16368 | 91.4319 | 26.0500 | 2.0126 | 20.4152 | 15.5957 |
| 20235 | 91.3146 | 32.0133 | 1.9444 | 41.3535 | 22.4684 |
| 18209 | 91.2559 | 127.9733 | 8.0882 | 173.3853 | 51.8906 |
| 1660 | 91.2559 | 47.7567 | 3.9689 | 25.5445 | 33.7402 |
| 1501 | 91.1972 | 1352.6200 | 202.5585 | 2213.4966 | 566.4025 |
| 12422 | 91.1972 | 140.0667 | 4.9274 | 173.5576 | 54.8378 |
| 20357 | 91.1385 | 58.8067 | 2.6243 | 63.0280 | 33.7813 |
| 4364 | 91.1385 | 105.2867 | 6.3137 | 82.5090 | 35.4553 |
| 16535 | 91.1385 | 1171.2133 | 48.6359 | 1431.9100 | 506.6838 |
| 17108 | 91.1385 | 132.0967 | 3.3524 | 140.5891 | 35.7544 |
| 15569 | 91.0211 | 34.5067 | 1.3274 | 37.4447 | 17.2194 |
| 20026 | 91.0211 | 89.0467 | 4.8233 | 76.8488 | 33.4835 |
| 6241 | 100.0000 | 50.3233 | 0.0058 | 50.8960 | 27.2440 |
| 16909 | 99.1784 | 445.4700 | 5.4319 | 308.6417 | 62.8504 |
| 4814 | 98.5915 | 14.1600 | 0.3700 | 30.4624 | 26.4002 |
| 17632 | 98.2394 | 82.0300 | 0.4687 | 85.7136 | 36.0800 |
| 23403 | 98.2394 | 137.4167 | 0.7186 | 158.2033 | 48.0129 |
| 14745 | 98.2394 | 22.1300 | 0.4173 | 31.2172 | 31.9228 |
| 3317 | 97.7700 | 34.8767 | 0.3450 | 34.0734 | 26.1690 |
| 6315 | 97.6526 | 70.2300 | 0.7873 | 84.0403 | 35.3586 |
| 16986 | 97.6526 | 1294.2167 | 26.9886 | 988.5831 | 746.6562 |
| 3584 | 97.2418 | 29.1200 | 0.4419 | 38.5215 | 23.2124 |
| 9510 | 97.2418 | 26.4000 | 0.5556 | 20.0571 | 18.8305 |
| 10156 | 97.0070 | 652.5833 | 19.6801 | 441.7665 | 187.3169 |
| 20694 | 97.0070 | 214.4467 | 3.9028 | 140.8560 | 55.8960 |
| 12000 | 96.8310 | 380.4833 | 55.5277 | 190.4899 | 68.9239 |
| 13776 | 96.7136 | 34.2900 | 0.5534 | 28.8459 | 25.3090 |
| 23325 | 96.7136 | 224.8233 | 1.8600 | 246.4426 | 73.0295 |
| 23583 | 96.7136 | 120.0533 | 48.4725 | 48.9943 | 21.7321 |
| 994 | 96.7136 | 578.4300 | 6.6111 | 726.9823 | 188.7234 |
| 8365 | 96.4789 | 50.8167 | 0.4539 | 47.6431 | 17.1295 |
| 16199 | 96.4789 | 86.8033 | 1.4558 | 62.4798 | 34.3643 |
| 14510 | 96.4202 | 162.3533 | 4.6710 | 431.9601 | 298.7986 |
| 6838 | 96.4202 | 76.7333 | 6.4788 | 69.0887 | 78.9375 |
| 3746 | 96.3615 | 743.9900 | 4.7844 | 784.5842 | 162.2759 |
| 13386 | 96.0681 | 29.1367 | 1.6105 | 49.5808 | 18.6079 |
| 4153 | 96.0094 | 726.6833 | 5.7805 | 697.6108 | 157.9230 |
| 10714 | 95.9507 | 189.5167 | 3.0657 | 213.9803 | 93.0804 |
| 18679 | 95.8920 | 462.8333 | 5.9555 | 424.6149 | 115.4540 |
| 11404 | 95.8920 | 558.8133 | 14.1202 | 431.5947 | 125.6193 |
| 21668 | 95.8333 | 300.0200 | 1.9883 | 311.2505 | 62.2409 |
| 11561 | 95.7746 | 377.4300 | 34.4538 | 230.5533 | 65.0937 |
| 16451 | 95.7746 | 551.9500 | 13.7123 | 476.0406 | 210.3648 |
| 2069 | 95.7746 | 849.5900 | 24.7226 | 1050.6257 | 182.8484 |
| 13977 | 95.5399 | 268.8367 | 13.6411 | 478.0138 | 154.6699 |
| 2781 | 95.4812 | 247.5867 | 17.4291 | 139.6392 | 94.3951 |
| 5256 | 95.4812 | 68.3500 | 1.5687 | 89.8123 | 61.5472 |
| 21469 | 95.4812 | 344.1767 | 7.9813 | 354.3289 | 160.5296 |
| 14234 | 95.4225 | 1027.2067 | 243.0928 | 625.7670 | 131.2207 |
| 8577 | 95.4225 | 295.9033 | 2.9504 | 267.8078 | 66.1661 |
| 22065 | 95.4225 | 1309.5033 | 22.1943 | 1170.4870 | 329.7017 |
| 11066 | 95.3052 | 255.6500 | 5.8592 | 342.1098 | 117.0751 |
| 5624 | 95.3052 | 553.7733 | 23.4419 | 360.7303 | 160.4921 |
| 18742 | 95.1878 | 42.6733 | 3.5372 | 88.0659 | 52.0385 |
| 8132 | 95.1878 | 163.0067 | 2.4774 | 185.0842 | 53.9417 |
| 5999 | 95.1291 | 212.7767 | 5.6900 | 200.7787 | 113.1627 |
| 21279 | 95.1291 | 75.4067 | 2.5307 | 50.8432 | 19.1903 |
| 22471 | 95.0704 | 41.2467 | 0.8458 | 53.3912 | 22.4259 |
| 7691 | 95.0117 | 33.5700 | 0.8642 | 53.1849 | 56.3899 |
| 21505 | 95.0117 | 150.3867 | 3.4840 | 113.1032 | 41.6647 |
| 6582 | 95.0117 | 283.3767 | 5.5381 | 223.1994 | 64.1512 |
| 14388 | 94.8944 | 78.7500 | 5.0129 | 120.7581 | 48.9875 |
| 9977 | 94.8944 | 49.8700 | 2.5275 | 33.2643 | 31.5414 |
| 6635 | 94.8357 | 126.7267 | 2.6088 | 98.1642 | 38.4304 |
| 2526 | 94.7183 | 316.9300 | 7.4353 | 401.9889 | 87.5810 |
| 6176 | 94.6596 | 43.2233 | 1.3288 | 36.7272 | 31.0535 |
| 23799 | 94.6009 | 171.5967 | 3.0202 | 181.0648 | 61.1450 |
| 2733 | 94.6009 | 327.9033 | 5.4151 | 362.5652 | 101.6928 |
| 23097 | 94.5423 | 695.9167 | 54.1146 | 477.1844 | 107.2960 |
| 3986 | 94.5423 | 53.2867 | 2.8136 | 87.5412 | 30.4123 |
| 4427 | 94.5423 | 100.6567 | 1.8579 | 82.0286 | 31.7293 |
| 21744 | 94.5423 | 101.0933 | 9.2880 | 54.5613 | 46.2865 |
| 3103 | 94.4249 | 106.7233 | 1.9255 | 113.2733 | 35.0297 |
| 21197 | 94.4249 | 31.3133 | 1.9745 | 18.0013 | 15.9929 |
| 6608 | 94.3075 | 73.2000 | 19.5353 | 147.3671 | 38.9766 |
| 19765 | 94.3075 | 416.1767 | 10.3273 | 407.7220 | 155.3258 |
| 12554 | 94.3075 | 41.2700 | 2.2824 | 22.5745 | 16.8033 |
| 23656 | 94.3075 | 315.7333 | 3.3950 | 319.2350 | 75.4920 |
| 13916 | 94.2488 | 22.1067 | 0.8116 | 25.7640 | 13.6463 |
| 23355 | 94.2488 | 446.8800 | 12.7153 | 434.6363 | 170.8930 |

TABLE 5BB-continued

HYDRAZINE
Timepoint(s): 24 hrs

| GLGC ID NO. | LDA Score | Mean Tox | SD Tox | Mean Nontox | SD Nontox |
|---|---|---|---|---|---|
| 9596 | 94.1901 | 56.8800 | 11.2409 | 153.9710 | 88.3758 |
| 4068 | 94.1901 | 30.0533 | 1.0171 | 42.2742 | 25.1705 |
| 5528 | 94.1901 | 92.0433 | 8.7276 | 218.9110 | 107.8415 |
| 1263 | 94.1901 | 726.2400 | 46.0840 | 536.1424 | 111.3495 |
| 16579 | 94.1901 | 363.6600 | 6.2905 | 334.9118 | 70.3986 |
| 22934 | 94.0728 | 50.6667 | 1.6051 | 68.9886 | 28.0706 |

TABLE 5CC

IMIPRAMINE
Timepoint(s): 24 hrs

| GLGC ID NO. | LDA Score | Mean Tox | SD Tox | Mean Nontox | SD Nontox |
|---|---|---|---|---|---|
| 1720 | 99.4125 | 31.9032 | 2.2578 | −29.7535 | 32.9198 |
| 20746 | 99.2362 | 1638.9485 | 66.2612 | 560.3927 | 300.2581 |
| 21015 | 99.2362 | 3074.4276 | 21.2156 | 4926.3466 | 1487.3141 |
| 21013 | 99.0599 | 2298.6030 | 59.4444 | 4827.2689 | 1682.2280 |
| 20650 | 98.8837 | 102.7452 | 8.4703 | 607.2097 | 405.2485 |
| 2854 | 98.7074 | 1233.9485 | 31.1854 | 708.3210 | 203.1734 |
| 20745 | 98.6486 | 1195.7975 | 145.1309 | 410.1511 | 216.8996 |
| 1575 | 98.6486 | 37.0993 | 1.7586 | 13.0926 | 11.3351 |
| 18725 | 98.5899 | 20.6555 | 1.1694 | 93.0900 | 59.1469 |
| 1878 | 98.5899 | 39.4790 | 2.0725 | 15.1939 | 13.3405 |
| 20801 | 98.5899 | 372.2555 | 12.8974 | 223.4977 | 103.9353 |
| 25718 | 98.2374 | 1438.0315 | 50.0931 | 1008.6785 | 160.7302 |
| 17486 | 98.2374 | 23.2910 | 1.7326 | 5.1067 | 8.5820 |
| 1789 | 98.1786 | 51.3125 | 2.2267 | 25.3892 | 13.3963 |
| 11755 | 98.1786 | 179.6920 | 25.7524 | 686.0843 | 302.2192 |
| 426 | 98.1199 | 983.9775 | 55.4611 | 2597.4705 | 1304.8870 |
| 25200 | 98.0024 | 34.8295 | 3.7577 | 13.2202 | 12.6108 |
| 25168 | 97.7673 | 24.0880 | 0.1920 | 23.7542 | 9.1863 |
| 25056 | 97.7673 | −15.5760 | 9.2022 | 141.7213 | 163.6066 |
| 3387 | 97.7086 | 25.4895 | 3.5759 | 6.7353 | 8.6512 |
| 17775 | 97.7086 | 97.2798 | 5.2653 | 40.3201 | 41.9903 |
| 26043 | 97.6498 | 28.6130 | 2.8807 | 9.5689 | 7.8717 |
| 24693 | 97.6498 | 71.3015 | 13.1434 | 773.9918 | 485.9603 |
| 3831 | 97.5911 | 301.1957 | 28.9726 | 125.1445 | 62.3240 |
| 15800 | 97.5911 | 148.6680 | 23.3699 | 52.5346 | 23.2110 |
| 18000 | 97.5911 | 678.7267 | 33.2355 | 1238.9171 | 348.7831 |
| 20088 | 97.5323 | 214.9960 | 11.0121 | 92.7950 | 47.9793 |
| 5545 | 97.5323 | 125.9530 | 23.2153 | 544.2325 | 272.7071 |
| 1435 | 97.5323 | 1693.7863 | 141.8816 | 929.1961 | 277.1226 |
| 6049 | 97.4736 | 1998.2413 | 131.2543 | 1212.9939 | 284.3219 |
| 670 | 97.3561 | 72.7118 | 9.1183 | 313.6622 | 123.1828 |
| 13283 | 97.3561 | 54.3508 | 5.5288 | 145.4198 | 71.7992 |
| 108 | 97.3561 | 649.8777 | 81.9309 | 1574.0627 | 613.2621 |
| 19967 | 97.2385 | 35.0850 | 2.4348 | 12.0096 | 11.4830 |
| 13646 | 97.2385 | 2487.4215 | 242.4951 | 1615.6364 | 281.8239 |
| 25966 | 97.2385 | 53.8155 | 32.1419 | −10.5998 | 19.2468 |
| 10429 | 97.1798 | 49.0665 | 12.2701 | 7.9586 | 13.0597 |
| 8266 | 97.1798 | 841.9622 | 63.4079 | 2086.9398 | 954.1779 |
| 17292 | 97.1798 | 37.9300 | 4.2373 | 122.2014 | 59.8957 |
| 25753 | 97.1798 | 65.6697 | 16.2949 | −17.8769 | 32.6182 |
| 17173 | 97.1798 | 174.6208 | 16.8220 | 102.4593 | 25.4983 |
| 18504 | 97.1210 | 117.9572 | 13.7541 | 58.6650 | 19.1122 |
| 649 | 97.1210 | 30.6130 | 4.8894 | 7.2398 | 8.8764 |
| 24326 | 97.1210 | 1583.9358 | 173.8404 | 824.6246 | 251.5429 |
| 10545 | 97.1210 | 676.2200 | 8.3667 | 527.2831 | 121.7804 |
| 24490 | 97.0623 | 125.2865 | 23.4315 | 54.8461 | 25.5435 |
| 16042 | 97.0623 | 76.0185 | 5.4796 | 39.0057 | 17.5455 |
| 3910 | 97.0623 | 121.4825 | 6.0622 | 67.9678 | 28.0145 |
| 80 | 97.0035 | 41.0427 | 6.4302 | 12.0243 | 10.9181 |
| 15749 | 97.0035 | 27.4755 | 3.1713 | 4.0401 | 33.5984 |
| 25546 | 96.9448 | 95.7995 | 10.0550 | 29.5695 | 35.9153 |
| 3879 | 96.8860 | 800.6863 | 33.5704 | 1446.7208 | 432.6999 |
| 20494 | 96.8860 | −159.5240 | 50.8250 | 195.4982 | 181.6616 |
| 20410 | 96.8273 | 205.2305 | 44.0058 | 70.8153 | 46.0380 |
| 18147 | 96.8273 | 48.3982 | 17.9986 | −19.2140 | 21.4748 |

TABLE 5CC-continued

IMIPRAMINE
Timepoint(s): 24 hrs

| GLGC ID NO. | LDA Score | Mean Tox | SD Tox | Mean Nontox | SD Nontox |
|---|---|---|---|---|---|
| 20902 | 96.8273 | 279.5470 | 30.4802 | 147.2794 | 43.8067 |
| 25848 | 96.7685 | 47.1313 | 18.7490 | 12.0558 | 10.3040 |
| 16895 | 96.7685 | 25.2713 | 13.5038 | 266.3075 | 167.0301 |
| 17088 | 96.7685 | 677.4872 | 69.7123 | 350.6841 | 135.5349 |
| 4559 | 96.7685 | 53.9000 | 9.4575 | 12.9112 | 17.6750 |
| 20188 | 96.7685 | 405.1217 | 26.6384 | 211.0001 | 101.8184 |
| 20236 | 96.7685 | 421.7645 | 33.7972 | 197.1529 | 126.0187 |
| 20859 | 96.7685 | 93.9305 | 13.5483 | 43.5931 | 55.2011 |
| 1728 | 96.7685 | 322.3097 | 17.1906 | 227.6089 | 90.1142 |
| 1920 | 96.7098 | 327.5068 | 5.1861 | 518.9960 | 217.0989 |
| 25821 | 96.7098 | 120.4375 | 35.3441 | 45.5962 | 23.0681 |
| 25382 | 96.7098 | 50.3423 | 17.4157 | 3.6390 | 13.5023 |
| 67 | 96.7098 | 158.1370 | 29.5556 | 54.6080 | 34.2261 |
| 25942 | 96.7098 | 35.0240 | 4.0015 | 13.2366 | 9.2897 |
| 20834 | 96.7098 | 77.2023 | 8.9449 | 30.4114 | 19.0754 |
| 4324 | 96.7098 | 38.1283 | 10.8636 | −13.3853 | 24.1243 |
| 405 | 96.7098 | 75.5808 | 7.1246 | 216.8274 | 115.4306 |
| 4035 | 96.7098 | 69.0588 | 16.0426 | 15.0741 | 18.4216 |
| 1184 | 96.7098 | 21.9150 | 1.4490 | 10.0585 | 6.4782 |
| 22783 | 96.7098 | 505.8063 | 28.9973 | 244.8359 | 154.2268 |
| 1418 | 96.6510 | 140.1768 | 36.8226 | 63.2517 | 22.2376 |
| 15066 | 96.6510 | 249.2687 | 44.5852 | 644.7028 | 204.1419 |
| 745 | 96.6510 | 47.8130 | 2.6540 | 27.4286 | 12.1833 |
| 212 | 96.6510 | 36.8225 | 4.8711 | 15.6931 | 12.1807 |
| 25799 | 96.6510 | 416.8150 | 26.4510 | 212.1327 | 140.9002 |
| 4748 | 96.5922 | 35.4350 | 19.6952 | 451.7404 | 360.3694 |
| 16721 | 96.5922 | 48.1607 | 8.9241 | 123.8567 | 48.6051 |
| 14486 | 96.5335 | 45.6530 | 12.3812 | 8.5912 | 11.5271 |
| 730 | 96.4747 | 187.7680 | 34.2000 | 45.9734 | 51.8037 |
| 3431 | 96.4747 | 5427.9056 | 1003.6967 | 3104.0541 | 783.1762 |
| 24750 | 96.4747 | 25.4115 | 6.7316 | −12.4145 | 16.5016 |
| 4556 | 96.4747 | 107.6130 | 7.0878 | 71.6394 | 17.2472 |
| 1130 | 96.4747 | 266.7875 | 114.7086 | 969.3972 | 386.4870 |
| 1138 | 96.4160 | 115.9005 | 8.7627 | 57.2749 | 28.6947 |
| 23180 | 96.4160 | 2187.7585 | 274.4873 | 1369.4050 | 273.4658 |
| 25636 | 96.4160 | 91.1408 | 14.6815 | 22.2760 | 33.6224 |
| 20405 | 96.4160 | 60.4735 | 16.4305 | 219.2488 | 96.7823 |
| 20509 | 96.4160 | 106.6507 | 3.2586 | 71.2812 | 26.6382 |
| 11599 | 96.4160 | 32.2320 | 2.6967 | 15.7003 | 9.5009 |
| 25433 | 96.3572 | 132.5613 | 16.5868 | 42.7323 | 39.3132 |
| 15738 | 96.3572 | 69.2153 | 7.4256 | 36.3364 | 12.6308 |
| 16220 | 96.3572 | 48.8158 | 5.5251 | 20.3506 | 16.2981 |
| 1598 | 96.3572 | 528.1760 | 52.1856 | 280.7837 | 272.4267 |
| 25244 | 96.2985 | 62.9182 | 11.0923 | 19.2739 | 18.1887 |
| 19107 | 96.2985 | 152.5425 | 52.9369 | 46.2327 | 35.9661 |
| 4049 | 99.1187 | 2214.3220 | 74.6095 | 602.9060 | 432.2398 |
| 4048 | 98.6486 | 1472.4213 | 228.7942 | 293.3014 | 273.0935 |
| 12769 | 98.6486 | 267.1693 | 82.4715 | 37.4415 | 36.9600 |
| 3246 | 98.4724 | 196.6472 | 7.7285 | 103.4193 | 56.4708 |
| 5624 | 98.2961 | 155.0115 | 5.4827 | 362.3778 | 160.3710 |
| 5491 | 98.2374 | 146.6950 | 5.2612 | 74.6135 | 32.1499 |
| 14197 | 98.1786 | 296.9390 | 21.1412 | 166.7641 | 42.6758 |
| 22519 | 98.1786 | 511.7805 | 13.3682 | 927.2739 | 256.7793 |
| 20271 | 98.1199 | 270.3340 | 1.4987 | 353.0691 | 140.5164 |
| 7904 | 98.0611 | −24.8485 | 10.0853 | 43.9280 | 27.4796 |
| 3062 | 98.0611 | 462.5840 | 22.1126 | 1117.3416 | 442.8188 |
| 15218 | 98.0024 | 366.5058 | 49.6671 | 989.9652 | 266.1225 |
| 8584 | 98.0024 | −8.6980 | 11.9211 | 287.0885 | 213.4408 |
| 11052 | 97.9436 | −25.8247 | 9.2157 | 46.4014 | 30.6259 |
| 23756 | 97.8848 | 262.1920 | 20.0908 | 652.3686 | 363.1937 |
| 19206 | 97.8261 | 86.1618 | 13.1107 | 23.8917 | 17.6849 |
| 16865 | 97.7673 | 257.7357 | 106.1991 | 42.0832 | 52.1270 |
| 19991 | 97.7673 | −1.0915 | 5.6320 | 45.8193 | 24.2942 |
| 4936 | 97.7673 | 559.2685 | 7.9481 | 699.6318 | 245.4573 |
| 22098 | 97.7086 | 44.9002 | 1.2861 | 23.5876 | 15.9654 |
| 12354 | 97.7086 | 417.4155 | 85.1057 | 152.8118 | 74.9778 |
| 6804 | 97.7086 | 91.0923 | 23.2618 | 19.8872 | 16.2478 |
| 2250 | 97.7086 | 846.2498 | 70.6939 | 1651.9306 | 680.9355 |
| 14042 | 97.6498 | 820.5130 | 106.3353 | 3529.0945 | 1669.3916 |
| 19200 | 97.5911 | 503.9525 | 42.9623 | 227.8102 | 83.3323 |
| 6090 | 97.5323 | 221.9317 | 24.0005 | 27.0724 | 61.2912 |
| 10246 | 97.5323 | 475.7337 | 34.3866 | 209.7920 | 99.4899 |
| 8312 | 97.5323 | 49.9635 | 7.1518 | 3.1397 | 17.5270 |

TABLE 5CC-continued

IMIPRAMINE
Timepoint(s): 24 hrs

| GLGC ID NO. | LDA Score | Mean Tox | SD Tox | Mean Nontox | SD Nontox |
|---|---|---|---|---|---|
| 5476 | 97.4736 | 36.5477 | 8.4047 | −23.9081 | 24.4414 |
| 10393 | 97.4736 | 139.5157 | 20.3947 | 39.7465 | 33.6332 |
| 2847 | 97.4736 | 4.5670 | 3.0584 | 52.0936 | 38.6388 |
| 18874 | 97.4148 | 39.4213 | 1.4350 | 20.3523 | 15.7538 |
| 633 | 97.4148 | 142.0900 | 14.4773 | 289.9103 | 95.3720 |
| 3476 | 97.3561 | 186.0202 | 26.0301 | 67.4625 | 55.2117 |
| 19146 | 97.3561 | 107.6828 | 12.3529 | 40.6341 | 28.2997 |
| 26359 | 97.2973 | 214.3947 | 26.8314 | 87.1304 | 42.2466 |
| 19023 | 97.2973 | 152.1170 | 67.0009 | −27.4465 | 64.0066 |
| 14192 | 97.2973 | 39.8817 | 2.7133 | 12.6719 | 15.4468 |
| 12768 | 97.2973 | 344.7960 | 42.6819 | 153.0503 | 85.0537 |
| 17552 | 97.2973 | 205.7418 | 11.2967 | 111.5849 | 47.3979 |
| 26115 | 97.2973 | 823.2372 | 38.7069 | 459.8416 | 194.3307 |
| 7240 | 97.2973 | 45.4507 | 5.0657 | 1.4012 | 27.2958 |
| 9004 | 97.2385 | 62.2205 | 6.7585 | 21.6030 | 17.1300 |
| 12335 | 97.2385 | 294.4088 | 14.7742 | 134.0225 | 85.7094 |
| 3436 | 97.1798 | 760.2025 | 24.4311 | 454.6793 | 183.8222 |
| 19456 | 97.1798 | 616.7365 | 162.4362 | 154.6475 | 141.0503 |
| 21237 | 97.1210 | 228.0030 | 21.4545 | 87.2611 | 51.5071 |
| 5996 | 97.1210 | 147.4330 | 7.7876 | 84.8020 | 30.9678 |
| 14108 | 97.1210 | 34.3457 | 6.8543 | −4.7013 | 20.5878 |
| 19205 | 97.0623 | 242.7788 | 34.6836 | 87.3128 | 47.8076 |
| 16739 | 97.0623 | 198.8505 | 5.5287 | 317.1395 | 103.5826 |
| 4670 | 97.0623 | 648.2467 | 22.7990 | 892.3156 | 378.7150 |
| 2855 | 97.0623 | 1293.4650 | 32.8246 | 915.3109 | 214.8895 |
| 1690 | 97.0623 | 353.6910 | 18.7103 | 228.0386 | 73.6332 |
| 22681 | 97.0623 | 1551.9040 | 27.1289 | 1469.8577 | 742.6888 |

TABLE 5DD

INDOMETHACIN
Timepoint(s): 24 hrs

| GLGC ID NO. | LDA Score | Mean Tox | SD Tox | Mean Nontox | SD Nontox |
|---|---|---|---|---|---|
| 10504 | 99.9412 | 62.2300 | 3.5592 | 330.2917 | 199.6281 |
| 20980 | 99.8825 | 257.3800 | 6.8927 | 105.5871 | 25.8754 |
| 1159 | 99.7062 | 59.5625 | 12.2939 | 302.3441 | 89.2271 |
| 21400 | 99.6475 | 66.1025 | 14.2310 | 348.8392 | 149.3777 |
| 3292 | 99.5887 | 510.6300 | 128.6361 | 3447.4895 | 1520.3414 |
| 25313 | 99.5300 | 429.7700 | 40.6774 | 183.6502 | 63.2161 |
| 26032 | 99.5300 | 28.9550 | 12.7369 | 502.7892 | 438.3524 |
| 20994 | 99.4712 | 390.9400 | 22.5578 | 158.1114 | 58.3106 |
| 10306 | 99.4125 | 2332.4200 | 321.4667 | 645.7242 | 210.6717 |
| 1868 | 99.4125 | −18.7075 | 4.2378 | 461.1461 | 323.9081 |
| 21657 | 99.4125 | 229.5825 | 47.2791 | 889.3388 | 404.3261 |
| 20719 | 99.3537 | 235.0750 | 22.1061 | 99.5416 | 32.7611 |
| 570 | 99.3537 | 602.2650 | 38.6618 | 257.5117 | 78.2253 |
| 20743 | 99.2949 | 42.0950 | 2.1564 | 94.1823 | 32.6478 |
| 18725 | 99.2362 | 8.1100 | 0.9713 | 93.1490 | 59.0683 |
| 20702 | 99.1774 | 145.2325 | 4.1802 | 50.5415 | 29.0111 |
| 17913 | 99.1774 | 484.4975 | 37.5925 | 230.3018 | 60.7197 |
| 6477 | 99.1774 | 530.9275 | 112.2568 | 2195.5485 | 686.8809 |
| 626 | 99.1187 | 477.7125 | 88.2634 | 87.8368 | 70.3504 |
| 23868 | 99.1187 | 45.3650 | 6.4010 | 579.7014 | 534.3961 |
| 19335 | 99.1187 | 650.7500 | 57.4103 | 335.4375 | 91.1097 |
| 17281 | 99.1187 | 27.6800 | 8.2295 | 156.5676 | 82.6348 |
| 1571 | 99.0599 | 1356.6825 | 93.0060 | 573.5366 | 165.6940 |
| 797 | 99.0599 | 288.5275 | 61.3999 | 82.8972 | 29.7812 |
| 18867 | 99.0599 | 29.0775 | 16.0220 | 310.5560 | 156.9917 |
| 18061 | 99.0599 | 379.6025 | 55.8814 | 178.0563 | 42.1544 |
| 1468 | 99.0012 | 72.8975 | 27.0035 | 14.8508 | 11.5623 |
| 798 | 98.9424 | 194.4850 | 38.7411 | 51.9808 | 20.3189 |
| 11493 | 98.9424 | 370.2575 | 107.5498 | 32.3674 | 48.0765 |
| 21586 | 98.9424 | 376.0450 | 38.6225 | 135.3681 | 56.8817 |
| 22576 | 98.9424 | 291.2825 | 55.1263 | 712.7280 | 186.2299 |
| 14289 | 98.9424 | 248.6100 | 25.5448 | 110.1495 | 37.8151 |
| 17933 | 98.8837 | 852.8025 | 109.1073 | 246.1008 | 128.7651 |
| 14881 | 98.8837 | 36.1825 | 7.9075 | 438.6018 | 277.1638 |

TABLE 5DD-continued

INDOMETHACIN
Timepoint(s): 24 hrs

| GLGC ID NO. | LDA Score | Mean Tox | SD Tox | Mean Nontox | SD Nontox |
|---|---|---|---|---|---|
| 15932 | 98.8837 | 313.3350 | 63.6640 | 135.4865 | 34.1409 |
| 15281 | 98.8837 | 1358.3000 | 384.8702 | 542.5394 | 165.9380 |
| 18000 | 98.8837 | 337.2675 | 114.8414 | 1240.5221 | 345.3338 |
| 10503 | 98.8837 | 22.6750 | 10.2151 | 183.8699 | 121.4110 |
| 3512 | 98.8249 | 288.2200 | 13.3579 | 145.4154 | 45.0371 |
| 5496 | 98.8249 | 45.5050 | 2.5767 | 164.8591 | 97.4298 |
| 23872 | 98.8249 | 7.9175 | 4.1278 | 176.7958 | 175.4309 |
| 1466 | 98.8249 | 4549.0700 | 1537.8844 | 1246.7102 | 579.3674 |
| 23344 | 98.8249 | 877.2525 | 123.8365 | 382.3115 | 107.3639 |
| 14213 | 98.8249 | 70.7100 | 15.0978 | 2.2392 | 25.8764 |
| 4314 | 98.7662 | 35.6100 | 4.0408 | 163.9508 | 83.6022 |
| 14992 | 98.7662 | 205.4200 | 30.2527 | 88.5483 | 26.4634 |
| 21090 | 98.7662 | 14.1000 | 6.1319 | 109.3410 | 48.9452 |
| 16726 | 98.7662 | 110.9725 | 18.4607 | 324.3886 | 105.4385 |
| 1602 | 98.7662 | 3.4100 | 15.7642 | 224.4890 | 174.8619 |
| 16180 | 98.7074 | 18.2625 | 5.8828 | 95.1405 | 42.9565 |
| 22903 | 98.7074 | 338.1050 | 11.7323 | 206.3488 | 53.0736 |
| 556 | 98.7074 | 64.9100 | 23.4381 | 265.2199 | 88.5712 |
| 1540 | 98.7074 | 21.0225 | 4.8927 | 97.7588 | 49.2141 |
| 18011 | 98.7074 | 441.1475 | 67.8457 | 161.7030 | 65.2610 |
| 24196 | 98.6486 | 128.6075 | 57.2429 | 18.1542 | 16.1318 |
| 19942 | 98.6486 | 337.1150 | 43.3266 | 145.8070 | 41.1419 |
| 1382 | 98.6486 | 193.6200 | 12.2027 | 114.6752 | 27.2709 |
| 16133 | 98.6486 | 54.2500 | 7.0315 | 14.1804 | 12.1225 |
| 9125 | 98.5899 | 1290.5900 | 79.3310 | 778.0816 | 158.0294 |
| 24645 | 98.5899 | 36.2000 | 3.0405 | 115.8434 | 43.6103 |
| 1869 | 98.5899 | 32.2150 | 14.8344 | 704.9147 | 393.3038 |
| 12788 | 98.5899 | 111.9350 | 33.9635 | 12.1004 | 21.9528 |
| 10108 | 98.5899 | 500.5125 | 78.1530 | 203.9349 | 79.5596 |
| 2744 | 98.5899 | 630.1400 | 74.3785 | 313.7995 | 83.7923 |
| 1598 | 98.5311 | 1291.8125 | 169.1408 | 277.1943 | 263.7988 |
| 11494 | 98.5311 | 1200.6075 | 506.7700 | 165.6916 | 123.5680 |
| 14583 | 98.5311 | 865.4525 | 73.0594 | 396.6406 | 118.1961 |
| 19831 | 98.5311 | 277.6050 | 75.5232 | 106.9405 | 30.3524 |
| 21915 | 98.5311 | 1013.0475 | 20.4381 | 711.2750 | 149.8386 |
| 17185 | 98.4724 | 330.9675 | 12.2666 | 229.8158 | 39.6072 |
| 22739 | 98.4724 | 298.5725 | 52.7861 | 114.6913 | 31.5662 |
| 20509 | 98.4724 | 142.0025 | 6.8330 | 71.1151 | 26.3019 |
| 20753 | 98.4724 | 774.7575 | 118.4954 | 361.5211 | 115.5258 |
| 18069 | 98.4136 | 173.1450 | 80.2732 | 27.3541 | 22.5176 |
| 23248 | 98.4136 | 252.2625 | 112.7353 | 39.0741 | 33.5420 |
| 17517 | 98.4136 | 1073.7525 | 207.7605 | 550.5227 | 175.9005 |
| 16416 | 98.4136 | 715.1300 | 131.2254 | 275.8531 | 104.0179 |
| 25260 | 98.4136 | 187.5500 | 38.6410 | 63.8350 | 27.7721 |
| 15154 | 98.4136 | 1188.5800 | 230.7209 | 480.2157 | 162.3013 |
| 24350 | 98.4136 | 97.9975 | 20.5576 | 29.1151 | 18.1116 |
| 14959 | 98.3549 | 2807.4675 | 183.9564 | 1626.7477 | 403.4471 |
| 21154 | 98.3549 | 97.6700 | 13.1641 | 41.5304 | 16.4321 |
| 25257 | 98.3549 | 740.2375 | 143.0950 | 288.9688 | 105.5923 |
| 1583 | 98.2961 | 309.5600 | 45.1569 | 121.9829 | 40.8861 |
| 16825 | 98.2961 | 152.3525 | 35.9514 | 45.4750 | 23.8228 |
| 16256 | 98.2961 | 46.6825 | 25.3516 | 580.0201 | 334.3963 |
| 18719 | 98.2374 | 19.5900 | 1.2792 | 129.9511 | 94.6025 |
| 18647 | 98.2374 | 1629.3875 | 458.6422 | 441.1557 | 203.6546 |
| 15767 | 98.2374 | 30.8100 | 3.1614 | 83.1373 | 29.4440 |
| 20443 | 98.2374 | 326.5100 | 92.0980 | 135.5416 | 35.5447 |
| 3513 | 98.1786 | 423.3200 | 45.8831 | 188.8129 | 65.0018 |
| 25559 | 98.1786 | 376.2900 | 21.4184 | 165.7325 | 79.4425 |
| 18726 | 98.1786 | 57.6575 | 7.3446 | 194.8580 | 85.1690 |
| 1004 | 98.1786 | 163.6475 | 35.3333 | 73.4974 | 19.2918 |
| 19103 | 98.1786 | 13.4450 | 5.5949 | 111.5269 | 68.9002 |
| 1501 | 98.1786 | 955.4300 | 153.9155 | 2216.3751 | 562.4601 |
| 4574 | 98.1199 | 85.0700 | 10.6922 | 327.4832 | 128.0218 |
| 19825 | 98.1199 | 4.5125 | 2.4202 | 72.9398 | 55.4831 |
| 16255 | 98.1199 | 127.1950 | 43.1738 | 1113.9598 | 611.7239 |
| 43 | 98.1199 | 34.6800 | 8.8711 | 168.8600 | 82.2045 |
| 9054 | 100.0000 | 351.9900 | 7.9793 | 125.6519 | 41.4967 |
| 633 | 99.8237 | 47.2075 | 8.5617 | 290.3563 | 94.4549 |
| 19082 | 99.7062 | 89.2425 | 3.1454 | 197.0939 | 39.7598 |
| 23159 | 99.7062 | 1280.5475 | 78.3938 | 564.2374 | 275.8493 |
| 18846 | 99.6475 | 436.2850 | 11.5557 | 240.6489 | 42.5052 |
| 16045 | 99.5887 | 59.9075 | 1.9551 | 142.3596 | 41.7614 |
| 4193 | 99.5887 | 102.6725 | 7.6252 | 267.3471 | 72.4567 |

TABLE 5DD-continued

INDOMETHACIN
Timepoint(s): 24 hrs

| GLGC ID NO. | LDA Score | Mean Tox | SD Tox | Mean Nontox | SD Nontox |
|---|---|---|---|---|---|
| 17340 | 99.5887 | 241.1350 | 56.3941 | 924.8543 | 266.7224 |
| 10667 | 99.5300 | −104.2100 | 17.9208 | 103.3579 | 97.4672 |
| 10396 | 99.5300 | 557.0700 | 36.7065 | 218.0900 | 75.8198 |
| 17339 | 99.5300 | 37.5700 | 7.8964 | 269.0511 | 296.5241 |
| 23162 | 99.4712 | 23.8625 | 11.6809 | 421.2251 | 301.8778 |
| 2702 | 99.4712 | 2222.5775 | 65.7403 | 814.8188 | 283.1735 |
| 19249 | 99.4712 | 2083.5700 | 257.6838 | 479.3686 | 216.9405 |
| 4883 | 99.4712 | 1102.4000 | 173.3207 | 277.4060 | 113.7145 |
| 3191 | 99.4712 | 2317.9725 | 239.4131 | 1026.1202 | 297.2656 |
| 19189 | 99.4712 | 39.2300 | 13.5171 | 444.7078 | 307.0730 |
| 15122 | 99.4125 | 133.1575 | 5.2603 | 266.8445 | 60.8079 |
| 11549 | 99.4125 | 539.7725 | 8.8368 | 342.8817 | 77.7989 |
| 15404 | 99.4125 | 894.1975 | 114.5920 | 120.6707 | 133.1243 |
| 22469 | 99.4125 | 800.5050 | 51.2871 | 291.6135 | 130.2465 |
| 3519 | 99.4125 | 4.1875 | 15.7170 | 491.0872 | 266.7510 |
| 8347 | 99.4125 | 1433.9300 | 559.4427 | 255.6099 | 237.7935 |
| 24119 | 99.3537 | 596.9750 | 67.1134 | 250.3303 | 81.0242 |
| 5686 | 99.3537 | 205.4725 | 45.5102 | 2159.3932 | 1292.6711 |
| 15588 | 99.2949 | 492.4250 | 64.5372 | 136.3331 | 91.7687 |
| 23824 | 99.2949 | 749.3700 | 83.8252 | 282.1444 | 83.6065 |
| 2750 | 99.2949 | 4126.0950 | 795.9146 | 1315.6750 | 528.0626 |
| 8919 | 99.2949 | 1165.8475 | 76.6829 | 585.7077 | 120.1433 |
| 24028 | 99.2949 | 983.0900 | 150.7155 | 399.1276 | 125.3691 |
| 21660 | 99.2949 | 325.4075 | 125.0238 | 1789.4427 | 909.2538 |
| 16 | 99.2949 | 38.9100 | 22.2407 | 329.9026 | 130.0023 |
| 23423 | 99.2949 | 499.0300 | 26.3975 | 234.7998 | 89.3107 |
| 16883 | 99.2949 | 138.6150 | 13.2748 | 405.6459 | 142.9161 |
| 2141 | 99.2949 | 146.0550 | 26.9273 | 425.4535 | 133.4590 |
| 23076 | 99.2362 | 773.4950 | 100.7242 | 303.7639 | 84.0008 |
| 3138 | 99.2362 | 524.8675 | 28.2598 | 211.4031 | 77.3706 |
| 17768 | 99.2362 | 1539.8175 | 377.1585 | 597.6006 | 136.5156 |
| 6057 | 99.2362 | 312.2575 | 31.6028 | 131.3275 | 46.5272 |
| 3023 | 99.2362 | 9.7800 | 1.6818 | 57.2105 | 39.4703 |
| 2433 | 99.2362 | 350.3400 | 41.4538 | 149.9695 | 41.7688 |
| 18002 | 99.2362 | 306.0125 | 78.7259 | 1303.1528 | 482.7103 |
| 18535 | 99.1774 | 835.7700 | 142.0840 | 232.1802 | 91.1171 |
| 24375 | 99.1774 | 1142.8725 | 104.4671 | 511.7731 | 151.0502 |
| 17522 | 99.1774 | 1436.1525 | 95.3435 | 404.2032 | 226.4876 |
| 6682 | 99.1187 | −0.3700 | 1.0139 | 51.1645 | 28.6147 |
| 22676 | 99.1187 | 320.8525 | 17.1388 | 163.3937 | 48.9459 |
| 9407 | 99.1187 | 27.6775 | 12.7545 | 462.5909 | 427.4146 |
| 19193 | 99.1187 | 104.1300 | 8.1756 | 228.5600 | 49.8296 |
| 2267 | 99.1187 | 524.0450 | 31.9154 | 199.3561 | 63.1539 |
| 14697 | 99.0599 | 242.1625 | 36.6703 | 64.7691 | 41.2756 |
| 5258 | 99.0599 | 45.7125 | 6.0899 | 191.6872 | 55.8202 |
| 14051 | 99.0012 | 880.8400 | 158.3002 | 341.3118 | 105.4003 |
| 6632 | 99.0012 | 1167.4825 | 169.0619 | 496.9089 | 135.4993 |
| 22029 | 99.0012 | 575.2275 | 125.4391 | 4040.2448 | 1536.0511 |
| 22492 | 99.0012 | 259.2750 | 22.9185 | 460.8390 | 81.6687 |
| 18868 | 98.9424 | 606.8800 | 85.9892 | 155.4969 | 91.4550 |
| 15403 | 98.9424 | 821.3625 | 162.3524 | 278.8046 | 78.0158 |
| 21208 | 98.9424 | 69.1400 | 15.0950 | −1.0806 | 23.3668 |
| 3547 | 98.9424 | 208.5125 | 11.4607 | 116.4047 | 33.2878 |
| 3246 | 98.9424 | 357.0775 | 58.3305 | 102.6652 | 53.9879 |
| 2978 | 98.9424 | 562.8375 | 79.0739 | 227.6677 | 52.8734 |
| 18909 | 98.9424 | 42.1200 | 8.0112 | 366.4631 | 198.2310 |
| 3107 | 98.9424 | 898.1750 | 139.8782 | 446.4196 | 82.6735 |
| 14975 | 98.9424 | 540.9725 | 137.2379 | 4073.3305 | 2424.0041 |
| 4952 | 98.8837 | 2638.6125 | 364.2734 | 930.2780 | 355.6940 |
| 7436 | 98.8837 | 791.4100 | 113.9532 | 356.6442 | 105.8016 |
| 7379 | 98.8837 | 25.2350 | 6.3830 | 95.5795 | 35.3714 |

TABLE 5EE

INDOMETHACIN
Timepoint(s): 3, 6 hrs

| GLGC ID NO. | LDA Score | Mean Tox | SD Tox | Mean Nontox | SD Nontox |
|---|---|---|---|---|---|
| 10543 | 99.2344 | 24.3800 | 14.4212 | −6.6322 | 7.2900 |
| 24825 | 97.7032 | 2106.3233 | 263.3400 | 842.6462 | 408.3046 |
| 16825 | 96.8198 | 110.1933 | 20.6317 | 45.5211 | 24.3961 |
| 17316 | 95.6419 | 94.6467 | 23.1372 | 35.0426 | 27.7532 |
| 17728 | 94.1107 | 5787.3817 | 281.5390 | 3978.6380 | 1035.1560 |
| 353 | 94.0518 | 717.8300 | 82.3841 | 410.8303 | 247.6053 |
| 19161 | 93.9340 | 3129.0483 | 82.3470 | 2565.7714 | 670.6154 |
| 16315 | 93.8163 | 20.5617 | 3.2377 | 6.2142 | 8.9082 |
| 17100 | 93.5218 | 2811.1767 | 124.6943 | 2109.8541 | 457.3016 |
| 16918 | 93.4040 | 4351.1517 | 305.5557 | 3013.2120 | 883.4637 |
| 22412 | 93.4040 | 943.3383 | 114.7927 | 688.7529 | 452.6229 |
| 18107 | 93.3451 | 909.7950 | 20.3440 | 791.1657 | 168.4428 |
| 19952 | 93.1684 | 2.2650 | 6.1361 | 29.2135 | 23.7795 |
| 16275 | 93.0506 | 5979.9517 | 297.2096 | 4308.9991 | 1442.9995 |
| 16381 | 92.9918 | 276.0017 | 18.2616 | 431.2981 | 120.4333 |
| 21654 | 92.8740 | 1304.0683 | 212.5128 | 852.7638 | 221.4411 |
| 1813 | 92.6973 | 170.0333 | 39.6697 | 51.6642 | 64.2916 |
| 11189 | 92.6973 | 124.8617 | 9.4317 | 88.4635 | 20.9321 |
| 21154 | 92.6973 | 65.3700 | 6.1522 | 41.6264 | 16.7892 |
| 1540 | 92.6973 | 39.3967 | 6.9177 | 97.8097 | 49.3074 |
| 4186 | 92.4617 | 5529.7167 | 313.7911 | 4097.1779 | 1197.6529 |
| 5358 | 91.8728 | 41.4850 | 6.5388 | 93.7589 | 51.1839 |
| 1610 | 91.8139 | 126.8150 | 31.7320 | 62.3387 | 30.8112 |
| 2697 | 91.7550 | 3600.5100 | 165.2472 | 2876.2334 | 619.7999 |
| 18615 | 91.6372 | 2384.0483 | 251.3521 | 1712.0141 | 371.8772 |
| 11350 | 91.6372 | 10.6467 | 1.4666 | 24.4535 | 14.1151 |
| 21380 | 91.5783 | 323.0200 | 40.6165 | 202.5287 | 68.0559 |
| 12639 | 91.4605 | 3743.2600 | 312.3105 | 2728.7545 | 612.5186 |
| 1694 | 91.4605 | 3420.9500 | 253.5555 | 2471.3516 | 617.6841 |
| 20928 | 91.3428 | 47.1833 | 6.1546 | 111.8406 | 70.3876 |
| 1867 | 91.2839 | 1616.1500 | 71.2711 | 1325.1602 | 262.0566 |
| 4441 | 91.2839 | 2647.1583 | 120.5208 | 2085.4028 | 440.4377 |
| 17105 | 91.1661 | 3379.1617 | 558.9931 | 2403.4440 | 560.9624 |
| 3027 | 91.0483 | 3109.7033 | 165.1798 | 2340.2548 | 597.1547 |
| 16401 | 90.8716 | 9731.1033 | 724.0395 | 7197.6016 | 3178.1108 |
| 18611 | 90.7538 | 4048.7917 | 522.2197 | 2799.8785 | 800.0305 |
| 809 | 90.5183 | 12.8067 | 3.6061 | 93.3238 | 145.9655 |
| 11975 | 90.4594 | 20.0633 | 2.3415 | 7.6341 | 19.0391 |
| 10305 | 90.1649 | 25.7933 | 2.1682 | 47.1931 | 28.2563 |
| 25774 | 90.1649 | 10.1200 | 3.5607 | 28.1311 | 14.6310 |
| 16942 | 90.0471 | 1276.7833 | 30.2769 | 1195.7805 | 243.0254 |
| 15735 | 89.9882 | 58.8833 | 9.2766 | 103.9531 | 35.5529 |
| 798 | 89.9293 | 77.7367 | 12.7522 | 54.2702 | 22.5619 |
| 16929 | 89.9293 | 2547.6850 | 219.4385 | 1976.1322 | 398.1845 |
| 4213 | 89.9293 | 9874.8083 | 954.5959 | 6707.2585 | 2582.9874 |
| 16039 | 89.7527 | 993.9867 | 86.4770 | 712.0597 | 206.2687 |
| 17211 | 89.6938 | 3932.4333 | 445.8944 | 2681.9398 | 841.3591 |
| 238 | 89.6938 | 258.9633 | 11.3256 | 327.4939 | 87.2265 |
| 20812 | 89.3993 | 4149.5417 | 495.7116 | 2964.9498 | 735.2147 |
| 5317 | 89.3404 | 583.7200 | 37.8045 | 693.5554 | 480.0953 |
| 14981 | 89.2815 | 8894.7083 | 1683.9675 | 5405.0387 | 2268.2013 |
| 5667 | 89.2226 | 2238.0933 | 135.5298 | 1847.4786 | 352.2519 |
| 25808 | 89.2226 | 96.1400 | 24.0058 | 68.3337 | 80.8573 |
| 13973 | 89.1637 | 18.4917 | 6.1961 | 57.8494 | 32.4703 |
| 1928 | 89.0459 | 73.4400 | 13.1645 | 125.9314 | 39.9750 |
| 19421 | 88.9870 | 6723.2400 | 1273.4134 | 4432.4977 | 1604.2763 |
| 22413 | 88.9282 | 552.2333 | 64.9133 | 465.9755 | 283.8107 |
| 1973 | 88.8693 | 182.3300 | 17.4177 | 264.4734 | 76.0289 |
| 16132 | 88.8693 | 6458.8083 | 526.2780 | 5049.2796 | 1800.8586 |
| 19694 | 88.8104 | 8.3083 | 5.0799 | 23.5972 | 10.6688 |
| 18122 | 88.8104 | 65.0233 | 9.8846 | 44.0133 | 35.2179 |
| 21917 | 88.6337 | 16.6833 | 2.6667 | 27.0752 | 12.1714 |
| 16871 | 88.4570 | 6.8283 | 4.7077 | 23.3336 | 13.3454 |
| 18582 | 88.4570 | 119.1233 | 10.3595 | 169.6300 | 58.8148 |
| 14959 | 88.3981 | 2165.1567 | 234.8589 | 1628.5056 | 409.2306 |
| 10109 | 88.3981 | 4024.0317 | 425.9288 | 3026.1301 | 695.7214 |
| 17549 | 88.3392 | 985.3550 | 31.0833 | 867.2478 | 164.0544 |
| 17787 | 88.2803 | 2084.9650 | 236.9322 | 1633.6004 | 504.0643 |
| 21400 | 88.2803 | 181.8600 | 36.1691 | 348.6872 | 150.1303 |
| 16938 | 88.2214 | 3956.6883 | 383.2469 | 3012.3976 | 687.4951 |
| 23883 | 88.1037 | 52.5933 | 12.0384 | 166.6202 | 118.6147 |
| 517 | 88.1037 | 140.3967 | 9.3654 | 163.5929 | 84.7540 |
| 16956 | 88.1037 | 424.6100 | 16.5362 | 460.3850 | 106.7428 |

TABLE 5EE-continued

INDOMETHACIN
Timepoint(s): 3, 6 hrs

| GLGC ID NO. | LDA Score | Mean Tox | SD Tox | Mean Nontox | SD Nontox |
|---|---|---|---|---|---|
| 4185 | 88.1037 | 6669.2983 | 627.6036 | 4835.6217 | 1745.6294 |
| 16982 | 88.0742 | 4869.1517 | 1469.6829 | 1602.9005 | 938.8693 |
| 23274 | 88.0448 | 1039.2450 | 23.0436 | 948.4271 | 182.3544 |
| 15612 | 87.9270 | 101.0483 | 10.6896 | 236.3170 | 195.2092 |
| 15137 | 87.7503 | 1101.4717 | 102.8059 | 1542.3185 | 343.4252 |
| 17112 | 87.6914 | 10532.7267 | 1665.8448 | 7162.7296 | 2589.0751 |
| 18628 | 87.6914 | 3742.0533 | 396.6643 | 2823.9894 | 651.6874 |
| 16963 | 87.6325 | 9032.4733 | 1481.4070 | 6136.6555 | 2563.1590 |
| 18640 | 87.6325 | 121.9233 | 16.2214 | 171.3842 | 37.3440 |
| 17111 | 87.5147 | 10187.2350 | 1395.9656 | 6851.1265 | 2725.9975 |
| 2465 | 87.5147 | 5.7000 | 4.0993 | 21.1085 | 15.5090 |
| 804 | 87.4853 | 1886.6583 | 291.8008 | 988.6440 | 371.1965 |
| 20467 | 87.4558 | 41.5667 | 12.2795 | 11.8728 | 20.6279 |
| 25511 | 87.4558 | 39.8683 | 8.3392 | 22.4326 | 23.5929 |
| 20811 | 87.3969 | 5179.4483 | 900.9748 | 3692.6774 | 1147.1936 |
| 2696 | 87.3969 | 2192.5000 | 285.7628 | 1601.2932 | 460.5565 |
| 19109 | 87.3969 | 114.6217 | 10.2731 | 172.8636 | 58.6449 |
| 16123 | 87.2203 | 68.5533 | 20.0110 | 254.7184 | 222.1148 |
| 1541 | 87.2203 | 19.6200 | 4.8586 | 44.5224 | 23.8212 |
| 21843 | 87.2203 | 99.1950 | 6.8644 | 125.2638 | 35.3734 |
| 15653 | 86.9847 | 2983.7583 | 348.8977 | 2358.4940 | 488.9654 |
| 1475 | 86.9258 | 62.5033 | 15.9571 | 290.8709 | 324.5207 |
| 23070 | 86.9258 | 316.5383 | 48.3709 | 239.3569 | 58.2875 |
| 14751 | 86.9258 | 58.5500 | 9.1784 | 39.5591 | 16.7970 |
| 15875 | 86.9258 | 3454.1017 | 353.4437 | 2580.2155 | 693.0522 |
| 21643 | 86.8080 | 2997.1200 | 347.4320 | 2294.7308 | 623.4944 |
| 17908 | 86.7197 | 1064.4783 | 429.2395 | 445.8285 | 265.7494 |
| 13634 | 97.7621 | 5363.5417 | 222.6323 | 2850.8978 | 1032.6332 |
| 14051 | 97.7621 | 705.6150 | 130.7731 | 341.2791 | 107.5048 |
| 9808 | 96.2309 | 163.4100 | 13.7140 | 84.5596 | 37.6219 |
| 21510 | 96.1720 | 1324.6617 | 324.5198 | 627.4807 | 217.1705 |
| 22581 | 96.1131 | 127.7567 | 38.3997 | 17.7075 | 49.0309 |
| 4190 | 94.9352 | 172.6517 | 14.7281 | 102.7109 | 40.2959 |
| 8917 | 94.8763 | 138.9933 | 23.3870 | 53.5015 | 44.1104 |
| 12794 | 94.8763 | 834.4917 | 26.3139 | 594.2381 | 163.3441 |
| 11411 | 94.7585 | 621.2783 | 84.0663 | 412.9537 | 88.6290 |
| 16501 | 94.6408 | 34.5900 | 10.3791 | 100.2185 | 39.8545 |
| 24375 | 94.5819 | 819.0883 | 73.0732 | 512.5746 | 155.1996 |
| 13507 | 94.5819 | 472.1017 | 69.2651 | 284.6275 | 79.0011 |
| 2958 | 94.3463 | 480.9467 | 93.9148 | 234.4485 | 111.4784 |
| 6382 | 93.9340 | 598.7967 | 54.5069 | 329.5110 | 169.2354 |
| 22876 | 93.6985 | 170.7767 | 18.4599 | 104.3305 | 35.5639 |
| 4952 | 93.6985 | 1675.1333 | 289.9962 | 933.0627 | 369.6254 |
| 14352 | 93.6396 | 509.9917 | 23.2710 | 404.9785 | 77.4087 |
| 2788 | 93.2862 | 446.3167 | 73.8269 | 254.6656 | 88.6863 |
| 10820 | 93.2862 | 5335.5333 | 327.8053 | 3806.7636 | 917.1116 |
| 1923 | 93.0506 | 649.2650 | 97.9943 | 346.2076 | 157.8775 |
| 8164 | 93.0506 | 181.7300 | 42.3964 | 105.9581 | 42.5462 |
| 21838 | 92.9329 | 490.0650 | 79.2046 | 298.3442 | 90.7654 |
| 10281 | 92.7562 | 0.6867 | 22.1241 | 200.0244 | 167.1235 |
| 19344 | 92.5795 | 193.4000 | 8.0742 | 291.6941 | 102.5424 |
| 18641 | 92.5206 | 227.7217 | 9.2580 | 327.9687 | 102.4483 |
| 2388 | 92.4617 | 4801.2517 | 418.4236 | 3121.3732 | 956.1541 |
| 7289 | 92.4028 | −4.4967 | 5.2330 | 28.3656 | 30.6388 |
| 6223 | 92.3439 | 18.1783 | 7.0157 | 41.9214 | 16.5867 |
| 8665 | 92.2850 | 167.0983 | 23.9732 | 517.1451 | 411.6194 |
| 18838 | 92.2850 | 110.2900 | 3.7228 | 92.5480 | 31.0644 |
| 7142 | 92.2261 | 650.7967 | 122.9873 | 364.4096 | 133.8193 |
| 3260 | 92.1673 | 73.3133 | 24.4677 | 201.1012 | 97.1035 |
| 11507 | 92.1084 | 1269.2533 | 53.5282 | 1010.3462 | 180.1297 |
| 14879 | 92.0495 | 75.7183 | 9.8547 | 138.2863 | 46.6705 |
| 24373 | 91.9906 | 354.2500 | 73.5639 | 206.9843 | 73.8334 |
| 21816 | 91.9317 | 1782.1867 | 89.7420 | 1352.3481 | 336.6435 |
| 7243 | 91.8139 | 199.3700 | 21.3942 | 134.6220 | 40.1926 |
| 12766 | 91.7550 | 163.6733 | 57.6963 | 370.2901 | 133.2472 |
| 3798 | 91.6372 | 144.4733 | 29.9517 | 311.4275 | 135.3080 |
| 19452 | 91.6372 | 253.2433 | 30.8592 | 153.3418 | 115.2311 |
| 5937 | 91.5783 | 544.6050 | 70.1994 | 372.3010 | 99.3150 |
| 17664 | 91.5783 | 1023.5433 | 140.3720 | 703.1680 | 175.5302 |
| 19927 | 91.5783 | 6763.3200 | 849.1312 | 3872.5569 | 2297.7424 |
| 17190 | 91.5194 | 382.7833 | 24.5750 | 517.4024 | 106.5697 |
| 14243 | 91.5194 | 43.0550 | 7.4302 | 89.3135 | 35.8939 |
| 20635 | 91.2839 | −9.2850 | 6.4931 | 21.1134 | 27.7551 |
| 15196 | 91.2250 | 138.8350 | 11.2089 | 93.2752 | 31.3411 |
| 320 | 91.1661 | 2937.2400 | 130.9974 | 2367.1015 | 533.8159 |
| 5255 | 91.1661 | 411.1600 | 82.4481 | 207.3157 | 102.7573 |
| 2108 | 91.0483 | 65.5983 | 26.4561 | 148.4754 | 51.0656 |
| 10998 | 90.9894 | 47.9517 | 9.5149 | 85.1140 | 24.6336 |
| 21747 | 90.9894 | 452.7800 | 25.3157 | 577.6032 | 118.2991 |
| 3720 | 90.9894 | 359.6100 | 31.3469 | 275.3491 | 62.7340 |
| 13317 | 90.7538 | 284.0150 | 36.1864 | 186.4690 | 56.1166 |
| 14670 | 90.7538 | 5826.5850 | 531.8751 | 3851.2828 | 1153.9273 |
| 18900 | 90.4594 | 2769.7067 | 290.8992 | 1851.2257 | 522.2700 |
| 8025 | 90.4594 | 991.1450 | 57.7803 | 704.1607 | 246.8090 |
| 350 | 90.4005 | 497.5983 | 42.6445 | 687.0801 | 155.2894 |
| 14406 | 90.4005 | 88.0667 | 14.6838 | 50.9663 | 26.1752 |
| 22084 | 90.3416 | 76.8350 | 5.8521 | 111.5113 | 34.6042 |
| 18115 | 90.1649 | 26.7517 | 8.0676 | 105.7596 | 77.0453 |
| 12033 | 90.1649 | 174.0033 | 11.9393 | 246.9847 | 61.5871 |

Table 5FF

Inducer Liver Enlargement
Timepoint(s): Various

| GLGC ID NO. | LDA Score | Mean Tox | SD Tox | Mean Nontox | SD Nontox |
|---|---|---|---|---|---|
| 13348 | 77.3371 | 56.1007 | 19.7632 | 34.9341 | 25.5757 |
| 15291 | 75.9161 | 180.3362 | 51.4163 | 130.9505 | 72.5057 |
| 15411 | 75.9004 | 67.8815 | 29.9454 | 136.8866 | 84.3633 |
| 16249 | 75.8202 | 100.6368 | 54.3983 | 69.3591 | 64.8830 |
| 18686 | 75.3895 | 229.3079 | 105.1214 | 577.4128 | 488.7145 |
| 26051 | 75.0509 | 22.0742 | 9.4974 | 35.8596 | 17.2631 |
| 12348 | 73.9039 | 310.2187 | 60.5749 | 257.1916 | 66.5750 |
| 18687 | 73.5339 | 258.1389 | 77.1124 | 536.5579 | 435.1013 |
| 25047 | 72.6903 | 39.5720 | 11.9397 | 29.5571 | 13.8761 |
| 21238 | 72.1187 | 156.5895 | 53.7086 | 104.3031 | 73.4338 |
| 4407 | 72.1148 | 303.6367 | 110.8826 | 170.7567 | 90.1733 |
| 17227 | 71.7644 | 1043.0540 | 155.4137 | 1284.8668 | 341.4977 |
| 22413 | 71.6587 | 594.2750 | 208.9158 | 461.7768 | 284.3352 |
| 19712 | 71.6430 | 14.7125 | 9.4243 | 28.9455 | 16.9190 |
| 11973 | 71.6391 | 63.9008 | 23.4195 | 40.1428 | 19.4939 |
| 322 | 71.5882 | 273.2246 | 155.6002 | 164.7277 | 179.2547 |
| 18362 | 71.4610 | 44.4851 | 13.9953 | 64.5248 | 23.9039 |
| 18468 | 71.3299 | 102.8783 | 34.9663 | 65.9981 | 47.7991 |
| 22813 | 71.1889 | 74.6475 | 30.7726 | 48.9929 | 32.0397 |
| 22412 | 71.1380 | 883.6835 | 318.6074 | 683.2731 | 454.4025 |
| 16982 | 71.1224 | 2139.4857 | 707.7157 | 1606.4968 | 984.9039 |
| 16085 | 71.0871 | 121.4498 | 36.2186 | 96.3934 | 51.4368 |
| 25799 | 70.8092 | 266.7109 | 84.8578 | 211.0730 | 142.5992 |
| 24658 | 70.6272 | 39.9037 | 12.6599 | 30.1120 | 15.4474 |
| 1453 | 70.6213 | 48.6338 | 13.0742 | 62.1430 | 42.8791 |
| 1977 | 70.6115 | 190.7254 | 62.9339 | 291.3452 | 131.8458 |
| 5655 | 70.5410 | 37.5187 | 18.7261 | 22.4854 | 21.3157 |
| 15995 | 70.4510 | 385.8373 | 190.7988 | 226.6805 | 170.3337 |
| 5297 | 70.4001 | 76.3587 | 27.9825 | 46.7762 | 27.7690 |
| 20509 | 70.3942 | 78.3129 | 13.4326 | 71.1884 | 27.0286 |
| 1063 | 70.1730 | 96.5502 | 44.9813 | 54.3967 | 36.4390 |
| 4739 | 70.1163 | 90.7829 | 26.2185 | 113.9265 | 29.1028 |
| 17586 | 70.0869 | 199.3536 | 51.3932 | 156.7442 | 43.7736 |
| 15579 | 70.0752 | 250.8660 | 243.8336 | 609.3461 | 508.0160 |
| 20597 | 70.0301 | 1180.6380 | 189.3158 | 994.3915 | 296.3209 |
| 17226 | 70.0047 | 686.3449 | 127.6701 | 850.3682 | 250.0062 |
| 23129 | 70.0008 | 62.3583 | 19.9830 | 41.5425 | 20.2028 |
| 19727 | 69.8931 | 2312.6521 | 331.1082 | 2651.0391 | 592.3776 |
| 18494 | 69.8579 | 145.2624 | 31.4788 | 128.2460 | 49.7060 |
| 43 | 69.8324 | 120.9760 | 36.9594 | 170.0101 | 83.2442 |
| 10248 | 69.8285 | 36.9076 | 19.4179 | 22.4998 | 22.5538 |
| 25608 | 69.8285 | 71.2978 | 29.1753 | 49.4122 | 34.7829 |
| 22916 | 69.8285 | 479.1869 | 125.3762 | 361.2016 | 127.9370 |
| 1764 | 69.7267 | 202.8437 | 42.8990 | 170.5455 | 54.1801 |
| 20944 | 69.7267 | 1373.7014 | 192.4485 | 1250.9611 | 275.9236 |

Table 5FF-continued

Inducer Liver Enlargement
Timepoint(s): Various

| GLGC ID NO. | LDA Score | Mean Tox | SD Tox | Mean Nontox | SD Nontox |
|---|---|---|---|---|---|
| 21882 | 69.7267 | 557.3504 | 102.7223 | 688.0792 | 180.4701 |
| 2070 | 69.7228 | 143.5868 | 45.8673 | 103.7961 | 43.3644 |
| 19103 | 69.6759 | 60.7387 | 27.7676 | 112.9615 | 69.4443 |
| 1531 | 69.5897 | 56.1672 | 40.6003 | 147.8179 | 132.3351 |
| 16155 | 69.4233 | 112.2564 | 35.7576 | 96.2407 | 55.8818 |
| 1255 | 69.4194 | 44.3367 | 31.8818 | 18.1485 | 26.8093 |
| 14694 | 69.3372 | 1834.7539 | 406.1874 | 2180.6492 | 552.2725 |
| 20849 | 69.2765 | 582.3709 | 88.5306 | 519.0045 | 142.6416 |
| 10305 | 69.2374 | 70.3324 | 32.8308 | 46.1667 | 27.6681 |
| 4524 | 69.0240 | 87.1190 | 21.7353 | 70.8006 | 31.0214 |
| 15545 | 69.0142 | 21.2825 | 9.3107 | 16.0410 | 11.0901 |
| 14332 | 68.8929 | 102.1133 | 44.9267 | 84.0863 | 51.4061 |
| 6963 | 68.8420 | 474.1156 | 80.1191 | 402.1738 | 109.9758 |
| 7395 | 68.8166 | 642.0439 | 148.4427 | 773.8930 | 199.5821 |
| 20493 | 68.6952 | 74.8464 | 23.7539 | 110.2341 | 47.0251 |
| 25531 | 68.6600 | 28.2719 | 7.6129 | 21.8505 | 10.7845 |
| 23282 | 68.6149 | 491.5175 | 90.5316 | 432.1111 | 93.7205 |
| 15265 | 68.5347 | 533.8075 | 161.2220 | 488.6354 | 113.8165 |
| 15409 | 68.4975 | 123.4252 | 49.4666 | 204.2404 | 127.6320 |
| 20426 | 68.4779 | 149.6585 | 32.2722 | 127.6747 | 40.9276 |
| 17958 | 68.4740 | 96.5777 | 53.2780 | 64.7777 | 44.7599 |
| 23302 | 68.4740 | 110.3512 | 45.2313 | 80.4504 | 39.0039 |
| 15580 | 68.3918 | 483.9744 | 320.4002 | 967.8970 | 603.6172 |
| 4234 | 68.3566 | 820.1767 | 117.1995 | 724.2143 | 172.8685 |
| 21729 | 68.3409 | 233.4187 | 93.2829 | 461.0103 | 373.2648 |
| 18381 | 68.3370 | 50.9194 | 16.0820 | 37.6543 | 16.0971 |
| 1466 | 68.3213 | 1569.9011 | 414.9407 | 1250.5822 | 630.9345 |
| 672 | 68.3174 | 31.3718 | 28.7630 | 20.6111 | 24.3721 |
| 17421 | 68.2606 | 157.4791 | 41.4077 | 210.2173 | 59.7426 |
| 14997 | 68.2567 | 514.7473 | 299.0396 | 465.4704 | 212.6295 |
| 20957 | 68.2254 | 118.3284 | 48.5463 | 145.8628 | 45.9630 |
| 21063 | 68.2098 | 33.5693 | 6.6437 | 28.1946 | 11.4075 |
| 17541 | 68.1491 | 2145.3666 | 526.6878 | 2973.7481 | 1080.1001 |
| 21849 | 68.1236 | 72.0586 | 32.8786 | 109.3342 | 60.9450 |
| 23249 | 68.1099 | 94.1877 | 48.8957 | 67.9199 | 43.7112 |
| 818 | 67.9768 | 1731.0612 | 789.7770 | 2917.9189 | 1780.1634 |
| 21941 | 67.9768 | 227.8179 | 40.5259 | 276.4243 | 77.4909 |
| 15292 | 67.9573 | 270.1595 | 45.0795 | 234.0548 | 74.6038 |
| 14928 | 67.9416 | 1132.3629 | 175.8735 | 1315.5746 | 258.7202 |
| 14353 | 67.8966 | 112.5906 | 22.4866 | 95.0016 | 35.1337 |
| 20915 | 67.8300 | 205.7333 | 97.6321 | 422.4928 | 342.6298 |
| 15182 | 67.8202 | 219.2893 | 45.9693 | 261.7592 | 75.6182 |
| 15927 | 67.7850 | 43.4862 | 12.6658 | 61.1917 | 23.1835 |
| 15996 | 67.7811 | 362.1020 | 163.2909 | 243.1424 | 153.0433 |
| 17564 | 67.7596 | 326.2950 | 70.9832 | 398.4094 | 101.8717 |
| 20243 | 67.7498 | 135.7471 | 28.0424 | 116.3105 | 36.7717 |
| 25483 | 67.7498 | 36.0595 | 7.4022 | 29.4978 | 9.7365 |
| 18770 | 67.7341 | 787.1463 | 98.9568 | 817.6303 | 201.2717 |
| 21090 | 67.6989 | 78.5215 | 25.5253 | 110.0381 | 49.5826 |
| 338 | 67.6754 | 32.0057 | 42.7460 | −0.5299 | 35.9089 |
| 4541 | 67.6636 | 218.2407 | 68.6198 | 276.3739 | 89.0275 |
| 25605 | 67.6441 | 45.8828 | 16.3492 | 34.8375 | 17.2896 |
| 11956 | 67.6030 | 1295.3297 | 274.5209 | 1591.4034 | 406.7798 |
| 25719 | 67.6030 | 2386.1639 | 319.7131 | 2778.1065 | 614.5672 |
| 4224 | 67.5932 | 365.8112 | 65.6803 | 318.4252 | 103.1652 |
| 6252 | 76.1236 | 567.1340 | 120.1918 | 421.7183 | 149.5285 |
| 14763 | 75.9611 | 143.9174 | 127.4739 | 569.2141 | 566.6156 |
| 6165 | 75.5422 | 423.6922 | 134.4659 | 317.1905 | 131.4511 |
| 18522 | 75.4404 | 162.6187 | 34.8217 | 223.9357 | 62.7990 |
| 23584 | 75.3191 | 10.4295 | 25.3364 | 63.3896 | 56.7429 |
| 18096 | 75.0313 | 55.2966 | 21.3404 | 36.9849 | 24.1760 |
| 13563 | 74.3736 | 324.0982 | 97.1325 | 469.8289 | 149.9044 |
| 23499 | 74.3482 | 85.0474 | 26.8445 | 128.8031 | 50.9022 |
| 23184 | 74.1818 | 174.1454 | 40.7951 | 123.1746 | 49.4218 |
| 2911 | 74.0448 | 150.5585 | 60.8574 | 289.7925 | 180.2599 |
| 3365 | 73.6455 | 65.9130 | 45.3407 | 136.5436 | 73.7037 |
| 7199 | 73.2560 | 270.8130 | 79.0348 | 407.0139 | 165.9699 |
| 12096 | 73.1855 | 159.0664 | 40.5937 | 121.7344 | 58.3004 |
| 16989 | 73.1855 | 390.7460 | 93.0590 | 484.7738 | 110.7234 |
| 2768 | 73.1248 | 556.8278 | 243.0606 | 956.7324 | 413.0317 |
| 5494 | 73.0896 | 185.7107 | 49.2461 | 141.2537 | 68.8392 |
| 22416 | 73.0132 | 37.5362 | 20.3151 | 101.1657 | 97.5376 |
| 7913 | 72.9682 | 278.3544 | 77.2099 | 205.6779 | 97.9994 |
| 22558 | 72.9526 | 277.2611 | 135.3227 | 556.9096 | 313.3986 |
| 22415 | 72.8116 | 2804.8320 | 916.3613 | 2106.9886 | 1263.2985 |
| 15085 | 72.7705 | 755.9309 | 136.9326 | 1026.3972 | 339.8806 |
| 3963 | 72.4632 | 322.0818 | 100.7646 | 239.8735 | 97.7946 |
| 7310 | 72.3360 | 552.8986 | 165.2240 | 768.0045 | 240.7791 |
| 24386 | 72.3203 | 165.2544 | 21.1365 | 153.0984 | 40.8497 |
| 2691 | 72.1285 | 386.3193 | 67.1723 | 330.2897 | 99.4576 |
| 21993 | 72.1089 | 386.8642 | 98.2619 | 288.2825 | 125.4992 |
| 16703 | 72.0776 | 275.7302 | 49.9746 | 411.5062 | 217.1560 |
| 3924 | 72.0776 | 161.7287 | 49.4438 | 217.7177 | 91.7048 |
| 22542 | 71.8956 | 1479.1973 | 181.1793 | 1770.8507 | 414.6681 |
| 5602 | 71.8349 | 33.2478 | 28.4030 | 122.4479 | 156.2744 |
| 14501 | 71.7546 | 57.7538 | 16.7238 | 39.7193 | 21.2871 |
| 18659 | 71.5178 | 215.7451 | 75.4203 | 136.9710 | 66.5420 |
| 3487 | 71.3201 | 39.4568 | 34.2752 | 6.8063 | 35.1896 |
| 7745 | 71.3201 | 354.8808 | 104.1573 | 276.9847 | 136.5046 |
| 16701 | 71.2888 | 522.8651 | 109.0657 | 791.0215 | 386.5636 |
| 14393 | 71.2888 | 168.0008 | 18.9072 | 160.7665 | 43.2984 |
| 7147 | 71.2692 | 840.0680 | 213.7877 | 1062.1016 | 253.5514 |
| 11416 | 71.2437 | 144.5078 | 37.3508 | 181.9726 | 47.6173 |
| 4587 | 71.1987 | 1241.7289 | 299.8607 | 996.9830 | 306.5197 |
| 18413 | 71.1420 | 171.9747 | 29.5225 | 161.5461 | 59.4391 |
| 21581 | 71.0969 | 2285.4891 | 346.9150 | 2810.3135 | 632.2322 |
| 3917 | 71.0363 | 478.1307 | 233.6233 | 883.9168 | 520.7576 |
| 22414 | 70.8797 | 401.8120 | 80.2689 | 384.7359 | 206.1217 |
| 23700 | 70.8640 | 561.4910 | 177.5897 | 944.9332 | 530.0280 |
| 8815 | 70.8190 | 743.7311 | 133.2296 | 890.5131 | 195.0983 |
| 18800 | 70.8092 | 321.7784 | 111.8215 | 258.2904 | 189.6780 |
| 26114 | 70.7485 | 114.9126 | 62.6190 | 62.1365 | 79.0575 |
| 18826 | 70.6115 | 2216.6520 | 606.8805 | 1815.2425 | 933.4582 |
| 2431 | 70.5763 | 1343.1627 | 244.9309 | 1577.5029 | 304.8693 |
| 6188 | 70.5508 | 126.5444 | 43.8432 | 185.8759 | 74.7834 |
| 22768 | 70.4764 | 199.9241 | 81.8792 | 143.8164 | 55.7454 |
| 11819 | 70.4647 | 67.2348 | 22.5598 | 52.6513 | 33.4273 |
| 11719 | 70.4001 | 47.6029 | 21.8458 | 31.0154 | 21.9630 |
| 9712 | 70.3903 | 74.0876 | 57.6905 | 85.5450 | 42.3819 |
| 3860 | 70.3688 | 207.0138 | 74.1902 | 315.0073 | 134.5876 |
| 22677 | 70.3238 | 617.1937 | 153.9140 | 443.4916 | 188.5757 |
| 2374 | 70.3081 | 40.2034 | 20.6523 | 66.0946 | 31.4207 |
| 4291 | 70.2826 | 17.2137 | 8.4108 | 26.5355 | 14.0498 |
| 22540 | 70.2220 | 656.7586 | 150.7826 | 832.1162 | 266.6403 |
| 16389 | 70.1769 | 93.8938 | 38.4044 | 66.1444 | 39.2163 |
| 11489 | 70.0712 | 54.0887 | 30.6415 | 63.3681 | 24.9236 |
| 22332 | 70.0556 | 34.5858 | 16.4050 | 50.6956 | 21.8495 |
| 11233 | 70.0262 | 372.6505 | 170.1312 | 271.6053 | 129.6800 |

TABLE 5GG

INFLAMMATION
Timepoint(s): Various

| GLGC ID NO. | LDA Score | Mean Tox | SD Tox | Mean Nontox | SD Nontox |
|---|---|---|---|---|---|
| 22890 | 99.0610 | 62.9833 | 0.1893 | 59.3822 | 33.2336 |
| 15468 | 98.5329 | 2534.1833 | 26.2300 | 1919.2331 | 434.8911 |
| 19339 | 98.0047 | 257.3100 | 5.7855 | 153.4800 | 52.7564 |
| 6595 | 97.7700 | 119.9367 | 1.3282 | 153.7211 | 51.7649 |
| 20487 | 97.7113 | 36.4367 | 1.6684 | 4.9140 | 19.2783 |
| 15401 | 97.7113 | 109.4467 | 1.1547 | 83.0246 | 34.7256 |
| 21538 | 97.5352 | 74.2767 | 1.2136 | 101.5142 | 30.1713 |
| 18208 | 97.3592 | 17.4800 | 0.5308 | 28.8671 | 41.5460 |
| 16895 | 97.2418 | 141.2167 | 5.2040 | 265.6163 | 167.5836 |
| 19392 | 97.0657 | 2971.1300 | 335.2112 | 1962.0771 | 332.6310 |
| 17508 | 96.7113 | 50.4667 | 0.5052 | 55.9608 | 19.7124 |
| 13856 | 96.6549 | 83.1100 | 1.1911 | 68.8688 | 20.2977 |
| 1454 | 96.5962 | 106.6833 | 1.8105 | 111.1379 | 69.9320 |
| 18716 | 96.4202 | 51.5900 | 0.7758 | 64.6004 | 24.2558 |
| 17886 | 96.4202 | 458.5833 | 12.5669 | 652.2928 | 140.0482 |
| 15387 | 96.3615 | 1392.2433 | 28.8522 | 1087.7323 | 285.5557 |

TABLE 5GG-continued

INFLAMMATION
Timepoint(s): Various

| GLGC ID NO. | LDA Score | Mean Tox | SD Tox | Mean Nontox | SD Nontox |
|---|---|---|---|---|---|
| 23987 | 96.1854 | 60.9033 | 1.2486 | 85.4225 | 31.2602 |
| 15703 | 96.1854 | 0.5100 | 3.5404 | 27.6249 | 16.6232 |
| 11865 | 96.1268 | 19.2700 | 1.2650 | 50.3155 | 29.0210 |
| 407 | 96.1268 | 19.3400 | 0.2364 | 25.6925 | 8.0069 |
| 21012 | 96.1268 | 672.7700 | 21.9655 | 1219.9637 | 631.0007 |
| 6107 | 96.0681 | 689.3533 | 13.8908 | 545.4477 | 217.3588 |
| 17563 | 95.9507 | 4044.6000 | 170.1909 | 2820.1337 | 637.2251 |
| 1680 | 95.9507 | 3.1400 | 1.8357 | 23.1431 | 15.4067 |
| 19393 | 95.8920 | 1483.2233 | 242.7832 | 890.3457 | 189.1350 |
| 18389 | 95.8920 | −31.6467 | 13.7413 | 34.4476 | 32.8588 |
| 12118 | 95.8333 | 69.5833 | 1.8196 | 121.4279 | 71.6547 |
| 20984 | 95.7160 | 71.6300 | 2.4134 | 149.7884 | 147.8554 |
| 265 | 95.7160 | 16.1400 | 0.3659 | 20.9205 | 12.6513 |
| 15372 | 95.5986 | 513.0200 | 5.4015 | 428.5034 | 96.7768 |
| 1610 | 95.5399 | 81.3200 | 1.5223 | 62.7260 | 31.3015 |
| 11892 | 95.4812 | 30.1700 | 0.8762 | 53.7860 | 26.2760 |
| 248 | 95.4812 | 40.2700 | 4.7706 | 20.2522 | 12.7292 |
| 17174 | 95.4225 | 124.7833 | 6.8264 | 85.9962 | 45.7678 |
| 21846 | 95.3638 | 18.9400 | 1.5980 | 40.8608 | 32.1534 |
| 25030 | 95.3638 | 62.2700 | 13.8459 | 33.4323 | 142.6617 |
| 4507 | 95.3052 | 46.1467 | 2.2073 | 30.6886 | 21.4853 |
| 904 | 95.2465 | 83.1733 | 18.6301 | 49.0633 | 12.9564 |
| 20627 | 95.1878 | 52.8633 | 1.9771 | 310.3007 | 451.2757 |
| 16108 | 95.1878 | 136.7667 | 1.0987 | 131.0689 | 27.2183 |
| 17060 | 95.1878 | 49.6067 | 1.9740 | 55.4973 | 43.5530 |
| 18746 | 95.1291 | 29.5167 | 1.3858 | 61.2115 | 33.9797 |
| 11907 | 95.0704 | 23.2367 | 0.5108 | 22.5137 | 47.4247 |
| 23226 | 95.0704 | 18.4667 | 5.3541 | 57.3559 | 24.4433 |
| 7148 | 95.0117 | 122.0133 | 1.4230 | 124.8553 | 35.4678 |
| 25642 | 95.0117 | 24.7833 | 2.9848 | 11.2757 | 6.9901 |
| 22424 | 95.0117 | 19.9533 | 1.1423 | 32.9115 | 17.0120 |
| 18001 | 94.9531 | 192.2033 | 15.2611 | 357.8858 | 125.0898 |
| 14928 | 94.9531 | 1603.0667 | 40.9748 | 1307.8961 | 258.2491 |
| 20826 | 94.8944 | 178.8333 | 4.4011 | 177.4929 | 65.7819 |
| 18541 | 94.8944 | 3018.3433 | 76.0800 | 2500.6136 | 558.6709 |
| 17805 | 94.8357 | 260.8433 | 51.1361 | 657.8627 | 270.9862 |
| 24423 | 94.7770 | 14.0700 | 5.2388 | 59.9118 | 32.4484 |
| 20075 | 94.6596 | 25.4833 | 5.8606 | 8.5284 | 7.9867 |
| 7864 | 94.6009 | 1260.3767 | 13.2421 | 1389.3680 | 213.5595 |
| 16853 | 94.5423 | 126.6767 | 34.0770 | 72.8511 | 21.0492 |
| 19268 | 94.5423 | 2618.1133 | 69.0329 | 2094.2899 | 572.2317 |
| 20716 | 94.4836 | 347.4133 | 20.0898 | 523.0024 | 182.1989 |
| 21146 | 94.3662 | 20.3467 | 2.5129 | 9.6721 | 6.6313 |
| 4185 | 94.3662 | 5567.8867 | 217.9663 | 4845.9565 | 1749.3975 |
| 25149 | 94.3075 | 26.6867 | 0.7508 | 29.2073 | 14.0724 |
| 20129 | 94.3075 | 53.5467 | 2.6045 | 36.0082 | 13.8776 |
| 13715 | 94.2488 | 21.4867 | 1.4236 | 4.1912 | 14.5136 |
| 6891 | 94.2488 | 581.0000 | 10.8778 | 619.6318 | 168.3834 |
| 17649 | 94.1901 | 16.2467 | 0.8552 | 29.6281 | 17.7553 |
| 17900 | 94.1901 | 412.0667 | 4.8942 | 379.5418 | 74.9409 |
| 15141 | 94.1901 | 166.6767 | 8.8226 | 245.7835 | 56.8273 |
| 11350 | 94.1315 | 3.6367 | 2.7415 | 24.4296 | 14.0835 |
| 382 | 94.0141 | 2.2467 | 4.4453 | 43.9506 | 43.4341 |
| 2143 | 93.9554 | 544.6500 | 35.4330 | 400.7126 | 83.0949 |
| 20426 | 93.9554 | 116.0000 | 2.5139 | 128.5157 | 40.9032 |
| 866 | 93.9554 | 134.9967 | 3.4537 | 153.3978 | 51.8187 |
| 21801 | 93.8380 | 191.6767 | 15.4484 | 123.6261 | 34.0362 |
| 17567 | 93.8380 | 3525.4800 | 123.2339 | 2651.1500 | 680.0792 |
| 16854 | 93.7793 | 319.1133 | 57.9018 | 219.6170 | 48.0453 |
| 16954 | 93.7793 | 370.9233 | 83.2084 | 146.5834 | 103.1233 |
| 15201 | 93.7793 | 5815.3133 | 477.6845 | 3894.4377 | 1046.7459 |
| 4367 | 93.7793 | 204.9267 | 8.9437 | 141.6465 | 40.6253 |
| 12028 | 93.7793 | 49.4700 | 1.1755 | 46.6192 | 16.3143 |
| 16227 | 93.7207 | 70.0967 | 2.3500 | 101.8044 | 39.4352 |
| 20695 | 93.7207 | −6.0133 | 3.7412 | 20.6149 | 20.3327 |
| 18620 | 93.7207 | 2404.8433 | 90.1524 | 1932.3292 | 397.3328 |
| 18819 | 93.7207 | −2.8767 | 5.7836 | 32.8421 | 25.3108 |
| 17304 | 93.6620 | 31.8733 | 2.1652 | 63.3074 | 37.3465 |
| 15852 | 93.6033 | 29.7967 | 54.8746 | 43.3783 | 24.3296 |
| 18606 | 93.6033 | 3219.5033 | 260.8873 | 2178.2932 | 573.9259 |
| 20945 | 93.6033 | 2433.2167 | 79.4629 | 1945.7740 | 458.7310 |
| 11745 | 93.6033 | 141.8400 | 7.0045 | 158.1448 | 54.9707 |
| 3562 | 93.6033 | 27.9300 | 3.0350 | 15.2644 | 11.6695 |
| 18859 | 93.5446 | 10.2900 | 2.8451 | 31.1420 | 17.1224 |
| 2576 | 93.4859 | 74.1533 | 10.3196 | 31.9732 | 29.2644 |
| 19073 | 93.4859 | 549.4733 | 13.3865 | 461.9069 | 101.6744 |
| 19244 | 93.4272 | 4182.0933 | 229.5170 | 3021.4368 | 759.7564 |
| 16918 | 93.3685 | 4869.0933 | 777.2367 | 3016.0994 | 881.6780 |
| 15875 | 93.3099 | 3896.4733 | 394.7816 | 2581.7349 | 691.5708 |
| 15652 | 93.3099 | 3989.0633 | 185.0531 | 3098.3777 | 572.9614 |
| 18628 | 93.3099 | 3756.7067 | 159.9940 | 2827.1704 | 653.3981 |
| 17533 | 93.2512 | 33.0200 | 5.0851 | 99.5282 | 70.9172 |
| 20309 | 93.2512 | 34.9267 | 0.9880 | 42.2956 | 19.0703 |
| 17142 | 93.2512 | 842.4767 | 26.1264 | 759.9782 | 310.9947 |
| 7211 | 99.7066 | 24.3233 | 0.4735 | −5.5183 | 13.2906 |
| 14518 | 99.7066 | 538.5400 | 2.0528 | 268.7477 | 151.2513 |
| 23747 | 99.5305 | 85.3833 | 0.5742 | 18.8980 | 55.7292 |
| 16484 | 99.3545 | 58.8100 | 2.4800 | 142.7366 | 42.6873 |
| 23504 | 99.3545 | 829.5800 | 10.2110 | 541.9403 | 142.7596 |
| 21563 | 99.2371 | 161.0300 | 0.6991 | 232.8309 | 49.4632 |
| 4896 | 99.0023 | 933.4233 | 4.2383 | 1234.8624 | 238.3889 |
| 8616 | 98.8850 | 3.3533 | 0.4907 | 24.1509 | 14.6335 |
| 26058 | 98.7676 | 140.7667 | 2.3691 | 70.1809 | 71.2447 |
| 4077 | 98.5915 | 1.6400 | 1.7722 | 41.7971 | 26.4811 |
| 11928 | 98.5915 | 33.2433 | 0.8376 | 1.4806 | 37.2959 |
| 6207 | 98.4742 | 360.6367 | 1.8054 | 319.9769 | 84.1822 |
| 3613 | 98.4155 | 25.1500 | 0.7662 | −16.5326 | 34.3566 |
| 10173 | 98.2981 | 106.3033 | 3.5247 | 63.8721 | 20.1758 |
| 22368 | 98.2981 | 459.7200 | 18.2593 | 881.4000 | 299.1864 |
| 8219 | 98.2394 | −9.5133 | 0.9949 | 29.4157 | 32.4008 |
| 14313 | 98.1808 | 25.4500 | 0.9052 | 29.8080 | 44.1420 |
| 6446 | 98.0634 | 162.8033 | 1.5253 | 150.3929 | 67.1448 |
| 5346 | 98.0634 | 162.5967 | 0.9652 | 131.8170 | 40.9038 |
| 22254 | 98.0634 | 31.2167 | 1.1402 | 65.9781 | 33.3147 |
| 8720 | 98.0047 | 47.5833 | 1.1232 | 88.6013 | 38.8806 |
| 6526 | 97.9460 | 656.7200 | 5.7857 | 510.6745 | 100.3921 |
| 10842 | 97.9460 | 31.9600 | 6.3793 | 4.6294 | 10.9717 |
| 5433 | 97.9460 | 36.7000 | 2.3091 | 87.8460 | 50.8050 |
| 16187 | 97.8873 | 230.5233 | 2.9827 | 251.3711 | 102.9532 |
| 18659 | 97.8873 | 82.1200 | 1.2619 | 140.0303 | 68.4744 |
| 24174 | 97.7700 | 10.8100 | 0.9457 | 36.3313 | 21.3655 |
| 2140 | 97.7113 | 6.7500 | 1.1101 | 51.6127 | 64.3148 |
| 22656 | 97.7113 | 161.5300 | 3.0362 | 94.2208 | 56.2978 |
| 3054 | 97.7113 | 97.7700 | 3.0694 | 53.8884 | 30.0460 |
| 2044 | 97.6526 | 220.7733 | 2.2076 | 272.8567 | 54.4099 |
| 4747 | 97.6526 | 47.0100 | 2.3012 | 99.1815 | 41.0463 |
| 22748 | 97.6526 | 84.0000 | 1.1107 | 106.0991 | 22.9850 |
| 19127 | 97.4765 | 247.7700 | 1.7206 | 306.2968 | 90.3996 |
| 22130 | 97.3592 | 14.3800 | 1.0411 | 42.2758 | 26.3817 |
| 21260 | 97.3005 | 191.8767 | 7.1515 | 309.0015 | 124.2285 |
| 6946 | 97.3005 | 138.4533 | 4.7174 | 247.5709 | 72.7852 |
| 23750 | 97.3005 | 15.2533 | 2.8572 | 65.0670 | 39.7598 |
| 8717 | 97.2418 | 1016.1067 | 7.6671 | 982.1344 | 301.8535 |
| 17955 | 97.2418 | 237.7867 | 2.5193 | 251.2719 | 95.7317 |
| 6972 | 97.2418 | 12.6600 | 0.5429 | 25.8890 | 13.7536 |
| 13674 | 97.2418 | 42.6800 | 0.3816 | 52.6485 | 23.4672 |
| 11031 | 97.1244 | 37.1267 | 1.2689 | 13.8928 | 19.3790 |
| 23104 | 97.1244 | −10.3967 | 3.4685 | 38.0930 | 41.3523 |
| 11659 | 97.1244 | 60.5633 | 2.9037 | 22.1559 | 36.6782 |
| 18574 | 97.1244 | 295.9533 | 1.3518 | 278.7570 | 52.1432 |
| 23386 | 97.1244 | 414.8733 | 5.9494 | 594.2249 | 187.9959 |
| 13892 | 97.0657 | 348.1233 | 6.8555 | 473.0480 | 128.8040 |
| 18805 | 97.0657 | 897.6767 | 197.0461 | 455.5105 | 118.6916 |
| 21528 | 97.0657 | 246.1800 | 5.4895 | 187.2260 | 48.2494 |
| 10318 | 97.0657 | 25.4367 | 1.6437 | −1.5739 | 27.6959 |
| 12310 | 97.0070 | 538.6900 | 5.0474 | 446.0799 | 130.7488 |
| 22337 | 97.0070 | 49.2600 | 9.4517 | −30.8655 | 43.7218 |
| 9384 | 96.9484 | 0.3300 | 1.9751 | 32.0059 | 24.7386 |
| 24167 | 96.9484 | 18.4367 | 1.0957 | 33.8878 | 18.6135 |
| 5810 | 96.9484 | 26.5967 | 2.9017 | 5.0324 | 17.4799 |
| 11088 | 96.8897 | 92.7500 | 7.5068 | 43.8994 | 22.4434 |
| 13426 | 96.8310 | 775.3400 | 9.5616 | 617.5610 | 154.1059 |
| 2355 | 96.8310 | 386.0800 | 2.4916 | 388.4531 | 91.5583 |
| 6791 | 96.7723 | 366.3067 | 12.9650 | 669.6902 | 345.2565 |
| 22148 | 96.7136 | 29.2433 | 4.3221 | 4.0651 | 15.6231 |
| 6873 | 96.7136 | 57.1067 | 1.2758 | 44.2189 | 42.1939 |

TABLE 5GG-continued

INFLAMMATION
Timepoint(s): Various

| GLGC ID NO. | LDA Score | Mean Tox | SD Tox | Mean Nontox | SD Nontox |
|---|---|---|---|---|---|
| 11834 | 96.6549 | 28.9900 | 5.9899 | −0.6306 | 11.8896 |
| 17451 | 96.6549 | 160.0167 | 1.9342 | 133.3811 | 33.0696 |
| 7664 | 96.6549 | 22.5567 | 0.6714 | 15.4585 | 14.7729 |
| 17568 | 96.6549 | 128.3100 | 3.3226 | 88.0107 | 60.4400 |
| 14960 | 96.5962 | 4278.3667 | 47.3248 | 3794.6913 | 1055.1968 |
| 5527 | 96.5962 | 105.6400 | 1.5125 | 96.8612 | 42.9351 |
| 26187 | 96.5962 | 522.6733 | 39.6652 | 256.4143 | 135.8406 |
| 18465 | 96.5376 | 199.7400 | 5.6448 | 237.9064 | 119.8761 |
| 15377 | 96.4789 | 21.5800 | 2.3377 | 52.1270 | 23.1634 |
| 7748 | 96.4789 | −3.4333 | 6.7099 | 41.3526 | 21.7749 |
| 4442 | 96.4202 | 8597.5767 | 228.9571 | 5902.2308 | 1976.9768 |
| 6496 | 96.4202 | 66.1733 | 2.8540 | 123.0224 | 45.1062 |
| 17248 | 96.3615 | 1855.8367 | 16.6825 | 2129.0783 | 445.4304 |
| 17699 | 96.3028 | 84.1967 | 1.0374 | 77.1096 | 35.7062 |
| 16921 | 96.2441 | 0.5833 | 2.8140 | 52.6056 | 59.6934 |
| 23953 | 96.2441 | 38.4333 | 19.7319 | 8.7860 | 10.1310 |
| 7917 | 96.2441 | 22.7067 | 1.4969 | 41.6220 | 18.0414 |
| 23990 | 96.1854 | 168.7600 | 17.7739 | 65.2763 | 53.5149 |
| 6857 | 96.1268 | 26.8233 | 0.6413 | 12.8269 | 85.4249 |
| 12798 | 96.1268 | 20.1333 | 2.2181 | 1.4870 | 15.3054 |

TABLE 5HH

IPS
Timepoint(s): 24 hrs

| GLGC ID NO. | LDA Score | Mean Tox | SD Tox | Mean Nontox | SD Nontox |
|---|---|---|---|---|---|
| 22890 | 99.0610 | 62.9833 | 0.1893 | 59.3822 | 33.2336 |
| 15468 | 98.5329 | 2534.1833 | 26.2300 | 1919.2331 | 434.8911 |
| 19319 | 98.0047 | 257.3100 | 5.7855 | 153.4800 | 52.7564 |
| 6595 | 97.7700 | 119.9367 | 1.3282 | 153.7211 | 51.7649 |
| 20487 | 97.7113 | 36.4367 | 1.6684 | 4.9140 | 19.2783 |
| 15401 | 97.7113 | 109.4467 | 1.1547 | 83.0246 | 34.7256 |
| 21538 | 97.5352 | 74.2767 | 1.2136 | 101.5412 | 30.1713 |
| 18208 | 97.3592 | 17.4800 | 0.5308 | 28.8671 | 41.5460 |
| 16895 | 97.2418 | 141.2167 | 5.2040 | 265.6163 | 167.5836 |
| 19392 | 97.0657 | 2971.1300 | 335.2112 | 1962.0771 | 332.6310 |
| 17508 | 96.7136 | 50.4667 | 0.0502 | 55.9608 | 19.7124 |
| 13856 | 96.6549 | 83.1100 | 1.1911 | 68.8688 | 20.2977 |
| 1454 | 96.5962 | 106.6833 | 1.8105 | 111.1379 | 69.9320 |
| 18716 | 96.4202 | 51.5900 | 0.7758 | 64.6004 | 24.2558 |
| 17886 | 96.4202 | 458.5833 | 12.5669 | 652.2928 | 140.0482 |
| 15387 | 96.3615 | 1392.2433 | 28.8522 | 1087.7323 | 285.5557 |
| 23987 | 96.1854 | 60.9033 | 1.2486 | 85.4225 | 31.2602 |
| 15703 | 96.1854 | 0.5100 | 3.5404 | 27.6249 | 16.6232 |
| 11865 | 96.1268 | 19.2700 | 1.2650 | 50.3155 | 29.0210 |
| 407 | 96.1268 | 19.3400 | 0.2364 | 25.6925 | 8.0069 |
| 21012 | 96.1268 | 672.7700 | 21.9655 | 1219.9637 | 631.0007 |
| 6107 | 96.0681 | 689.3533 | 13.8908 | 545.4477 | 217.3588 |
| 17563 | 95.9507 | 4044.6000 | 170.1909 | 2820.1337 | 637.2251 |
| 1680 | 95.9507 | 3.1400 | 1.8357 | 23.1431 | 15.4067 |
| 19393 | 95.8920 | 1483.2233 | 242.7832 | 890.3457 | 189.1350 |
| 18389 | 95.8920 | −31.6467 | 13.7413 | 34.4476 | 32.8588 |
| 12118 | 95.8333 | 69.5833 | 1.8196 | 121.4279 | 71.6547 |
| 20984 | 95.7160 | 71.6300 | 2.4134 | 149.7884 | 147.8554 |
| 265 | 95.7160 | 16.1400 | 0.3659 | 20.9205 | 12.6513 |
| 15372 | 95.5986 | 513.0200 | 5.4015 | 428.5034 | 96.7768 |
| 1610 | 95.5399 | 81.3200 | 1.5223 | 62.7260 | 31.3015 |
| 11892 | 95.4812 | 30.1700 | 0.8762 | 53.7860 | 26.2760 |
| 248 | 95.4812 | 40.2700 | 4.7706 | 20.2522 | 12.7292 |
| 17174 | 95.4225 | 124.7833 | 6.8264 | 85.9962 | 45.7678 |
| 21846 | 95.3638 | 18.9400 | 1.5980 | 40.8608 | 32.1534 |
| 25030 | 95.3638 | 62.2700 | 13.8469 | 33.4323 | 142.6617 |
| 4507 | 95.3052 | 46.1467 | 2.2073 | 30.6886 | 21.4853 |
| 904 | 95.2465 | 83.1733 | 18.6301 | 49.0633 | 12.9564 |
| 20627 | 95.1878 | 52.8633 | 1.9771 | 310.3007 | 451.2757 |
| 16108 | 95.1878 | 136.7667 | 1.0987 | 131.0689 | 27.2183 |
| 17060 | 95.1878 | 49.6067 | 1.9740 | 55.4973 | 43.5530 |

TABLE 5HH-continued

IPS
Timepoint(s): 24 hrs

| GLGC ID NO. | LDA Score | Mean Tox | SD Tox | Mean Nontox | SD Nontox |
|---|---|---|---|---|---|
| 18746 | 95.1291 | 29.5167 | 1.3858 | 61.2115 | 33.9797 |
| 11907 | 95.0704 | 23.2367 | 0.5108 | 22.5137 | 47.4247 |
| 23226 | 95.0704 | 18.4667 | 5.3541 | 57.3559 | 24.4433 |
| 7148 | 95.0117 | 122.0133 | 1.4230 | 124.8553 | 35.4678 |
| 25642 | 95.0117 | 24.7833 | 2.9848 | 11.2757 | 6.9901 |
| 22424 | 95.0117 | 19.9533 | 1.1423 | 32.9115 | 17.0120 |
| 18001 | 94.9531 | 192.2033 | 15.2611 | 357.8858 | 125.0898 |
| 14928 | 94.9531 | 1603.0667 | 40.9748 | 1307.8961 | 258.2491 |
| 20826 | 94.8944 | 178.8333 | 4.4011 | 177.4929 | 65.7819 |
| 18541 | 94.8944 | 3018.3433 | 76.0800 | 2500.6136 | 558.6709 |
| 17805 | 94.8357 | 260.8433 | 51.1361 | 657.8627 | 270.9862 |
| 24423 | 94.7770 | 14.0700 | 5.2388 | 59.9118 | 32.4484 |
| 20075 | 94.6596 | 25.4833 | 5.8606 | 8.5284 | 7.9867 |
| 7864 | 94.6009 | 1260.3767 | 13.2421 | 1389.3680 | 213.5595 |
| 16853 | 94.5423 | 126.6767 | 34.0770 | 72.8511 | 21.0492 |
| 19268 | 94.5423 | 2618.1133 | 69.0329 | 2094.2899 | 572.2317 |
| 20716 | 94.4836 | 347.4133 | 20.0898 | 523.0024 | 182.1989 |
| 21146 | 94.3662 | 20.3467 | 2.5129 | 9.6721 | 6.6313 |
| 4185 | 94.3662 | 5567.8867 | 217.9663 | 4845.9565 | 1749.3975 |
| 25149 | 94.3075 | 26.6867 | 0.7508 | 29.2073 | 14.0724 |
| 20129 | 94.3075 | 53.5467 | 2.6045 | 36.0082 | 13.8776 |
| 13715 | 94.2488 | 21.4867 | 1.4236 | 4.1912 | 14.5136 |
| 6891 | 94.2488 | 581.0000 | 10.8778 | 619.6318 | 168.3834 |
| 17649 | 94.1901 | 16.2467 | 0.8552 | 29.6281 | 17.7553 |
| 17900 | 94.1901 | 412.0667 | 4.8942 | 379.5418 | 74.9409 |
| 15141 | 94.1901 | 166.6767 | 8.8226 | 245.7835 | 56.8273 |
| 11350 | 94.1315 | 3.6367 | 2.7415 | 24.4296 | 14.0835 |
| 382 | 94.0141 | 2.2467 | 4.4453 | 43.9506 | 43.4341 |
| 2143 | 93.9554 | 544.6500 | 35.4330 | 400.7126 | 83.0949 |
| 20426 | 93.9554 | 116.0000 | 2.5139 | 128.5157 | 40.9032 |
| 866 | 93.9554 | 134.9967 | 3.4537 | 153.3918 | 51.8187 |
| 21801 | 93.8380 | 191.6767 | 15.4484 | 123.6261 | 34.0362 |
| 17567 | 93.8380 | 3525.4800 | 123.2339 | 2651.1500 | 680.0792 |
| 16854 | 93.7793 | 319.1133 | 57.9018 | 219.6170 | 48.0453 |
| 16954 | 93.7793 | 370.9233 | 83.2084 | 146.8564 | 103.1233 |
| 15201 | 93.7793 | 5815.3133 | 477.6845 | 3894.4377 | 1046.7459 |
| 4367 | 93.7793 | 204.9267 | 8.9437 | 141.6465 | 40.6253 |
| 12028 | 93.7793 | 49.4700 | 1.1755 | 46.6192 | 16.3143 |
| 16227 | 93.7207 | 70.0967 | 2.3502 | 101.8044 | 39.4352 |
| 20695 | 93.7207 | −6.0133 | 3.7412 | 20.6149 | 20.3327 |
| 18620 | 93.7207 | 2404.8433 | 90.1524 | 1932.3292 | 397.3328 |
| 18819 | 93.7207 | −2.8767 | 5.7836 | 32.8421 | 25.3108 |
| 17304 | 93.6620 | 31.8733 | 2.1652 | 63.3074 | 37.3465 |
| 15852 | 93.6033 | 29.7967 | 54.8746 | 43.3783 | 24.3296 |
| 18606 | 93.6033 | 3219.5033 | 260.8873 | 2178.2932 | 573.9259 |
| 20945 | 93.6033 | 2433.2167 | 79.4629 | 1945.7740 | 458.7310 |
| 11745 | 93.6033 | 141.8400 | 7.0045 | 158.1448 | 54.9707 |
| 3562 | 93.6033 | 27.9300 | 3.0350 | 15.2644 | 11.6695 |
| 18859 | 93.5446 | 10.2900 | 2.8451 | 31.1420 | 17.1224 |
| 2576 | 93.4859 | 74.1533 | 10.3196 | 31.9732 | 29.2644 |
| 19073 | 93.4859 | 549.4733 | 13.3865 | 461.9069 | 101.6744 |
| 19244 | 93.4272 | 4182.0933 | 229.5170 | 3021.4368 | 759.7564 |
| 16918 | 93.3685 | 4869.0933 | 777.2367 | 3016.0994 | 881.6780 |
| 15875 | 93.3099 | 3896.4733 | 394.7816 | 2581.7349 | 691.5708 |
| 15652 | 93.3099 | 3989.0633 | 185.0531 | 3098.3777 | 572.9614 |
| 18628 | 93.3099 | 3756.7067 | 159.9940 | 2827.1704 | 653.3981 |
| 17533 | 93.2512 | 33.0200 | 5.0851 | 99.5282 | 70.9172 |
| 20309 | 93.2512 | 34.9267 | 0.9880 | 42.2956 | 19.0703 |
| 17142 | 93.2512 | 842.4767 | 26.1264 | 759.9782 | 310.9947 |
| 7211 | 99.7066 | 24.3233 | 0.4735 | −5.5183 | 13.2906 |
| 14518 | 99.7066 | 538.5400 | 2.0528 | 268.7477 | 151.2513 |
| 23747 | 99.5305 | 85.3833 | 0.5742 | 18.8980 | 55.7292 |
| 16484 | 99.3545 | 58.8100 | 2.4800 | 142.7366 | 42.6873 |
| 23504 | 99.3545 | 829.5800 | 10.2110 | 541.9403 | 142.7596 |
| 21563 | 99.2371 | 161.0300 | 0.6991 | 232.8309 | 49.4632 |
| 4896 | 99.0023 | 933.4233 | 4.2383 | 1234.8624 | 238.3889 |
| 8616 | 98.8850 | 3.3533 | 0.4907 | 24.1509 | 14.6335 |
| 26078 | 98.7676 | 140.7667 | 2.3691 | 70.1809 | 71.2447 |
| 4077 | 98.5915 | 1.6400 | 1.7722 | 41.7971 | 26.4811 |
| 11928 | 98.5915 | 33.2433 | 0.8376 | 1.4806 | 37.2959 |
| 6207 | 98.4742 | 360.6367 | 1.8054 | 319.9769 | 84.1822 |
| 3613 | 98.4155 | 25.1500 | 0.7662 | −16.5326 | 34.3566 |
| 10173 | 98.2981 | 106.3033 | 3.5247 | 63.8721 | 20.1758 |

TABLE 5HH-continued

IPS
Timepoint(s): 24 hrs

| GLGC ID NO. | LDA Score | Mean Tox | SD Tox | Mean Nontox | SD Nontox |
|---|---|---|---|---|---|
| 22368 | 98.2981 | 459.7200 | 18.2593 | 881.4000 | 299.1864 |
| 8219 | 98.2394 | −9.5133 | 0.9949 | 29.4157 | 32.4008 |
| 14313 | 98.1808 | 25.4500 | 0.9052 | 29.8080 | 44.1420 |
| 6446 | 98.0634 | 162.8033 | 1.5253 | 150.3929 | 67.1448 |
| 5346 | 98.0634 | 162.5967 | 0.9652 | 131.8170 | 40.9038 |
| 22254 | 98.0634 | 31.2167 | 1.1402 | 65.9781 | 33.3147 |
| 8720 | 98.0047 | 47.5833 | 1.1232 | 88.6013 | 38.8806 |
| 6526 | 97.9460 | 656.7200 | 5.7857 | 510.1745 | 100.3921 |
| 10842 | 97.9460 | 31.9600 | 6.3793 | 4.6294 | 10.9717 |
| 5433 | 97.9460 | 36.7000 | 2.3091 | 87.8460 | 50.8050 |
| 16187 | 97.8873 | 230.5233 | 2.9827 | 251.3711 | 102.9532 |
| 18659 | 97.8873 | 82.1200 | 1.2619 | 140.0303 | 68.4744 |
| 24174 | 97.7700 | 10.8100 | 0.9457 | 36.3313 | 21.3655 |
| 2140 | 97.7113 | 6.7500 | 1.1101 | 51.6127 | 64.3148 |
| 22656 | 97.7113 | 161.5300 | 3.0362 | 94.2208 | 56.2978 |
| 3054 | 97.7113 | 97.7700 | 3.0694 | 53.8884 | 30.0460 |
| 2044 | 97.6526 | 220.7733 | 2.2076 | 272.8567 | 54.4099 |
| 4747 | 97.6526 | 47.0100 | 2.3012 | 99.1815 | 41.0463 |
| 22748 | 97.6526 | 84.0000 | 1.1107 | 106.0991 | 22.9850 |
| 19127 | 97.4765 | 247.7700 | 1.7206 | 306.2968 | 90.3996 |
| 22130 | 97.3592 | 14.3800 | 1.0411 | 42.2758 | 26.3817 |
| 21260 | 97.3005 | 191.8767 | 7.1515 | 309.0015 | 124.2285 |
| 6946 | 97.3005 | 138.4533 | 4.7174 | 247.5709 | 72.7852 |
| 23750 | 97.3005 | 15.2533 | 2.8572 | 65.0670 | 39.7598 |
| 8717 | 97.2418 | 1016.1067 | 7.6671 | 982.1344 | 301.8535 |
| 17955 | 97.2418 | 237.7867 | 2.5193 | 251.2719 | 95.7317 |
| 6972 | 97.2418 | 12.6600 | 0.5429 | 25.8890 | 13.7536 |
| 13674 | 97.2418 | 42.6800 | 0.3816 | 52.6485 | 23.4672 |
| 11031 | 97.1244 | 37.1267 | 1.2689 | 13.8928 | 19.3790 |
| 23104 | 97.1244 | −10.3967 | 3.4685 | 38.0930 | 41.3523 |
| 11659 | 97.1244 | 60.5633 | 2.9037 | 22.1559 | 36.6782 |
| 18574 | 97.1244 | 295.9533 | 1.3518 | 278.7570 | 52.1432 |
| 23386 | 97.1244 | 414.8733 | 5.9494 | 594.2249 | 187.9959 |
| 13892 | 97.0657 | 348.1233 | 6.8555 | 473.0480 | 128.8040 |
| 18805 | 97.0657 | 897.6767 | 197.0461 | 455.5105 | 118.6916 |
| 21528 | 97.0657 | 246.1800 | 5.4895 | 187.2260 | 48.2494 |
| 10318 | 97.0657 | 25.4367 | 1.6437 | −1.5739 | 27.6959 |
| 12310 | 97.0070 | 538.6900 | 5.0474 | 446.0799 | 130.7488 |
| 22337 | 97.0070 | 49.2600 | 9.4517 | −30.8655 | 43.7218 |
| 9384 | 96.9484 | 0.3300 | 1.9751 | 32.0059 | 24.7386 |
| 24167 | 96.9484 | 18.4367 | 1.0957 | 33.8878 | 18.6135 |
| 5810 | 96.9484 | 26.5967 | 2.9017 | 5.0324 | 17.4799 |
| 11088 | 96.8897 | 92.7500 | 7.5068 | 43.8994 | 22.4434 |
| 13426 | 96.8310 | 775.3400 | 9.5616 | 617.5610 | 154.1059 |
| 2355 | 96.8310 | 386.0800 | 2.4916 | 388.4531 | 91.5583 |
| 6791 | 96.7723 | 366.3067 | 12.9650 | 669.6902 | 345.2565 |
| 22148 | 96.7136 | 29.2433 | 4.3221 | 4.0651 | 15.6231 |
| 6873 | 96.7136 | 57.1067 | 1.2758 | 44.2189 | 42.1939 |
| 11834 | 96.6549 | 28.9900 | 5.9899 | −0.6306 | 11.8896 |
| 17451 | 96.6549 | 160.0167 | 1.9342 | 133.3811 | 33.0696 |
| 7664 | 96.6549 | 22.5567 | 0.6714 | 15.4585 | 14.7729 |
| 17568 | 96.6549 | 128.3100 | 3.3226 | 88.0107 | 60.4400 |
| 14960 | 96.5962 | 4278.3667 | 47.3248 | 3794.6913 | 1055.1968 |
| 5527 | 96.5962 | 105.6400 | 1.5125 | 96.8612 | 42.9351 |
| 26187 | 96.5962 | 522.6733 | 39.6652 | 256.4143 | 135.8406 |
| 18465 | 96.5376 | 199.7400 | 5.6448 | 237.9064 | 119.8761 |
| 15377 | 96.4789 | 21.5800 | 2.3377 | 52.1270 | 23.1634 |
| 7748 | 96.4789 | −3.4333 | 6.7099 | 41.3526 | 21.7749 |
| 4442 | 96.4202 | 8597.5767 | 228.9571 | 5902.2308 | 1976.9768 |
| 6496 | 96.4202 | 66.1733 | 2.8540 | 123.0224 | 45.1062 |
| 17248 | 96.3615 | 1855.8367 | 16.6825 | 2129.0783 | 445.4304 |
| 17699 | 96.3028 | 84.1967 | 1.0374 | 77.1096 | 35.7062 |
| 16921 | 96.2441 | 0.5833 | 2.8140 | 52.6056 | 59.6934 |
| 23953 | 96.2441 | 38.4333 | 19.7319 | 8.7860 | 10.1310 |
| 7917 | 96.2441 | 22.7067 | 1.4969 | 41.6220 | 18.0414 |
| 23990 | 96.1854 | 168.7600 | 17.7739 | 65.2763 | 53.5149 |
| 6857 | 96.1268 | 26.8233 | 0.6413 | 12.8269 | 85.4249 |
| 12798 | 96.1268 | 20.1333 | 2.2181 | 1.4870 | 15.3054 |

TABLE 5II

METHOTREXATE
Timepoint(s): 24 hrs

| GLGC ID NO. | LDA Score | Mean Tox | SD Tox | Mean Nontox | SD Nontox |
|---|---|---|---|---|---|
| 643 | 98.7074 | 43.9825 | 7.0395 | 13.9907 | 24.5127 |
| 20944 | 98.1199 | 1452.3175 | 7.9371 | 1254.4859 | 274.5334 |
| 24351 | 98.1199 | 99.2900 | 27.9576 | 15.8629 | 16.7960 |
| 4477 | 97.7086 | 283.5075 | 56.9869 | 100.0627 | 43.4432 |
| 25643 | 97.4148 | 1320.2575 | 282.2911 | 543.0042 | 202.3403 |
| 16546 | 97.2973 | 209.0600 | 25.8406 | 97.6569 | 62.9828 |
| 13646 | 97.1210 | 2414.6175 | 188.9322 | 1615.9787 | 282.9816 |
| 23 | 97.0035 | 25.5750 | 2.8505 | 2.6229 | 10.9261 |
| 19825 | 96.8860 | 259.0375 | 57.8625 | 71.7435 | 54.0759 |
| 15680 | 96.7098 | 273.8575 | 6.1922 | 381.0013 | 78.6346 |
| 22927 | 96.2985 | 80.6800 | 2.7407 | 49.9837 | 20.6109 |
| 18770 | 96.1222 | 1048.2350 | 23.5202 | 815.4359 | 198.3582 |
| 17148 | 96.0635 | 1515.3775 | 58.0015 | 2121.9175 | 1202.8012 |
| 15185 | 95.9459 | 52.7500 | 8.5743 | 10.8489 | 20.7831 |
| 23476 | 95.5934 | 80.0800 | 9.4122 | 37.6997 | 20.2448 |
| 588 | 95.5347 | 603.0625 | 160.4995 | 292.8663 | 123.4761 |
| 20971 | 95.1234 | 168.7625 | 27.7016 | 97.9652 | 31.4898 |
| 18498 | 95.0646 | 362.4950 | 48.8014 | 237.9669 | 55.3153 |
| 1894 | 95.0646 | 152.7775 | 70.7713 | 43.3173 | 33.9542 |
| 18293 | 95.0646 | 1173.7925 | 191.4276 | 650.7958 | 376.4664 |
| 23606 | 94.9471 | 1288.4300 | 61.0481 | 707.0604 | 307.5750 |
| 1452 | 94.8884 | 43.8050 | 2.4811 | 22.0579 | 23.9498 |
| 15247 | 94.8296 | 185.8475 | 40.0699 | 86.9354 | 67.3857 |
| 17038 | 94.6533 | 66.3425 | 1.0742 | 59.4068 | 22.5247 |
| 15070 | 94.6533 | 383.4025 | 28.4470 | 233.9208 | 113.1518 |
| 6186 | 94.5946 | 16.0100 | 2.4790 | 38.2356 | 15.6908 |
| 15617 | 94.4771 | 400.4675 | 51.6396 | 201.6870 | 88.7584 |
| 18880 | 94.4771 | 27.1700 | 0.7835 | 38.3344 | 14.6592 |
| 18819 | 94.4771 | 13.1125 | 1.5058 | 32.8089 | 25.3797 |
| 5082 | 94.4771 | 15.8325 | 1.8449 | 38.3230 | 21.7301 |
| 15065 | 94.4771 | 1961.4525 | 86.8331 | 1532.0825 | 235.0390 |
| 17147 | 94.4771 | 1412.1600 | 84.0696 | 1707.8871 | 972.5256 |
| 5545 | 94.3596 | 795.6750 | 61.2153 | 541.0846 | 273.6306 |
| 14495 | 94.2421 | 296.0575 | 46.8945 | 141.6292 | 75.5057 |
| 17405 | 94.2421 | 227.2500 | 23.4433 | 151.0875 | 34.9581 |
| 22918 | 94.2421 | 281.1625 | 26.4957 | 181.7123 | 65.5175 |
| 15462 | 94.1833 | 257.1725 | 24.1116 | 154.9751 | 51.8824 |
| 15613 | 94.1833 | 846.3575 | 67.1071 | 674.9760 | 518.1259 |
| 16085 | 93.9483 | 151.4400 | 10.9074 | 97.0474 | 51.1449 |
| 20816 | 93.8895 | 1666.0425 | 205.6872 | 848.6562 | 391.0413 |
| 15409 | 93.8308 | 389.8400 | 102.0706 | 200.4241 | 126.0301 |
| 25090 | 93.8308 | 303.4975 | 51.9820 | 174.2674 | 116.4047 |
| 20494 | 93.8308 | 346.1925 | 25.6480 | 193.1211 | 182.9982 |
| 24414 | 93.8308 | 127.9050 | 5.5826 | 186.7428 | 60.7967 |
| 19679 | 93.8308 | 123.2850 | 12.7115 | 73.8356 | 49.4282 |
| 13647 | 93.7720 | 3110.3900 | 292.9675 | 2116.8030 | 494.8018 |
| 7602 | 93.7720 | 503.1075 | 68.6070 | 350.0570 | 100.1551 |
| 10625 | 93.7720 | 68.4375 | 5.5900 | 88.9577 | 102.5892 |
| 20082 | 93.6545 | 258.3075 | 20.2642 | 456.3180 | 167.2140 |
| 20626 | 93.5958 | 25.4950 | 2.8334 | 212.3910 | 258.7079 |
| 900 | 93.5958 | 81.8300 | 1.4305 | 103.0382 | 46.2318 |
| 7176 | 93.5958 | 249.6175 | 8.8826 | 306.3545 | 134.8480 |
| 10744 | 93.5370 | 26.2825 | 1.3941 | 52.5943 | 48.3760 |
| 322 | 93.5370 | 54.0900 | 5.1645 | 169.2000 | 179.7712 |
| 16929 | 93.5370 | 2494.2550 | 93.0786 | 1977.7266 | 399.3377 |
| 21066 | 93.5370 | 226.9925 | 8.5547 | 185.0588 | 44.3376 |
| 20506 | 93.4783 | 8.8925 | 1.6305 | 22.0405 | 11.6196 |
| 14924 | 93.4195 | 89.9875 | 3.1669 | 100.7847 | 40.5684 |
| 24230 | 93.3608 | 33.2700 | 1.1967 | 50.5807 | 22.5714 |
| 1949 | 93.3608 | 41.7675 | 3.1001 | 78.9844 | 38.2777 |
| 25278 | 93.3608 | 18.8975 | 3.7631 | 41.2576 | 16.9317 |
| 23884 | 93.3608 | 312.1475 | 18.0190 | 227.6588 | 122.2230 |
| 20752 | 93.3608 | 25.8000 | 1.6951 | 44.4663 | 23.2110 |
| 235 | 93.3020 | 159.7975 | 3.7628 | 218.4270 | 85.6380 |
| 15190 | 93.1257 | 4878.0975 | 257.9775 | 3996.1034 | 1991.4783 |
| 22816 | 93.1257 | 89.7275 | 4.1383 | 83.0229 | 46.3391 |
| 17806 | 93.0670 | 15.7625 | 1.2494 | 38.0751 | 24.0211 |
| 3454 | 93.0670 | 455.4000 | 122.3485 | 225.6620 | 110.1268 |
| 9125 | 93.0082 | 1099.4400 | 142.0536 | 778.9801 | 160.2297 |
| 5622 | 93.0082 | 1975.6775 | 148.1399 | 1314.6977 | 443.8772 |
| 16446 | 92.8907 | 31.7450 | 0.9219 | 21.7796 | 17.9094 |
| 20256 | 92.7732 | 15.1800 | 12.3642 | 51.1496 | 20.3824 |
| 1522 | 92.7732 | 263.4025 | 28.7757 | 133.6994 | 79.9112 |

TABLE 5II-continued

METHOTREXATE
Timepoint(s): 24 hrs

| GLGC ID NO. | LDA Score | Mean Tox | SD Tox | Mean Nontox | SD Nontox |
|---|---|---|---|---|---|
| 16006 | 92.7145 | 269.2175 | 43.0871 | 152.4622 | 61.8644 |
| 4749 | 92.7145 | 1135.2200 | 181.0063 | 702.0827 | 504.7945 |
| 19108 | 92.6557 | 14.7425 | 0.8058 | 33.2413 | 30.3907 |
| 18373 | 92.5969 | 195.6175 | 4.3006 | 170.5967 | 47.4867 |
| 1962 | 92.5969 | 233.6450 | 6.0973 | 211.2093 | 71.3165 |
| 683 | 92.5382 | 21.0650 | 0.9674 | 28.5274 | 19.1235 |
| 4500 | 92.5382 | 38.2050 | 1.6964 | 34.4284 | 25.9024 |
| 17516 | 92.5382 | 166.1125 | 6.2496 | 136.3439 | 61.1737 |
| 25628 | 92.4794 | 9.9300 | 0.9491 | 22.1675 | 24.9067 |
| 17101 | 92.4794 | 704.7825 | 53.2664 | 456.4563 | 164.7814 |
| 11239 | 92.4207 | 37.1925 | 5.2667 | 66.2386 | 20.9728 |
| 18719 | 92.4207 | 284.2675 | 42.8976 | 128.7070 | 94.2701 |
| 21039 | 92.4207 | 225.3675 | 12.8997 | 189.2275 | 102.7062 |
| 9124 | 92.3619 | 759.3625 | 82.4816 | 516.5759 | 132.6683 |
| 24831 | 92.3619 | 3.2925 | 4.4105 | 26.2438 | 18.1914 |
| 8149 | 92.3619 | 26.6800 | 2.2212 | 8.2802 | 22.3771 |
| 16510 | 92.3032 | 97.7275 | 5.3012 | 173.6416 | 80.4808 |
| 243 | 92.3032 | 30.5325 | 7.3067 | 10.4220 | 11.6372 |
| 4574 | 92.2444 | 507.5450 | 51.3001 | 325.4974 | 128.4550 |
| 16178 | 92.2444 | 227.7225 | 4.5155 | 215.2447 | 51.1290 |
| 10499 | 92.2444 | 24.3500 | 1.8310 | 34.6916 | 22.6256 |
| 23142 | 92.2444 | 20.0875 | 0.7782 | 20.5815 | 13.4998 |
| 20254 | 92.2444 | 23.9575 | 0.7647 | 23.5902 | 12.5602 |
| 15715 | 92.1857 | 20.4775 | 1.8725 | 40.2691 | 23.3488 |
| 11827 | 92.1857 | 23.3175 | 1.5111 | 39.0067 | 15.3476 |
| 1349 | 92.1269 | 0.1625 | 11.3661 | 26.2791 | 13.9915 |
| 446 | 92.1269 | 19.0450 | 8.9604 | 75.7350 | 40.4414 |
| 4478 | 99.4125 | 253.3550 | 33.7523 | 39.3299 | 46.6318 |
| 16170 | 99.2949 | 622.9800 | 145.5328 | 84.1214 | 44.0348 |
| 15490 | 99.2949 | 105.4150 | 1.1279 | 183.8671 | 52.0361 |
| 19623 | 98.8249 | 388.2475 | 95.6089 | 97.2484 | 49.9334 |
| 4479 | 98.5899 | 3930.2175 | 369.4428 | 1505.0518 | 614.8657 |
| 9859 | 98.4136 | 81.5200 | 7.3761 | 34.0130 | 18.9532 |
| 11251 | 98.2961 | 38.4000 | 1.1192 | 72.6993 | 40.1008 |
| 16200 | 98.2374 | 233.3625 | 51.0417 | 89.3401 | 34.7569 |
| 7256 | 98.1786 | 138.8175 | 4.6945 | 211.4434 | 43.9867 |
| 6692 | 97.9436 | 256.3525 | 2.6133 | 369.6612 | 122.6341 |
| 2175 | 97.9436 | 167.5000 | 2.6452 | 230.3706 | 52.2801 |
| 4145 | 97.8848 | 3242.4150 | 72.1777 | 2172.0107 | 575.1020 |
| 8675 | 97.8848 | 87.7075 | 34.6030 | 26.6188 | 15.9094 |
| 2423 | 97.7086 | 68.4975 | 6.0140 | 142.3865 | 37.7050 |
| 19004 | 97.6498 | 100.3000 | 17.0370 | 28.7777 | 24.2586 |
| 3458 | 97.4736 | 2086.8775 | 142.2480 | 1322.9845 | 288.7572 |
| 7357 | 97.1798 | 210.6100 | 20.0974 | 87.1841 | 65.9154 |
| 14664 | 97.1210 | 698.4950 | 78.6754 | 340.0358 | 112.8105 |
| 17358 | 97.1210 | 673.4550 | 19.4221 | 491.8627 | 215.0951 |
| 6609 | 97.1210 | 2160.1400 | 689.1251 | 1051.0102 | 264.6512 |
| 2702 | 97.1210 | 1074.0975 | 22.2284 | 820.2170 | 298.6323 |
| 2131 | 97.0623 | 137.6400 | 1.9228 | 106.1079 | 30.9712 |
| 5778 | 97.0623 | 59.8250 | 19.9205 | −2.2473 | 22.2939 |
| 16788 | 97.0035 | 2.5875 | 2.9285 | 27.2398 | 20.8848 |
| 9180 | 97.0035 | 105.7525 | 8.6576 | 224.3777 | 71.0851 |
| 14963 | 97.0035 | 961.6650 | 99.0968 | 609.5110 | 124.9709 |
| 4903 | 97.0035 | 151.0125 | 3.2735 | 102.0087 | 76.3451 |
| 12591 | 97.0035 | 142.5475 | 23.9319 | 52.5554 | 38.1639 |
| 5331 | 96.9448 | 514.3025 | 28.4177 | 355.5425 | 66.0558 |
| 10659 | 96.9448 | 64.3325 | 8.7835 | 211.3114 | 122.0529 |
| 2860 | 96.9448 | 75.9725 | 1.9214 | 45.8183 | 36.1359 |
| 4978 | 96.8860 | 142.0250 | 5.6075 | 110.8151 | 76.9979 |
| 14458 | 96.8273 | 1110.3025 | 228.2936 | 335.9479 | 235.9479 |
| 21744 | 96.8273 | 116.8225 | 11.0365 | 54.4326 | 46.1965 |
| 8709 | 96.7685 | 227.8850 | 2.7725 | 197.8782 | 63.4392 |
| 5141 | 96.7685 | 498.8500 | 52.3600 | 235.3173 | 218.4001 |
| 23768 | 96.7098 | 512.6650 | 33.5774 | 255.4822 | 100.1498 |
| 17673 | 96.6510 | 48.3725 | 0.9239 | 68.1339 | 32.5216 |
| 13020 | 96.6510 | 35.2575 | 3.3009 | 82.5663 | 46.2626 |
| 19274 | 96.5922 | 88.6000 | 1.6626 | 88.6161 | 41.5406 |
| 4490 | 96.5922 | 466.8325 | 34.6372 | 261.4696 | 88.7176 |
| 4511 | 96.5922 | 146.4175 | 1.8578 | 168.0691 | 52.6716 |
| 11050 | 96.5335 | 1962.9600 | 42.6975 | 1448.8893 | 344.8602 |
| 2813 | 96.4747 | 929.5275 | 43.1944 | 539.8080 | 207.7774 |
| 8656 | 96.4747 | 0.5800 | 1.8501 | 27.6007 | 22.6679 |
| 21253 | 96.4160 | 237.4450 | 1.8376 | 262.4011 | 76.7061 |
| 6321 | 96.2985 | 1435.1850 | 105.4879 | 864.2324 | 251.4640 |
| 16405 | 96.2985 | 326.9850 | 34.5820 | 100.6520 | 105.6468 |
| 18650 | 96.2397 | 2699.5475 | 120.7457 | 1811.3960 | 939.4109 |
| 3814 | 96.2397 | 327.5850 | 14.6617 | 538.8142 | 178.9819 |
| 1900 | 96.1810 | 264.6625 | 101.3604 | 52.4651 | 59.3353 |
| 18547 | 96.1810 | 20.7975 | 3.3042 | −23.5748 | 44.3695 |
| 3860 | 96.1222 | 461.9950 | 15.0908 | 310.3824 | 134.2913 |
| 15085 | 96.0635 | 1734.6925 | 151.9368 | 1013.2154 | 335.5037 |
| 23270 | 96.0635 | 1746.4625 | 394.0203 | 866.7104 | 275.8191 |
| 5870 | 96.0635 | 49.6425 | 1.6905 | 84.5613 | 41.6240 |
| 17297 | 96.0047 | 1183.9300 | 79.6871 | 836.9459 | 164.3416 |
| 23989 | 96.0047 | 536.6950 | 24.8387 | 328.6852 | 156.6940 |
| 6508 | 96.0047 | 1309.2450 | 126.3835 | 806.7096 | 209.2004 |
| 5110 | 95.9459 | 447.8775 | 64.3858 | 259.6879 | 70.8334 |
| 14527 | 95.9459 | 311.2150 | 17.0761 | 163.3598 | 86.7028 |
| 22490 | 95.9459 | 1233.0175 | 41.7023 | 930.9652 | 171.4620 |
| 17871 | 95.8284 | 94.1975 | 3.2028 | 151.7754 | 55.6268 |
| 2326 | 95.8284 | 267.8525 | 53.3661 | 114.1202 | 61.4368 |
| 16458 | 95.8284 | 544.4925 | 30.7026 | 881.2658 | 240.8147 |
| 21200 | 95.7697 | 83.7975 | 25.3783 | 31.0232 | 27.7236 |
| 21341 | 95.7697 | 299.8425 | 22.6253 | 179.6793 | 153.2591 |
| 17221 | 95.7109 | 914.3700 | 176.8225 | 306.6860 | 240.0347 |
| 13098 | 95.7109 | 416.1925 | 74.5825 | 189.4046 | 94.6685 |
| 10535 | 95.7109 | 126.8375 | 8.2040 | 56.9928 | 42.3105 |
| 3087 | 95.7109 | 22.7400 | 2.3631 | −0.4132 | 25.4431 |
| 5556 | 95.5934 | 117.3775 | 6.0059 | 212.3910 | 101.0605 |
| 8584 | 95.5347 | 95.3525 | 10.6951 | 286.5994 | 213.9990 |
| 6420 | 95.4172 | 26.2325 | 3.6621 | 52.4480 | 18.9841 |
| 14459 | 95.4172 | 5073.1175 | 345.0341 | 3213.2884 | 1561.8458 |
| 12164 | 95.4172 | 145.1750 | 41.0850 | 54.8388 | 40.8187 |
| 2841 | 95.3584 | 209.4400 | 57.3285 | 76.9743 | 62.3557 |
| 7415 | 95.2996 | 36.8800 | 1.6405 | 64.3555 | 27.1996 |
| 20102 | 95.2996 | 532.5725 | 52.7588 | 289.1738 | 108.3973 |
| 2699 | 95.2996 | 179.2000 | 5.7969 | 113.1428 | 49.4064 |
| 21947 | 95.2996 | 105.2000 | 3.9145 | 158.2160 | 49.0972 |
| 1957 | 95.2409 | 590.3575 | 97.5197 | 259.9034 | 160.4302 |
| 1587 | 95.1821 | 49.9900 | 5.3774 | 116.5100 | 52.7200 |
| 21568 | 95.1821 | 157.6500 | 5.1840 | 100.9895 | 61.0855 |

TABLE 5JJ

Lovastatin
Timepoint(s): 24 hrs

| GLGC ID NO. | LDA Score | Mean Tox | SD Tox | Mean Nontox | SD Nontox |
|---|---|---|---|---|---|
| 20927 | 99.8826 | 418.4033 | 2.5815 | 113.3893 | 53.0130 |
| 400 | 99.6479 | 211.8333 | 59.8192 | 28.1289 | 27.8925 |
| 21743 | 99.5892 | 53.2567 | 0.9908 | 25.1074 | 11.6496 |
| 21842 | 99.4131 | 1759.2967 | 158.2677 | 476.5565 | 251.2509 |
| 25235 | 99.4131 | 8.2833 | 0.3325 | 26.5078 | 13.8735 |
| 16449 | 99.3545 | 967.5500 | 169.6212 | 162.2961 | 127.1987 |
| 20600 | 99.2958 | 1354.7867 | 227.2991 | 208.2581 | 179.7589 |
| 20930 | 99.2371 | 439.7533 | 117.3833 | 66.1404 | 82.2614 |
| 16681 | 99.1784 | 758.1467 | 45.5046 | 206.6474 | 114.3653 |
| 14213 | 99.0610 | 29.1733 | 0.2723 | 2.4658 | 26.2495 |
| 10184 | 99.0023 | 180.5267 | 26.1860 | 46.9239 | 28.5379 |
| 19073 | 99.0023 | 880.9800 | 76.9139 | 460.7396 | 98.6445 |
| 20856 | 98.8850 | 42.3233 | 5.4905 | 10.7732 | 34.0516 |
| 18958 | 98.8263 | 127.8733 | 2.0078 | 87.0267 | 69.6744 |
| 1403 | 98.7676 | 73.2267 | 1.7790 | 28.9256 | 19.9918 |
| 301 | 98.7676 | 192.3867 | 14.2719 | 69.9240 | 30.0087 |
| 20601 | 98.6502 | 1772.6733 | 342.2460 | 375.7806 | 292.3960 |
| 16043 | 98.5915 | 91.6933 | 0.9266 | 149.7053 | 46.1791 |
| 7228 | 98.5915 | 40.6633 | 1.1014 | 18.8916 | 11.2096 |
| 12082 | 98.5915 | 312.7633 | 22.0812 | 151.1902 | 100.0322 |
| 1794 | 98.5329 | 4422.3000 | 900.1011 | 824.2779 | 743.0357 |
| 17079 | 98.5329 | 1401.9400 | 19.0636 | 969.6651 | 210.5228 |
| 16795 | 98.5329 | 24.3567 | 0.2371 | 17.5994 | 5.4072 |

TABLE 5JJ-continued

Lovastatin
Timepoint(s): 24 hrs

| GLGC ID NO. | LDA Score | Mean Tox | SD Tox | Mean Nontox | SD Nontox |
|---|---|---|---|---|---|
| 302 | 98.4155 | 47.9633 | 8.7480 | −2.7688 | 15.4036 |
| 16450 | 98.3568 | 454.0367 | 86.6079 | 150.8375 | 61.5897 |
| 23324 | 98.2981 | 277.1233 | 27.6730 | 44.4673 | 61.9610 |
| 1793 | 98.2981 | 1782.6100 | 448.0249 | 341.0809 | 331.6712 |
| 672 | 98.2981 | 65.3800 | 2.7670 | 20.8450 | 24.5092 |
| 17270 | 98.2394 | 48.6933 | 10.3132 | 190.2869 | 73.2420 |
| 25799 | 98.1221 | 734.5333 | 81.4099 | 211.2542 | 138.0236 |
| 15069 | 98.1221 | 2045.6033 | 190.3191 | 760.8230 | 340.3016 |
| 16180 | 98.1221 | 36.4200 | 1.8173 | 94.9863 | 43.1139 |
| 25460 | 98.0634 | 2955.3233 | 692.7500 | 862.0108 | 434.6490 |
| 53 | 98.0047 | 19.5933 | 2.1781 | 69.7856 | 44.2971 |
| 303 | 97.9460 | 104.9033 | 18.7208 | 31.6969 | 18.4756 |
| 10185 | 97.8286 | 82.4767 | 17.4274 | 27.8049 | 15.7228 |
| 18578 | 97.7113 | 546.3033 | 151.1919 | 135.9693 | 99.2602 |
| 1797 | 97.7113 | 1637.3700 | 149.4107 | 582.4666 | 479.5996 |
| 16148 | 97.7113 | 823.1133 | 48.4926 | 486.1914 | 363.4403 |
| 1795 | 97.6526 | 563.1767 | 159.6419 | 176.7671 | 186.3559 |
| 21701 | 97.6526 | 111.8300 | 33.7092 | 25.1573 | 25.1701 |
| 16133 | 97.4765 | 31.9733 | 1.2007 | 14.3059 | 12.3841 |
| 21674 | 97.4765 | 113.3533 | 10.9405 | 54.8340 | 26.4143 |
| 1214 | 97.4178 | 7.6033 | 0.6086 | 33.6105 | 25.2006 |
| 11455 | 97.4178 | 81.8067 | 1.2506 | 126.0890 | 69.0474 |
| 12083 | 97.4178 | 219.1167 | 23.0824 | 104.4182 | 66.9390 |
| 25165 | 97.3592 | 52.2433 | 11.4294 | 6.3894 | 23.8171 |
| 17516 | 97.3005 | 318.4100 | 54.8440 | 135.8426 | 60.1494 |
| 15124 | 97.3005 | 2820.7000 | 123.4586 | 1895.2553 | 454.9416 |
| 20929 | 97.2418 | 42.1200 | 20.6125 | −24.4099 | 28.9264 |
| 3217 | 97.1831 | 117.4767 | 1.3717 | 150.8239 | 44.0102 |
| 15070 | 97.1831 | 575.0833 | 109.8727 | 233.4213 | 111.6120 |
| 15870 | 97.1244 | 50.9633 | 6.0391 | 2.6426 | 24.5808 |
| 24492 | 97.0657 | 27.6167 | 0.4428 | 48.6702 | 29.0322 |
| 18628 | 97.0657 | 2905.6700 | 26.6782 | 2830.1670 | 655.7460 |
| 18686 | 97.0070 | 1599.9800 | 327.6689 | 561.1464 | 481.2315 |
| 265 | 97.0070 | 8.2500 | 0.5524 | 20.9482 | 12.6321 |
| 18433 | 97.0070 | 166.9767 | 50.7015 | 40.5487 | 40.2194 |
| 15242 | 96.9484 | 117.1500 | 2.4419 | 83.4987 | 19.7194 |
| 21396 | 96.9484 | 61.8833 | 1.2133 | 80.9484 | 49.1660 |
| 20734 | 96.8897 | 1826.6667 | 202.6219 | 965.7175 | 334.8584 |
| 17078 | 96.8897 | 969.1133 | 99.4160 | 579.8697 | 136.9298 |
| 24008 | 96.7723 | 32.7000 | 2.0004 | 65.4352 | 21.9437 |
| 2801 | 96.6549 | 242.7300 | 22.7167 | 109.6117 | 62.1573 |
| 20851 | 96.6549 | 259.2733 | 89.7528 | 89.2108 | 66.1521 |
| 8269 | 96.5376 | 51.6733 | 7.0072 | 337.0788 | 372.2556 |
| 623 | 96.5376 | 10.7967 | 0.4148 | 23.5512 | 14.6994 |
| 2811 | 96.5376 | 353.7067 | 76.7939 | 165.3938 | 60.3210 |
| 1858 | 96.5376 | 158.5467 | 73.3101 | 43.6301 | 209.0738 |
| 1058 | 96.4202 | 545.9300 | 174.9288 | 179.7191 | 112.0260 |
| 16150 | 96.4202 | 556.4833 | 165.1654 | 255.2688 | 185.0642 |
| 22669 | 96.4202 | 25.6967 | 0.9322 | 18.2186 | 13.4535 |
| 17377 | 96.3615 | 295.5767 | 4.3769 | 231.2182 | 84.3403 |
| 17726 | 96.3028 | 11.5533 | 0.6490 | 28.1848 | 17.3781 |
| 9527 | 96.3028 | 10.1767 | 1.0719 | 27.5415 | 16.1037 |
| 14543 | 96.2441 | 93.3200 | 5.4317 | 41.7104 | 35.7218 |
| 25705 | 96.1854 | 2056.1833 | 18.1883 | 1879.5848 | 390.5156 |
| 15420 | 96.1854 | 79.1767 | 37.2290 | −2.7356 | 33.6705 |
| 14979 | 96.1268 | 13.4233 | 0.4652 | 22.1072 | 11.0482 |
| 25693 | 96.1268 | 93.2233 | 15.3193 | 38.6779 | 19.4919 |
| 19110 | 96.1268 | 237.8700 | 60.4025 | 101.2704 | 50.0630 |
| 18083 | 96.1268 | 134.1267 | 37.3043 | 44.7062 | 64.4987 |
| 668 | 96.0681 | 5.7067 | 1.1500 | 24.9866 | 15.4893 |
| 15311 | 96.0681 | 23.8733 | 2.1220 | 60.7624 | 33.8879 |
| 15316 | 96.0094 | 24.6267 | 0.5859 | 33.5688 | 8.6423 |
| 12347 | 95.8920 | 21.0867 | 2.8197 | 58.0368 | 32.7780 |
| 19864 | 95.8920 | 10.4567 | 1.1707 | 25.5307 | 13.2537 |
| 2143 | 95.8920 | 625.3467 | 115.3647 | 400.4284 | 82.2891 |
| 19997 | 95.8333 | 28.9500 | 3.4564 | 83.8980 | 42.4852 |
| 24470 | 95.8333 | 6131.1300 | 80.0810 | 5119.0356 | 1254.3877 |
| 11138 | 95.8333 | 146.2100 | 28.9443 | 390.9625 | 143.1250 |
| 1409 | 95.8333 | 187.5267 | 17.3800 | 115.4200 | 39.2139 |
| 15126 | 95.8333 | 3006.3167 | 226.3711 | 1884.8744 | 640.8967 |
| 15409 | 95.7746 | 430.7767 | 74.3179 | 200.5022 | 125.9771 |
| 24672 | 95.7160 | 33.0200 | 1.3444 | 56.2307 | 21.2694 |
| 900 | 95.7160 | 55.7767 | 3.6606 | 103.1051 | 46.1419 |
| 23340 | 95.7160 | 480.0833 | 165.5208 | 240.0502 | 72.8686 |
| 1463 | 95.6573 | 271.7433 | 12.1122 | 144.9562 | 85.3364 |
| 3381 | 95.6573 | 258.7900 | 23.8365 | 158.9408 | 39.6434 |
| 13282 | 95.6573 | 14.3400 | 2.6600 | 45.0552 | 23.2514 |
| 5275 | 99.5892 | 76.3900 | 0.0500 | 57.0412 | 25.4214 |
| 16451 | 99.5305 | 1327.3300 | 51.1486 | 473.3104 | 204.2199 |
| 21744 | 99.2371 | 279.5000 | 66.7646 | 53.9331 | 44.2836 |
| 7178 | 99.1784 | 39.1200 | 0.1609 | 44.1848 | 21.2908 |
| 23305 | 99.0610 | 164.2033 | 0.3700 | 149.5682 | 49.0753 |
| 13310 | 99.0023 | −11.1067 | 0.4761 | 35.4194 | 51.8867 |
| 7749 | 98.8850 | 2254.4967 | 3.5487 | 2077.7157 | 442.2286 |
| 3995 | 98.8850 | 229.0033 | 0.9393 | 265.2511 | 115.1490 |
| 23976 | 98.8850 | 252.8933 | 60.1101 | 55.4523 | 34.0821 |
| 21354 | 98.6502 | 1518.0500 | 194.2846 | 558.3923 | 524.3590 |
| 16452 | 98.3568 | 404.1033 | 94.8919 | 100.9331 | 57.3587 |
| 21742 | 98.3568 | 242.6400 | 91.6185 | 63.8324 | 33.3074 |
| 2733 | 98.3568 | 323.7967 | 1.1354 | 362.5797 | 101.6879 |
| 4738 | 98.2981 | 0.3300 | 0.4949 | 23.2273 | 33.7390 |
| 6946 | 98.2981 | 218.2333 | 1.4514 | 247.2899 | 73.0520 |
| 13661 | 98.2394 | 22.3400 | 5.1517 | −70.1548 | 58.4132 |
| 15467 | 98.2394 | 136.1867 | 34.3408 | 28.9510 | 27.4871 |
| 21490 | 98.2394 | 130.8967 | 0.4521 | 130.4203 | 35.6975 |
| 19412 | 98.1808 | 255.2533 | 1.2656 | 309.8956 | 83.1884 |
| 6218 | 98.0634 | 239.3033 | 11.7302 | 99.4843 | 93.9005 |
| 12769 | 98.0047 | 6.4900 | 0.9778 | 38.6290 | 40.3937 |
| 11339 | 97.9460 | 849.9000 | 253.3613 | 321.7828 | 117.3687 |
| 5836 | 97.8873 | 169.6200 | 2.6881 | 119.7898 | 44.8496 |
| 9162 | 97.8286 | 64.4600 | 0.4850 | 93.3089 | 44.3630 |
| 16921 | 97.8286 | 53.3000 | 1.1623 | 54.3200 | 59.7731 |
| 13642 | 97.8286 | 49.7233 | 4.0619 | 9.9944 | 19.4115 |
| 4271 | 97.8286 | 106.5567 | 15.1922 | 43.1284 | 52.8679 |
| 3145 | 97.8286 | 302.6600 | 14.4823 | 205.8981 | 73.8242 |
| 26368 | 97.7700 | 647.1667 | 277.0430 | 125.7676 | 113.1102 |
| 21256 | 97.7113 | 276.4833 | 36.4828 | 147.1130 | 38.4847 |
| 3284 | 97.5939 | 40.4167 | 0.6174 | 21.7506 | 34.6959 |
| 22070 | 97.5352 | 97.3767 | 23.9684 | 19.3904 | 27.8515 |
| 16814 | 97.5352 | 46.6633 | 0.8895 | 33.4532 | 27.3650 |
| 18154 | 97.5352 | 59.4500 | 1.4581 | 43.7136 | 32.4113 |
| 5436 | 97.4765 | 192.0667 | 4.1349 | 134.3838 | 33.9482 |
| 26109 | 97.4765 | 368.6667 | 96.0761 | 87.4173 | 168.9479 |
| 1846 | 97.4178 | 424.1500 | 5.4854 | 379.1411 | 128.0955 |
| 16477 | 97.3592 | 124.0867 | 1.3126 | 147.8176 | 47.8360 |
| 15015 | 97.3592 | 159.3833 | 1.4692 | 153.2373 | 48.8767 |
| 23805 | 97.3592 | 40.0467 | 1.2513 | 21.5554 | 40.3252 |
| 11887 | 97.3592 | −24.3400 | 5.2519 | 36.6269 | 33.6864 |
| 22975 | 97.3005 | 51.4800 | 0.6951 | 78.3204 | 39.4851 |
| 9404 | 97.2418 | 456.5833 | 101.9537 | 143.9889 | 81.9557 |
| 13055 | 97.2418 | 968.5733 | 300.4569 | 400.6792 | 160.2766 |
| 23662 | 97.1244 | 23.8900 | 0.5556 | 35.4516 | 20.4679 |
| 5895 | 97.1244 | 25.2300 | 0.5600 | 42.9689 | 34.6221 |
| 4171 | 97.1244 | 328.0800 | 4.7753 | 250.3335 | 54.2628 |
| 8344 | 97.1244 | 1195.5333 | 171.4617 | 479.2807 | 221.3820 |

TABLE 5KK

NECROSIS
Timepoint(s): Various

| GLGC ID NO. | LDA Score | Mean Tox | SD Tox | Mean Nontox | SD Nontox |
|---|---|---|---|---|---|
| 17920 | 80.0697 | 38.3436 | 9.0101 | 62.2006 | 23.4918 |
| 17075 | 77.4477 | 929.9793 | 188.1424 | 739.2324 | 155.8287 |
| 22124 | 77.2387 | 209.2132 | 66.9924 | 127.1095 | 55.0989 |
| 22352 | 76.9774 | 774.9868 | 320.5275 | 423.8816 | 209.1626 |
| 11455 | 76.6725 | 254.6658 | 125.1524 | 120.4483 | 59.7698 |
| 25370 | 76.2892 | 21.4781 | 18.3930 | 69.5996 | 48.7982 |
| 11454 | 75.9408 | 430.6366 | 181.5251 | 222.1117 | 91.7977 |
| 21062 | 75.9408 | 69.4435 | 32.0303 | 39.0280 | 19.3894 |
| 15011 | 74.9303 | 266.7018 | 80.5040 | 166.6836 | 56.4077 |

TABLE 5KK-continued

NECROSIS
Timepoint(s): Various

| GLGC ID NO. | LDA Score | Mean Tox | SD Tox | Mean Nontox | SD Nontox |
|---|---|---|---|---|---|
| 6980 | 74.9303 | 28.0729 | 12.3628 | 51.1270 | 20.6641 |
| 22351 | 74.8519 | 148.9433 | 84.9063 | 68.8754 | 32.4693 |
| 20649 | 74.7909 | 127.4411 | 74.3348 | 355.6391 | 315.3982 |
| 17269 | 74.5557 | 99.3490 | 26.2678 | 161.6115 | 62.5549 |
| 24351 | 74.3641 | 33.3740 | 15.4845 | 15.5224 | 17.5061 |
| 923 | 74.3118 | 337.8270 | 108.6251 | 187.5766 | 107.0027 |
| 22603 | 74.2770 | 54.7977 | 14.6347 | 91.7960 | 51.3270 |
| 15980 | 73.8240 | 18.5626 | 12.9912 | 24.4253 | 9.7292 |
| 904 | 73.7892 | 35.7691 | 14.4163 | 49.7555 | 12.7623 |
| 1928 | 73.6847 | 86.3779 | 35.9660 | 127.2356 | 39.4153 |
| 21709 | 73.6411 | 88.1469 | 26.6125 | 138.3089 | 58.1437 |
| 110 | 73.6063 | 129.5578 | 52.6346 | 236.7910 | 131.4242 |
| 1306 | 73.3885 | 236.1643 | 102.9236 | 148.5107 | 53.3042 |
| 21377 | 73.3449 | 94.3646 | 39.4146 | 146.1809 | 52.1614 |
| 12041 | 73.3101 | 325.4678 | 39.5950 | 286.7209 | 73.6771 |
| 1598 | 72.9965 | 641.3303 | 391.1521 | 266.6013 | 255.3939 |
| 20590 | 72.9791 | 367.9407 | 98.8018 | 258.0404 | 83.0054 |
| 14997 | 72.8833 | 266.4679 | 148.9493 | 475.8423 | 214.6599 |
| 7784 | 72.8484 | 21.1661 | 7.1694 | 34.6987 | 16.4081 |
| 24431 | 72.7787 | 801.7437 | 388.5459 | 386.6035 | 293.0287 |
| 24377 | 72.7352 | 122.4135 | 35.1097 | 163.9703 | 43.8338 |
| 15335 | 72.7265 | 1055.5643 | 220.0266 | 817.1732 | 223.2226 |
| 17115 | 72.6655 | 9.6915 | 11.2243 | 25.1383 | 17.3046 |
| 23486 | 72.6394 | 439.4203 | 83.8663 | 334.4661 | 90.9429 |
| 16721 | 72.4826 | 87.4051 | 21.2385 | 125.0433 | 49.0228 |
| 17921 | 72.3868 | 72.8541 | 21.8406 | 120.8407 | 66.6905 |
| 19712 | 72.3345 | 15.1474 | 9.2968 | 28.9964 | 16.9365 |
| 19790 | 72.2822 | 8.2864 | 13.0673 | 25.2252 | 17.3294 |
| 644 | 72.2038 | 25.5829 | 7.4067 | 36.9493 | 14.8267 |
| 108 | 72.1777 | 1113.4153 | 280.1024 | 1589.2162 | 618.0346 |
| 18396 | 72.1429 | 584.4188 | 172.0002 | 388.2735 | 198.9895 |
| 7266 | 72.1167 | 483.2693 | 120.1489 | 370.0215 | 111.6983 |
| 19952 | 72.1167 | 12.3256 | 8.6754 | 29.7371 | 23.9886 |
| 20996 | 72.1080 | 328.1281 | 82.0256 | 247.6915 | 90.1976 |
| 18043 | 72.0906 | 207.7032 | 73.6053 | 132.4898 | 77.7098 |
| 851 | 72.0906 | 125.9281 | 26.0197 | 178.0581 | 58.2422 |
| 22582 | 72.0035 | 46.3573 | 15.6996 | 82.4915 | 39.9133 |
| 17800 | 71.8815 | 72.2586 | 23.3348 | 97.3041 | 28.2168 |
| 16330 | 71.8467 | 124.4710 | 34.5870 | 181.0862 | 62.0100 |
| 23044 | 71.7596 | 89.7656 | 21.4423 | 122.9436 | 36.5296 |
| 15023 | 71.7073 | 273.4780 | 54.2338 | 364.0158 | 82.7244 |
| 353 | 71.6812 | 664.1139 | 330.9229 | 402.2658 | 238.4323 |
| 18393 | 71.6812 | 253.9495 | 74.3068 | 194.5012 | 45.1152 |
| 15996 | 71.6812 | 351.7576 | 132.3120 | 243.0037 | 154.3310 |
| 15642 | 71.6725 | 1360.6299 | 394.5207 | 914.1193 | 311.4168 |
| 12118 | 71.6202 | 79.4936 | 18.9150 | 123.0281 | 72.4727 |
| 9427 | 71.6115 | 14.1383 | 8.2399 | 21.0964 | 9.5689 |
| 17289 | 71.5418 | 41.8047 | 24.5556 | 69.2088 | 44.7394 |
| 15683 | 71.5331 | 110.0602 | 34.2438 | 77.4863 | 39.7467 |
| 15421 | 71.4895 | 337.5454 | 66.5270 | 423.6442 | 90.6590 |
| 14970 | 71.3850 | 40.5913 | 19.3083 | 59.8316 | 25.6275 |
| 20650 | 71.3240 | 297.5755 | 156.2199 | 617.9650 | 407.9945 |
| 12496 | 71.2979 | 14.6159 | 8.1158 | 26.2176 | 13.7236 |
| 11483 | 71.2805 | 673.2156 | 276.4610 | 382.7948 | 245.8432 |
| 16346 | 71.1498 | 207.6587 | 67.8226 | 159.1452 | 65.5184 |
| 24589 | 71.0453 | 137.0346 | 41.9089 | 97.9149 | 42.4671 |
| 19824 | 70.9930 | 57.2717 | 23.9351 | 98.0851 | 46.9532 |
| 17101 | 70.8711 | 625.0768 | 185.5572 | 450.4705 | 160.6608 |
| 22567 | 70.8624 | 141.5358 | 44.3199 | 177.7156 | 44.1501 |
| 111 | 70.8362 | 2102.7169 | 533.6692 | 2897.0542 | 982.3695 |
| 12524 | 70.8101 | 716.0642 | 91.9846 | 586.4459 | 176.6639 |
| 590 | 70.7753 | 71.4830 | 31.8044 | 46.4696 | 16.5543 |
| 16198 | 70.7753 | 81.7747 | 15.1381 | 107.6850 | 36.4200 |
| 13968 | 70.7230 | 12.1374 | 7.6730 | 22.0347 | 13.4951 |
| 20351 | 70.6359 | 92.4308 | 26.8712 | 62.1860 | 23.5756 |
| 11992 | 70.6010 | 14.5313 | 7.0889 | 22.3634 | 9.3980 |
| 18582 | 70.5749 | 120.0169 | 45.9230 | 171.3781 | 58.3542 |
| 23522 | 70.5488 | 351.2867 | 102.6773 | 248.0025 | 75.5684 |
| 25058 | 70.4965 | 58.0787 | 14.3296 | 85.4347 | 46.3468 |
| 22537 | 70.4094 | 15.2366 | 42.8309 | 59.9172 | 66.9252 |
| 24582 | 70.4094 | 101.6503 | 25.6652 | 73.2939 | 30.0576 |
| 19472 | 70.3310 | 897.1327 | 186.3170 | 729.1925 | 153.0911 |
| 15376 | 70.2526 | 288.6977 | 61.4146 | 241.5779 | 64.9371 |
| 606 | 70.1394 | 20.6348 | 30.9106 | −9.4605 | 31.7587 |
| 24205 | 69.9652 | 53.5023 | 19.6757 | 73.6951 | 23.8416 |
| 15759 | 69.9477 | 7.5711 | 11.4410 | 29.1228 | 33.2488 |
| 23368 | 69.9216 | 16.8977 | 15.3530 | 43.2722 | 35.3567 |
| 23417 | 69.9216 | 612.6607 | 117.2837 | 482.7822 | 124.7775 |
| 17891 | 69.8955 | 66.8302 | 18.8712 | 53.5766 | 19.5831 |
| 15274 | 69.8955 | 30.4077 | 11.9888 | 44.4288 | 20.0761 |
| 2947 | 69.8519 | 115.6635 | 44.9945 | 80.6217 | 31.7198 |
| 2114 | 69.8084 | 42.0145 | 15.9457 | 30.9996 | 15.7042 |
| 3254 | 69.7909 | 579.7408 | 111.9107 | 477.5422 | 126.0688 |
| 1478 | 69.7648 | 33.8458 | 14.9743 | 64.2203 | 48.1580 |
| 24066 | 69.6690 | 37.4509 | 15.7547 | 53.0857 | 17.6178 |
| 4402 | 69.6429 | 37.6766 | 11.1233 | 24.7345 | 14.6692 |
| 25550 | 69.6167 | 167.8484 | 63.1772 | 123.7603 | 44.9259 |
| 15446 | 69.6167 | 535.0001 | 102.3790 | 436.7580 | 106.5110 |
| 21012 | 69.5557 | 809.3135 | 221.7808 | 1235.4895 | 636.6529 |
| 619 | 69.5296 | 46.6199 | 27.5964 | 100.2451 | 66.3919 |
| 15839 | 69.4861 | 473.9767 | 101.3837 | 375.8462 | 117.2470 |
| 3493 | 78.5453 | 157.7257 | 53.4088 | 96.6981 | 45.6069 |
| 5079 | 77.9181 | 34.9935 | 18.1748 | 65.9913 | 26.1265 |
| 2752 | 77.7875 | 189.2381 | 67.7181 | 299.7008 | 104.4101 |
| 20350 | 77.6916 | 21.8303 | 20.8462 | 83.5036 | 63.0048 |
| 15644 | 77.7345 | 2152.0352 | 569.7626 | 1486.4810 | 368.6595 |
| 18612 | 75.8275 | 303.3538 | 68.1801 | 219.4783 | 66.4105 |
| 3759 | 75.8188 | 428.1330 | 148.5632 | 265.2457 | 79.4874 |
| 11729 | 75.8014 | 286.3255 | 61.2661 | 224.2657 | 51.3001 |
| 17506 | 75.3833 | 991.7645 | 526.2289 | 459.8825 | 398.9085 |
| 16 | 75.0523 | 201.2281 | 67.2891 | 333.9753 | 130.5508 |
| 4952 | 74.5557 | 1329.7272 | 367.7772 | 921.5617 | 365.4266 |
| 21664 | 74.4338 | 607.1335 | 110.5190 | 496.1032 | 94.3458 |
| 2655 | 74.4164 | 1722.0652 | 703.9498 | 914.6900 | 429.3902 |
| 4478 | 74.2334 | 104.6377 | 62.7281 | 37.5864 | 46.2176 |
| 16053 | 74.2073 | 619.4755 | 163.5583 | 455.3507 | 202.6089 |
| 16727 | 74.1986 | 390.2727 | 110.0896 | 262.5911 | 91.1953 |
| 17077 | 74.0592 | 24.1458 | 18.2202 | 41.7346 | 17.8179 |
| 9551 | 73.9024 | 215.2315 | 57.7361 | 289.8123 | 67.2129 |
| 16172 | 73.7979 | 2.1601 | 57.7105 | 117.1523 | 114.4852 |
| 11714 | 73.7108 | 119.9341 | 66.0431 | 251.7749 | 126.4212 |
| 2049 | 73.5714 | 249.0791 | 77.3602 | 163.8734 | 80.6935 |
| 14664 | 73.5366 | 508.4789 | 174.3481 | 334.5948 | 106.5554 |
| 14455 | 73.5017 | 72.8721 | 46.0236 | 152.4548 | 78.2442 |
| 13751 | 73.4408 | 265.5317 | 111.9122 | 167.4223 | 84.8957 |
| 10921 | 73.4233 | 48.6621 | 20.8625 | 101.3293 | 64.9434 |
| 18434 | 73.3624 | 669.4561 | 363.2245 | 401.6426 | 143.0873 |
| 18115 | 73.3362 | 36.2951 | 40.5990 | 108.1464 | 76.8892 |
| 2893 | 73.3101 | 1458.2634 | 329.0475 | 1113.8686 | 268.9892 |
| 18973 | 73.2753 | 566.7653 | 103.2776 | 447.6540 | 97.2513 |
| 14500 | 73.2753 | 21.0660 | 11.7626 | 42.6622 | 25.3222 |
| 8919 | 73.2056 | 693.8281 | 108.6115 | 583.9227 | 125.1144 |
| 22666 | 73.1794 | 409.8058 | 290.5020 | 177.2822 | 91.7395 |
| 21838 | 73.0923 | 368.4374 | 104.2854 | 296.7553 | 90.4084 |
| 15012 | 73.0749 | 248.5351 | 59.1067 | 195.7161 | 45.4367 |
| 3074 | 73.0662 | 28.8661 | 21.1530 | 46.1346 | 23.8125 |
| 16445 | 73.0662 | 237.3843 | 74.8845 | 341.9308 | 116.7969 |
| 21458 | 73.0139 | 3657.2085 | 1407.0886 | 2365.4449 | 952.3838 |
| 12309 | 73.0052 | 63.0746 | 28.7549 | 122.5813 | 65.8386 |
| 1398 | 72.9791 | 822.7953 | 154.9155 | 638.2734 | 132.0797 |
| 6454 | 72.9094 | 590.1262 | 111.1155 | 465.2511 | 103.1415 |
| 9575 | 72.8833 | 1004.3643 | 202.2357 | 773.6202 | 182.7943 |
| 13618 | 72.8659 | 280.7163 | 75.2017 | 210.1907 | 48.7580 |
| 7859 | 72.8659 | 277.5761 | 102.2599 | 179.8015 | 57.6382 |
| 6897 | 72.8397 | 396.7161 | 182.5419 | 244.6128 | 99.5196 |
| 26119 | 72.8310 | 369.2091 | 106.2482 | 270.3274 | 74.5288 |
| 7888 | 72.7875 | 1040.1900 | 126.0448 | 867.5961 | 220.6643 |
| 6732 | 72.7613 | 240.9802 | 66.8766 | 161.8444 | 60.5056 |
| 13617 | 72.7003 | 118.1744 | 45.7021 | 71.3702 | 40.0602 |
| 22995 | 72.6655 | 147.9133 | 65.2800 | 320.0601 | 212.0194 |
| 2250 | 72.6655 | 3116.7285 | 2087.4686 | 1585.4786 | 455.3688 |
| 7503 | 72.6307 | 64.1075 | 36.2318 | 20.2857 | 38.3991 |
| 21579 | 72.6220 | 567.4052 | 230.4537 | 310.4827 | 162.8993 |
| 23299 | 72.5958 | 2239.8694 | 938.3187 | 1205.3177 | 516.1230 |
| 13262 | 72.5697 | 94.9640 | 29.9016 | 117.6449 | 25.8202 |
| 10666 | 72.4477 | 950.0980 | 220.3205 | 769.9632 | 207.3944 |

TABLE 5KK-continued

NECROSIS
Timepoint(s): Various

| GLGC ID NO. | LDA Score | Mean Tox | SD Tox | Mean Nontox | SD Nontox |
|---|---|---|---|---|---|
| 23068 | 72.4390 | 253.0267 | 170.6231 | 302.4363 | 96.7734 |
| 13286 | 72.3606 | 156.1631 | 87.2274 | 294.9002 | 154.5629 |
| 16199 | 72.3345 | 35.9991 | 17.4281 | 63.6990 | 34.4261 |
| 21637 | 72.2735 | 79.7772 | 37.9251 | 52.2732 | 31.4657 |
| 7751 | 72.2300 | 53.2511 | 26.9113 | 26.4616 | 16.8289 |
| 23797 | 72.2213 | 95.8227 | 29.1378 | 135.5160 | 39.7547 |
| 13054 | 72.1864 | 195.7559 | 60.6047 | 135.0139 | 49.9788 |

TABLE 5LL

Necrosis Steatosis
Timepoint(s): Various

| GLGC ID NO. | LDA Score | Mean Tox | SD Tox | Mean Nontox | SD Nontox |
|---|---|---|---|---|---|
| 1460 | 86.9203 | 1131.9257 | 370.1441 | 2130.0026 | 699.1047 |
| 17075 | 86.1984 | 1018.8143 | 225.9918 | 742.5166 | 156.5896 |
| 15613 | 85.3109 | 795.8550 | 119.0225 | 673.7789 | 520.9051 |
| 15618 | 83.3404 | 516.1621 | 167.8901 | 262.3236 | 119.8459 |
| 15087 | 82.0282 | 299.5657 | 98.4621 | 183.8733 | 46.3201 |
| 23344 | 81.7394 | 533.6343 | 79.0021 | 382.1465 | 111.3879 |
| 21014 | 81.6842 | 348.7379 | 111.1647 | 835.1538 | 437.1708 |
| 18606 | 81.4464 | 2736.8264 | 323.8934 | 2172.7095 | 575.2254 |
| 11849 | 80.9665 | 2042.9307 | 295.1152 | 1585.8016 | 339.0811 |
| 12639 | 80.8519 | 3387.4550 | 451.2738 | 2725.0270 | 613.4226 |
| 26030 | 80.6735 | 2216.0350 | 368.4115 | 1673.4775 | 519.5605 |
| 17806 | 80.6141 | 15.4229 | 5.0786 | 38.3460 | 24.0257 |
| 18498 | 80.6013 | 352.5436 | 85.5702 | 236.6518 | 53.3358 |
| 2697 | 80.3126 | 3636.0843 | 505.4993 | 2868.7516 | 614.8873 |
| 18725 | 80.1979 | 36.5929 | 16.4693 | 93.6860 | 59.2219 |
| 19393 | 80.1894 | 1182.9350 | 195.2072 | 887.5899 | 188.7115 |
| 20821 | 80.0790 | 2739.7943 | 392.5381 | 2181.0195 | 511.5872 |
| 1660 | 79.6034 | 33.5621 | 12.9688 | 25.4903 | 33.9328 |
| 19181 | 79.5312 | 130.7521 | 40.3302 | 91.4241 | 22.0037 |
| 4338 | 79.4165 | 33.8029 | 16.8993 | 45.1189 | 12.1405 |
| 15617 | 79.2976 | 311.9450 | 107.0859 | 200.7970 | 88.2533 |
| 23950 | 79.1235 | 110.0879 | 22.3251 | 86.8508 | 24.4581 |
| 4723 | 78.9961 | 802.8929 | 233.5520 | 513.3254 | 164.6922 |
| 17211 | 78.8899 | 3470.2293 | 547.8829 | 2677.7388 | 843.7772 |
| 16257 | 78.8305 | 123.2543 | 49.2732 | 213.9442 | 82.4859 |
| 16918 | 78.6479 | 3946.7929 | 799.0535 | 3007.2162 | 881.3853 |
| 24885 | 78.6479 | 2668.2607 | 340.8049 | 2070.9885 | 502.8365 |
| 20427 | 78.4653 | 2255.7457 | 325.2806 | 1783.0066 | 336.2120 |
| 19440 | 78.4058 | 233.8007 | 69.0349 | 153.2042 | 61.2243 |
| 16929 | 78.3506 | 2442.4479 | 274.9464 | 1972.4472 | 397.3326 |
| 7602 | 78.2827 | 476.4700 | 112.1302 | 348.6806 | 99.0757 |
| 14934 | 78.2275 | 150.1843 | 25.8397 | 112.2519 | 24.6454 |
| 91 | 78.1765 | 19.8621 | 15.2651 | 42.9847 | 21.3559 |
| 15653 | 78.1722 | 2877.2700 | 424.5008 | 2354.3188 | 487.4316 |
| 3027 | 77.9939 | 3045.2657 | 499.7961 | 2334.0081 | 593.4579 |
| 10109 | 77.6966 | 3767.2500 | 597.6565 | 3020.9121 | 694.3495 |
| 24351 | 77.6839 | 61.1521 | 35.1339 | 15.5058 | 16.3701 |
| 21643 | 77.5735 | 3047.5600 | 631.9779 | 2287.2096 | 617.2572 |
| 455 | 77.5268 | 112.2621 | 31.5889 | 240.7281 | 147.3238 |
| 15372 | 77.5183 | 541.2636 | 85.0003 | 426.9278 | 95.8528 |
| 23574 | 77.4588 | 2725.3907 | 493.5538 | 2095.1231 | 550.2913 |
| 9125 | 77.4503 | 1009.0850 | 208.7290 | 776.6738 | 158.0450 |
| 15024 | 77.4078 | 14.4500 | 12.8522 | 82.6434 | 161.2384 |
| 132 | 77.4036 | 67.8029 | 41.6696 | 156.2195 | 82.0397 |
| 798 | 77.3994 | 69.7107 | 13.0959 | 52.3635 | 22.6229 |
| 2327 | 77.3441 | 56.7986 | 7.9340 | 73.2741 | 17.9329 |
| 17533 | 77.2295 | 44.5914 | 24.7848 | 100.2055 | 71.0683 |
| 21916 | 77.2083 | 1134.9050 | 288.7272 | 752.5776 | 153.7826 |
| 15247 | 77.1573 | 140.1829 | 56.8807 | 86.5195 | 67.4516 |
| 446 | 77.1063 | 34.0707 | 18.8441 | 76.1590 | 40.4471 |
| 24886 | 77.0426 | 2980.9943 | 455.6850 | 2499.5401 | 489.8961 |
| 9620 | 76.9832 | 1664.6379 | 215.1824 | 1351.6575 | 294.2379 |
| 20744 | 76.9789 | 109.7321 | 42.1667 | 73.1486 | 47.9778 |
| 20490 | 76.9195 | 7.9036 | 19.3258 | 42.7810 | 26.7394 |

TABLE 5LL-continued

Necrosis Steatosis
Timepoint(s): Various

| GLGC ID NO. | LDA Score | Mean Tox | SD Tox | Mean Nontox | SD Nontox |
|---|---|---|---|---|---|
| 1169 | 76.8685 | 101.8800 | 31.1476 | 179.9508 | 85.3322 |
| 15489 | 76.6137 | 92.8043 | 30.5782 | 58.7641 | 15.9184 |
| 20994 | 76.5585 | 244.2257 | 66.6315 | 157.7852 | 59.2296 |
| 20056 | 76.5161 | 35.8129 | 5.3299 | 87.5812 | 100.9942 |
| 21646 | 76.5033 | 86.5457 | 34.9826 | 129.3309 | 33.6846 |
| 855 | 76.4524 | 11.5886 | 4.1920 | 19.7018 | 12.1565 |
| 17808 | 76.4439 | 1919.7657 | 344.1665 | 1507.1252 | 342.6570 |
| 1190 | 76.3971 | 16.0264 | 4.9392 | 26.9857 | 17.2884 |
| 20844 | 76.3292 | 2664.5607 | 550.0108 | 2073.5578 | 637.7959 |
| 20816 | 76.3207 | 1313.3264 | 544.2307 | 844.8086 | 387.1292 |
| 21012 | 76.1551 | 641.3886 | 188.5077 | 1227.6432 | 631.0770 |
| 15065 | 76.0829 | 1848.9443 | 275.9505 | 1528.8499 | 232.2574 |
| 16953 | 76.0319 | 1852.3721 | 265.4180 | 1518.4018 | 329.6201 |
| 13090 | 75.9725 | 42.6543 | 42.0946 | 80.1787 | 44.1597 |
| 16047 | 75.9173 | 58.9493 | 18.1730 | 91.8075 | 36.3698 |
| 1598 | 75.8493 | 435.1200 | 211.1990 | 279.3911 | 272.6018 |
| 17541 | 75.8493 | 1601.3786 | 602.9470 | 2966.0588 | 1068.2520 |
| 7427 | 75.7389 | 343.4343 | 67.5622 | 276.6882 | 94.3950 |
| 25203 | 75.7347 | 26.9443 | 33.7616 | 58.6066 | 32.7021 |
| 21379 | 75.6837 | 26.5021 | 7.8208 | 36.5862 | 21.3364 |
| 20456 | 75.6710 | 216.2993 | 48.1083 | 137.5332 | 61.8848 |
| 21083 | 75.6582 | 69.7314 | 53.9077 | 32.0826 | 12.6240 |
| 17257 | 75.6582 | 91.2200 | 90.7154 | 32.1795 | 20.5436 |
| 4957 | 75.6200 | 89.3364 | 22.5009 | 148.7077 | 68.2029 |
| 20798 | 75.6158 | 134.8007 | 37.8123 | 191.6162 | 52.2724 |
| 15680 | 75.6158 | 297.3757 | 52.9811 | 381.8838 | 78.4285 |
| 14881 | 75.5606 | 185.8586 | 148.2117 | 440.8951 | 277.6613 |
| 11997 | 75.5521 | 146.7000 | 36.5716 | 108.1219 | 39.9321 |
| 25389 | 75.5011 | 3.0786 | 42.6249 | 76.7262 | 81.4775 |
| 15535 | 75.4969 | 1150.2207 | 175.2716 | 911.5016 | 211.5050 |
| 2846 | 75.4374 | 30.5121 | 14.1243 | 52.1977 | 19.3351 |
| 20716 | 75.3822 | 378.3571 | 100.2068 | 524.7839 | 182.3046 |
| 15394 | 75.3780 | 553.7957 | 69.7120 | 408.8436 | 132.6244 |
| 4222 | 75.3695 | 1256.3271 | 223.0748 | 1040.7164 | 182.1498 |
| 815 | 75.3143 | 3605.8193 | 630.9495 | 2933.6670 | 650.9019 |
| 133 | 75.2633 | 36.4379 | 32.6695 | 90.0948 | 73.0978 |
| 16367 | 75.2590 | 350.9457 | 216.4610 | 626.7133 | 286.5804 |
| 4206 | 75.2548 | 744.9400 | 177.9477 | 622.4682 | 159.3977 |
| 21657 | 75.2081 | 585.9650 | 129.0058 | 891.2511 | 407.0766 |
| 25363 | 75.2038 | 210.4621 | 77.7254 | 375.4242 | 181.0378 |
| 6626 | 75.1996 | 27.0557 | 13.0003 | 61.8342 | 31.0551 |
| 1178 | 75.1953 | 14.4186 | 26.9045 | 38.9765 | 24.1098 |
| 1170 | 75.1444 | 157.3507 | 49.8327 | 268.8495 | 129.7268 |
| 14882 | 75.0255 | 138.0564 | 152.5094 | 358.2852 | 235.1680 |
| 811 | 74.9703 | 68.6107 | 14.9260 | 93.5991 | 42.1456 |
| 706 | 74.9660 | 16.2907 | 5.7458 | 23.1521 | 9.9050 |
| 7604 | 86.9755 | 549.2236 | 109.5181 | 378.8346 | 114.5647 |
| 4926 | 85.7270 | 506.2864 | 42.7723 | 390.6002 | 76.2216 |
| 23224 | 83.5910 | 374.3971 | 33.5524 | 320.0869 | 108.0133 |
| 23299 | 83.1621 | 2281.5200 | 934.1672 | 1230.4574 | 553.6372 |
| 21008 | 83.1153 | 3.8400 | 17.7273 | 93.5011 | 114.1667 |
| 24137 | 83.0389 | 77.2671 | 36.8582 | 26.8851 | 17.5579 |
| 13865 | 82.0409 | 96.7021 | 16.2867 | 137.3349 | 32.7043 |
| 7074 | 81.8031 | 43.8221 | 4.8258 | 52.8229 | 21.0370 |
| 13330 | 81.6248 | 21.8300 | 37.6547 | 73.0082 | 60.9451 |
| 735 | 81.5653 | 101.9457 | 51.6380 | 190.5994 | 71.0066 |
| 11221 | 81.3148 | 235.6500 | 99.0806 | 164.0485 | 38.3068 |
| 4107 | 81.2680 | 97.3386 | 58.4224 | 206.0995 | 85.7395 |
| 8167 | 81.2086 | 642.6550 | 107.5338 | 431.1963 | 172.0675 |
| 5821 | 81.0897 | 98.5271 | 12.9363 | 73.3566 | 25.8310 |
| 7071 | 81.0302 | 86.8386 | 33.7108 | 203.6941 | 111.9421 |
| 6321 | 80.9580 | 1437.0179 | 499.8233 | 857.4129 | 237.0613 |
| 4662 | 80.6650 | 30.9800 | 32.3600 | −17.1501 | 32.7584 |
| 2231 | 80.6141 | 140.1493 | 19.6676 | 235.2950 | 113.3655 |
| 6464 | 80.4230 | 317.9164 | 105.1633 | 207.2934 | 58.6327 |
| 15561 | 80.3720 | 163.9121 | 80.3284 | 265.8809 | 76.1185 |
| 8110 | 80.3126 | 60.1279 | 29.1294 | 86.7072 | 26.4025 |
| 17559 | 80.2573 | 141.2007 | 76.5527 | 271.4127 | 119.6747 |
| 13717 | 80.2573 | 118.3014 | 20.5371 | 174.7959 | 49.1592 |
| 14458 | 80.2446 | 844.7686 | 360.1982 | 405.4593 | 231.6832 |
| 19032 | 80.0068 | 1530.0450 | 531.2493 | 1245.1574 | 275.3352 |
| 19835 | 79.8284 | 50.7007 | 40.2034 | 84.2399 | 21.6693 |
| 23608 | 79.7817 | 1430.6079 | 243.8615 | 1047.6552 | 367.6771 |

TABLE 5LL-continued

Necrosis Steatosis
Timepoint(s): Various

| GLGC ID NO. | LDA Score | Mean Tox | SD Tox | Mean Nontox | SD Nontox |
|---|---|---|---|---|---|
| 6635 | 79.7817 | 59.7057 | 28.9619 | 98.9063 | 38.2228 |
| 3963 | 79.7817 | 126.7693 | 72.9044 | 244.7866 | 98.2986 |
| 11228 | 79.7690 | 594.3386 | 191.0444 | 361.4018 | 141.5230 |
| 16781 | 79.7265 | 125.1371 | 20.9633 | 185.5312 | 100.8128 |
| 2536 | 79.7265 | 106.6993 | 23.1353 | 173.6004 | 77.0924 |
| 2993 | 79.7223 | 1188.2643 | 106.2663 | 968.0314 | 219.2296 |
| 13397 | 79.7223 | 123.8600 | 15.6373 | 152.0376 | 48.8268 |
| 19451 | 79.6034 | 53.1879 | 27.0584 | 156.9797 | 104.0292 |
| 21200 | 79.5864 | 101.8093 | 74.4300 | 30.0959 | 24.9640 |
| 17009 | 79.4887 | 26.5100 | 13.0034 | 67.2130 | 49.3429 |
| 5959 | 79.3061 | 23.9964 | 13.1137 | 39.8467 | 20.9686 |
| 18943 | 79.3019 | 871.6671 | 146.0986 | 633.8804 | 194.5551 |
| 17614 | 79.3019 | 76.6550 | 48.7615 | 162.2348 | 60.9819 |
| 18650 | 79.2424 | 2483.9336 | 431.3369 | 1804.4246 | 941.4566 |
| 18337 | 79.2339 | 89.7086 | 49.9143 | 58.4278 | 28.2491 |
| 12164 | 78.9918 | 153.6407 | 96.9205 | 53.6238 | 37.7007 |
| 9040 | 78.9536 | 276.7286 | 45.2519 | 375.4818 | 129.2932 |
| 2939 | 78.9536 | 56.1736 | 27.0153 | 103.3220 | 52.4868 |
| 14049 | 78.9409 | 132.7136 | 50.9267 | 193.5843 | 45.1123 |
| 21074 | 78.8772 | 791.4264 | 303.8549 | 582.2662 | 167.8771 |
| 22915 | 78.6479 | 334.2393 | 54.1492 | 269.9590 | 67.2086 |
| 4337 | 78.5884 | 33.8014 | 19.3256 | 53.2584 | 19.7758 |
| 21971 | 78.5799 | 472.1443 | 209.9305 | 337.7528 | 118.4374 |
| 5907 | 78.4653 | 478.5736 | 100.8673 | 343.9045 | 92.3833 |
| 9918 | 78.4568 | 219.1236 | 102.1367 | 147.1791 | 31.6163 |
| 23252 | 78.4101 | 14.4836 | 12.8353 | 36.5743 | 18.3404 |
| 6820 | 78.3506 | 162.8057 | 40.2982 | 226.7325 | 51.3825 |
| 13702 | 78.2996 | 13.5436 | 6.9363 | 28.4093 | 19.0896 |
| 18454 | 78.2869 | 213.1079 | 52.2993 | 151.5269 | 45.0605 |
| 4722 | 78.2869 | 64.4343 | 28.0676 | 34.8417 | 23.7041 |
| 21172 | 78.2869 | 219.9914 | 81.2019 | 286.6458 | 63.1852 |
| 6824 | 78.2359 | 2268.2814 | 215.9508 | 2122.2888 | 580.2950 |
| 11127 | 78.2359 | 46.4457 | 8.6426 | 68.0136 | 26.4075 |
| 17914 | 78.2190 | 356.5200 | 177.9903 | 139.3548 | 83.1964 |
| 6669 | 78.1765 | 97.4179 | 23.3259 | 142.7761 | 43.4676 |
| 2100 | 78.1765 | 446.3250 | 48.6002 | 394.8268 | 110.6236 |
| 17168 | 78.1680 | 685.4243 | 144.7330 | 482.8978 | 144.7772 |
| 22106 | 78.1595 | 212.2857 | 73.4527 | 133.5982 | 35.1993 |
| 15280 | 78.0576 | 92.0879 | 15.4512 | 120.7782 | 29.4080 |

TABLE 5MM

Negative Controls
Timepoint(s): Various

| GLGC ID NO. | LDA Score | Mean Tox | SD Tox | Mean Nontox | SD Nontox |
|---|---|---|---|---|---|
| 1588 | 72.0192 | 700.1723 | 327.1804 | 412.6330 | 232.2981 |
| 1970 | 71.7140 | 317.4336 | 163.8809 | 183.3308 | 92.0966 |
| 5358 | 70.8818 | 146.2672 | 68.8164 | 85.4217 | 42.6874 |
| 20664 | 70.7094 | 919.6611 | 385.6522 | 588.6121 | 289.9668 |
| 23037 | 70.7046 | 41.4132 | 25.4593 | 22.7396 | 15.7872 |
| 445 | 70.5946 | 144.1969 | 73.7507 | 82.7641 | 39.9387 |
| 11260 | 70.4534 | 131.2696 | 67.0105 | 80.3999 | 52.0857 |
| 338 | 70.4173 | 26.8128 | 46.4904 | -3.2941 | 33.2337 |
| 16602 | 70.3358 | 79.7489 | 47.4923 | 43.5814 | 33.9562 |
| 25491 | 70.0923 | 59.3552 | 25.8583 | 46.0522 | 18.5662 |
| 1969 | 70.0382 | 103.0510 | 76.6244 | 44.6752 | 37.1192 |
| 15123 | 69.9036 | 445.9574 | 378.8451 | 138.2921 | 199.1620 |
| 22661 | 69.8393 | 686.6783 | 174.0167 | 845.8637 | 162.6250 |
| 17562 | 69.6639 | 981.9633 | 494.9466 | 601.9823 | 338.2572 |
| 444 | 69.5359 | 119.7477 | 51.6946 | 75.2388 | 34.5437 |
| 11691 | 69.3406 | 97.4342 | 69.8516 | 47.0863 | 47.7230 |
| 7062 | 69.3340 | 678.8113 | 289.1407 | 446.6483 | 210.8374 |
| 25605 | 69.3340 | 49.0482 | 23.0321 | 33.1562 | 15.3231 |
| 1198 | 69.2980 | 230.3009 | 108.1482 | 146.6678 | 60.1223 |
| 8384 | 69.2799 | 133.4638 | 108.8685 | 52.7224 | 63.6315 |
| 25666 | 69.2715 | 297.7699 | 123.8606 | 189.0201 | 108.4282 |
| 1357 | 69.2601 | 64.3937 | 35.7978 | 39.5850 | 32.0069 |

TABLE 5MM-continued

Negative Controls
Timepoint(s): Various

| GLGC ID NO. | LDA Score | Mean Tox | SD Tox | Mean Nontox | SD Nontox |
|---|---|---|---|---|---|
| 17090 | 69.2451 | 141.1620 | 40.6309 | 110.0864 | 43.2448 |
| 446 | 69.2241 | 115.9174 | 53.5452 | 69.3727 | 34.3229 |
| 691 | 69.1994 | 253.3392 | 125.3368 | 160.7856 | 94.5799 |
| 18694 | 69.1682 | 52.2869 | 38.5101 | 20.5569 | 32.3570 |
| 20842 | 69.1057 | 434.3375 | 130.6649 | 530.4334 | 114.1818 |
| 15291 | 69.1027 | 210.0274 | 111.1492 | 121.0910 | 56.1285 |
| 1359 | 68.9909 | 124.0474 | 43.4722 | 86.0803 | 35.8946 |
| 25747 | 68.9170 | 2599.3565 | 819.1626 | 1952.2409 | 697.7238 |
| 18539 | 68.8317 | 277.0947 | 116.1440 | 180.8553 | 101.2148 |
| 1602 | 68.7776 | 360.6752 | 231.9046 | 202.7700 | 154.8374 |
| 26000 | 68.7710 | 106.0417 | 45.9246 | 67.6999 | 32.7440 |
| 17280 | 68.7644 | 54.5093 | 28.7895 | 33.3071 | 23.9295 |
| 8386 | 68.7170 | 372.6581 | 276.6053 | 163.3642 | 163.8884 |
| 17560 | 68.7037 | 1577.5364 | 658.8757 | 1109.8588 | 472.8835 |
| 1905 | 68.6479 | 1116.1489 | 425.0095 | 746.6038 | 351.2317 |
| 1323 | 68.5331 | 183.6707 | 161.9220 | 67.8422 | 119.5126 |
| 1589 | 68.4970 | 343.7262 | 243.3609 | 150.0170 | 155.5176 |
| 15470 | 68.4754 | 289.3183 | 94.5553 | 363.2355 | 90.0747 |
| 17204 | 68.4015 | 830.1091 | 260.2573 | 1051.4636 | 258.1818 |
| 21624 | 68.3769 | 3265.6684 | 797.8762 | 2619.7276 | 773.5407 |
| 25743 | 68.3607 | 285.8291 | 132.4984 | 176.9054 | 134.5639 |
| 4392 | 68.3144 | 3076.6233 | 991.3459 | 3928.9072 | 1097.3968 |
| 25405 | 68.3066 | 80.5659 | 45.8796 | 47.1951 | 34.4194 |
| 25254 | 68.3000 | 20.0008 | 14.7593 | 8.3585 | 12.2068 |
| 19212 | 68.2934 | 45.6356 | 22.3702 | 28.0473 | 19.0646 |
| 17561 | 68.2819 | 753.3032 | 390.2580 | 466.8154 | 262.5253 |
| 25203 | 68.2621 | 83.3872 | 35.7133 | 54.2746 | 30.7778 |
| 860 | 68.2014 | 30.9888 | 37.3480 | 5.0628 | 30.5953 |
| 690 | 68.1786 | 89.3896 | 51.1848 | 50.4340 | 38.1501 |
| 24518 | 68.1636 | 503.1269 | 155.8908 | 627.7239 | 140.3486 |
| 9135 | 68.1636 | 834.1229 | 229.2764 | 1025.8800 | 209.0868 |
| 16469 | 68.1029 | 567.9515 | 207.9904 | 718.9486 | 181.6754 |
| 1538 | 68.0686 | 51.2477 | 42.5605 | 21.0976 | 28.0544 |
| 19584 | 68.0290 | 142.2739 | 43.7453 | 109.7579 | 43.3979 |
| 1704 | 68.0146 | 76.8139 | 79.3908 | 20.3441 | 36.8293 |
| 16248 | 67.8914 | 296.6191 | 220.4052 | 131.7359 | 125.1992 |
| 5317 | 67.8782 | 1034.1240 | 575.8959 | 641.3310 | 440.0832 |
| 455 | 67.8469 | 350.8188 | 164.7255 | 221.7124 | 136.5616 |
| 24867 | 67.8421 | 23.8259 | 24.4825 | 10.3614 | 13.9329 |
| 1029 | 67.8175 | 63.1238 | 36.6012 | 36.6180 | 28.1018 |
| 20942 | 67.8139 | 1070.6024 | 372.0032 | 1341.3559 | 371.2910 |
| 16122 | 67.7748 | 257.2677 | 170.4956 | 144.5708 | 134.8216 |
| 25774 | 67.7418 | 37.5755 | 14.8995 | 26.5620 | 14.0790 |
| 107 | 67.7057 | 48.6099 | 32.8655 | 31.5429 | 33.7987 |
| 595 | 67.6781 | 40.6585 | 33.2938 | 17.8861 | 20.1950 |
| 1324 | 67.6517 | 246.9592 | 155.0421 | 138.0418 | 120.6183 |
| 25498 | 67.6336 | 1167.7139 | 377.5257 | 897.8104 | 289.5853 |
| 8385 | 67.6288 | 200.1869 | 193.8442 | 60.6545 | 100.9654 |
| 17487 | 67.6090 | 118.2829 | 56.9709 | 72.2499 | 40.0397 |
| 16468 | 67.6072 | 392.0984 | 171.1802 | 538.9689 | 159.5771 |
| 25233 | 67.5958 | 106.9239 | 46.2984 | 70.4084 | 41.6746 |
| 6348 | 67.5826 | 107.6063 | 25.6021 | 86.2305 | 23.9068 |
| 18501 | 67.5663 | 260.8951 | 146.6785 | 166.3205 | 95.6014 |
| 25741 | 67.5549 | 54.2489 | 31.9825 | 33.2459 | 24.1203 |
| 15127 | 67.5417 | 1687.2792 | 594.9493 | 1189.7128 | 449.9288 |
| 17279 | 67.4810 | 31.0786 | 29.8442 | 8.7767 | 23.7823 |
| 13348 | 67.4762 | 61.4927 | 43.1010 | 31.8138 | 19.1288 |
| 6671 | 67.4498 | 154.5497 | 58.6586 | 109.2871 | 45.8246 |
| 19671 | 67.4346 | 33.3586 | 14.8462 | 22.6958 | 13.4190 |
| 16331 | 67.4317 | 507.4313 | 152.6846 | 414.8411 | 114.5641 |
| 1423 | 67.4269 | 57.2294 | 49.8707 | 18.6384 | 32.7724 |
| 15677 | 67.4119 | 416.1161 | 143.3043 | 301.8559 | 137.1014 |
| 4393 | 67.3362 | 1454.7974 | 427.1450 | 1766.2319 | 446.0295 |
| 4223 | 67.3332 | 26.6995 | 18.2720 | 15.7354 | 15.6172 |
| 20833 | 67.2821 | 757.6682 | 220.3785 | 954.1106 | 226.6227 |
| 4257 | 67.2791 | 37.9946 | 19.5550 | 22.8364 | 13.1962 |
| 4224 | 67.2707 | 379.0323 | 100.1701 | 311.2664 | 99.8314 |
| 1715 | 67.2479 | 736.6243 | 297.8945 | 534.8848 | 222.0980 |
| 18538 | 67.2052 | 137.0972 | 68.3642 | 82.9521 | 59.4567 |
| 762 | 67.1457 | 545.3490 | 316.8535 | 861.5952 | 388.1749 |
| 3254 | 67.1409 | 405.5852 | 125.2067 | 493.2032 | 123.4377 |
| 20270 | 67.1181 | 119.9073 | 40.8512 | 89.1837 | 38.1321 |

TABLE 5MM-continued

Negative Controls
Timepoint(s): Various

| GLGC ID NO. | LDA Score | Mean Tox | SD Tox | Mean Nontox | SD Nontox |
|---|---|---|---|---|---|
| 21415 | 67.1001 | 224.6154 | 129.6468 | 301.2975 | 108.5496 |
| 19391 | 67.0640 | 546.3534 | 212.4043 | 383.2988 | 194.2972 |
| 18517 | 67.0442 | 12.0599 | 33.1034 | 31.6403 | 30.5873 |
| 19934 | 67.0148 | 21.4517 | 11.4077 | 14.0448 | 9.5341 |
| 1703 | 67.0051 | 146.6583 | 83.9200 | 90.2165 | 45.1965 |
| 23123 | 72.4656 | 567.3654 | 203.6273 | 385.7111 | 140.2185 |
| 6916 | 70.9918 | 23.9360 | 36.7022 | −4.5256 | 22.5220 |
| 21166 | 70.8998 | 530.0798 | 174.2102 | 378.4626 | 117.7436 |
| 21165 | 70.7899 | 96.7910 | 51.7130 | 48.9320 | 37.2751 |
| 3801 | 70.5880 | 135.2705 | 90.0342 | 62.3402 | 56.5697 |
| 4857 | 70.4961 | 432.7370 | 161.3085 | 315.2322 | 117.1048 |
| 20905 | 70.2924 | 669.0422 | 125.6625 | 553.1366 | 128.9441 |
| 16682 | 69.8856 | 187.7224 | 138.6072 | 84.5150 | 74.9155 |
| 23966 | 69.8231 | 1425.0503 | 465.2624 | 1043.2942 | 359.4651 |
| 23648 | 69.7065 | 96.4215 | 59.4314 | 48.6223 | 46.5149 |
| 16603 | 69.6393 | 200.9065 | 117.5932 | 111.8387 | 93.1396 |
| 16250 | 69.6164 | 663.5608 | 568.2097 | 227.0135 | 298.8362 |
| 12096 | 69.6032 | 171.4396 | 77.0649 | 115.5779 | 50.9465 |
| 17359 | 69.4043 | 2555.0124 | 915.8376 | 3421.1064 | 1020.5396 |
| 2425 | 69.2601 | 333.7374 | 98.9107 | 245.0317 | 73.1125 |
| 10512 | 69.2487 | 92.9364 | 64.1815 | 43.4753 | 49.7717 |
| 21183 | 69.2307 | 94.8686 | 87.5651 | 19.6783 | 56.7134 |
| 22536 | 69.2175 | 2021.7775 | 679.8734 | 1489.3497 | 498.2782 |
| 12203 | 69.2108 | 126.6889 | 105.1990 | 55.4980 | 90.7146 |
| 12413 | 69.1436 | 126.5232 | 51.0095 | 88.2707 | 43.6235 |
| 11719 | 69.1075 | 49.1879 | 25.8539 | 28.9682 | 20.2925 |
| 7497 | 69.1039 | 723.9603 | 198.2665 | 907.9666 | 224.0040 |
| 10065 | 69.0534 | 63.2661 | 41.4436 | 29.3961 | 22.9302 |
| 11693 | 69.0222 | 210.0040 | 175.2931 | 77.6781 | 131.9286 |
| 3798 | 68.9909 | 405.2292 | 139.8835 | 295.9397 | 129.0722 |
| 23038 | 68.9188 | 89.7648 | 135.7914 | −15.4220 | 84.5182 |
| 2583 | 68.8972 | 1239.6842 | 564.2699 | 1699.3341 | 537.7434 |
| 14837 | 68.8762 | 238.7945 | 189.7019 | 94.8228 | 98.7406 |
| 12356 | 68.8563 | 101.7330 | 43.4444 | 67.5108 | 35.1861 |
| 5698 | 68.8071 | 1755.2828 | 347.2762 | 1460.7047 | 295.1276 |
| 7208 | 68.7824 | 462.3861 | 117.9233 | 367.9713 | 106.1929 |
| 4120 | 68.7170 | 136.2969 | 74.4209 | 72.6698 | 48.7599 |
| 14745 | 68.6923 | 58.4411 | 44.0337 | 27.0768 | 27.3862 |
| 1358 | 68.6677 | 94.2927 | 53.3833 | 52.7809 | 44.4291 |
| 2708 | 68.6611 | 533.2813 | 162.1809 | 407.9145 | 120.0697 |
| 20271 | 68.6118 | 458.0638 | 167.6026 | 336.7968 | 128.5470 |
| 14582 | 68.6052 | 99.6793 | 72.1583 | 55.1626 | 68.5206 |
| 17890 | 68.6004 | 64.7480 | 33.1459 | 40.5078 | 25.0759 |
| 22056 | 68.5181 | 1538.5664 | 467.7118 | 1964.3915 | 456.8412 |
| 17240 | 68.4982 | 2423.2748 | 755.1185 | 3083.7921 | 835.8118 |
| 21043 | 68.4904 | 129.4519 | 65.1127 | 79.3958 | 40.6243 |
| 16251 | 68.4790 | 301.8112 | 226.3305 | 131.3911 | 115.3099 |
| 1332 | 68.4724 | 717.0398 | 282.0905 | 472.8529 | 166.8469 |
| 11639 | 68.3739 | 53.6605 | 32.0890 | 26.6092 | 22.2659 |
| 8874 | 68.2705 | 192.3272 | 148.5437 | 85.5015 | 125.0438 |
| 23067 | 68.2669 | 594.8275 | 174.2484 | 694.8385 | 162.0993 |
| 11821 | 68.2459 | 461.1344 | 298.7934 | 248.2410 | 217.5429 |
| 22283 | 68.2195 | 441.4797 | 184.2639 | 302.9867 | 172.3775 |
| 12467 | 68.1948 | 86.1844 | 40.1733 | 58.5442 | 36.3061 |

TABLE 5NN

Peroxisome Prolif.
Timepoint(s): Various

| GLGC ID NO. | LDA Score | Mean Tox | SD Tox | Mean Nontox | SD Nontox |
|---|---|---|---|---|---|
| 18082 | 86.2579 | 44.5773 | 15.5649 | 19.7703 | 19.1852 |
| 15829 | 83.1578 | 243.8207 | 192.0725 | 24.7479 | 70.0758 |
| 17160 | 81.5696 | 1212.4548 | 112.8651 | 1302.8403 | 352.9742 |
| 427 | 81.5101 | 894.0591 | 202.1734 | 1723.9238 | 925.9238 |
| 17691 | 81.4464 | 84.2828 | 10.7396 | 104.1129 | 37.9378 |
| 3743 | 81.0769 | 92.8936 | 26.0431 | 52.9832 | 18.9158 |
| 426 | 80.5589 | 1462.6036 | 239.4410 | 2608.6883 | 1308.7895 |

TABLE 5NN-continued

Peroxisome Prolif.
Timepoint(s): Various

| GLGC ID NO. | LDA Score | Mean Tox | SD Tox | Mean Nontox | SD Nontox |
|---|---|---|---|---|---|
| 20854 | 80.0195 | 74.0029 | 18.6699 | 77.3810 | 57.2440 |
| 24179 | 79.7817 | 22.2346 | 4.2705 | 16.0739 | 6.6862 |
| 8606 | 79.7223 | 30.3863 | 3.1392 | 38.1327 | 12.8463 |
| 3427 | 79.0003 | 282.5055 | 45.8121 | 197.7148 | 52.7929 |
| 1894 | 78.9451 | 76.4861 | 27.4887 | 43.2858 | 34.8070 |
| 7101 | 78.7116 | 2270.2657 | 501.9336 | 3384.7465 | 990.6960 |
| 18083 | 78.6946 | 171.1562 | 93.3377 | 42.9202 | 61.9832 |
| 20940 | 78.5927 | 1106.4821 | 151.3055 | 1143.5983 | 507.1657 |
| 1973 | 78.4738 | 186.0221 | 39.2390 | 265.1933 | 75.8850 |
| 2830 | 77.8996 | 140.3473 | 19.1905 | 176.5186 | 42.4623 |
| 14970 | 77.8198 | 32.4401 | 11.6418 | 59.4869 | 25.6153 |
| 11116 | 77.7051 | 556.4093 | 300.6821 | 1198.5089 | 784.1704 |
| 15011 | 77.4588 | 227.6250 | 50.1289 | 169.8316 | 60.5864 |
| 4002 | 77.4078 | 66.1343 | 19.9695 | 100.1764 | 37.5230 |
| 11115 | 77.4078 | 367.3098 | 186.4486 | 729.3327 | 426.1530 |
| 22865 | 77.2847 | 68.1444 | 8.0419 | 64.4614 | 23.6823 |
| 23211 | 77.2804 | 67.4802 | 7.7921 | 52.5810 | 16.8704 |
| 17225 | 76.8685 | 513.0661 | 60.3307 | 416.0054 | 127.6933 |
| 20766 | 76.8600 | 161.9414 | 40.9758 | 119.3250 | 41.4160 |
| 1131 | 76.5118 | 163.4415 | 15.3054 | 150.1790 | 43.2178 |
| 22513 | 76.4566 | 595.3514 | 309.3171 | 1775.0317 | 1907.9758 |
| 15313 | 76.4481 | 360.0410 | 63.6286 | 300.5834 | 170.7511 |
| 24868 | 76.3887 | 33.3062 | 11.0899 | 19.8432 | 14.1351 |
| 457 | 76.3334 | 340.2109 | 79.1718 | 509.0309 | 183.7460 |
| 25083 | 76.2145 | 22.1354 | 4.9296 | 28.8162 | 15.1099 |
| 3862 | 76.2103 | 44.2247 | 9.8789 | 36.0769 | 25.3985 |
| 20996 | 76.0956 | 298.5401 | 46.9204 | 250.1926 | 91.6008 |
| 16168 | 76.0786 | 4313.6831 | 1653.8148 | 2292.4695 | 970.9152 |
| 17258 | 75.9215 | 74.9320 | 12.3564 | 94.4594 | 30.4594 |
| 16806 | 75.9088 | 35.2704 | 12.4687 | 15.8009 | 19.7066 |
| 16141 | 75.7899 | 172.8531 | 23.2592 | 130.9408 | 32.1631 |
| 20518 | 75.6795 | 79.9956 | 17.6049 | 117.5184 | 40.0685 |
| 21403 | 75.6200 | 134.5834 | 11.7301 | 124.6232 | 30.5556 |
| 14595 | 75.5393 | 290.5388 | 183.2117 | 107.5601 | 94.9639 |
| 15886 | 75.5011 | 233.4456 | 19.2499 | 242.6179 | 56.3203 |
| 4354 | 75.4969 | 43.6042 | 7.6115 | 33.5283 | 12.6622 |
| 1678 | 75.4417 | 5.8723 | 16.7649 | 40.4734 | 42.2008 |
| 1949 | 75.4374 | 108.9981 | 32.6211 | 78.3078 | 38.1748 |
| 21589 | 75.4374 | 110.7866 | 21.3081 | 83.9200 | 27.4647 |
| 20126 | 75.3864 | 64.3703 | 19.1732 | 160.8076 | 168.8437 |
| 15248 | 75.3610 | 81.4823 | 59.8222 | 32.7996 | 22.9006 |
| 58 | 75.3227 | 89.2659 | 25.0930 | 125.4691 | 39.8828 |
| 20741 | 75.2633 | 37.9201 | 18.2840 | 70.4148 | 39.6750 |
| 1859 | 75.2633 | 28.2801 | 10.5134 | 44.9867 | 25.8389 |
| 17316 | 75.1232 | 107.5392 | 80.8764 | 34.2610 | 24.8334 |
| 17161 | 75.0255 | 2386.6296 | 348.3855 | 2233.3626 | 741.7372 |
| 24651 | 75.0255 | 92.8724 | 7.9629 | 90.8517 | 23.3813 |
| 12013 | 74.9660 | 99.7602 | 12.5207 | 86.6886 | 22.9826 |
| 21443 | 74.9066 | 42.4943 | 27.5567 | 24.1537 | 39.2063 |
| 20919 | 74.9066 | 299.9556 | 114.8842 | 488.4804 | 186.9574 |
| 24428 | 74.7877 | 36.3631 | 5.8523 | 36.2079 | 17.9293 |
| 18583 | 74.6603 | 33.5783 | 11.6342 | 19.0311 | 13.4327 |
| 1129 | 74.6093 | 185.4774 | 29.6090 | 159.9542 | 54.5373 |
| 9183 | 74.6093 | 34.4197 | 9.2939 | 25.7168 | 17.2724 |
| 16759 | 74.4946 | 39.6276 | 9.2369 | 45.8266 | 24.7381 |
| 10744 | 74.4309 | 14.2900 | 11.1413 | 53.1068 | 48.4228 |
| 17532 | 74.4309 | 129.4729 | 40.3058 | 196.7185 | 73.4366 |
| 17934 | 74.4097 | 585.2562 | 287.0931 | 279.3999 | 124.8753 |
| 24508 | 74.3715 | 122.8081 | 24.7980 | 122.1201 | 51.7083 |
| 18055 | 74.3715 | 38.8280 | 5.2628 | 37.2065 | 13.0573 |
| 20057 | 74.3715 | 25.4351 | 10.1211 | 50.5631 | 39.4166 |
| 20583 | 74.3120 | 50.6381 | 14.1006 | 47.2220 | 29.2967 |
| 4225 | 74.3120 | 131.5003 | 18.3854 | 167.7601 | 60.3387 |
| 21211 | 74.2526 | 219.1737 | 72.4515 | 300.3574 | 103.6825 |
| 24377 | 74.2526 | 132.3789 | 16.8133 | 162.7667 | 44.4157 |
| 10517 | 74.2526 | 48.0038 | 5.1735 | 52.4509 | 16.3429 |
| 15545 | 74.2441 | 24.7379 | 9.2089 | 16.0894 | 11.0470 |
| 2629 | 74.2399 | 300.3459 | 124.3567 | 198.4732 | 120.2287 |
| 18490 | 74.1931 | 155.2598 | 24.6857 | 135.5154 | 33.1712 |
| 16085 | 74.1762 | 180.2121 | 67.2824 | 95.9216 | 49.7478 |
| 21657 | 74.1379 | 560.9604 | 164.9586 | 891.6673 | 406.5498 |
| 20951 | 74.1337 | 15.1066 | 11.1272 | 37.2115 | 25.1213 |
| 1105 | 74.0785 | 27.7314 | 13.5270 | 28.0817 | 30.2449 |

TABLE 5NN-continued

Peroxisome Prolif.
Timepoint(s): Various

| GLGC ID NO. | LDA Score | Mean Tox | SD Tox | Mean Nontox | SD Nontox |
|---|---|---|---|---|---|
| 455 | 74.0785 | 139.8100 | 33.9161 | 240.2695 | 147.6721 |
| 8663 | 74.0190 | −44.2808 | 15.2883 | 34.0349 | 159.0256 |
| 1712 | 73.8959 | 144.3361 | 22.2200 | 139.1354 | 50.5814 |
| 7266 | 73.8916 | 452.7692 | 67.3810 | 373.3571 | 114.4017 |
| 19696 | 73.7770 | 18.9611 | 4.8432 | 22.1058 | 10.4668 |
| 7914 | 73.7175 | 44.7176 | 18.0842 | 75.4719 | 35.3386 |
| 3254 | 73.7175 | 519.7501 | 64.5899 | 481.0928 | 127.7937 |
| 9254 | 73.7175 | 80.7448 | 15.5041 | 104.5317 | 30.3013 |
| 21011 | 73.7175 | 3290.0082 | 589.8038 | 4556.3964 | 1710.1817 |
| 9073 | 73.7175 | 33.3095 | 5.3631 | 39.1851 | 18.4820 |
| 19486 | 73.7175 | 42.5449 | 5.1592 | 42.9853 | 13.6772 |
| 561 | 73.6581 | 121.1746 | 21.3529 | 144.4137 | 41.1660 |
| 17123 | 73.5986 | 319.6412 | 29.9245 | 302.0121 | 69.4160 |
| 18395 | 73.5986 | 151.8395 | 17.2008 | 169.0055 | 46.6869 |
| 8277 | 73.5392 | 190.3479 | 21.8408 | 167.3931 | 39.0009 |
| 11455 | 73.4755 | 154.3256 | 30.8823 | 125.4701 | 69.3438 |
| 21090 | 73.4202 | 70.6546 | 30.7575 | 109.5320 | 49.2733 |
| 18050 | 73.4202 | 62.4132 | 8.1159 | 61.3400 | 28.7652 |
| 15035 | 73.4160 | 86.6509 | 27.4557 | 66.9224 | 39.0475 |
| 18667 | 73.3650 | 35.8000 | 6.7329 | 39.2679 | 18.9981 |
| 2331 | 92.3858 | 1517.1174 | 786.7751 | 271.3670 | 322.5522 |
| 23541 | 87.2134 | 383.8332 | 50.0560 | 278.5867 | 187.3603 |
| 16169 | 86.2579 | 5341.4124 | 1639.2310 | 2742.0200 | 1348.3251 |
| 21593 | 86.2026 | 406.2272 | 75.5527 | 243.9546 | 93.2026 |
| 3597 | 84.0029 | 36.9789 | 19.4002 | 9.2053 | 23.1754 |
| 14763 | 83.9349 | 1602.4111 | 719.6398 | 536.3378 | 543.0679 |
| 6347 | 83.6462 | 284.8249 | 44.9198 | 211.9513 | 55.0996 |
| 6198 | 82.5803 | 91.6780 | 14.7108 | 124.2920 | 54.8248 |
| 19718 | 81.9263 | 46.6930 | 4.3836 | 37.9819 | 26.1709 |
| 18826 | 81.6757 | 3492.4854 | 1340.9523 | 1802.1180 | 893.2655 |
| 2501 | 81.3275 | 166.4521 | 14.2693 | 148.2138 | 50.0027 |
| 17668 | 81.2128 | 99.4798 | 30.1154 | 97.3989 | 102.0160 |
| 12223 | 81.0302 | 474.5644 | 76.3302 | 355.3771 | 97.9129 |
| 8759 | 80.9580 | 295.0525 | 172.0974 | 93.8107 | 142.6451 |
| 22793 | 80.7372 | 171.9039 | 38.2751 | 114.3082 | 70.9383 |
| 22688 | 80.6141 | 70.3886 | 38.2797 | 190.6117 | 109.2493 |
| 12863 | 80.1427 | 32.3991 | 6.0598 | 51.0893 | 24.6062 |
| 14902 | 79.9601 | 121.1314 | 24.8770 | 168.9708 | 39.9535 |
| 11028 | 79.9049 | 29.0030 | 9.9210 | 55.6180 | 30.9338 |
| 22885 | 79.8964 | 1326.8246 | 538.5187 | 2211.8571 | 683.0980 |
| 10724 | 79.7265 | 22.6085 | 5.8976 | 39.0323 | 24.5835 |
| 11270 | 79.6586 | 108.4228 | 16.0731 | 73.7778 | 54.6678 |
| 2655 | 79.6034 | 1288.9743 | 262.7846 | 942.0609 | 472.0516 |
| 14911 | 79.5354 | 251.6394 | 88.7633 | 146.7471 | 77.6922 |
| 10923 | 79.4293 | 20.8113 | 4.4594 | 26.9056 | 18.7606 |
| 5198 | 79.3656 | 320.2161 | 78.3966 | 250.0550 | 164.5816 |
| 22268 | 78.9494 | 23.2384 | 20.1898 | 57.9323 | 39.9111 |
| 2825 | 78.9494 | 205.8289 | 23.6668 | 166.9881 | 51.4256 |
| 6268 | 78.7158 | 156.5834 | 21.5621 | 152.2829 | 55.4817 |
| 23099 | 78.7116 | 283.3297 | 33.5517 | 253.8040 | 112.5789 |
| 15655 | 78.6521 | 32.5396 | 6.9911 | 20.4413 | 22.9366 |
| 19063 | 78.5332 | 199.4999 | 14.3447 | 200.4805 | 55.8799 |
| 4877 | 78.4185 | 157.8528 | 44.3489 | 285.8035 | 154.5576 |
| 8314 | 78.3464 | 1874.4062 | 811.7529 | 1181.4276 | 675.6475 |
| 14743 | 78.2402 | 29.9267 | 6.4082 | 29.9233 | 28.3392 |
| 16128 | 78.0513 | 353.5840 | 55.5609 | 286.2976 | 64.9407 |
| 17861 | 77.9259 | 86.9809 | 30.1695 | 53.6356 | 23.8978 |
| 4004 | 77.8835 | 237.0301 | 82.7260 | 371.9543 | 169.7009 |
| 6799 | 77.7603 | 136.3316 | 26.9484 | 102.6565 | 42.6740 |
| 11729 | 77.7561 | 281.0616 | 45.1604 | 225.9030 | 52.8233 |
| 13977 | 77.6329 | 420.9243 | 230.5922 | 478.2180 | 153.3476 |
| 11901 | 77.5820 | 624.8398 | 84.0775 | 472.2110 | 173.0209 |
| 23124 | 77.5777 | 82.0552 | 23.5805 | 121.1877 | 34.8553 |
| 8917 | 77.5055 | 164.7281 | 77.9283 | 52.2599 | 41.4488 |
| 14717 | 77.4631 | 530.9520 | 49.7675 | 634.7687 | 122.7478 |
| 21661 | 77.4078 | 613.5280 | 142.8058 | 1091.8751 | 590.0762 |
| 15981 | 77.3484 | 55.2763 | 8.4631 | 56.2611 | 25.4138 |
| 23553 | 77.2252 | 48.5883 | 13.5610 | 47.8383 | 40.1371 |
| 7806 | 77.2210 | 167.9940 | 48.4181 | 128.4024 | 52.7160 |
| 7741 | 77.1658 | 104.6897 | 11.5086 | 122.8710 | 47.4839 |
| 23043 | 77.1063 | 295.7834 | 37.2768 | 278.1222 | 83.7112 |
| 22233 | 77.0936 | 729.6806 | 162.2083 | 566.1615 | 122.1263 |
| 3991 | 77.0511 | 33.1801 | 7.3239 | 28.4545 | 27.9650 |
| 10665 | 77.0341 | 243.9692 | 81.2514 | 156.0302 | 65.5081 |
| 22065 | 76.9322 | 919.4732 | 177.5527 | 1175.1615 | 329.6012 |
| 14187 | 76.8685 | 103.2077 | 17.2902 | 117.2611 | 66.3551 |
| 6039 | 76.7496 | 890.4421 | 84.8289 | 898.7258 | 231.0628 |
| 14923 | 76.6902 | 462.3856 | 105.1810 | 345.9852 | 206.6330 |
| 3557 | 76.6902 | 118.6593 | 11.4322 | 113.4772 | 35.3645 |
| 8590 | 76.6307 | 517.1463 | 118.0956 | 375.3916 | 201.0728 |
| 15308 | 76.6265 | 81.0025 | 46.8768 | 142.6579 | 55.6353 |
| 20857 | 76.3929 | 39.4898 | 18.0327 | 68.4858 | 30.5139 |
| 9575 | 76.3334 | 827.3069 | 65.9879 | 782.3294 | 190.4231 |
| 20901 | 76.3334 | 118.0553 | 14.1417 | 137.6982 | 34.3281 |
| 15016 | 76.2740 | 1128.0619 | 163.2019 | 964.1729 | 310.8262 |
| 18696 | 76.2103 | 176.9453 | 29.0944 | 236.3701 | 59.0067 |
| 23447 | 76.1593 | 60.3744 | 10.7296 | 61.0540 | 26.6462 |

TABLE 5OO

PHENOBARBITAL
Timepoint(s): 24 hrs

| GLGC ID NO. | LDA Score | Mean Tox | SD Tox | Mean Nontox | SD Nontox |
|---|---|---|---|---|---|
| 18702 | 100.0000 | 225.1067 | 3.7274 | 71.9180 | 29.2478 |
| 17598 | 100.0000 | 91.0233 | 3.0182 | −12.8744 | 38.1015 |
| 19675 | 99.9413 | 95.6800 | 15.1661 | 13.3462 | 15.2759 |
| 1783 | 99.8239 | 44.7600 | 6.7168 | −17.3986 | 13.6213 |
| 16514 | 99.7653 | 514.9400 | 5.5043 | 335.4483 | 71.4689 |
| 25567 | 99.7653 | 1287.9133 | 30.9060 | 426.5708 | 176.2910 |
| 20389 | 99.7653 | 34.6533 | 0.8376 | 10.1304 | 8.2366 |
| 3430 | 99.7066 | 1332.5833 | 41.4309 | 499.3650 | 178.5283 |
| 15857 | 99.7066 | 273.4300 | 1.2646 | 171.4739 | 45.3854 |
| 16610 | 99.7066 | 907.1133 | 30.1060 | 435.2142 | 143.1046 |
| 16157 | 99.7066 | 57.3067 | 1.2838 | 26.2247 | 9.8195 |
| 17052 | 99.6479 | 202.2267 | 10.0315 | 92.9090 | 27.0155 |
| 16327 | 99.5305 | 72.6400 | 1.2347 | 170.7202 | 53.0745 |
| 12363 | 99.4718 | 125.4300 | 0.3780 | 184.5832 | 39.5870 |
| 25260 | 99.4718 | 209.3300 | 17.5413 | 63.9036 | 27.7891 |
| 17367 | 99.4131 | 40.8367 | 1.1836 | 19.8781 | 7.9150 |
| 21576 | 99.4131 | 250.5167 | 13.2052 | 132.7633 | 32.1223 |
| 1580 | 99.4131 | 96.9433 | 3.0954 | 42.3922 | 23.8352 |
| 17088 | 99.3545 | 955.5467 | 45.1289 | 350.0885 | 132.5608 |
| 20443 | 99.3545 | 235.3500 | 6.2496 | 136.0867 | 37.7856 |
| 25071 | 99.3545 | 2086.2567 | 356.2937 | 412.2394 | 242.6002 |
| 812 | 99.3545 | 22.5667 | 0.4754 | 54.7419 | 23.8784 |
| 16809 | 99.2958 | 114.4967 | 2.2106 | 63.4169 | 26.0209 |
| 17597 | 99.2958 | 177.4233 | 5.5743 | 76.5205 | 27.0915 |
| 798 | 99.2371 | 157.6533 | 11.0023 | 52.2778 | 21.7573 |
| 18061 | 99.2371 | 353.5400 | 24.5809 | 178.3846 | 43.2060 |
| 20984 | 99.2371 | 59.2433 | 0.7497 | 149.8320 | 147.8305 |
| 16346 | 99.1784 | 330.6167 | 8.8804 | 160.5343 | 65.6205 |
| 20980 | 99.1784 | 204.1300 | 10.4729 | 105.9528 | 27.2506 |
| 1785 | 99.1784 | 111.2467 | 2.9776 | 55.9623 | 21.7677 |
| 17508 | 99.1784 | 124.5033 | 8.3205 | 55.7001 | 19.2845 |
| 1586 | 99.1197 | 181.0100 | 2.8987 | 111.0348 | 29.8706 |
| 1734 | 99.1197 | 32.8567 | 0.7650 | 76.0878 | 35.4319 |
| 4407 | 99.0610 | 512.9367 | 32.7299 | 174.3866 | 92.2597 |
| 797 | 99.0610 | 241.6533 | 35.3009 | 83.3036 | 31.7171 |
| 18726 | 99.0610 | 47.1567 | 5.9271 | 194.7340 | 85.1875 |
| 5048 | 99.0023 | 99.9367 | 1.1754 | 63.0890 | 18.7245 |
| 1309 | 99.0023 | 127.4133 | 6.7823 | 56.1040 | 22.4340 |
| 19148 | 99.0023 | 289.5333 | 7.5634 | 183.0517 | 43.4568 |
| 1126 | 99.0023 | 89.0400 | 1.5156 | 50.1240 | 18.7593 |
| 14213 | 99.0023 | 64.0567 | 7.6038 | 2.3430 | 26.0389 |
| 23926 | 99.0023 | 81.4733 | 19.3964 | 8.5752 | 60.4103 |
| 4832 | 98.9437 | 88.1533 | 0.7286 | 50.4232 | 20.1291 |
| 20150 | 98.9437 | 28.4100 | 1.2771 | 9.0343 | 8.3965 |
| 25907 | 98.9437 | 174.0167 | 3.9305 | 79.7012 | 49.5565 |
| 1045 | 98.8850 | 192.4533 | 9.5062 | 84.2679 | 26.5960 |
| 17171 | 98.8850 | 1313.2333 | 198.8186 | 384.5224 | 174.0695 |

TABLE 5OO-continued

PHENOBARBITAL
Timepoint(s): 24 hrs

| GLGC ID NO. | LDA Score | Mean Tox | SD Tox | Mean Nontox | SD Nontox |
|---|---|---|---|---|---|
| 17382 | 98.8850 | 445.4133 | 6.0995 | 274.8817 | 103.9189 |
| 15475 | 98.8850 | 51.1200 | 7.4177 | 14.4313 | 8.9215 |
| 20702 | 98.8263 | 148.1367 | 7.9878 | 50.6424 | 29.1397 |
| 24033 | 98.8263 | 141.9967 | 7.6980 | 67.8542 | 22.7707 |
| 18069 | 98.8263 | 144.5367 | 27.2606 | 27.6259 | 24.0591 |
| 17661 | 98.8263 | 526.8367 | 21.1796 | 308.9286 | 82.7410 |
| 570 | 98.8263 | 509.8867 | 25.3921 | 258.2416 | 80.3078 |
| 24228 | 98.8263 | 280.3067 | 3.5241 | 453.1020 | 127.3325 |
| 19823 | 98.7676 | 47.8833 | 0.6161 | 24.8010 | 13.3966 |
| 11423 | 98.7676 | 73.1867 | 1.2832 | 37.4252 | 16.2489 |
| 18468 | 98.7676 | 173.9267 | 10.7717 | 66.9599 | 47.5391 |
| 11296 | 98.7676 | 167.9967 | 2.7717 | 114.4154 | 38.9384 |
| 11358 | 98.7089 | 108.7933 | 8.1836 | 36.7604 | 25.5974 |
| 11317 | 98.7089 | 28.5967 | 4.5008 | 0.9232 | 9.5796 |
| 20801 | 98.7089 | 521.9133 | 23.7858 | 223.1453 | 102.8546 |
| 23869 | 98.7089 | 12.4733 | 1.2947 | 168.6124 | 165.5488 |
| 16871 | 98.7089 | 63.0767 | 4.7420 | 23.0774 | 13.1847 |
| 815 | 98.7089 | 3100.5633 | 9.4215 | 2944.1241 | 656.8888 |
| 20161 | 98.7089 | 29.8733 | 0.3691 | 75.6303 | 55.5762 |
| 1448 | 98.6502 | 1693.4067 | 15.9351 | 1256.4641 | 214.8845 |
| 11494 | 98.6502 | 788.2800 | 156.3945 | 168.3581 | 140.5692 |
| 21696 | 98.6502 | 635.0933 | 37.2765 | 366.5898 | 90.9816 |
| 13092 | 98.6502 | 379.5700 | 18.2319 | 215.7547 | 56.3006 |
| 23868 | 98.5915 | 51.3467 | 12.0481 | 579.0532 | 534.4164 |
| 21586 | 98.5915 | 348.2300 | 31.6686 | 135.7485 | 57.8534 |
| 21703 | 98.5915 | 174.9200 | 10.7058 | 102.6012 | 23.4396 |
| 16413 | 98.5915 | 20.9900 | 10.4467 | −53.2136 | 48.9713 |
| 114 | 98.5329 | 60.8067 | 3.6967 | 17.5627 | 13.8269 |
| 25204 | 98.5329 | 25.6900 | 1.3406 | 106.5336 | 56.2727 |
| 7864 | 98.5329 | 1682.8400 | 11.4389 | 1387.8805 | 212.9802 |
| 1305 | 98.5329 | 33.8633 | 0.4200 | 22.3541 | 21.0166 |
| 3203 | 98.4742 | 1078.9733 | 61.7950 | 639.8670 | 144.1360 |
| 16180 | 98.4742 | 33.7900 | 1.4730 | 94.9956 | 43.1011 |
| 20772 | 98.4742 | 186.0733 | 4.9311 | 115.8452 | 32.4829 |
| 18179 | 98.4742 | 21.5367 | 5.0517 | −1.9587 | 8.4773 |
| 20744 | 98.4155 | 108.9400 | 2.4582 | 73.6237 | 48.1305 |
| 15683 | 98.2981 | 223.5633 | 33.7453 | 78.3100 | 39.1447 |
| 11493 | 98.2981 | 234.7467 | 71.5950 | 33.2412 | 52.2384 |
| 1579 | 98.2981 | 64.4400 | 9.9870 | 23.8259 | 14.5340 |
| 19744 | 98.2981 | 33.7300 | 4.1947 | 1.3672 | 14.2749 |
| 24628 | 98.2981 | 162.9133 | 2.1658 | 239.2929 | 51.7801 |
| 19712 | 98.2394 | 13.4000 | 0.2869 | 28.4824 | 16.9197 |
| 4256 | 98.2394 | 76.3467 | 13.0668 | 8.4451 | 21.6276 |
| 17858 | 98.2394 | 128.4300 | 2.9951 | 190.8795 | 37.4062 |
| 9254 | 98.2394 | 50.7600 | 3.3793 | 104.3302 | 30.1499 |
| 626 | 98.2394 | 239.8733 | 20.0350 | 89.1319 | 74.8411 |
| 15579 | 98.1808 | 14.6967 | 6.9182 | 598.3967 | 504.9746 |
| 18098 | 98.1221 | 68.8133 | 1.7033 | 41.9745 | 13.3971 |
| 23070 | 98.1221 | 348.9900 | 6.7083 | 239.5144 | 58.2984 |
| 13543 | 98.0634 | 537.6033 | 48.6319 | 320.7175 | 70.4617 |
| 2801 | 98.0634 | 237.4333 | 12.0570 | 109.6303 | 62.2035 |
| 1569 | 98.0634 | 88.2967 | 13.4739 | −7.9747 | 46.5420 |
| 16450 | 98.0634 | 237.0033 | 5.7402 | 151.6017 | 64.0950 |
| 23023 | 99.9413 | 14.1733 | 0.0252 | 41.2746 | 18.2511 |
| 22372 | 99.9413 | 993.4900 | 7.6368 | 305.5506 | 125.6298 |
| 21822 | 99.8826 | 1342.1733 | 34.2174 | 654.3701 | 186.2635 |
| 4983 | 99.8826 | 504.4033 | 18.0930 | 144.1978 | 102.2454 |
| 21208 | 99.8239 | 97.8700 | 6.8379 | −1.0994 | 23.1240 |
| 3558 | 99.7653 | 412.6500 | 5.2562 | 192.9978 | 62.2566 |
| 5876 | 99.7066 | 442.8667 | 0.5408 | 599.4852 | 244.0400 |
| 4119 | 99.7066 | 219.9967 | 0.2335 | 178.3105 | 65.2194 |
| 13879 | 99.6479 | 206.8767 | 15.4656 | 66.2265 | 26.8840 |
| 7596 | 99.6479 | 348.9867 | 11.1955 | 162.0247 | 57.0973 |
| 18466 | 99.5892 | 402.3733 | 26.5128 | 108.8541 | 58.4569 |
| 2340 | 99.5892 | 228.6400 | 7.1754 | −69.7332 | 153.7308 |
| 5615 | 99.5892 | 300.2033 | 19.2736 | 70.6303 | 34.7182 |
| 21883 | 99.5892 | 374.9367 | 39.1587 | 72.4107 | 45.7184 |
| 9492 | 99.5305 | 137.2733 | 1.8119 | 83.0409 | 24.2309 |
| 21853 | 99.5305 | 20.6300 | 3.7165 | −59.8947 | 40.5864 |
| 17820 | 99.5305 | 172.8867 | 4.1793 | 77.3554 | 33.1217 |
| 18254 | 99.4718 | 51.8533 | 4.5093 | 2.2803 | 22.4468 |
| 7583 | 99.4718 | 60.6500 | 0.5274 | 50.0166 | 63.6190 |
| 7793 | 99.4718 | 125.7233 | 10.7996 | 295.8028 | 86.6279 |
| 22075 | 99.4131 | 337.8367 | 3.8951 | 195.9980 | 58.2888 |
| 21968 | 99.4131 | 1226.9400 | 149.9360 | 274.2234 | 192.0222 |
| 4931 | 99.4131 | 194.2867 | 18.6601 | 35.7153 | 57.3142 |
| 12342 | 99.3545 | 306.7800 | 7.0936 | 137.2887 | 61.3538 |
| 19041 | 99.3545 | 388.5200 | 5.9537 | 213.4117 | 60.0690 |
| 19827 | 99.3545 | 380.0000 | 15.2840 | 1015.1311 | 600.5093 |
| 17768 | 99.3545 | 938.4000 | 41.3457 | 600.8241 | 151.2120 |
| 7043 | 99.3545 | 308.8833 | 26.9154 | 113.0749 | 43.0522 |
| 7307 | 99.2958 | 159.5167 | 7.9203 | 70.0674 | 28.7267 |
| 14596 | 99.2958 | 76.2133 | 5.3665 | 24.9157 | 14.2900 |
| 15399 | 99.2958 | 400.4167 | 42.1624 | 185.0000 | 47.2645 |
| 10106 | 99.2958 | 46.2067 | 0.4310 | 85.2417 | 31.3500 |
| 3827 | 99.2958 | 369.6167 | 21.6183 | 121.9604 | 85.9681 |
| 11180 | 99.2371 | 328.4467 | 14.9447 | 122.8410 | 71.2747 |
| 3246 | 99.2371 | 257.1167 | 9.7966 | 103.3158 | 56.0603 |
| 16580 | 99.1784 | 582.8233 | 20.5297 | 276.1437 | 96.5156 |
| 15029 | 99.1784 | 38.4033 | 3.3194 | 164.6743 | 73.6902 |
| 7912 | 99.1784 | 145.8033 | 12.3336 | 58.3178 | 27.1062 |
| 23034 | 99.1784 | 174.5867 | 6.3180 | 71.5438 | 37.0341 |
| 18535 | 99.1197 | 725.2300 | 95.8109 | 233.2779 | 95.8979 |
| 15582 | 99.1197 | 14.3833 | 10.3308 | 1664.0208 | 1548.2096 |
| 23435 | 99.1197 | 346.5833 | 12.5881 | 138.7576 | 100.2538 |
| 10110 | 99.1197 | 60.4267 | 1.0808 | 129.8492 | 54.3359 |
| 19480 | 99.1197 | 143.6467 | 5.3176 | 300.4449 | 89.4172 |
| 13006 | 99.0610 | 112.0700 | 10.2911 | −8.2870 | 45.5605 |
| 18777 | 99.0610 | 181.9600 | 8.8978 | 42.6582 | 54.3040 |
| 21667 | 99.0610 | 53.8467 | 0.4225 | 33.1529 | 20.2649 |
| 7104 | 99.0610 | 242.6367 | 18.9004 | 509.9274 | 149.8265 |
| 20577 | 99.0023 | 174.2167 | 1.6384 | 70.5272 | 83.3347 |
| 12011 | 99.0023 | 110.1933 | 14.6591 | 357.0211 | 92.0900 |
| 17335 | 99.0023 | 198.3733 | 3.6147 | 119.5997 | 36.2285 |
| 16027 | 99.0023 | 331.2667 | 9.7572 | 183.5997 | 55.9349 |
| 22558 | 99.0023 | 103.3600 | 8.2293 | 548.3316 | 312.5418 |
| 8018 | 99.0023 | 343.6067 | 57.1963 | 139.7496 | 40.1245 |
| 19418 | 98.9437 | 134.6567 | 0.4405 | 136.8561 | 57.4271 |
| 13617 | 98.9437 | 142.4433 | 2.5936 | 73.0426 | 41.1995 |
| 6226 | 98.9437 | 103.3233 | 35.7003 | 4.0885 | 9.3021 |
| 23659 | 98.9437 | 384.4200 | 33.7842 | 126.7757 | 71.6257 |

TABLE 5PP

PHENOBARBITAL
Timepoint(s): 3, 6 hrs

| GLGC ID NO. | LDA Score | Mean Tox | SD Tox | Mean Nontox | SD Nontox |
|---|---|---|---|---|---|
| 4407 | 96.3486 | 395.4550 | 65.8401 | 174.0206 | 92.6202 |
| 23192 | 95.5241 | 452.7150 | 27.2763 | 284.0135 | 84.8301 |
| 14295 | 94.1107 | 67.9450 | 13.6080 | 33.6149 | 16.6182 |
| 21120 | 93.8163 | 357.0317 | 24.8250 | 238.1310 | 77.5156 |
| 7170 | 93.4040 | 105.2833 | 17.1796 | 66.3770 | 19.0398 |
| 24881 | 92.6384 | 24.7217 | 1.2115 | 40.6897 | 21.2339 |
| 797 | 92.0495 | 126.1317 | 14.9440 | 83.5605 | 32.9669 |
| 16241 | 91.9906 | 11.4067 | 2.6291 | 22.8817 | 8.0129 |
| 18442 | 91.9317 | 77.0600 | 16.0677 | 48.9086 | 18.8366 |
| 19443 | 91.7917 | 576.5300 | 55.9964 | 384.4212 | 132.0764 |
| 15703 | 91.7550 | 57.7917 | 9.6831 | 27.3159 | 16.5182 |
| 21663 | 91.6372 | 612.7783 | 31.4937 | 440.3137 | 126.2564 |
| 24582 | 91.5783 | 126.2317 | 22.4264 | 74.0888 | 30.1453 |
| 866 | 91.5783 | 80.9333 | 13.1873 | 153.8389 | 51.5512 |
| 21951 | 91.4605 | 219.4817 | 29.8799 | 139.3694 | 49.4604 |
| 25531 | 91.3428 | 25.5017 | 1.1561 | 22.0592 | 10.7837 |
| 20456 | 91.2839 | 238.0700 | 39.0056 | 138.1216 | 62.0538 |
| 3430 | 90.5771 | 709.2600 | 101.9248 | 500.8258 | 184.5809 |
| 24377 | 90.4005 | 110.0900 | 9.3035 | 162.6379 | 44.1991 |
| 798 | 90.2238 | 75.8767 | 9.7197 | 52.4834 | 22.5850 |
| 17636 | 89.9882 | 21.9967 | 3.5497 | 27.2343 | 28.7822 |
| 1058 | 89.8704 | 273.4933 | 57.8084 | 180.3505 | 114.2739 |
| 15023 | 89.6938 | 267.7933 | 16.5718 | 360.9634 | 83.6008 |

TABLE 5PP-continued

PHENOBARBITAL
Timepoint(s): 3, 6 hrs

| GLGC ID NO. | LDA Score | Mean Tox | SD Tox | Meam Nontox | SD Nontox |
|---|---|---|---|---|---|
| 1569 | 89.6349 | 53.2400 | 22.1360 | −8.0671 | 46.6651 |
| 11975 | 89.5760 | 31.9550 | 9.2013 | 7.5501 | 18.9452 |
| 14213 | 89.3993 | 32.0567 | 6.7178 | 2.3511 | 26.2206 |
| 14066 | 89.3404 | 68.7383 | 5.9962 | 100.2889 | 28.4272 |
| 1053 | 89.3404 | 38.2883 | 3.3043 | 57.2265 | 37.3100 |
| 1678 | 89.2815 | 31.3883 | 4.5857 | 39.9670 | 42.2754 |
| 1586 | 89.1637 | 149.0250 | 11.9358 | 111.0136 | 30.0283 |
| 15009 | 89.1048 | 6.4367 | 2.8005 | 24.4854 | 14.5933 |
| 17657 | 88.6926 | 51.1683 | 8.7016 | 24.9940 | 26.1930 |
| 19768 | 88.6337 | 762.5917 | 29.3263 | 680.7383 | 183.5494 |
| 19222 | 88.6337 | 1016.4983 | 47.6021 | 863.6054 | 183.3232 |
| 17590 | 88.6337 | 254.8667 | 8.0494 | 222.5550 | 41.8596 |
| 16684 | 88.5748 | 1342.9233 | 89.6150 | 1065.5421 | 221.0828 |
| 21842 | 88.5159 | 667.5100 | 126.1341 | 479.7396 | 262.4281 |
| 22927 | 88.5159 | 57.6800 | 3.9710 | 50.0739 | 20.7307 |
| 1578 | 88.5159 | 24.7600 | 2.0148 | 23.4925 | 14.2561 |
| 21864 | 88.4570 | 137.8450 | 23.1646 | 87.8379 | 34.3728 |
| 12348 | 88.2803 | 303.1633 | 20.7447 | 258.8029 | 67.1868 |
| 1558 | 88.2214 | 86.4283 | 6.5077 | 71.6577 | 35.8701 |
| 1302 | 88.1625 | 199.2817 | 46.4679 | 113.0512 | 175.0560 |
| 25700 | 88.0448 | 46.7183 | 7.1409 | 91.4354 | 49.8908 |
| 1764 | 87.9859 | 247.9150 | 37.0435 | 171.1781 | 53.8641 |
| 14300 | 87.9270 | 8.5217 | 4.1702 | 30.1439 | 17.6914 |
| 23044 | 87.9270 | 82.1050 | 8.5017 | 121.8644 | 36.5958 |
| 8427 | 87.8681 | 101.9817 | 11.5440 | 72.6342 | 36.4304 |
| 22813 | 87.8681 | 64.8033 | 7.2348 | 49.8179 | 32.4204 |
| 2078 | 87.8681 | 180.2883 | 16.6676 | 240.9317 | 62.6361 |
| 4474 | 87.7503 | 131.4750 | 19.1233 | 85.5978 | 36.9258 |
| 18572 | 87.7503 | 502.0983 | 24.3683 | 618.2184 | 126.7957 |
| 6128 | 87.6914 | 47.1933 | 3.0485 | 41.0922 | 15.6509 |
| 6127 | 87.6325 | 29.2217 | 3.0300 | 19.2731 | 11.0980 |
| 322 | 87.5736 | 315.2583 | 101.7477 | 167.6254 | 179.5607 |
| 17908 | 87.5147 | 631.4850 | 99.8304 | 448.8885 | 272.2225 |
| 21623 | 87.5147 | 1849.5617 | 285.7510 | 2640.6595 | 526.6026 |
| 25934 | 87.5147 | 108.3600 | 11.2170 | 78.2071 | 30.6302 |
| 17473 | 87.4558 | 726.6917 | 65.3995 | 549.8209 | 163.0577 |
| 24344 | 87.4558 | 24.3100 | 3.0090 | 15.0805 | 16.2966 |
| 18561 | 87.3969 | 103.7367 | 14.6907 | 71.0113 | 25.3026 |
| 17316 | 87.3675 | 92.9033 | 41.9868 | 35.0549 | 27.6487 |
| 24897 | 87.3380 | 33.2817 | 5.0574 | 51.1797 | 16.0051 |
| 26032 | 87.3380 | 549.2150 | 41.8194 | 500.2287 | 440.0381 |
| 17203 | 87.2203 | 849.8833 | 50.7371 | 700.0617 | 198.7016 |
| 25758 | 87.1025 | 8.8067 | 6.3127 | 25.0490 | 12.2567 |
| 15247 | 87.1025 | 28.2567 | 10.0770 | 87.8161 | 67.6582 |
| 317 | 87.1025 | 28.7867 | 2.6384 | 36.8688 | 21.1191 |
| 1894 | 87.0436 | 33.2667 | 5.5639 | 43.9040 | 35.0514 |
| 8426 | 86.9847 | 165.3650 | 18.4056 | 118.2176 | 49.8346 |
| 713 | 86.9258 | 61.6683 | 17.7126 | 29.5460 | 47.2611 |
| 25120 | 86.9258 | 16.2367 | 1.3500 | 20.0574 | 9.9894 |
| 17727 | 86.9258 | 69.8133 | 5.4972 | 60.8142 | 22.4131 |
| 20740 | 86.8669 | 1095.0650 | 159.1367 | 819.4514 | 345.4374 |
| 17920 | 86.8669 | 33.0983 | 8.3065 | 61.4228 | 23.5103 |
| 13160 | 86.8080 | 63.0217 | 12.0218 | 91.0576 | 22.2981 |
| 23220 | 86.8080 | 91.2283 | 6.6678 | 71.7726 | 21.5988 |
| 8107 | 86.7491 | 35.0667 | 4.2768 | 53.0259 | 18.8437 |
| 6967 | 86.7491 | 356.6400 | 11.2272 | 360.8622 | 75.1059 |
| 24423 | 86.7491 | 60.1067 | 6.0386 | 59.7485 | 32.6172 |
| 24735 | 86.6902 | 29.3517 | 1.7515 | 37.2044 | 13.5864 |
| 17480 | 86.6902 | 29.8967 | 4.1483 | 48.3796 | 34.2764 |
| 25639 | 86.6902 | 21.1433 | 6.6639 | −5.3925 | 22.1412 |
| 25793 | 86.5724 | 15.7550 | 7.2352 | 38.1074 | 18.3617 |
| 24427 | 86.5724 | 83.1600 | 7.6888 | 116.6971 | 36.2771 |
| 11239 | 86.5724 | 45.2917 | 4.9620 | 66.2497 | 21.0172 |
| 9842 | 86.4547 | 778.1100 | 111.6739 | 526.1685 | 210.3246 |
| 11358 | 86.4547 | 50.4650 | 6.7320 | 36.9180 | 25.9699 |
| 4524 | 86.4547 | 93.2867 | 10.2085 | 71.2375 | 30.9195 |
| 19649 | 86.3958 | 30.0233 | 3.3875 | 42.4531 | 14.7812 |
| 20753 | 86.3958 | 485.7467 | 38.7951 | 362.5901 | 118.8008 |
| 23563 | 86.3369 | 28.9983 | 6.3737 | 7.7635 | 28.0337 |
| 1131 | 86.2780 | 197.2400 | 20.6792 | 150.0651 | 42.8772 |
| 15629 | 86.2780 | 38.1633 | 5.8804 | 64.7312 | 28.4091 |
| 20702 | 86.2191 | 66.7083 | 9.2157 | 50.8733 | 29.7241 |
| 436 | 86.1013 | 109.2083 | 14.3536 | 78.3475 | 24.2797 |
| 18898 | 86.1013 | 73.9867 | 4.6392 | 67.6641 | 20.0070 |
| 26012 | 85.9835 | 4.6750 | 3.6080 | 20.3717 | 14.7448 |
| 1640 | 85.9835 | 30.7583 | 4.5124 | 34.6732 | 23.2584 |
| 18494 | 85.9246 | 131.1500 | 11.2742 | 128.8468 | 49.4198 |
| 21409 | 95.7597 | 266.3033 | 15.8457 | 153.1239 | 68.3114 |
| 6044 | 94.8174 | 783.5067 | 15.8705 | 622.4593 | 135.5204 |
| 8053 | 94.6996 | 415.5983 | 44.1993 | 210.8615 | 118.2898 |
| 13401 | 94.5819 | 47.1967 | 3.0137 | 25.5906 | 16.3073 |
| 14375 | 94.4641 | 165.0800 | 29.6997 | 86.9849 | 32.3799 |
| 18406 | 94.3463 | 98.8733 | 10.2641 | 49.0038 | 27.7333 |
| 17210 | 94.0518 | 210.9617 | 14.6953 | 138.0324 | 44.7156 |
| 11870 | 93.9340 | 487.7750 | 25.9381 | 946.9646 | 818.1707 |
| 17540 | 93.9340 | 1961.1733 | 200.8557 | 1146.0335 | 425.7501 |
| 7171 | 93.8751 | 368.1850 | 28.1205 | 237.7318 | 68.3220 |
| 11596 | 93.8163 | 60.6533 | 3.0436 | 103.0055 | 46.6734 |
| 19271 | 93.8163 | 419.4033 | 35.4474 | 279.2055 | 96.6563 |
| 21390 | 93.7574 | 380.8233 | 90.3442 | 193.7824 | 82.0631 |
| 3477 | 93.7574 | 118.7317 | 18.0895 | 57.9498 | 74.3034 |
| 5999 | 93.6985 | 91.8767 | 6.6790 | 201.5907 | 112.9905 |
| 8081 | 93.5807 | 79.6667 | 7.1812 | 131.0524 | 44.1763 |
| 7434 | 93.5218 | 548.3750 | 42.6663 | 335.0612 | 120.9031 |
| 23944 | 93.4040 | 677.8500 | 45.4018 | 499.1061 | 134.3490 |
| 24604 | 93.4040 | 121.4433 | 15.1830 | 79.7727 | 73.0805 |
| 23034 | 93.4040 | 132.6850 | 13.8055 | 71.4759 | 37.2351 |
| 8048 | 93.2862 | 134.1633 | 12.5851 | 73.6077 | 36.0260 |
| 16609 | 93.0506 | 225.9067 | 11.7104 | 330.2502 | 93.5395 |
| 16409 | 92.7562 | 89.9900 | 19.6646 | 1.6079 | 59.8891 |
| 23542 | 92.7562 | 356.8367 | 26.1540 | 223.7336 | 82.4482 |
| 19384 | 92.5795 | 1717.6500 | 92.0712 | 2635.8927 | 876.8582 |
| 17767 | 92.5795 | 240.5950 | 38.6143 | 157.7913 | 49.6677 |
| 21510 | 92.5795 | 976.6217 | 103.4538 | 629.9400 | 224.2569 |
| 22729 | 92.4617 | 154.1833 | 27.1141 | 82.6701 | 34.0447 |
| 16490 | 92.4617 | 559.4117 | 20.8678 | 407.4154 | 123.2992 |
| 17358 | 92.4028 | 353.0283 | 17.8645 | 493.6994 | 215.3840 |
| 8595 | 92.3439 | 321.0183 | 32.7308 | 215.2353 | 66.4038 |
| 19035 | 92.2850 | 180.7533 | 33.6881 | 330.4614 | 93.6456 |
| 14560 | 92.2850 | 149.9917 | 15.6263 | 100.3550 | 40.6198 |
| 15235 | 92.2261 | 179.7467 | 17.0594 | 303.4877 | 91.2074 |
| 18272 | 92.1673 | 31.8250 | 5.6630 | 68.1814 | 27.6820 |
| 22318 | 92.1673 | 701.7683 | 157.6327 | 420.6326 | 161.2750 |
| 8265 | 92.1084 | 108.1167 | 4.0059 | 128.0502 | 42.8567 |
| 22724 | 91.9317 | 138.8683 | 8.5931 | 94.2878 | 39.6872 |
| 13052 | 91.8728 | 475.8100 | 24.2593 | 359.1517 | 86.4540 |
| 7994 | 91.8139 | 20.1067 | 6.2453 | −6.0040 | 18.5132 |
| 4401 | 91.6372 | 32.9267 | 2.0981 | 44.3692 | 17.2749 |
| 10929 | 91.5194 | 97.3767 | 19.6590 | 195.5547 | 72.1059 |
| 17793 | 91.5194 | 179.4267 | 12.1777 | 120.4858 | 55.2052 |
| 5794 | 91.4605 | 236.0783 | 18.8342 | 174.2573 | 40.8347 |
| 2937 | 91.4605 | 444.0167 | 12.0505 | 527.4182 | 111.2821 |
| 16872 | 91.4016 | 45.5700 | 6.4159 | 78.8023 | 27.7696 |
| 22446 | 91.4016 | 229.4483 | 20.7101 | 108.1015 | 110.3666 |
| 19205 | 91.3428 | 136.6483 | 19.1017 | 87.6963 | 48.8843 |
| 18684 | 91.3428 | 177.2633 | 32.2297 | 107.4661 | 40.4394 |
| 11228 | 91.2250 | 429.6483 | 17.2201 | 364.7606 | 145.7708 |
| 1600 | 91.1072 | 558.0083 | 113.5306 | 340.9151 | 380.8938 |
| 9421 | 91.1072 | 85.1267 | 11.7750 | 141.1911 | 40.1432 |
| 8372 | 91.1072 | 71.4917 | 7.9482 | 124.9891 | 46.7788 |
| 21275 | 91.1072 | 1327.7767 | 184.0489 | 825.3051 | 295.8464 |
| 21334 | 91.1072 | 305.7933 | 22.0480 | 216.7477 | 97.3321 |
| 23607 | 91.1072 | 277.9667 | 19.4140 | 177.7147 | 88.1503 |
| 15873 | 91.0483 | 28.2883 | 11.1767 | 95.6395 | 50.8733 |
| 4641 | 91.0483 | 223.7517 | 13.8053 | 176.8867 | 50.2984 |
| 18477 | 90.9894 | 89.6033 | 12.9067 | 220.1180 | 126.1461 |
| 9440 | 90.9305 | 297.9000 | 39.0511 | 204.4944 | 65.6249 |
| 2702 | 90.8127 | 1027.5433 | 75.5086 | 819.9480 | 298.9307 |
| 8305 | 90.7538 | 333.4617 | 51.0712 | 183.3841 | 93.5300 |
| 21870 | 90.6949 | 89.4400 | 9.9167 | 145.8173 | 48.7595 |
| 5972 | 90.6949 | 45.4400 | 4.5323 | 79.1719 | 32.6681 |
| 14941 | 90.6360 | 27.3400 | 6.9771 | 8.4593 | 15.7624 |
| 3267 | 90.6360 | 32.9633 | 2.8279 | 36.1784 | 36.6816 |
| 3290 | 90.5771 | 476.7483 | 68.1174 | 315.5338 | 111.4818 |
| 11160 | 90.5183 | 68.9017 | 5.1714 | 101.9135 | 50.3872 |
| 22833 | 90.5183 | 2150.8917 | 100.5147 | 1776.1048 | 422.3499 |

TABLE 5PP-continued

PHENOBARBITAL
Timepoint(s): 3, 6 hrs

| GLGC ID NO. | LDA Score | Mean Tox | SD Tox | Meam Nontox | SD Nontox |
|---|---|---|---|---|---|
| 22770 | 90.4594 | 1300.1667 | 127.4369 | 831.1107 | 321.4702 |
| 6165 | 90.4594 | 484.4900 | 49.1710 | 319.8969 | 132.6826 |
| 22677 | 90.4594 | 704.8650 | 57.6898 | 447.9869 | 189.5528 |
| 23177 | 90.4005 | 164.1050 | 11.4120 | 110.1478 | 58.8722 |
| 6440 | 90.3416 | 860.7933 | 57.5109 | 628.9122 | 168.6959 |
| 18756 | 90.3416 | 177.0800 | 17.4634 | 144.8825 | 93.7277 |
| 3586 | 90.2827 | 122.2133 | 23.4818 | 47.5822 | 53.4129 |
| 2930 | 90.2238 | 33.2383 | 6.6525 | 68.7859 | 27.9258 |
| 2781 | 90.1649 | 238.2250 | 41.4258 | 139.3239 | 94.3658 |
| 19427 | 90.1649 | 2858.8950 | 244.7747 | 4712.5229 | 1632.1355 |
| 19187 | 90.1649 | 666.6067 | 120.5731 | 423.4085 | 153.4523 |

TABLE 5QQ

STEATOSIS
Timepoint(s): Various

| GLGC ID NO. | LDA Score | Mean Tox | SD Tox | Mean Nontox | SD Nontox |
|---|---|---|---|---|---|
| 12155 | 89.7754 | −30.8741 | 17.6114 | 84.5637 | 168.6316 |
| 2853 | 89.1844 | 356.1531 | 59.5981 | 243.1721 | 88.6332 |
| 14002 | 89.1844 | 164.0276 | 33.2423 | 325.8097 | 116.2489 |
| 5497 | 88.8298 | 163.8578 | 209.6461 | 212.3724 | 134.3593 |
| 15794 | 88.7707 | 42.5068 | 9.8700 | 22.4105 | 17.5811 |
| 14495 | 88.7116 | 113.3602 | 159.0365 | 142.6600 | 74.8767 |
| 20939 | 88.4161 | 874.0879 | 116.3979 | 543.6799 | 178.9772 |
| 15025 | 88.1206 | 4.5673 | 5.5214 | 76.5886 | 140.2811 |
| 13646 | 88.0024 | 1902.0956 | 101.4132 | 1616.7109 | 287.6258 |
| 15028 | 87.4113 | 255.2997 | 264.6793 | 336.5637 | 148.3257 |
| 16947 | 87.2931 | 244.0790 | 304.0594 | 346.7074 | 136.9965 |
| 20430 | 87.1158 | 36.6321 | 25.2443 | 210.7372 | 180.3685 |
| 4723 | 86.9976 | 387.3069 | 306.3019 | 519.4579 | 167.6198 |
| 9917 | 86.8794 | 71.2038 | 4.7286 | 59.1666 | 15.7476 |
| 17091 | 86.8203 | 69.7136 | 30.9932 | 143.0598 | 62.3560 |
| 25725 | 86.7612 | 16.9488 | 22.0425 | 93.1753 | 57.1054 |
| 21657 | 86.7021 | 540.7094 | 53.0180 | 889.9282 | 406.4404 |
| 17146 | 86.6430 | 211.0584 | 291.9780 | 311.2461 | 162.0846 |
| 14346 | 86.5839 | 219.3271 | 172.0336 | 731.7349 | 317.5485 |
| 16780 | 86.5839 | 68.6151 | 21.4168 | 175.7070 | 96.2355 |
| 20193 | 86.4066 | 21.3317 | 14.6574 | 4.3323 | 9.1103 |
| 19825 | 86.4066 | 35.0479 | 82.5149 | 73.0194 | 55.1272 |
| 7864 | 86.1111 | 1758.8559 | 225.2740 | 1384.9799 | 209.8504 |
| 20836 | 85.9338 | 77.8298 | 18.4083 | 28.7636 | 28.7781 |
| 16948 | 85.7565 | 167.8014 | 345.0438 | 293.0995 | 192.1965 |
| 17693 | 85.6974 | 48.7537 | 25.9991 | 159.4326 | 85.4850 |
| 1630 | 85.6383 | 119.1427 | 63.2096 | 34.3397 | 23.0631 |
| 15024 | 85.6383 | 2.6570 | 10.5102 | 82.3658 | 160.7928 |
| 1557 | 85.5792 | 59.9853 | 38.2129 | 16.2220 | 13.3840 |
| 4594 | 85.5201 | 672.7701 | 429.2416 | 173.3318 | 221.7632 |
| 20493 | 85.5201 | 72.8118 | 74.6503 | 109.3355 | 46.3818 |
| 3422 | 85.4610 | 36.2244 | 9.4934 | 17.2007 | 14.9509 |
| 17626 | 85.4019 | 1000.5265 | 276.8126 | 603.5389 | 152.6175 |
| 24326 | 85.4019 | 1229.8021 | 252.9136 | 823.9064 | 253.2392 |
| 20149 | 85.3428 | −32.0366 | 9.1485 | 46.1890 | 208.2264 |
| 17393 | 85.3428 | 667.5976 | 108.5595 | 480.5765 | 119.3324 |
| 7176 | 85.2246 | 638.7340 | 316.1162 | 302.5503 | 127.1608 |
| 23806 | 85.2246 | 224.5569 | 189.5362 | 339.8794 | 115.9459 |
| 14003 | 85.2246 | 164.0702 | 42.1760 | 339.7797 | 115.1853 |
| 18911 | 85.1655 | 45.8232 | 7.5894 | 26.7880 | 13.2845 |
| 2384 | 85.1064 | 138.0603 | 247.0845 | 287.7761 | 164.5921 |
| 4500 | 84.9291 | 93.8112 | 36.0318 | 33.8145 | 24.9951 |
| 18553 | 84.9291 | 343.9678 | 146.6804 | 114.6895 | 92.5777 |
| 354 | 84.9291 | 1261.4244 | 632.9731 | 505.2324 | 308.9319 |
| 19943 | 84.7518 | 112.9447 | 16.5831 | 169.0652 | 86.1446 |
| 18468 | 84.7518 | 122.5208 | 22.4323 | 66.7482 | 47.7412 |
| 353 | 84.6927 | 1083.1582 | 533.9235 | 405.8552 | 233.8745 |
| 20026 | 84.6927 | 99.6284 | 13.5086 | 76.6497 | 33.5021 |
| 25379 | 84.5745 | 210.4127 | 94.7476 | 84.2156 | 64.2507 |
| 16139 | 84.5154 | 99.3353 | 38.9195 | 60.2566 | 20.2241 |

TABLE 5QQ-continued

STEATOSIS
Timepoint(s): Various

| GLGC ID NO. | LDA Score | Mean Tox | SD Tox | Mean Nontox | SD Nontox |
|---|---|---|---|---|---|
| 22411 | 84.4563 | 112.0474 | 56.4223 | 36.7617 | 43.7017 |
| 4524 | 84.3381 | 144.1262 | 59.5190 | 70.6185 | 29.5461 |
| 18989 | 84.3381 | 473.1457 | 346.4281 | 1452.4046 | 693.0425 |
| 1379 | 84.2790 | 99.4790 | 39.3706 | 45.8039 | 22.2623 |
| 14250 | 84.2199 | 176.9473 | 85.0308 | 64.5130 | 71.1455 |
| 21053 | 84.2199 | 436.9409 | 90.5088 | 818.3116 | 359.4382 |
| 21098 | 84.1608 | 411.8118 | 208.3279 | 1022.2973 | 627.7139 |
| 25550 | 84.1017 | 217.9914 | 67.5841 | 124.5818 | 45.3745 |
| 19101 | 84.1017 | 185.2970 | 52.2191 | 117.4166 | 51.0687 |
| 20515 | 84.1017 | 148.7723 | 26.5604 | 109.1364 | 28.0982 |
| 1306 | 84.0426 | 268.5656 | 100.9200 | 150.8599 | 56.9467 |
| 1495 | 84.0426 | 232.8632 | 79.4093 | 133.9129 | 43.7255 |
| 17739 | 84.0426 | 9.8816 | 4.7902 | 43.7989 | 41.5571 |
| 19181 | 84.0426 | 126.1987 | 14.1745 | 91.7050 | 22.7396 |
| 3174 | 83.9835 | 20.5408 | 16.2459 | 1.1157 | 10.3003 |
| 5496 | 83.8652 | 139.1512 | 150.5818 | 164.5683 | 96.9247 |
| 3636 | 83.8652 | 169.1108 | 102.1899 | 223.2729 | 68.7393 |
| 20982 | 83.8061 | 165.3276 | 74.0235 | 102.9644 | 34.1794 |
| 3027 | 83.8061 | 2453.4969 | 167.8524 | 2344.5071 | 601.5012 |
| 17936 | 83.7470 | 601.4779 | 77.0545 | 802.0074 | 204.1845 |
| 11916 | 83.6288 | 68.1432 | 11.3912 | 97.5082 | 51.8092 |
| 21653 | 83.5697 | 819.1572 | 255.0109 | 514.4674 | 139.4061 |
| 6377 | 83.5106 | 1462.8354 | 778.6869 | 718.0737 | 399.1619 |
| 18767 | 83.5106 | 110.3214 | 39.3906 | 73.9675 | 31.0290 |
| 7783 | 83.5106 | 22.5789 | 33.4931 | 39.3383 | 22.7455 |
| 912 | 83.5106 | 972.9948 | 131.4487 | 759.7573 | 161.6791 |
| 16479 | 83.3333 | 86.3972 | 19.1360 | 63.3767 | 19.2156 |
| 19241 | 83.2151 | 326.7102 | 93.6727 | 193.4731 | 67.5978 |
| 22413 | 83.0969 | 1033.7560 | 492.7225 | 460.5470 | 274.1363 |
| 11949 | 83.0969 | 62.7307 | 22.5361 | 37.8542 | 14.4648 |
| 20996 | 83.0378 | 371.4097 | 91.6844 | 249.7031 | 90.4286 |
| 8207 | 83.0378 | 87.9517 | 15.7201 | 62.4695 | 18.7447 |
| 1037 | 82.9787 | 173.6148 | 64.1794 | 94.1892 | 43.4224 |
| 15618 | 82.9196 | 500.4811 | 191.8636 | 263.9907 | 121.7532 |
| 18349 | 82.8605 | 387.3220 | 143.3906 | 222.1103 | 90.2778 |
| 20431 | 82.8605 | 18.3710 | 9.5408 | 115.8948 | 139.1245 |
| 771 | 82.8014 | 67.9828 | 27.3032 | 31.9989 | 16.8069 |
| 19646 | 82.6832 | 41.1887 | 21.6220 | 16.8051 | 15.5584 |
| 15891 | 82.6832 | 458.5871 | 37.9132 | 354.0491 | 84.8085 |
| 1496 | 82.6241 | 215.1470 | 53.4345 | 123.9139 | 50.3144 |
| 818 | 82.6241 | 2123.9054 | 2961.7942 | 2882.8758 | 1751.9427 |
| 19040 | 82.6241 | 1456.7989 | 334.2698 | 832.5591 | 301.2214 |
| 573 | 82.6241 | 12.4559 | 15.0523 | 80.6609 | 58.8500 |
| 13974 | 82.5650 | 1207.9378 | 581.1905 | 908.4260 | 250.2259 |
| 17145 | 82.5650 | 347.5722 | 303.8736 | 501.1010 | 208.5365 |
| 11493 | 82.5650 | 82.1960 | 37.8085 | 33.4349 | 53.5296 |
| 1598 | 82.5059 | 598.7171 | 265.2699 | 278.5711 | 270.5681 |
| 18396 | 82.5059 | 746.8849 | 347.2349 | 392.5732 | 196.5518 |
| 15617 | 82.4468 | 389.0241 | 151.9829 | 200.6340 | 86.7617 |
| 3831 | 82.4468 | 216.4721 | 91.4620 | 125.0053 | 62.3611 |
| 8872 | 92.7896 | 499.1034 | 128.5223 | 937.3703 | 243.1816 |
| 12542 | 91.9622 | 564.5841 | 72.9629 | 379.6807 | 149.0151 |
| 2267 | 91.1939 | 279.7553 | 38.6099 | 200.0360 | 66.5677 |
| 10063 | 91.1348 | 130.5700 | 12.3068 | 94.8841 | 44.7917 |
| 2250 | 90.6028 | 2658.5946 | 320.2917 | 1637.4121 | 676.4109 |
| 22628 | 90.3664 | 84.4051 | 7.4632 | 137.3008 | 54.1077 |
| 22239 | 90.1891 | 121.3429 | 14.2020 | 84.0201 | 44.0684 |
| 12408 | 89.1253 | 427.3727 | 91.4926 | 205.6534 | 117.4253 |
| 9800 | 89.0071 | 181.8530 | 12.1150 | 244.1768 | 71.7987 |
| 14500 | 88.4161 | 14.8701 | 6.4960 | 42.0257 | 25.2456 |
| 18742 | 88.3570 | 31.6747 | 16.4046 | 88.5048 | 51.9420 |
| 7374 | 88.3570 | 28.8532 | 8.2043 | 3.5895 | 22.7084 |
| 14233 | 87.8842 | 324.1514 | 40.7442 | 225.1345 | 73.0459 |
| 6976 | 87.8251 | 77.8626 | 21.7676 | 44.8723 | 17.3190 |
| 12223 | 87.8251 | 479.3499 | 39.3358 | 356.0306 | 98.3688 |
| 5528 | 87.7660 | 88.7257 | 24.2315 | 219.8567 | 107.6102 |
| 14938 | 87.7069 | 151.8128 | 61.2224 | 50.4203 | 48.2778 |
| 12160 | 87.7069 | 166.5724 | 19.7403 | 343.2324 | 325.1653 |
| 14512 | 87.6478 | 18.7289 | 9.3041 | 116.0261 | 111.9933 |
| 2702 | 87.6478 | 1326.7594 | 233.0388 | 816.0287 | 294.5356 |
| 5491 | 87.5296 | 114.2678 | 18.9897 | 74.5325 | 32.3150 |
| 7618 | 87.5296 | 299.5808 | 21.9696 | 270.2680 | 112.8388 |
| 19544 | 87.2931 | 1859.2723 | 164.8088 | 1437.4596 | 375.4105 |

TABLE 5QQ-continued

STEATOSIS
Timepoint(s): Various

| GLGC ID NO. | LDA Score | Mean Tox | SD Tox | Mean Nontox | SD Nontox |
|---|---|---|---|---|---|
| 16781 | 87.2931 | 65.6841 | 22.3292 | 185.8067 | 100.0624 |
| 5859 | 87.2340 | 307.8782 | 76.6918 | 174.7722 | 61.8916 |
| 5009 | 87.1749 | 154.0234 | 34.5099 | 237.5931 | 63.4166 |
| 6828 | 86.8794 | 241.4102 | 38.5264 | 326.7695 | 144.4263 |
| 14509 | 86.8203 | 127.0463 | 57.1314 | 642.1332 | 566.0608 |
| 20035 | 86.6430 | 1230.5742 | 115.9504 | 1095.6678 | 521.0261 |
| 7559 | 86.5839 | 338.7061 | 56.5676 | 208.9602 | 70.6087 |
| 19146 | 86.5839 | 74.5348 | 16.6566 | 40.5905 | 28.5055 |
| 7208 | 86.5839 | 423.2532 | 33.4702 | 379.8826 | 112.8067 |
| 11871 | 86.5839 | 301.8713 | 253.0656 | −129.2045 | 95.8139 |
| 11873 | 86.3475 | 292.0461 | 160.6966 | 38.6249 | 47.9817 |
| 14510 | 86.2293 | 137.1550 | 41.3722 | 434.1403 | 298.7073 |
| 24028 | 86.0520 | 443.1997 | 29.0527 | 401.4198 | 132.1793 |
| 4355 | 85.9929 | 593.3164 | 182.5764 | 311.6999 | 114.5174 |
| 20788 | 85.9929 | 20.2359 | 6.2420 | 6.7142 | 12.4059 |
| 10093 | 85.6974 | 323.1014 | 71.6556 | 588.7499 | 240.6768 |
| 3730 | 85.6974 | 207.5431 | 72.3964 | 603.7363 | 309.8724 |
| 1690 | 85.6383 | 335.2570 | 67.4026 | 227.4921 | 73.2405 |
| 21740 | 85.5201 | 314.8449 | 271.8371 | 438.3128 | 163.7373 |
| 6909 | 85.5201 | 610.1101 | 252.7247 | 273.1262 | 142.9221 |
| 7685 | 85.5201 | 26.9751 | 6.0747 | 13.7674 | 18.3390 |
| 3940 | 85.4610 | 956.9838 | 64.9657 | 1123.3561 | 157.7399 |
| 19456 | 85.4610 | 322.4558 | 106.5108 | 155.0471 | 143.9092 |
| 21797 | 85.4019 | 171.9753 | 71.9959 | 70.2910 | 55.3784 |
| 8025 | 85.4019 | 620.9579 | 61.2127 | 707.0812 | 248.2293 |
| 4048 | 85.4019 | 635.0280 | 193.4370 | 295.2411 | 283.1728 |
| 7963 | 85.2837 | 185.0342 | 9.8544 | 175.6246 | 44.5163 |
| 3436 | 85.2246 | 735.1383 | 191.7974 | 453.1402 | 182.3352 |
| 17065 | 85.2246 | 45.0984 | 7.1258 | 35.7454 | 23.5487 |
| 10533 | 85.2246 | 254.8817 | 66.1713 | 460.2874 | 136.0796 |
| 3014 | 85.1655 | 83.2896 | 42.4058 | 32.9352 | 19.2495 |
| 18696 | 85.1655 | 186.2689 | 84.3630 | 235.9197 | 58.6378 |
| 5080 | 85.1064 | 87.6777 | 46.0071 | 105.6568 | 28.4222 |
| 24171 | 85.1064 | 68.0720 | 31.6802 | 22.1050 | 15.2842 |
| 15624 | 85.1064 | 49.8132 | 24.9031 | 11.9728 | 24.4809 |
| 24048 | 85.0473 | 493.8236 | 100.3887 | 857.4699 | 244.4614 |

TABLE 5RR

Steatosis Hepatitis
Timepoint(s): Various

| GLGC ID NO. | LDA Score | Mean Tox | SD Tox | Mean Nontox | SD Nontox |
|---|---|---|---|---|---|
| 20971 | 94.6871 | 160.6774 | 20.3156 | 97.7072 | 31.3376 |
| 17405 | 93.8607 | 219.6943 | 18.9205 | 150.7992 | 34.7802 |
| 18770 | 92.5620 | 1193.1811 | 193.7162 | 812.9675 | 195.2545 |
| 6013 | 90.9091 | 174.4481 | 51.3394 | 529.6018 | 269.2348 |
| 4282 | 90.7910 | 13.6316 | 2.4100 | 71.7303 | 81.8421 |
| 4477 | 90.4442 | 245.0659 | 59.2290 | 99.5595 | 42.8807 |
| 21066 | 90.4368 | 247.3979 | 35.3013 | 184.6680 | 44.0055 |
| 11899 | 89.8465 | 41.7430 | 2.5749 | 36.7233 | 15.3501 |
| 15066 | 89.3743 | 366.3779 | 74.2467 | 645.4642 | 204.5449 |
| 588 | 88.7323 | 342.6214 | 297.6842 | 293.8613 | 122.9109 |
| 17502 | 88.5478 | 324.5731 | 52.8966 | 211.6597 | 74.3911 |
| 17281 | 88.2527 | 79.6129 | 13.5337 | 156.6858 | 82.9581 |
| 768 | 88.1936 | 77.6526 | 30.7513 | 212.2265 | 116.3633 |
| 13646 | 87.7878 | 2250.0970 | 299.4916 | 1613.7610 | 281.1583 |
| 13686 | 87.7804 | 58.9148 | 3.3413 | 47.4648 | 13.5505 |
| 25400 | 87.5443 | 251.1916 | 57.9022 | 608.1288 | 308.5013 |
| 16081 | 87.3672 | 886.4551 | 113.4836 | 1178.0178 | 594.6462 |
| 15070 | 87.3155 | 442.6201 | 123.3252 | 232.6555 | 111.5037 |
| 10744 | 86.7769 | 27.6860 | 3.1614 | 52.7053 | 48.4626 |
| 18725 | 86.3046 | 28.9038 | 17.0795 | 93.3542 | 59.1461 |
| 15642 | 86.3046 | 545.5520 | 92.1370 | 936.0513 | 326.4237 |
| 16510 | 86.3046 | 92.3845 | 12.4888 | 174.0506 | 80.4440 |
| 18726 | 86.2456 | 102.8848 | 29.4946 | 195.0788 | 85.3816 |
| 614 | 86.1865 | 215.4611 | 74.2669 | 376.9739 | 126.6187 |
| 15186 | 86.0094 | 63.3304 | 15.8858 | 114.7970 | 42.4102 |

TABLE 5RR-continued

Steatosis Hepatitis
Timepoint(s): Various

| GLGC ID NO. | LDA Score | Mean Tox | SD Tox | Mean Nontox | SD Nontox |
|---|---|---|---|---|---|
| 16982 | 86.0094 | 2270.0128 | 363.2649 | 1619.7371 | 983.0583 |
| 1262 | 85.8914 | 20.0889 | 4.5694 | 42.7689 | 24.3174 |
| 16256 | 85.7733 | 176.0905 | 88.4145 | 581.3166 | 334.7948 |
| 17933 | 85.6553 | 352.9298 | 66.3780 | 247.9569 | 135.2538 |
| 1173 | 85.5962 | 36.3606 | 11.4448 | 203.9397 | 188.2477 |
| 18365 | 85.4855 | 155.9798 | 25.8586 | 100.9139 | 29.7418 |
| 10184 | 85.3011 | 65.7738 | 11.0726 | 47.2190 | 29.6594 |
| 23166 | 85.2494 | 803.0931 | 135.0776 | 554.2574 | 134.6423 |
| 2812 | 85.0649 | 260.6331 | 20.5246 | 209.4276 | 67.4652 |
| 15617 | 85.0133 | 358.1674 | 90.7948 | 201.1478 | 88.3829 |
| 20865 | 84.8878 | 17.5879 | 4.9904 | 34.5315 | 23.9237 |
| 1522 | 84.7772 | 266.2481 | 52.5727 | 133.0600 | 79.4296 |
| 17175 | 84.7181 | 2109.4948 | 406.0626 | 1616.7930 | 347.8754 |
| 16610 | 84.7181 | 678.4661 | 152.0508 | 434.5880 | 143.6682 |
| 4222 | 84.7181 | 1345.6535 | 119.5917 | 1041.4001 | 182.9729 |
| 14882 | 84.7107 | 98.3635 | 44.7153 | 357.1001 | 235.4039 |
| 17311 | 84.5927 | 272.4710 | 57.6656 | 345.9850 | 177.8414 |
| 24442 | 84.5927 | 15.6709 | 3.5798 | 30.5643 | 16.2281 |
| 22872 | 84.4820 | 186.9126 | 30.6677 | 144.0764 | 27.4023 |
| 17257 | 84.4746 | 7.4680 | 13.6777 | 33.3888 | 24.3803 |
| 9621 | 84.2459 | 1001.6635 | 177.2985 | 742.0244 | 172.5933 |
| 18687 | 84.2385 | 714.6949 | 164.9431 | 524.6853 | 431.9159 |
| 2854 | 84.1868 | 981.5269 | 193.5656 | 708.2228 | 204.3735 |
| 2846 | 84.1795 | 32.3373 | 6.7668 | 52.0268 | 19.4397 |
| 25209 | 84.1204 | 134.8290 | 20.0950 | 173.4607 | 35.2965 |
| 21014 | 83.9433 | 337.1251 | 132.2624 | 831.8178 | 437.4549 |
| 16301 | 83.8843 | 29.6913 | 9.3388 | 147.1134 | 147.4717 |
| 2970 | 83.8843 | 94.8343 | 36.2477 | 469.0053 | 378.7833 |
| 43 | 83.8253 | 95.0473 | 24.4303 | 168.9235 | 82.5741 |
| 15187 | 83.8253 | 40.9961 | 14.5866 | 92.0644 | 50.3244 |
| 4312 | 83.7072 | 140.4283 | 20.3414 | 137.0534 | 143.0579 |
| 1349 | 83.6555 | 4.5790 | 14.2513 | 26.3607 | 13.9367 |
| 4012 | 83.6482 | 199.0173 | 49.2719 | 528.3823 | 309.9721 |
| 15598 | 83.5375 | 436.6163 | 126.3227 | 595.9171 | 114.7644 |
| 16257 | 83.2940 | 120.1651 | 44.8306 | 213.3309 | 82.6373 |
| 11756 | 83.2940 | 46.2571 | 15.0628 | 98.4407 | 66.7424 |
| 24469 | 83.2423 | 1846.1886 | 131.4833 | 1501.8306 | 250.6679 |
| 25203 | 83.2349 | 21.2508 | 14.0690 | 58.4361 | 32.8798 |
| 4091 | 83.2349 | 1154.8765 | 62.7666 | 1146.3649 | 208.9862 |
| 1174 | 83.2349 | 132.0203 | 45.9040 | 594.4760 | 533.6458 |
| 17900 | 83.2349 | 376.3963 | 20.5938 | 379.6867 | 75.1632 |
| 243 | 83.1833 | 26.1939 | 8.5679 | 10.3680 | 11.6277 |
| 12028 | 83.1833 | 69.7726 | 10.2915 | 46.4106 | 16.1794 |
| 11153 | 83.1759 | 212.2358 | 22.2283 | 277.4671 | 84.3277 |
| 18867 | 83.1759 | 212.1526 | 35.0836 | 310.1561 | 158.2294 |
| 9136 | 83.1169 | 443.5870 | 52.1209 | 527.6480 | 154.0016 |
| 22918 | 83.0652 | 264.4065 | 53.0544 | 181.4009 | 65.3761 |
| 16511 | 83.0579 | 57.6629 | 21.3646 | 150.3932 | 107.6622 |
| 18226 | 83.0062 | 352.2586 | 53.7584 | 265.4117 | 58.1286 |
| 13647 | 83.0062 | 2818.4265 | 424.9860 | 2114.8683 | 494.7779 |
| 24247 | 82.9988 | 68.1320 | 8.9733 | 76.7161 | 79.9124 |
| 24697 | 82.9398 | 159.3628 | 13.2799 | 137.3243 | 30.8676 |
| 21006 | 82.8217 | 22.0309 | 10.4330 | 78.5476 | 71.9546 |
| 2118 | 82.7037 | 55.3801 | 10.3998 | 34.0886 | 26.2023 |
| 17171 | 82.6520 | 611.8070 | 195.5182 | 385.6650 | 181.1771 |
| 17431 | 82.5930 | 289.5151 | 19.0531 | 228.1524 | 66.1351 |
| 19086 | 82.5856 | 364.2333 | 45.0409 | 402.6738 | 162.6088 |
| 15300 | 82.4085 | 357.7895 | 75.7624 | 645.2803 | 346.3525 |
| 1531 | 82.4085 | 27.9689 | 21.0821 | 145.5954 | 131.3707 |
| 28 | 82.4085 | 15.2390 | 8.1425 | 59.0361 | 45.8997 |
| 1435 | 82.2978 | 1346.2631 | 216.6893 | 928.8676 | 279.2168 |
| 2694 | 82.2314 | 31.1421 | 14.6474 | 71.3906 | 36.4852 |
| 17999 | 82.1207 | 583.1346 | 194.0468 | 969.2270 | 261.6142 |
| 6049 | 81.9510 | 1813.9160 | 443.0417 | 1211.0265 | 281.3449 |
| 10949 | 81.9362 | 146.9866 | 79.4596 | 454.1877 | 294.4705 |
| 1801 | 81.8846 | 129.7823 | 30.1046 | 101.4297 | 28.4270 |
| 22909 | 81.8182 | 86.0510 | 10.1046 | 72.9125 | 21.7110 |
| 6773 | 81.7665 | 41.0870 | 9.5461 | 24.0782 | 11.7849 |
| 19085 | 81.7591 | 289.4649 | 34.3120 | 317.6259 | 119.7352 |
| 15259 | 81.7149 | 521.7283 | 135.1784 | 334.4770 | 97.1304 |

TABLE 5RR-continued

Steatosis Hepatitis
Timepoint(s): Various

| GLGC ID NO. | LDA Score | Mean Tox | SD Tox | Mean Nontox | SD Nontox |
|---|---|---|---|---|---|
| 16366 | 81.6485 | 148.1950 | 57.8374 | 318.3341 | 133.7816 |
| 11962 | 81.6411 | 22.0761 | 15.6265 | −3.6199 | 25.2606 |
| 24327 | 81.6411 | 1226.5344 | 163.0614 | 1025.6416 | 343.4248 |
| 4647 | 81.6411 | 232.5336 | 24.7594 | 213.0748 | 64.7389 |
| 15408 | 81.5304 | 153.8638 | 47.6026 | 96.9103 | 58.9378 |
| 20101 | 93.5655 | 457.3543 | 54.9640 | 255.5246 | 119.6932 |
| 3981 | 92.4439 | 22.3400 | 17.8805 | 207.1497 | 218.9264 |
| 14102 | 92.3849 | 598.4706 | 74.9775 | 376.7397 | 119.6691 |
| 15088 | 91.2633 | 276.6378 | 19.6658 | 211.6503 | 57.2248 |
| 23681 | 89.6104 | 550.3775 | 49.3547 | 411.9819 | 117.0779 |
| 16169 | 89.5514 | 4249.6308 | 771.6653 | 2770.7456 | 1389.5855 |
| 15858 | 89.4923 | 116.2461 | 35.2770 | 57.1735 | 51.3704 |
| 13634 | 88.8430 | 2779.3188 | 138.0727 | 2869.3730 | 1055.1649 |
| 17307 | 88.7839 | 266.2534 | 25.5037 | 208.7619 | 41.9660 |
| 9927 | 88.6659 | 168.3848 | 18.7265 | 258.6551 | 101.2129 |
| 16404 | 88.3707 | 179.4313 | 37.6465 | 110.8063 | 48.3766 |
| 20102 | 88.1420 | 549.4816 | 129.3233 | 287.8646 | 106.3704 |
| 19035 | 88.0756 | 232.9458 | 24.6635 | 330.3220 | 94.1324 |
| 10984 | 88.0165 | 58.2085 | 26.4728 | 177.5192 | 111.6921 |
| 23471 | 87.7214 | 93.2310 | 13.2546 | 142.5668 | 93.4378 |
| 8584 | 87.6623 | 33.8354 | 71.9923 | 288.0836 | 213.3921 |
| 16985 | 87.5517 | 1877.4846 | 343.7114 | 1276.9794 | 277.6955 |
| 14379 | 87.4852 | 54.1475 | 10.4474 | 28.2413 | 20.6582 |
| 18095 | 87.4336 | 2521.0894 | 113.0567 | 2003.5526 | 346.6912 |
| 8227 | 87.3672 | 29.5505 | 6.8860 | 59.2567 | 31.4269 |
| 16405 | 87.3155 | 319.2406 | 95.0364 | 99.6563 | 104.5605 |
| 11969 | 87.2491 | 38.7705 | 3.6354 | 31.6632 | 25.9316 |
| 20055 | 87.1901 | 235.5269 | 54.4351 | 125.2405 | 104.0420 |
| 6004 | 86.8949 | 684.5655 | 164.7374 | 1122.3866 | 329.3794 |
| 2702 | 86.8433 | 1306.1274 | 292.2685 | 816.8265 | 294.8871 |
| 20396 | 86.8433 | 588.4740 | 83.2776 | 422.3242 | 92.0954 |
| 23108 | 86.7769 | 97.8548 | 22.6590 | 61.3262 | 26.8007 |
| 6692 | 86.6588 | 256.7388 | 25.0557 | 370.1926 | 122.6576 |
| 19196 | 86.5998 | 65.0639 | 5.9925 | 83.8726 | 26.1090 |
| 23358 | 86.5481 | 349.5090 | 67.6587 | 521.4563 | 99.2611 |
| 18094 | 86.4300 | 2911.0743 | 473.2775 | 1995.8513 | 500.5462 |
| 14224 | 86.3046 | 241.5544 | 12.5218 | 236.1297 | 55.3536 |
| 11527 | 86.2530 | 426.3274 | 72.5160 | 254.5231 | 93.6394 |
| 23338 | 86.1939 | 5750.4274 | 764.9815 | 4346.6627 | 764.5263 |
| 17297 | 86.1349 | 1114.1456 | 121.0307 | 835.9664 | 163.9477 |
| 23504 | 86.0168 | 790.1519 | 124.0210 | 540.6148 | 141.7137 |
| 8917 | 85.7807 | 117.8224 | 31.2363 | 53.4996 | 44.2516 |
| 17618 | 85.7143 | 159.7138 | 8.4220 | 149.3617 | 32.9493 |
| 6240 | 85.7143 | 128.7299 | 32.0724 | 63.9880 | 90.4755 |
| 3153 | 85.6553 | 74.6275 | 20.3271 | 38.5638 | 34.0235 |
| 5208 | 85.5962 | 2162.8751 | 262.7970 | 2662.0320 | 1360.5467 |
| 18756 | 85.5372 | 111.7006 | 15.7015 | 145.4240 | 93.8193 |
| 2988 | 85.5372 | 160.1736 | 20.5662 | 123.7956 | 32.5908 |
| 24373 | 85.4191 | 137.6193 | 19.9943 | 208.6827 | 74.8221 |
| 10157 | 85.3601 | 714.5535 | 186.1251 | 476.1838 | 261.7957 |
| 4196 | 85.3084 | 29.9756 | 18.0007 | −10.8080 | 37.0401 |
| 15382 | 85.3011 | 1793.5466 | 189.5163 | 2166.0173 | 895.0360 |
| 15645 | 85.3011 | 898.0199 | 129.1839 | 1328.1020 | 420.2625 |
| 2548 | 85.2494 | 1623.5571 | 886.0803 | 1699.5642 | 523.0992 |
| 14561 | 85.1240 | 139.5658 | 17.4653 | 195.4121 | 54.3948 |
| 23444 | 85.0649 | 725.4500 | 60.1504 | 641.4610 | 186.2244 |
| 5331 | 85.0133 | 473.7515 | 51.8184 | 355.1758 | 65.9662 |
| 24270 | 85.0133 | 1051.8966 | 124.7951 | 714.5563 | 217.3034 |
| 23505 | 84.9543 | 1736.2586 | 205.8525 | 1292.2918 | 317.2629 |
| 2781 | 84.8952 | 277.9186 | 56.8619 | 138.7155 | 93.7908 |
| 12591 | 84.8952 | 114.7761 | 47.3337 | 52.3927 | 38.0594 |
| 7379 | 84.8878 | 56.9178 | 15.1308 | 95.6125 | 35.5607 |
| 14527 | 84.7772 | 315.2640 | 84.1405 | 162.6233 | 85.9069 |

TABLE 5SS

TACRINE
Timepoint(s): 24 hrs

| GLGC ID NO. | LDA Score | Mean Tox | SD Tox | Mean Nontox | SD Nontox |
|---|---|---|---|---|---|
| 2970 | NA | 103.5400 | 0.0000 | 466.3530 | 378.7759 |
| 16562 | 100.0000 | 53.2050 | 0.0778 | 147.5822 | 50.5004 |
| 17937 | 100.0000 | 137.4650 | 0.8132 | 47.8450 | 36.2754 |
| 23699 | 100.0000 | 127.7450 | 0.1061 | 292.0689 | 298.6437 |
| 18578 | 100.0000 | 200.5000 | 0.0283 | 137.2611 | 102.3528 |
| 11297 | 99.9414 | 37.9450 | 0.1344 | 23.0256 | 10.2062 |
| 16768 | 99.9414 | 115.2200 | 3.6911 | 235.4470 | 85.7427 |
| 17883 | 99.9414 | 22.7750 | 0.0071 | 23.6963 | 56.0307 |
| 911 | 99.8828 | 228.0600 | 3.6345 | 91.4573 | 41.4833 |
| 1517 | 99.8828 | 37.9800 | 0.0707 | 22.2816 | 19.0014 |
| 9037 | 99.8828 | 25.8050 | 0.0212 | 5.5973 | 13.5195 |
| 16450 | 99.8828 | 218.9750 | 0.5020 | 151.7440 | 64.1750 |
| 14621 | 99.8828 | 110.1850 | 0.2899 | 186.4561 | 49.4775 |
| 16148 | 99.8242 | 151.7550 | 2.5244 | 488.1605 | 363.4180 |
| 17740 | 99.8242 | 883.5250 | 8.3226 | 1816.3087 | 404.2780 |
| 19106 | 99.8242 | 25.6850 | 0.0495 | 11.2130 | 12.4027 |
| 24825 | 99.8242 | 112.3550 | 10.8117 | 853.2472 | 419.7833 |
| 24019 | 99.8242 | 174.4150 | 0.7566 | 89.1189 | 42.6537 |
| 7176 | 99.8242 | 912.2000 | 32.5552 | 304.6680 | 131.4952 |
| 19 | 99.7655 | 1561.6350 | 48.5570 | 710.5550 | 209.8161 |
| 21981 | 99.7655 | 133.9500 | 0.6223 | 278.2877 | 80.6929 |
| 1639 | 99.7655 | 57.4200 | 0.3960 | 114.0865 | 36.2433 |
| 11314 | 99.7655 | 122.8500 | 0.1273 | 146.9278 | 31.6112 |
| 25747 | 99.7655 | 1532.5500 | 1.4991 | 2038.1920 | 747.4137 |
| 910 | 99.7655 | 248.2550 | 2.4961 | 110.8944 | 39.7258 |
| 6539 | 99.7655 | 209.2400 | 7.4105 | −2.3766 | 79.2497 |
| 9866 | 99.7069 | 68.4400 | 0.2687 | 10.7564 | 31.7018 |
| 25312 | 99.7069 | 21.7950 | 0.0919 | 4.4223 | 12.9729 |
| 4349 | 99.7069 | 3.4350 | 0.0636 | 20.2799 | 14.0476 |
| 1557 | 99.7069 | 68.1550 | 1.6758 | 16.5620 | 14.3231 |
| 3902 | 99.7069 | 555.2450 | 29.9601 | 225.8690 | 65.0409 |
| 1573 | 99.7069 | 27.5150 | 0.0354 | 20.3497 | 9.9939 |
| 13480 | 99.7069 | 124.8150 | 2.2840 | 326.1053 | 98.6026 |
| 25039 | 99.7069 | 139.7100 | 3.8891 | 493.3188 | 177.1522 |
| 9929 | 99.7069 | 76.6600 | 1.5132 | 230.3032 | 125.8165 |
| 16029 | 99.7069 | 26.6000 | 0.1131 | 8.3887 | 9.2948 |
| 15579 | 99.6483 | 2.0600 | 1.9658 | 597.7420 | 505.0392 |
| 18293 | 99.6483 | 185.3350 | 12.2259 | 654.3397 | 377.2083 |
| 17101 | 99.6483 | 932.8750 | 20.5415 | 456.5038 | 163.8760 |
| 23321 | 99.6483 | 57.4550 | 0.3606 | 115.5587 | 42.3639 |
| 23679 | 99.6483 | 330.0850 | 2.4678 | 175.8115 | 93.7772 |
| 15174 | 99.6483 | 113.6400 | 0.3394 | 51.8665 | 47.8465 |
| 18366 | 99.6483 | 161.0050 | 0.8980 | 78.4435 | 28.8015 |
| 2439 | 99.6483 | 68.3100 | 0.0707 | 74.7484 | 19.1290 |
| 20494 | 99.6483 | −1.3650 | 1.6617 | 194.2949 | 182.8439 |
| 21709 | 99.6483 | 67.7450 | 0.5020 | 136.4161 | 58.0181 |
| 19326 | 99.5897 | 180.5800 | 0.1273 | 150.5905 | 44.0303 |
| 25137 | 99.5897 | 46.0700 | 1.0465 | 14.4783 | 7.8661 |
| 22352 | 99.5897 | 834.5500 | 6.4205 | 437.3252 | 225.0369 |
| 3405 | 99.5897 | 1032.9150 | 20.2020 | 564.5727 | 154.6144 |
| 18810 | 99.5897 | 280.2150 | 4.9427 | 476.2396 | 104.9007 |
| 15402 | 99.5897 | 98.2750 | 0.1626 | 109.8581 | 59.7301 |
| 17421 | 99.5311 | 117.6850 | 0.5303 | 208.5176 | 59.8855 |
| 17691 | 99.5311 | 47.6100 | 0.5515 | 103.9200 | 37.6788 |
| 22025 | 99.5311 | 1325.1750 | 6.7670 | 2624.1173 | 862.3145 |
| 820 | 99.5311 | 112.7300 | 4.8083 | 1031.5106 | 716.5980 |
| 906 | 99.5311 | 58.8300 | 0.4808 | 36.3711 | 22.7198 |
| 16139 | 99.5311 | 107.5250 | 0.6576 | 60.5581 | 20.7526 |
| 11350 | 99.5311 | 2.5000 | 0.2263 | 24.4079 | 14.0898 |
| 17469 | 99.5311 | 3.4650 | 6.2013 | 72.0691 | 33.2045 |
| 15659 | 99.4725 | 209.7700 | 2.8143 | 106.9566 | 33.7689 |
| 16807 | 99.4725 | 131.5900 | 6.6468 | 871.6723 | 712.7876 |
| 16085 | 99.4725 | 24.3100 | 0.8768 | 97.4730 | 51.1015 |
| 20405 | 99.4725 | 44.9500 | 0.9758 | 218.9129 | 96.9160 |
| 21955 | 99.4725 | 111.5200 | 1.7961 | 38.9004 | 28.5789 |
| 505 | 99.4725 | 28.4700 | 0.0990 | 19.3321 | 8.9706 |
| 21903 | 99.4725 | 203.2450 | 1.1526 | 404.9279 | 203.6163 |
| 17953 | 99.4725 | 86.1750 | 3.5992 | 175.8246 | 43.7674 |
| 20746 | 99.4138 | 2064.7150 | 56.5898 | 561.9233 | 300.1698 |
| 13464 | 99.4138 | 110.1150 | 1.1667 | 46.6698 | 31.2359 |
| 18450 | 99.4138 | 493.3850 | 0.7000 | 561.9134 | 125.3520 |
| 631 | 99.4138 | 22.9550 | 0.3182 | 10.9420 | 6.1584 |
| 326 | 99.4138 | 25.9550 | 0.1061 | 24.9881 | 34.8308 |

TABLE 5SS-continued

TACRINE
Timepoint(s): 24 hrs

| GLGC ID NO. | LDA Score | Mean Tox | SD Tox | Mean Nontox | SD Nontox |
|---|---|---|---|---|---|
| 22321 | 99.4138 | 1811.4350 | 11.5046 | 831.5685 | 434.1778 |
| 5496 | 99.3552 | 58.5050 | 0.4738 | 164.5488 | 97.5220 |
| 18281 | 99.3552 | 26.2250 | 0.1061 | 35.9166 | 15.1228 |
| 21115 | 99.3552 | 147.2300 | 3.7901 | 40.4477 | 45.8975 |
| 16930 | 99.3552 | 163.0450 | 3.7972 | 612.6991 | 336.3550 |
| 15151 | 99.3552 | 51.3000 | 1.0889 | 87.6226 | 19.2414 |
| 15301 | 99.3552 | 479.7200 | 6.2084 | 269.3189 | 180.9814 |
| 25528 | 99.3552 | 67.0600 | 0.7920 | 37.8852 | 14.6198 |
| 24865 | 99.3552 | 105.7450 | 87.8863 | 2.3034 | 7.8968 |
| 21909 | 99.3552 | 20.4650 | 6.6822 | 78.8265 | 27.9688 |
| 133 | 99.2966 | 261.8850 | 7.3893 | 88.8113 | 72.5302 |
| 2368 | 99.2966 | 275.6100 | 5.7558 | 464.1293 | 104.7198 |
| 537 | 99.2966 | 298.8550 | 30.7521 | 921.2896 | 355.0487 |
| 16895 | 99.2966 | 23.9200 | 2.4324 | 265.7455 | 167.2385 |
| 1422 | 99.2966 | 32.7550 | 2.0577 | 78.3471 | 20.8470 |
| 18724 | 99.2380 | 125.5800 | 0.7354 | 205.6322 | 135.5263 |
| 6968 | 99.2380 | 87.2650 | 2.1001 | 154.7789 | 34.2473 |
| 1537 | 99.2380 | 22.5050 | 0.1202 | 18.0736 | 11.2864 |
| 21078 | 99.2380 | 22.0350 | 4.4194 | 136.3941 | 75.5033 |
| 600 | 99.2380 | 146.2900 | 15.3584 | 326.7648 | 62.0976 |
| 1946 | 99.1794 | 39.6950 | 0.1909 | 49.7693 | 30.5278 |
| 18618 | 99.1794 | 3136.4250 | 23.9638 | 2253.7834 | 363.2427 |
| 18226 | 99.1794 | 394.7000 | 7.7499 | 265.9230 | 58.3964 |
| 17075 | 99.1794 | 1360.9150 | 78.6939 | 745.6014 | 159.0414 |
| 17742 | 99.1794 | 741.7900 | 64.3043 | 1389.8200 | 241.1768 |
| 13974 | 99.1208 | 983.5250 | 1.5486 | 911.4101 | 257.2852 |
| 23202 | 99.1208 | 51.2400 | 0.1556 | 63.1458 | 24.7472 |
| 15673 | NA | 776.5300 | 0.0000 | 1000.9494 | 162.8365 |
| 23177 | NA | 152.0700 | 0.0000 | 110.4291 | 58.8790 |
| 12583 | 100.0000 | 136.8350 | 5.9326 | 23.2650 | 13.8216 |
| 11818 | 100.0000 | 5.2000 | 5.8690 | 107.5256 | 37.0268 |
| 9821 | 100.0000 | 428.2800 | 4.3275 | 150.1009 | 47.3008 |
| 17865 | 100.0000 | 667.4100 | 0.7495 | 398.5542 | 61.9791 |
| 6225 | 100.0000 | 88.7050 | 0.4738 | 15.2678 | 22.6247 |
| 11179 | 100.0000 | 30.9350 | 0.0071 | 60.8276 | 35.2934 |
| 4401 | 100.0000 | 2.1500 | 0.0849 | 44.3877 | 17.1401 |
| 6824 | 100.0000 | 1792.0800 | 0.2263 | 2125.4592 | 576.8841 |
| 15088 | 100.0000 | 263.1500 | 0.0424 | 212.1390 | 57.3409 |
| 5966 | 100.0000 | 165.6150 | 0.2899 | 69.9456 | 40.4303 |
| 12132 | 100.0000 | 120.9600 | 0.0424 | 83.3198 | 38.3014 |
| 13492 | 100.0000 | −29.1350 | 0.0495 | 37.6392 | 34.0107 |
| 3833 | 100.0000 | 98.4450 | 0.5728 | 212.2015 | 63.4695 |
| 16492 | 100.0000 | 212.7350 | 0.0071 | 347.6728 | 348.1016 |
| 21142 | 100.0000 | 225.8000 | 0.0283 | 117.2754 | 48.7097 |
| 6841 | 100.0000 | 48.1200 | 0.1273 | 276.7175 | 110.1302 |
| 21933 | 100.0000 | 418.3350 | 0.5162 | 1193.7798 | 681.6302 |
| 17524 | 100.0000 | 112.6600 | 0.4384 | 421.3103 | 210.0524 |
| 16568 | 100.0000 | 210.1300 | 0.2970 | 364.1859 | 89.4826 |
| 16702 | 100.0000 | 21.4600 | 0.2687 | 132.5360 | 85.9691 |
| 19009 | 100.0000 | 215.5000 | 28.8358 | 1075.5486 | 293.8527 |
| 14737 | 100.0000 | 278.1750 | 16.9918 | 1144.5061 | 356.1780 |
| 13865 | 99.9414 | 41.4850 | 3.3163 | 136.8927 | 32.6176 |
| 23989 | 99.9414 | 59.8050 | 4.9144 | 330.2910 | 156.6154 |
| 13706 | 99.9414 | 83.0600 | 0.0990 | 179.3668 | 85.9286 |
| 1335 | 99.9414 | 140.3450 | 8.2237 | 495.5679 | 150.1717 |
| 3069 | 99.9414 | 44.2300 | 0.3960 | 117.9445 | 43.4784 |
| 22125 | 99.9414 | 144.1500 | 0.8627 | 42.1928 | 40.8735 |
| 4806 | 99.9414 | 115.7950 | 1.8314 | 18.5775 | 17.7280 |
| 7658 | 99.9414 | 410.2300 | 1.9799 | 231.0706 | 75.6830 |
| 8173 | 99.9414 | 1347.0200 | 39.2586 | 532.1782 | 112.1150 |
| 11256 | 99.9414 | 2.9350 | 0.0354 | 51.1866 | 26.4789 |
| 21861 | 99.9414 | 694.4750 | 11.0662 | 324.2242 | 71.9345 |
| 18826 | 99.9414 | 690.0500 | 0.6364 | 1832.4688 | 925.8768 |
| 2454 | 99.9414 | 62.2650 | 0.0071 | 79.0172 | 57.4390 |
| 14608 | 99.9414 | 74.4100 | 0.1131 | 182.0813 | 76.3075 |
| 12438 | 99.9414 | 257.4950 | 0.2616 | 142.6530 | 66.3890 |
| 22011 | 99.8828 | 132.6350 | 0.0778 | 128.6263 | 35.1819 |
| 4230 | 99.8828 | 679.3500 | 2.8426 | 412.6874 | 86.6259 |
| 23788 | 99.8828 | 32.9500 | 0.0707 | 95.3732 | 35.4522 |
| 10531 | 99.8828 | 74.8600 | 1.1455 | 31.7095 | 11.4970 |
| 17746 | 99.8828 | 93.2850 | 0.1768 | 141.5190 | 36.3115 |
| 14705 | 99.8828 | 29.9200 | 0.4243 | 5.6596 | 16.4007 |
| 9475 | 99.8828 | 60.7050 | 0.1344 | 174.7499 | 86.7860 |
| 6555 | 99.8828 | 188.8450 | 0.1485 | 259.5588 | 58.9095 |
| 21898 | 99.8828 | 148.0400 | 0.5233 | 97.9167 | 23.1769 |
| 12726 | 99.8828 | 66.9350 | 0.1768 | 123.2551 | 32.5349 |
| 5013 | 99.8828 | 749.9200 | 15.4432 | 175.0053 | 133.7395 |
| 22863 | 99.8828 | 79.5450 | 0.0636 | 55.1453 | 26.2597 |
| 7582 | 99.8828 | 119.0450 | 0.2051 | 227.8981 | 72.8248 |
| 14892 | 99.8828 | 184.1750 | 0.5869 | 110.7287 | 34.8198 |
| 24388 | 99.8242 | 1908.8100 | 47.9843 | 708.2736 | 243.9230 |
| 4979 | 99.8242 | 39.8400 | 0.0424 | 66.6662 | 27.2960 |
| 2241 | 99.8242 | 261.1550 | 0.7849 | 162.3622 | 41.5715 |
| 12899 | 99.8242 | 134.2800 | 8.4994 | −29.1558 | 30.8640 |
| 14664 | 99.8242 | 929.0850 | 23.9073 | 340.3356 | 111.8307 |
| 6384 | 99.8242 | 345.4500 | 0.6930 | 217.9104 | 70.0789 |
| 17715 | 99.8242 | 62.9250 | 0.1061 | 147.4092 | 98.6284 |
| 7323 | 99.8242 | −179.2950 | 5.6922 | 48.8643 | 68.4894 |
| 23587 | 99.8242 | 232.2050 | 0.2475 | 161.2546 | 47.9947 |
| 9490 | 99.8242 | 175.0800 | 0.1273 | 145.9418 | 44.6498 |
| 2972 | 99.8242 | 142.3650 | 1.2374 | 328.6134 | 114.7261 |
| 6943 | 99.8242 | 21.3400 | 3.7194 | 106.8212 | 35.5143 |
| 2321 | 99.8242 | 27.6550 | 0.0778 | 10.5680 | 15.9059 |
| 8321 | 99.8242 | 178.8000 | 0.0566 | 219.9885 | 53.5920 |
| 497 | 99.8242 | 753.6750 | 11.4905 | 327.0064 | 110.0074 |
| 20473 | 99.7655 | 65.3050 | 0.0636 | 56.9158 | 24.3544 |
| 11347 | 99.7655 | 24.0050 | 0.1344 | 1.7679 | 13.9558 |
| 7519 | 99.7655 | 740.2500 | 2.6163 | 491.8320 | 103.7716 |
| 11391 | 99.7655 | 328.4000 | 1.1172 | 193.7570 | 58.3774 |
| 16216 | 99.7655 | 1901.4250 | 12.7209 | 907.4193 | 450.4118 |
| 3828 | 99.7655 | 58.9300 | 0.8202 | 495.1482 | 311.7184 |
| 2690 | 99.7655 | 95.5900 | 0.5233 | 163.8505 | 41.7294 |
| 3784 | 99.7655 | 39.5150 | 0.6859 | 152.3127 | 55.1464 |
| 18891 | 99.7655 | −12.8400 | 0.6930 | 86.7338 | 100.8369 |
| 26178 | 99.7655 | 147.0400 | 0.1414 | 114.1493 | 47.2295 |
| 5648 | 99.7655 | 63.0100 | 0.0707 | 71.4211 | 67.6753 |
| 16096 | 99.7655 | 109.5850 | 0.67181 | 312.5899 | 123.1645 |

TABLE 5TT

TACRINE
Timepoint(s): 3, 6 hrs

| GLGC ID NO. | LDA Score | Mean Tox | SD Tox | Mean Nontox | SD Nontox |
|---|---|---|---|---|---|
| 23872 | 98.2311 | 983.9157 | 199.5701 | 169.3366 | 159.0538 |
| 23869 | 97.3467 | 944.6771 | 246.7732 | 161.6538 | 148.8786 |
| 23871 | 97.1698 | 242.4357 | 65.5672 | 62.6747 | 45.8812 |
| 1727 | 96.9340 | 1272.3400 | 165.9392 | 418.9107 | 278.1729 |
| 23868 | 96.8750 | 2801.2214 | 912.7085 | 558.8429 | 490.7302 |
| 3455 | 95.7547 | 962.2329 | 214.2881 | 425.5533 | 159.6486 |
| 21491 | 95.3420 | 357.2600 | 78.9511 | 148.4809 | 68.7493 |
| 9867 | 94.8113 | 36.6957 | 13.5717 | 4.6744 | 14.9516 |
| 24019 | 94.2807 | 140.3343 | 7.1887 | 88.8973 | 42.7219 |
| 15301 | 93.9269 | 543.6229 | 106.4752 | 267.5508 | 179.8524 |
| 20162 | 93.8679 | 195.4343 | 52.9686 | 75.5634 | 83.7044 |
| 21843 | 91.8632 | 75.2929 | 9.0362 | 125.4918 | 35.1651 |
| 24431 | 91.4505 | 618.7814 | 107.0189 | 401.8212 | 308.9506 |
| 22351 | 90.4987 | 260.7714 | 102.1942 | 70.5961 | 34.5315 |
| 11454 | 90.2123 | 368.4943 | 69.4484 | 229.5099 | 104.8890 |
| 19871 | 89.6142 | 133.5629 | 65.2530 | 35.5182 | 23.0719 |
| 26004 | 89.1509 | 40.3357 | 3.5908 | 29.9473 | 17.2507 |
| 26047 | 89.1425 | 742.4829 | 395.6452 | 163.2843 | 191.4115 |
| 22352 | 89.1425 | 1048.5257 | 299.0050 | 433.2167 | 218.1184 |
| 3454 | 89.0246 | 599.5071 | 179.2829 | 223.6597 | 105.2919 |
| 3549 | 88.8561 | 271.9486 | 22.9828 | 359.7190 | 79.6038 |
| 818 | 88.8561 | 2999.9686 | 195.7954 | 2873.8541 | 1774.9830 |
| 15137 | 88.8561 | 1171.0057 | 61.7411 | 1542.2644 | 344.0244 |
| 23895 | 88.6792 | 148.5471 | 18.9320 | 104.2024 | 32.0240 |
| 17161 | 88.5613 | 3345.4814 | 341.4743 | 2226.7127 | 732.6571 |
| 4327 | 88.1486 | 514.3543 | 94.9936 | 329.7588 | 115.1570 |
| 1337 | 88.0307 | 75.7114 | 13.0368 | 119.1759 | 32.3055 |
| 23329 | 87.7948 | 29.2800 | 3.9824 | 50.0744 | 19.5731 |
| 132 | 87.3821 | 236.7686 | 35.9937 | 154.0949 | 82.2401 |

TABLE 5TT-continued

TACRINE
Timepoint(s): 3, 6 hrs

| GLGC ID NO. | LDA Score | Mean Tox | SD Tox | Mean Nontox | SD Nontox |
|---|---|---|---|---|---|
| 857 | 87.3147 | 44.4086 | 20.5752 | 13.8536 | 14.2781 |
| 18361 | 87.2642 | 1863.7886 | 229.8218 | 1260.9934 | 453.3423 |
| 4091 | 87.2052 | 1173.1129 | 49.0403 | 1146.2244 | 208.8874 |
| 13930 | 87.1378 | 362.8271 | 59.2915 | 197.2753 | 96.9124 |
| 23033 | 86.8514 | 320.3129 | 45.0084 | 501.2156 | 150.5150 |
| 4325 | 86.6156 | 27.8486 | 3.0351 | 37.0113 | 12.3454 |
| 606 | 86.5566 | 23.2757 | 13.4089 | −8.4886 | 32.2487 |
| 16112 | 86.4303 | 205.9771 | 51.1321 | 110.6604 | 43.2425 |
| 8898 | 86.3797 | 681.9729 | 54.9702 | 873.0014 | 192.5576 |
| 591 | 86.2618 | 51.8857 | 9.5042 | 37.2297 | 17.1190 |
| 18192 | 86.1439 | 24.2386 | 3.0385 | 17.9108 | 10.6304 |
| 4418 | 86.1439 | 39.6086 | 4.1019 | 36.2465 | 20.7007 |
| 15850 | 86.0849 | 2260.5871 | 113.1967 | 1963.9867 | 351.4734 |
| 721 | 86.0259 | 39.0914 | 2.6735 | 39.2985 | 15.6963 |
| 25170 | 85.8996 | 146.6771 | 30.1536 | 79.9596 | 33.4173 |
| 11210 | 85.7817 | 71.1100 | 16.1524 | 37.6047 | 19.0501 |
| 15558 | 85.7817 | 552.7314 | 90.1649 | 397.9835 | 79.0101 |
| 17516 | 85.6722 | 83.0700 | 12.5387 | 136.9241 | 61.1138 |
| 6595 | 85.6722 | 149.9043 | 9.5285 | 153.6331 | 51.9185 |
| 3787 | 85.4953 | 22.4786 | 8.0402 | 44.5831 | 18.2475 |
| 347 | 85.1415 | 77.8900 | 7.9839 | 63.7338 | 23.1654 |
| 10340 | 85.0825 | 71.7429 | 6.7812 | 65.4609 | 26.8971 |
| 15154 | 84.9646 | 350.5100 | 33.6014 | 484.6277 | 169.7843 |
| 25699 | 84.9646 | 39.73711 | 8.7788 | 50.1714 | 47.7353 |
| 20876 | 84.9057 | 2159.8029 | 347.3916 | 1790.7775 | 415.6758 |
| 24179 | 84.8383 | 28.1629 | 6.3487 | 16.0758 | 6.6144 |
| 12523 | 84.7877 | 384.2286 | 42.5338 | 283.1502 | 83.1627 |
| 23282 | 84.6698 | 334.9886 | 30.1625 | 435.0846 | 94.1321 |
| 19 | 84.5435 | 1117.6929 | 205.8558 | 709.2015 | 210.5323 |
| 643 | 84.5435 | 35.8529 | 19.8017 | 13.9517 | 24.5091 |
| 958 | 84.4340 | 281.7686 | 57.9231 | 505.4072 | 203.6894 |
| 17302 | 84.3750 | 37.5157 | 10.5132 | 65.5103 | 26.0095 |
| 4366 | 84.3666 | 24.4314 | 9.0234 | 12.4939 | 7.6537 |
| 447 | 84.1981 | 14.7129 | 4.9648 | 32.5033 | 20.1118 |
| 18302 | 84.1981 | 106.2471 | 116.5174 | 137.7032 | 73.2874 |
| 20433 | 84.1897 | 69.5114 | 22.8948 | 36.9608 | 44.5993 |
| 21062 | 84.0128 | 70.0029 | 12.2854 | 40.0277 | 20.8070 |
| 25278 | 83.9623 | 43.0671 | 4.1411 | 41.1372 | 17.0278 |
| 15492 | 83.9623 | 126.0614 | 17.8452 | 193.6118 | 64.4575 |
| 15203 | 83.9033 | 213.2329 | 15.1756 | 255.5725 | 58.7833 |
| 20745 | 83.8443 | 246.8629 | 30.6570 | 415.2049 | 223.4928 |
| 14465 | 83.8359 | 68.2871 | 17.9202 | 23.3428 | 23.8375 |
| 16510 | 83.7264 | 136.0986 | 17.1776 | 173.5934 | 80.7074 |
| 16319 | 83.6675 | 78.4886 | 14.9945 | 78.5918 | 49.4090 |
| 1731 | 83.6675 | 53.3229 | 12.8569 | 86.0349 | 34.1281 |
| 20481 | 83.6085 | 22.2486 | 3.6757 | 35.7061 | 15.7807 |
| 737 | 83.5495 | 49.1214 | 14.1827 | 20.8368 | 25.8939 |
| 1451 | 83.5495 | 34.7600 | 5.8016 | 30.4490 | 28.8005 |
| 20493 | 83.5495 | 112.1429 | 10.3164 | 108.9247 | 47.0321 |
| 904 | 83.5411 | 26.4029 | 9.8228 | 49.3710 | 12.9838 |
| 18572 | 83.3726 | 554.0200 | 25.6497 | 617.9267 | 127.1076 |
| 6653 | 83.3726 | 219.5857 | 41.2769 | 331.8192 | 94.1615 |
| 9136 | 83.3726 | 629.9786 | 46.7634 | 526.0103 | 153.8602 |
| 17712 | 83.3137 | 248.0057 | 19.5725 | 291.3135 | 57.1872 |
| 17473 | 83.3053 | 826.8086 | 194.2494 | 548.7859 | 161.1323 |
| 17123 | 83.2547 | 378.8614 | 33.1429 | 301.6688 | 68.8544 |
| 24838 | 83.1958 | 657.9529 | 48.6502 | 858.1014 | 307.6628 |
| 24718 | 83.1958 | 227.1886 | 52.4478 | 155.6433 | 103.1550 |
| 20249 | 83.1368 | 25.5143 | 4.1151 | 38.4195 | 18.7789 |
| 25841 | 83.1368 | 24.6914 | 7.7673 | 7.6599 | 20.0876 |
| 22593 | 83.0778 | 22.0443 | 12.0429 | 5.8963 | 23.6166 |
| 21693 | 83.0189 | 445.5971 | 104.8545 | 335.4754 | 136.6263 |
| 22350 | 83.0020 | 45.6986 | 28.0987 | 15.4355 | 10.1941 |
| 3862 | 82.9599 | 34.7829 | 5.8880 | 36.2221 | 25.3391 |
| 21952 | 82.8420 | 92.7100 | 6.6260 | 104.6165 | 24.5455 |
| 16198 | 82.8420 | 85.6000 | 5.8105 | 106.7979 | 36.2553 |
| 18043 | 82.7746 | 242.9629 | 47.7755 | 134.6822 | 78.5403 |
| 16312 | 82.7662 | 81.1243 | 32.7066 | 29.5812 | 16.8308 |
| 25680 | 82.7241 | 1015.3886 | 84.0886 | 1069.6719 | 309.2812 |
| 489 | 82.6651 | 104.0043 | 42.1703 | 448.3203 | 474.2084 |
| 20018 | 82.6567 | 63.5329 | 23.0792 | 28.2982 | 29.9847 |
| 22885 | 98.9387 | 541.7457 | 169.0885 | 2211.0320 | 675.9507 |
| 23230 | 98.5849 | 1295.2471 | 199.3443 | 571.5190 | 168.5048 |
| 5469 | 98.4670 | 421.8157 | 52.6613 | 186.1822 | 57.1558 |
| 18434 | 98.0542 | 1046.3314 | 221.9096 | 407.3745 | 155.6930 |
| 2655 | 97.5236 | 2475.9571 | 371.0665 | 935.1263 | 451.1893 |
| 6609 | 97.1108 | 1867.3343 | 242.4095 | 1049.5035 | 268.0560 |
| 19723 | 96.8750 | 621.8243 | 120.1396 | 223.6366 | 107.1919 |
| 8143 | 96.8750 | 732.2643 | 205.8705 | 233.9692 | 130.1926 |
| 3759 | 96.6392 | 564.7314 | 109.3751 | 269.4965 | 85.1330 |
| 13618 | 96.4033 | 367.5214 | 52.1896 | 211.8028 | 50.0483 |
| 6897 | 96.0495 | 593.9971 | 153.4014 | 248.0066 | 103.3599 |
| 22263 | 95.4599 | 239.3829 | 15.2776 | 162.7295 | 42.5036 |
| 21579 | 94.9882 | 795.9300 | 174.8529 | 317.0796 | 168.2579 |
| 21698 | 94.3396 | 158.7829 | 19.9094 | 99.2156 | 29.8815 |
| 14760 | 93.6321 | 92.0071 | 9.3269 | 49.1990 | 29.1956 |
| 23404 | 93.5142 | 151.5843 | 19.6418 | 87.2057 | 34.0529 |
| 14335 | 93.0425 | 118.0571 | 9.0830 | 76.8193 | 26.7527 |
| 8496 | 92.8066 | 183.1171 | 31.5137 | 90.3151 | 49.3134 |
| 21275 | 92.6297 | 1405.4471 | 219.8437 | 824.0714 | 294.0943 |
| 16970 | 92.5118 | 892.4200 | 42.6024 | 687.2892 | 137.0219 |
| 21311 | 92.3349 | 53.3343 | 4.1858 | 41.5706 | 44.5722 |
| 7516 | 91.8548 | 295.6343 | 274.9823 | 0.8575 | 26.4925 |
| 22213 | 91.6863 | 530.3829 | 40.2104 | 409.7618 | 68.5797 |
| 10182 | 91.6779 | 186.3914 | 154.9259 | −11.5268 | 23.4917 |
| 6174 | 91.5094 | 215.1714 | 60.5651 | 426.5655 | 141.5273 |
| 2091 | 91.4505 | 325.2514 | 37.5717 | 225.2499 | 60.2522 |
| 11575 | 91.2146 | 436.5614 | 29.2897 | 330.7193 | 68.1583 |
| 11435 | 91.0967 | 316.1843 | 24.2358 | 230.3909 | 55.2187 |
| 2099 | 90.9198 | 1175.9557 | 129.3827 | 843.5866 | 201.7875 |
| 14380 | 90.9198 | 106.1314 | 36.8391 | 246.8648 | 98.3464 |
| 2264 | 90.9198 | 186.3171 | 5.0135 | 171.8866 | 40.4568 |
| 16671 | 90.5660 | −6.0429 | 17.1202 | 42.1197 | 32.5907 |
| 14560 | 90.4947 | 261.7629 | 113.7426 | 99.3738 | 36.9173 |
| 14519 | 90.3892 | 160.4557 | 21.9361 | 96.2858 | 48.6230 |
| 5255 | 90.3892 | 381.4500 | 66.3175 | 207.3205 | 103.0740 |
| 6290 | 90.3302 | 89.6057 | 10.1914 | 139.9339 | 38.8379 |
| 5996 | 90.2712 | 49.2986 | 7.2405 | 85.3905 | 31.1449 |
| 8296 | 90.1449 | 393.2786 | 147.6801 | 191.9145 | 53.1043 |
| 15113 | 90.0943 | 126.7786 | 27.2254 | 197.3593 | 46.6165 |
| 5781 | 90.0859 | 501.0557 | 244.4327 | 149.5959 | 84.9565 |
| 11763 | 89.9680 | 528.6914 | 154.1662 | 140.6452 | 91.6764 |
| 2188 | 89.9175 | 192.4186 | 22.8709 | 134.4135 | 46.3205 |
| 13645 | 89.7995 | 66.4886 | 10.0597 | 110.0156 | 34.2365 |
| 19248 | 89.7911 | 346.9700 | 50.8054 | 206.7090 | 45.5772 |
| 2245 | 89.7406 | 105.8314 | 19.1335 | 66.9590 | 25.5685 |
| 12394 | 89.6816 | 307.2057 | 35.4213 | 227.1283 | 58.3315 |
| 4049 | 89.6816 | 132.2857 | 61.4232 | 614.3919 | 444.7317 |
| 15089 | 89.6816 | 442.7000 | 20.8373 | 533.5996 | 172.1683 |
| 12926 | 89.6226 | 257.4257 | 38.1427 | 174.9156 | 60.1284 |
| 5012 | 89.6226 | 870.4286 | 111.6776 | 601.7194 | 169.5134 |
| 8036 | 89.4963 | 235.6100 | 70.8868 | 116.9312 | 71.8052 |
| 5953 | 89.4373 | 877.7186 | 141.1901 | 335.6551 | 165.5331 |
| 18485 | 89.4373 | 108.1371 | 48.6663 | 46.6956 | 19.7346 |
| 8173 | 89.3194 | 851.6057 | 159.8917 | 531.4632 | 114.8422 |
| 6974 | 89.2689 | 369.1186 | 55.1827 | 257.2524 | 90.9307 |
| 22387 | 89.0330 | 701.4071 | 84.0406 | 1048.8351 | 263.6860 |
| 18693 | 89.0246 | 567.9229 | 125.7617 | 289.8807 | 87.3101 |
| 20903 | 88.9067 | 966.5000 | 493.5537 | 367.7951 | 211.7213 |
| 17335 | 88.8561 | 68.9543 | 13.2696 | 120.2965 | 36.3013 |
| 7596 | 88.8561 | 87.9186 | 22.8738 | 163.2979 | 57.8696 |
| 12354 | 88.6792 | 70.4057 | 19.4453 | 154.7402 | 77.0413 |
| 26119 | 88.6203 | 377.0443 | 46.4320 | 273.5277 | 78.1566 |
| 23299 | 88.6119 | 2931.3757 | 1162.8723 | 1233.7692 | 549.6677 |
| 17614 | 88.5024 | 71.4400 | 30.5388 | 161.5714 | 61.4038 |
| 12873 | 88.4939 | 294.7614 | 104.1976 | 121.3084 | 57.0812 |
| 16688 | 88.3844 | 889.9757 | 79.2459 | 688.0041 | 195.6798 |
| 22211 | 88.3844 | 1882.0186 | 167.2309 | 1371.5057 | 365.0129 |
| 16216 | 88.3170 | 2072.7771 | 540.1016 | 900.1439 | 439.3844 |
| 11421 | 88.2665 | 145.5086 | 7.1754 | 171.6296 | 43.5099 |
| 7161 | 88.0896 | 231.7743 | 31.5337 | 160.3439 | 49.0815 |
| 2049 | 88.0896 | 264.4686 | 34.1012 | 166.5597 | 82.0812 |
| 22366 | 87.9717 | 133.9971 | 48.5983 | 224.4516 | 62.2997 |
| 5937 | 87.9043 | 637.3071 | 115.7359 | 371.3326 | 97.1509 |

TABLE 5UU

TAMOXIFEN
Timepoint(s): 24 hrs

| GLGC ID NO. | LDA Score | Mean Tox | SD Tox | Mean Nontox | SD Nontox |
|---|---|---|---|---|---|
| 20712 | 99.3537 | 73.2350 | 4.2969 | 246.6146 | 132.6729 |
| 537 | 99.2949 | 301.4650 | 34.4555 | 922.7402 | 354.1958 |
| 819 | 99.1187 | 350.7650 | 21.4528 | 1706.0754 | 942.9961 |
| 14964 | 98.3549 | 77.4925 | 7.9388 | 296.6999 | 224.5681 |
| 818 | 98.2961 | 482.9025 | 74.1621 | 2886.1298 | 1764.3057 |
| 1818 | 98.2961 | 268.2250 | 36.1530 | 762.0535 | 294.6689 |
| 1959 | 98.1786 | 285.8900 | 88.5445 | 1344.7558 | 853.6845 |
| 24645 | 98.0611 | 28.3125 | 6.2424 | 115.8804 | 43.5378 |
| 1958 | 97.9436 | 366.5025 | 167.4034 | 1764.5784 | 838.3526 |
| 17634 | 97.7673 | −3.8300 | 4.8156 | 83.5693 | 63.7451 |
| 1798 | 97.7086 | 271.2650 | 47.3768 | 1202.7976 | 660.1977 |
| 3430 | 97.4148 | 983.9000 | 100.6391 | 500.0248 | 182.2723 |
| 1995 | 97.4148 | 44.2475 | 3.1944 | 279.8447 | 212.4640 |
| 820 | 97.2385 | 132.2475 | 43.1126 | 1033.5782 | 716.1640 |
| 14583 | 97.2385 | 642.2025 | 28.8046 | 397.6900 | 121.3904 |
| 1552 | 97.1798 | 3.8650 | 3.0714 | 85.5140 | 66.1498 |
| 6539 | 97.1798 | 153.1525 | 18.7883 | −2.6103 | 79.2817 |
| 16947 | 97.1210 | 93.1825 | 17.5824 | 346.8137 | 139.0529 |
| 1504 | 97.1210 | 71.9275 | 22.9621 | 17.0339 | 15.1435 |
| 21827 | 97.1210 | 97.3675 | 2.5261 | 148.3878 | 37.1786 |
| 670 | 97.0623 | 70.9750 | 14.0824 | 313.6704 | 123.1651 |
| 4500 | 97.0035 | 107.2200 | 30.9614 | 34.1040 | 25.3494 |
| 20939 | 97.0035 | 1160.0600 | 173.4027 | 544.2771 | 176.7299 |
| 19073 | 97.0035 | 692.7850 | 39.2860 | 461.1304 | 100.6003 |
| 20746 | 96.9448 | 1353.5725 | 173.2066 | 561.7341 | 304.2637 |
| 20493 | 96.8860 | 24.4725 | 7.9108 | 109.3481 | 46.5949 |
| 2384 | 96.8860 | 35.1975 | 19.5715 | 287.3799 | 165.6545 |
| 13488 | 96.8860 | 11.1800 | 1.1493 | 29.2904 | 12.8387 |
| 4225 | 96.8860 | 82.4175 | 5.9427 | 167.5647 | 59.9193 |
| 15661 | 96.7685 | 96.9400 | 50.9059 | 29.4486 | 25.9326 |
| 24774 | 96.7685 | 21.6625 | 0.4640 | 21.3980 | 10.2175 |
| 17913 | 96.7685 | 347.1700 | 18.2050 | 230.9473 | 62.6904 |
| 1562 | 96.7098 | 126.0300 | 16.9322 | 321.8230 | 128.5222 |
| 844 | 96.7098 | 60.5500 | 12.0698 | 142.6625 | 38.5503 |
| 1551 | 96.7098 | 36.2575 | 11.1872 | 179.7551 | 92.5960 |
| 19181 | 96.7098 | 161.2475 | 29.7691 | 91.7429 | 22.4198 |
| 3717 | 96.6510 | 713.3725 | 31.8238 | 427.2528 | 141.4711 |
| 26032 | 96.5922 | 91.2750 | 14.9230 | 502.4963 | 438.6481 |
| 1531 | 96.5922 | 7.8300 | 3.7815 | 145.1372 | 131.2302 |
| 228 | 96.5335 | 54.0800 | 10.0844 | 117.4644 | 36.7597 |
| 3453 | 96.4747 | 234.7600 | 12.8079 | 150.0519 | 37.5972 |
| 15671 | 96.4747 | 197.8750 | 2.2011 | 236.9966 | 48.9935 |
| 25907 | 96.4160 | 213.2725 | 32.3002 | 79.4058 | 49.0147 |
| 1508 | 96.4160 | 56.3850 | 15.7996 | 267.8969 | 123.1980 |
| 6107 | 96.4160 | 1081.3975 | 132.4071 | 543.4359 | 214.3742 |
| 20801 | 96.3572 | 413.1175 | 37.7377 | 223.3056 | 103.6003 |
| 24033 | 96.2985 | 132.7900 | 23.9543 | 67.8103 | 22.7330 |
| 16948 | 96.2985 | 37.3300 | 16.4045 | 292.9766 | 194.1653 |
| 25204 | 96.2397 | 21.5675 | 5.9691 | 106.6479 | 56.2077 |
| 18597 | 96.2397 | 2170.7300 | 287.1219 | 1074.1398 | 364.8949 |
| 22841 | 96.2397 | 468.2525 | 92.3926 | 237.1032 | 85.2221 |
| 20716 | 96.2397 | 153.3575 | 61.2643 | 524.1209 | 180.7976 |
| 20931 | 96.2397 | 270.7925 | 10.2060 | 222.4098 | 141.9609 |
| 20984 | 96.1222 | 47.1150 | 7.7180 | 149.9955 | 147.8467 |
| 25799 | 96.1222 | 475.2525 | 40.3262 | 211.8581 | 140.4310 |
| 25777 | 96.1222 | 3390.6575 | 530.9110 | 1742.9540 | 556.8336 |
| 32 | 96.1222 | −9.2000 | 12.9131 | 50.8835 | 27.1338 |
| 18498 | 96.0635 | 366.9300 | 36.5774 | 237.9460 | 55.3007 |
| 1550 | 96.0635 | −0.6375 | 2.9208 | 44.3582 | 35.9754 |
| 20745 | 96.0635 | 900.6675 | 247.6286 | 411.5383 | 220.6214 |
| 16895 | 96.0047 | 31.6300 | 16.1424 | 266.2776 | 167.0718 |
| 6108 | 95.9459 | 921.1450 | 124.5260 | 508.4083 | 173.8601 |
| 4426 | 95.9459 | 452.6500 | 31.4705 | 276.6623 | 76.3657 |
| 17937 | 95.9459 | 91.7975 | 4.1825 | 47.8490 | 36.4520 |
| 614 | 95.8872 | 169.1200 | 21.8488 | 376.4326 | 126.6590 |
| 16807 | 95.8872 | 148.4900 | 47.0198 | 873.3322 | 712.7964 |
| 19084 | 95.8284 | 601.5225 | 12.5162 | 462.6870 | 93.7481 |
| 17836 | 95.7697 | 198.3100 | 34.5121 | 110.0593 | 33.1273 |
| 2667 | 95.7109 | 47.2775 | 15.3800 | 180.6304 | 85.6554 |
| 24204 | 95.6522 | 269.0675 | 27.7240 | 154.7672 | 48.7920 |
| 6055 | 95.6522 | 63.6900 | 23.0997 | 315.6228 | 163.3712 |
| 1561 | 95.5934 | 27.4525 | 16.1425 | 248.2342 | 146.5969 |
| 25567 | 95.5934 | 911.9150 | 189.1161 | 427.3259 | 180.2790 |
| 16721 | 95.5934 | 53.7675 | 8.5771 | 123.8304 | 48.6449 |
| 1515 | 95.5934 | 78.2025 | 3.9129 | 49.5178 | 18.6188 |
| 22919 | 95.5347 | 379.3025 | 46.3613 | 246.8864 | 60.8989 |
| 16306 | 95.5347 | 103.0950 | 37.2183 | 272.9263 | 80.8883 |
| 20650 | 95.5347 | 60.5775 | 56.0918 | 607.4079 | 404.9776 |
| 1045 | 95.4759 | 119.3150 | 5.8786 | 84.4845 | 27.2718 |
| 17764 | 95.4172 | 3903.6000 | 308.2638 | 2521.9503 | 641.9945 |
| 17064 | 95.4172 | 218.7375 | 31.8654 | 111.1074 | 48.3979 |
| 16562 | 95.4172 | 78.3800 | 6.7888 | 147.6856 | 50.5424 |
| 4574 | 95.3584 | 120.0150 | 18.5328 | 327.3189 | 128.3071 |
| 21989 | 95.3584 | 204.1450 | 35.7400 | 111.0605 | 34.0671 |
| 18108 | 95.3584 | 1018.6800 | 53.9662 | 708.3548 | 180.3863 |
| 17684 | 95.3584 | 10.0875 | 6.8472 | 62.4618 | 32.9998 |
| 18719 | 95.2409 | 18.5225 | 4.8967 | 129.9561 | 94.5962 |
| 1546 | 95.2409 | 38.4525 | 9.2093 | 108.1505 | 45.5193 |
| 4314 | 95.2409 | 45.4900 | 15.4041 | 163.9044 | 83.6661 |
| 17088 | 95.1821 | 646.9650 | 118.2375 | 350.8275 | 135.7461 |
| 14632 | 95.0646 | 217.9625 | 80.9555 | 941.8350 | 394.8074 |
| 22282 | 95.0646 | 249.5400 | 32.4191 | 144.5311 | 45.3856 |
| 16343 | 95.0646 | 326.7425 | 62.5674 | 178.9057 | 56.1984 |
| 4256 | 95.0646 | 56.1675 | 15.0496 | 8.4601 | 21.7591 |
| 1522 | 95.0059 | 274.6425 | 22.9766 | 133.6465 | 79.8282 |
| 23961 | 95.0059 | 79.6625 | 36.1386 | 274.2524 | 121.8769 |
| 13283 | 94.9471 | 31.7475 | 16.2761 | 145.5260 | 71.6416 |
| 24235 | 94.9471 | 1083.8450 | 50.6272 | 761.3037 | 226.2534 |
| 25643 | 94.8884 | 978.1175 | 113.9602 | 544.6124 | 207.6690 |
| 17727 | 94.8884 | 120.9950 | 26.7159 | 60.5948 | 21.9614 |
| 21649 | 98.8249 | 1224.6075 | 88.9280 | 405.7291 | 223.6608 |
| 19623 | 98.7662 | 249.0650 | 23.1384 | 97.9027 | 53.0408 |
| 19456 | 98.6486 | 606.1225 | 53.6072 | 154.6974 | 141.5054 |
| 22884 | 98.5899 | 438.0175 | 32.4143 | 236.2737 | 55.9184 |
| 5954 | 98.2961 | 1646.9800 | 337.4062 | 5526.0327 | 1795.6730 |
| 22079 | 98.2961 | 1090.4550 | 75.1320 | 2414.0943 | 763.5619 |
| 5446 | 98.1199 | 162.8375 | 12.4656 | 75.8704 | 31.5587 |
| 4049 | 97.8261 | 1865.1750 | 152.8462 | 604.5471 | 437.5927 |
| 16345 | 97.7673 | 1827.1925 | 119.8859 | 1000.9747 | 273.3885 |
| 23261 | 97.5911 | 38.3825 | 11.9430 | 395.8926 | 235.8133 |
| 7586 | 97.5323 | −3.5800 | 3.6097 | 55.7322 | 51.1290 |
| 3163 | 97.4736 | 68.1525 | 0.9482 | 53.6844 | 32.5928 |
| 17791 | 97.2973 | 66.2150 | 8.8603 | 151.5819 | 47.6460 |
| 2528 | 97.2973 | 644.6925 | 141.0519 | 202.2028 | 113.6257 |
| 12719 | 97.2385 | 378.9275 | 56.7535 | 148.8357 | 67.4589 |
| 8759 | 97.1210 | 191.2950 | 7.2961 | 96.6631 | 145.5170 |
| 12306 | 97.1210 | 6.5325 | 1.5131 | 60.9653 | 71.2700 |
| 17812 | 96.9448 | 123.8800 | 15.5956 | 356.2407 | 156.0959 |
| 2668 | 96.9448 | 101.4875 | 18.9320 | 409.1415 | 230.2966 |
| 3579 | 96.8860 | 81.7025 | 18.5727 | 380.1527 | 212.8423 |
| 6132 | 96.8860 | 53.3600 | 13.6323 | 167.6961 | 70.3314 |
| 10405 | 96.8273 | 15.2300 | 4.7907 | 90.4449 | 54.9550 |
| 9889 | 96.8273 | 28.7825 | 17.4669 | 436.8089 | 323.8168 |
| 11527 | 96.7098 | 489.7525 | 47.1158 | 255.0325 | 93.7001 |
| 10087 | 96.6510 | 78.2175 | 22.5608 | 288.1711 | 134.0266 |
| 4048 | 96.6510 | 968.9800 | 150.0888 | 295.6678 | 281.2009 |
| 19555 | 96.6510 | 95.2925 | 23.3038 | 384.1164 | 246.9061 |
| 15088 | 96.5922 | 306.1175 | 14.4124 | 211.8172 | 57.0915 |
| 5355 | 96.4747 | 244.9925 | 83.8839 | 1111.7845 | 519.4556 |
| 7469 | 96.4160 | 289.0425 | 18.5822 | 182.3555 | 50.1720 |
| 18909 | 96.4160 | 67.0000 | 21.8881 | 366.3462 | 198.4114 |
| 23596 | 96.3572 | 142.7000 | 11.5073 | 309.1455 | 134.7287 |
| 6297 | 96.3572 | 23.1975 | 7.5403 | 113.3091 | 59.4780 |
| 18960 | 96.3572 | 157.0800 | 17.8444 | 85.9608 | 30.1910 |
| 22071 | 96.3572 | 497.6825 | 35.5300 | 318.1904 | 89.1195 |
| 16865 | 96.2397 | 148.9400 | 81.9491 | 42.5946 | 53.8348 |
| 3917 | 96.2397 | 124.3050 | 54.8541 | 872.7054 | 517.3530 |
| 5833 | 96.2397 | 21.3850 | 4.8739 | 70.9574 | 34.5682 |
| 9211 | 96.1810 | 428.6250 | 35.1482 | 240.7218 | 79.5025 |
| 230 | 96.1810 | 144.1875 | 68.0681 | 687.0822 | 329.6134 |
| 3275 | 96.1222 | 344.2475 | 46.2131 | 178.5436 | 64.1321 |
| 13454 | 96.0635 | 120.2725 | 1.9266 | 145.1381 | 70.3023 |
| 18524 | 96.0635 | 282.9300 | 36.4388 | 765.5830 | 330.9474 |

TABLE 5VV

TETRACYCLINE
Timepoint(s): 24 hrs

| GLGC ID NO. | LDA Score | Mean Tox | SD Tox | Mean Nontox | SD Nontox |
|---|---|---|---|---|---|
| 22220 | 99.8822 | 130.2357 | 32.8210 | 1445.9045 | 601.1125 |
| 426 | 99.8233 | 650.8950 | 61.9680 | 2603.6254 | 1300.8329 |
| 25069 | 99.7055 | 59.7605 | 6.7558 | 328.1781 | 206.1853 |
| 22219 | 99.7055 | 57.4918 | 15.4888 | 607.9568 | 269.2391 |
| 11755 | 99.5289 | 94.7985 | 12.2666 | 687.8772 | 300.4762 |
| 17805 | 99.5289 | 109.8838 | 12.3824 | 660.3324 | 268.5619 |
| 18989 | 99.3522 | 264.1868 | 70.4021 | 1450.4210 | 692.7450 |
| 670 | 99.1755 | 89.7402 | 3.4178 | 314.1095 | 122.9996 |
| 111 | 99.1755 | 1098.6105 | 76.1980 | 2877.0175 | 972.7216 |
| 25326 | 99.1166 | 833.1158 | 60.2859 | 2203.3598 | 682.9501 |
| 1869 | 99.0577 | 17.0427 | 15.8625 | 706.6066 | 392.2191 |
| 17693 | 99.0577 | 37.9072 | 6.7904 | 159.1182 | 85.5182 |
| 2555 | 98.9988 | 885.8615 | 99.9609 | 298.3111 | 127.4290 |
| 1508 | 98.9988 | 55.6155 | 5.4910 | 268.4006 | 122.9072 |
| 17227 | 98.9988 | 554.2655 | 48.8557 | 1281.2006 | 335.2169 |
| 1798 | 98.9988 | 283.2140 | 18.6117 | 1204.9075 | 659.5455 |
| 20819 | 98.9988 | 352.9500 | 24.5643 | 196.9752 | 40.8490 |
| 1247 | 98.9988 | 10.9497 | 3.4864 | 130.5799 | 108.6180 |
| 12606 | 98.9399 | 27.9170 | 11.2107 | 154.5609 | 76.4092 |
| 650 | 98.8221 | 35.0092 | 5.89461 | 159.8486 | 97.3237 |
| 14347 | 98.8221 | 188.9633 | 41.5250 | 886.6096 | 339.4117 |
| 25725 | 98.8221 | 3.4782 | 7.8049 | 93.0011 | 57.0826 |
| 20914 | 98.7633 | −11.8792 | 7.2966 | 196.9603 | 186.1485 |
| 14346 | 98.7044 | 114.9373 | 43.4066 | 730.6620 | 317.5564 |
| 427 | 98.7044 | 419.5060 | 58.4040 | 1719.4579 | 921.5010 |
| 15851 | 98.6455 | −16.4322 | 7.5686 | 220.8996 | 199.0984 |
| 23878 | 98.6455 | 81.4322 | 12.4518 | 20.1193 | 13.7522 |
| 2384 | 98.5866 | 22.0222 | 7.8421 | 288.0671 | 165.2525 |
| 20449 | 98.5866 | 229.3185 | 36.9347 | 46.5622 | 64.3427 |
| 1868 | 98.5866 | −33.0308 | 16.4110 | 462.3777 | 323.2941 |
| 15661 | 98.5277 | 75.0573 | 3.7719 | 29.4442 | 26.2667 |
| 108 | 98.5277 | 539.4930 | 93.2670 | 1577.0199 | 611.0621 |
| 23961 | 98.4688 | 54.0058 | 13.4213 | 274.8921 | 121.3571 |
| 17158 | 98.4688 | 344.2177 | 90.5350 | 55.4516 | 48.0548 |
| 1557 | 98.4688 | 82.0980 | 16.6927 | 16.2204 | 13.4258 |
| 24710 | 98.4688 | 35.3535 | 3.3552 | 12.7569 | 10.1919 |
| 4748 | 98.4099 | 23.9230 | 6.0186 | 452.8025 | 360.1318 |
| 20650 | 98.4099 | 39.6082 | 12.3496 | 608.8443 | 404.3899 |
| 2554 | 98.4099 | 258.6987 | 28.3426 | 98.8093 | 37.4506 |
| 2010 | 98.4099 | 1001.3297 | 112.8231 | 2948.4610 | 1102.2065 |
| 402 | 98.3510 | 106.3513 | 32.7679 | 1081.0045 | 527.9927 |
| 20448 | 98.2921 | 185.4335 | 33.8649 | 50.3866 | 52.3858 |
| 20699 | 98.2921 | 24.4962 | 7.6021 | 348.5719 | 312.4400 |
| 17226 | 98.2921 | 335.3992 | 48.5553 | 848.0185 | 245.6111 |
| 46 | 98.2332 | 348.7580 | 76.7924 | 44.2338 | 60.4829 |
| 1379 | 98.2332 | 114.4102 | 10.1136 | 45.8880 | 22.4754 |
| 15028 | 98.1743 | 89.1578 | 13.6718 | 337.4507 | 149.0594 |
| 4314 | 98.1743 | 34.8027 | 8.6066 | 164.2589 | 83.4566 |
| 23660 | 98.1743 | 382.8345 | 59.1975 | 1001.2748 | 276.6513 |
| 21981 | 98.1743 | 135.4675 | 11.8705 | 278.9571 | 80.2845 |
| 25024 | 98.1743 | 53.5670 | 12.5091 | 240.1519 | 113.8262 |
| 109 | 98.1743 | 1319.0768 | 267.1436 | 3523.5456 | 1217.4647 |
| 1958 | 98.1743 | 484.0167 | 93.6646 | 1767.0414 | 837.9446 |
| 19825 | 98.1743 | −3.0148 | 4.8999 | 73.1542 | 55.3781 |
| 563 | 98.1154 | 88.0498 | 25.3677 | 582.6894 | 352.5511 |
| 20699 | 98.1154 | 883.0995 | 74.7613 | 2095.1144 | 658.3075 |
| 19040 | 98.1154 | 1614.223 | 3135.9921 | 833.6524 | 301.9434 |
| 20700 | 98.0565 | 858.7620 | 165.7691 | 3043.6708 | 1088.4985 |
| 20586 | 98.0565 | 17.5170 | 5.0878 | 142.3199 | 68.8434 |
| 6013 | 98.0565 | 109.5312 | 19.2312 | 529.2239 | 268.8443 |
| 4500 | 97.9976 | 114.9168 | 17.5881 | 33.8773 | 24.9926 |
| 23871 | 97.9976 | 152.8840 | 11.0974 | 63.5193 | 48.3812 |
| 20193 | 97.9976 | 27.8908 | 11.5545 | 4.3460 | 9.1150 |
| 11982 | 97.9388 | 380.2637 | 31.6857 | 188.9791 | 67.0454 |
| 14633 | 97.9388 | 81.9903 | 27.2755 | 492.5833 | 203.3008 |
| 7176 | 97.9388 | 708.8310 | 66.9646 | 303.2429 | 130.6142 |
| 1630 | 97.9388 | 150.9457 | 40.3850 | 34.4146 | 23.1995 |
| 4524 | 97.9388 | 179.6277 | 23.2129 | 70.6273 | 29.5533 |
| 16947 | 97.8799 | 75.1085 | 17.9450 | 347.5389 | 138.4236 |
| 16139 | 97.8799 | 119.7263 | 13.7273 | 60.2505 | 20.2961 |
| 208 | 97.8210 | 51.2432 | 23.9904 | −0.5958 | 14.4755 |
| 14003 | 97.8210 | 142.4053 | 16.9175 | 339.3119 | 115.2720 |
| 5384 | 97.7621 | 233.7298 | 21.8130 | 89.2259 | 54.6462 |
| 1530 | 97.7621 | 61.2343 | 8.0841 | 16.7825 | 15.5639 |
| 20698 | 97.7032 | 12.7432 | 14.0550 | 376.0902 | 209.1290 |
| 20421 | 97.7032 | 91.6033 | 6.8143 | 50.8633 | 14.5796 |
| 1546 | 97.7032 | 31.8850 | 4.6470 | 108.3611 | 45.3738 |
| 20464 | 97.6443 | 9.1067 | 9.3889 | 257.8579 | 161.5436 |
| 17956 | 97.6443 | 196.9510 | 12.7663 | 121.5488 | 30.4987 |
| 14250 | 97.6443 | 224.2627 | 38.3882 | 64.5760 | 71.1119 |
| 16780 | 97.6443 | 59.5710 | 9.9627 | 175.3925 | 96.2208 |
| 635 | 97.6443 | 434.6077 | 103.0363 | 1013.6628 | 335.6759 |
| 1045 | 97.5265 | 183.0585 | 27.7750 | 83.9520 | 26.0339 |
| 1496 | 97.5265 | 248.0738 | 16.3341 | 124.0036 | 50.2713 |
| 1495 | 97.5265 | 261.3765 | 20.5226 | 134.0611 | 44.1712 |
| 25325 | 97.5265 | 103.0088 | 58.7126 | 982.4467 | 540.4443 |
| 5545 | 97.5265 | 106.2063 | 34.0193 | 545.3574 | 272.0406 |
| 18108 | 97.5265 | 1114.4816 | 60.4702 | 706.9467 | 178.5776 |
| 17554 | 97.5265 | 55.7022 | 28.5974 | 432.6213 | 269.6811 |
| 1306 | 97.4676 | 319.0967 | 35.1856 | 150.9187 | 57.1578 |
| 18553 | 97.4087 | 401.4467 | 77.7704 | 115.0935 | 93.1857 |
| 354 | 97.4087 | 1348.2967 | 170.0670 | 507.2905 | 315.8262 |
| 18025 | 97.4087 | 301.4763 | 21.6092 | 159.3709 | 51.6019 |
| 591 | 97.2909 | 79.1402 | 11.1175 | 37.0543 | 16.7910 |
| 358 | 97.2909 | 268.6412 | 35.3284 | 735.0727 | 316.1771 |
| 11949 | 97.2909 | 75.8527 | 10.5648 | 37.8494 | 14.4560 |
| 16930 | 97.2320 | 118.6493 | 34.5328 | 615.1314 | 335.2689 |
| 20587 | 97.2320 | 69.2143 | 11.6037 | 253.1044 | 122.8018 |
| 20746 | 97.2320 | 1214.3198 | 147.4005 | 560.8529 | 304.4936 |
| 16417 | 97.2320 | 296.5592 | 25.6698 | 164.4356 | 50.7303 |
| 2888 | 99.9411 | 91.2345 | 20.6841 | 1132.1502 | 614.7726 |
| 9192 | 99.7644 | 189.7572 | 21.0927 | 850.9952 | 444.2027 |
| 17783 | 99.6466 | 1164.7637 | 163.8139 | 329.4144 | 126.6891 |
| 576 | 99.3522 | 146.2512 | 19.4715 | 986.5187 | 555.7285 |
| 23125 | 99.3522 | 173.6328 | 23.2626 | 665.5830 | 458.4881 |
| 2748 | 99.2933 | 545.7582 | 57.7599 | 247.3496 | 64.9539 |
| 5183 | 99.2933 | 374.3472 | 35.3905 | 160.5031 | 42.0004 |
| 24192 | 99.1755 | 232.7790 | 30.5090 | 906.1658 | 490.8575 |
| 17248 | 99.1166 | 1203.8833 | 61.7037 | 2134.6513 | 439.6190 |
| 24171 | 99.1166 | 87.8897 | 10.3926 | 22.1274 | 15.2780 |
| 7740 | 98.8221 | 426.5643 | 35.4740 | 181.2524 | 60.2914 |
| 3619 | 98.8221 | 206.1040 | 20.5902 | 93.7269 | 31.8421 |
| 8436 | 98.8221 | 209.4725 | 53.5400 | 1730.1021 | 788.7065 |
| 14007 | 98.7633 | 8.7375 | 1.4492 | 88.9432 | 56.7708 |
| 11871 | 98.7633 | 444.2603 | 140.9039 | −128.6876 | 96.3329 |
| 21796 | 98.7633 | 525.4250 | 75.8985 | 195.4612 | 78.6222 |
| 22079 | 98.7044 | 896.0612 | 95.7567 | 2418.5863 | 759.1488 |
| 2826 | 98.7044 | 234.0377 | 47.9011 | 56.3216 | 32.7686 |
| 11873 | 98.6455 | 391.8642 | 63.3514 | 38.8149 | 48.0912 |
| 16802 | 98.6455 | 298.7085 | 28.7428 | 1128.1505 | 493.7951 |
| 6252 | 98.6455 | 901.8658 | 59.6926 | 423.6346 | 146.0404 |
| 4355 | 98.6455 | 693.1297 | 87.8490 | 311.9896 | 114.6693 |
| 24229 | 98.6455 | 285.9425 | 59.9059 | 1974.7371 | 1245.0863 |
| 8057 | 98.5277 | 61.7975 | 7.0802 | 14.1644 | 16.0230 |
| 23261 | 98.5277 | 35.5630 | 6.3794 | 396.7548 | 235.4205 |
| 23596 | 98.4688 | 26.1683 | 31.8479 | 310.3611 | 133.2357 |
| 19416 | 98.4099 | 161.0380 | 8.8053 | 78.6427 | 35.7870 |
| 7785 | 98.4099 | 72.3907 | 16.3907 | 359.4068 | 146.5049 |
| 16680 | 98.4099 | 454.9258 | 23.3072 | 208.5032 | 99.4246 |
| 6455 | 98.3510 | 625.5480 | 48.9130 | 1552.5103 | 528.2951 |
| 21765 | 98.2921 | 278.4548 | 28.8329 | 116.6032 | 48.9056 |
| 10984 | 98.2332 | 26.2300 | 2.6612 | 177.4641 | 111.4620 |
| 16752 | 98.2332 | −20.1665 | 2.3192 | 75.0052 | 84.6931 |
| 23813 | 98.2332 | 149.1473 | 16.5844 | 863.5449 | 732.5011 |
| 11180 | 98.1743 | 348.3692 | 50.9287 | 121.9737 | 69.8012 |
| 15427 | 98.1743 | 168.3082 | 18.9644 | 75.7006 | 26.8842 |
| 12479 | 98.1743 | 535.5142 | 45.7034 | 1668.2774 | 811.8782 |
| 22770 | 98.1743 | 1616.3478 | 69.8696 | 828.8762 | 317.1736 |
| 15258 | 98.1743 | 865.0300 | 138.3186 | 247.9708 | 164.3805 |
| 2250 | 98.1743 | 2748.5586 | 132.7849 | 1640.3847 | 677.5692 |
| 16058 | 98.1154 | 603.6760 | 67.6716 | 241.6086 | 105.5544 |
| 17901 | 98.1154 | 704.3805 | 58.8104 | 410.2222 | 102.7722 |
| 2486 | 98.1154 | 532.9188 | 53.1925 | 290.3420 | 64.2899 |

TABLE 5WW

VALPROATE
Timepoint(s): 6, 24 hrs

| GLGC ID NO. | LDA Score | Mean Tox | SD Tox | Mean Nontox | SD Nontox |
|---|---|---|---|---|---|
| 3444 | 99.8821 | 144.5800 | 61.7450 | 14.3904 | 25.5938 |
| 22150 | 99.6462 | 129.5343 | 17.2392 | 45.4124 | 13.8346 |
| 5082 | 99.3514 | 173.2057 | 38.9008 | 37.1035 | 17.7117 |
| 1844 | 99.2335 | 251.8586 | 31.3296 | 113.3852 | 26.1181 |
| 21084 | 98.9387 | 96.1271 | 31.2456 | 23.8881 | 9.8758 |
| 17601 | 98.7618 | 153.7871 | 35.2416 | 48.4060 | 18.2639 |
| 24705 | 98.6439 | 14.4543 | 1.9279 | 49.6120 | 18.4100 |
| 17257 | 98.5849 | 162.1329 | 75.7169 | 32.0815 | 20.5496 |
| 16025 | 98.5849 | 479.2114 | 166.1093 | 121.2432 | 50.6633 |
| 11827 | 98.2901 | 99.9457 | 16.6275 | 38.4296 | 14.3028 |
| 16661 | 98.2901 | 337.3300 | 65.6463 | 157.1480 | 35.6664 |
| 21083 | 98.1722 | 110.7557 | 44.7945 | 32.0547 | 12.6772 |
| 25137 | 98.1132 | 41.3043 | 6.6234 | 14.3314 | 7.6367 |
| 1412 | 98.1132 | 59.5886 | 23.4333 | 11.6248 | 11.3912 |
| 9082 | 98.0542 | 113.0314 | 26.9057 | 38.9540 | 13.3140 |
| 1444 | 97.9953 | 86.5629 | 19.7541 | 42.1914 | 11.8372 |
| 16026 | 97.9363 | 677.2157 | 224.1748 | 162.7448 | 77.0733 |
| 22149 | 97.9363 | 42.8643 | 5.5124 | 10.7996 | 12.4657 |
| 18442 | 97.8774 | 144.8657 | 53.1017 | 48.3157 | 16.3080 |
| 15487 | 97.8774 | 211.1643 | 54.4853 | 91.7875 | 29.6761 |
| 18495 | 97.8774 | 88.4714 | 33.7047 | 18.9872 | 10.8983 |
| 6490 | 97.7005 | 273.2114 | 26.5179 | 150.3017 | 39.0434 |
| 15857 | 97.7005 | 336.1300 | 93.8056 | 170.4754 | 42.6496 |
| 17299 | 97.6415 | 128.4929 | 28.1546 | 59.5979 | 19.6092 |
| 15489 | 97.2877 | 116.0300 | 24.5272 | 58.8534 | 15.9195 |
| 1045 | 97.1108 | 157.4086 | 15.2687 | 84.0468 | 26.5790 |
| 20801 | 96.9340 | 445.1743 | 40.9959 | 222.3695 | 102.5993 |
| 20778 | 96.9340 | 129.4214 | 28.8279 | 65.4492 | 17.2747 |
| 23486 | 96.9340 | 721.8771 | 233.3117 | 335.6000 | 84.3057 |
| 11973 | 96.8160 | 101.9414 | 17.4343 | 40.5012 | 19.3775 |
| 18728 | 96.7571 | 289.1129 | 86.6215 | 163.1031 | 36.1369 |
| 21372 | 96.6981 | 99.2914 | 25.9457 | 35.3983 | 25.3617 |
| 15073 | 96.6981 | 31.4900 | 13.0998 | −5.8259 | 13.2277 |
| 16082 | 96.6981 | 73.1986 | 33.0991 | 24.8216 | 12.8609 |
| 25483 | 96.6392 | 60.6914 | 11.7255 | 29.4802 | 9.3066 |
| 16675 | 96.5802 | 54.1743 | 15.4843 | 15.7376 | 12.9291 |
| 20090 | 96.5212 | 330.9629 | 43.7027 | 191.5581 | 48.0380 |
| 4714 | 96.4623 | 260.3571 | 48.3682 | 103.9676 | 52.5834 |
| 2465 | 96.3443 | 53.8471 | 20.3744 | 20.7293 | 15.1872 |
| 17541 | 96.1675 | 1125.0386 | 323.2534 | 2958.7258 | 1067.3746 |
| 3446 | 95.9316 | 78.0443 | 13.0209 | 37.5914 | 15.6372 |
| 1683 | 95.6368 | 39.3357 | 6.2439 | 19.1940 | 8.8892 |
| 1131 | 95.5778 | 254.6414 | 26.2846 | 149.5357 | 41.9923 |
| 11252 | 95.5778 | 63.7243 | 10.4814 | 34.0662 | 12.1603 |
| 19013 | 95.3420 | 49.4657 | 6.8717 | 21.7663 | 11.8382 |
| 8984 | 95.2241 | 572.6114 | 91.7536 | 377.9046 | 72.8978 |
| 3548 | 95.1651 | 329.5600 | 41.3407 | 214.5087 | 48.3598 |
| 1660 | 94.8703 | 23.9386 | 3.0945 | 25.6363 | 33.8447 |
| 2515 | 94.7524 | 404.2214 | 64.3700 | 219.0737 | 88.4812 |
| 24351 | 94.7524 | 57.2800 | 19.8489 | 15.9145 | 17.3715 |
| 400 | 94.5755 | 70.9786 | 20.6898 | 28.4251 | 29.8555 |
| 1791 | 94.5165 | 111.2386 | 24.5355 | 57.1100 | 19.9846 |
| 18731 | 94.5165 | 229.5086 | 37.0794 | 148.7107 | 35.7388 |
| 19102 | 94.5165 | 63.1600 | 15.5854 | 28.4732 | 13.5488 |
| 15618 | 94.3396 | 546.1971 | 115.7018 | 264.1710 | 122.3836 |
| 1588 | 93.8090 | 446.1114 | 22.2354 | 450.3335 | 266.0797 |
| 1424 | 93.6321 | 215.5086 | 44.8928 | 113.1477 | 49.7158 |
| 18373 | 93.3373 | 234.9671 | 14.5044 | 170.1833 | 47.2239 |
| 22865 | 93.1604 | 113.6229 | 19.5127 | 64.1164 | 23.1223 |
| 14934 | 92.8066 | 165.8843 | 24.7174 | 112.4354 | 24.6631 |
| 3465 | 92.5118 | 115.0886 | 10.3031 | 68.5267 | 32.4511 |
| 17336 | 92.4528 | 37.6600 | 8.0302 | 19.5153 | 12.8488 |
| 1460 | 92.4528 | 897.1871 | 333.3809 | 2123.7015 | 699.9205 |
| 17698 | 92.0906 | 74.5571 | 20.7492 | 4.5155 | 37.4701 |
| 19543 | 91.7369 | 126.4571 | 82.5000 | 35.1164 | 13.0685 |
| 7947 | 91.6189 | 280.4857 | 98.7157 | 101.4455 | 29.5253 |
| 1501 | 91.5684 | 1199.9071 | 360.8232 | 2218.8179 | 561.7895 |
| 1580 | 91.5010 | 172.3186 | 76.4827 | 41.5127 | 19.9910 |
| 23710 | 91.4505 | 47.6871 | 8.1489 | 26.5727 | 12.9137 |
| 1579 | 91.2652 | 112.1100 | 64.4929 | 23.2409 | 11.1396 |
| 17613 | 91.0377 | 354.6400 | 78.7326 | 523.2556 | 96.5443 |
| 17258 | 91.0293 | 231.7671 | 99.3995 | 93.0036 | 26.4731 |
| 25907 | 90.9198 | 14.6414 | 13.4398 | 80.5719 | 49.6182 |
| 11975 | 90.8524 | 79.7114 | 46.6976 | 7.1271 | 17.4758 |
| 23344 | 90.8019 | 564.3243 | 69.6849 | 383.1436 | 111.6698 |
| 23485 | 90.7935 | 997.9843 | 325.8404 | 444.3934 | 122.3742 |
| 353 | 90.6840 | 645.5929 | 116.1683 | 411.0646 | 248.0672 |
| 548 | 90.6250 | 12.2314 | 13.5403 | 173.2888 | 193.3287 |
| 14346 | 90.6250 | 341.3429 | 86.1887 | 729.5192 | 319.9239 |
| 15613 | 90.5660 | 757.7586 | 82.5964 | 675.1011 | 519.0905 |
| 22919 | 90.5576 | 483.1743 | 137.0012 | 245.5606 | 56.7106 |
| 23465 | 90.5576 | 254.4814 | 93.6693 | 92.1306 | 31.4577 |
| 5257 | 90.5071 | 12.3171 | 7.5749 | 35.7259 | 14.5811 |
| 11296 | 90.4987 | 255.7043 | 82.7440 | 113.4386 | 36.3196 |
| 15911 | 90.4397 | 295.2443 | 102.0899 | 152.2922 | 33.0392 |
| 1822 | 90.3807 | 130.5514 | 56.3598 | 54.4118 | 16.4748 |
| 1841 | 90.3218 | 195.9600 | 51.1706 | 67.5316 | 25.4668 |
| 15437 | 90.2038 | 54.5871 | 28.2278 | 14.8786 | 12.5272 |
| 20977 | 90.2038 | 92.4729 | 34.4918 | 42.1871 | 14.9379 |
| 21064 | 90.2038 | 311.6886 | 101.5980 | 161.0000 | 41.0390 |
| 21843 | 90.0943 | 65.8486 | 25.0019 | 125.5698 | 34.9879 |
| 21062 | 90.0859 | 109.9843 | 49.6134 | 39.6977 | 19.5815 |
| 8139 | 89.9764 | 22.6243 | 7.4665 | 6.9491 | 10.2412 |
| 18419 | 89.9764 | 449.3257 | 41.0824 | 640.1130 | 149.2786 |
| 18887 | 89.9680 | 244.4986 | 59.9534 | 128.4661 | 32.3446 |
| 399 | 89.9680 | 86.9414 | 29.8870 | 32.2150 | 13.1600 |
| 4312 | 89.8585 | 26.4400 | 13.1713 | 137.9983 | 142.6243 |
| 935 | 89.7995 | 43.0029 | 11.7528 | 76.6196 | 22.0380 |
| 4308 | 89.7911 | 44.0014 | 11.8655 | 11.3064 | 9.3377 |
| 463 | 89.7911 | 85.6500 | 15.7670 | 40.9034 | 12.9185 |
| 6254 | 99.7642 | 155.7414 | 41.6559 | −1.9149 | 34.7296 |
| 21085 | 99.5873 | 192.4657 | 42.8307 | 56.8818 | 18.2115 |
| 4179 | 99.4693 | 780.1514 | 173.8288 | 253.9662 | 66.1519 |
| 8390 | 98.9976 | 249.4643 | 61.8875 | 95.0359 | 30.3142 |
| 16673 | 98.9387 | 210.3014 | 57.7937 | 59.5914 | 17.7578 |
| 8959 | 98.8797 | 132.6314 | 43.2777 | 23.8863 | 22.4768 |
| 6830 | 98.8797 | 31.0014 | 14.7398 | −27.0187 | 20.4576 |
| 6988 | 98.8208 | 562.5943 | 168.8704 | 68.2642 | 125.3950 |
| 19052 | 98.7618 | 549.9043 | 50.8929 | 280.8604 | 60.7070 |
| 9607 | 98.7618 | 308.1257 | 84.6105 | 87.2067 | 28.0188 |
| 6631 | 98.7618 | 172.5014 | 38.2802 | 56.4441 | 22.0745 |
| 23106 | 98.7028 | 83.8700 | 18.0902 | 24.0835 | 12.4770 |
| 14800 | 98.7028 | 56.2229 | 14.1362 | 6.3023 | 17.2849 |
| 4475 | 98.6439 | 314.8357 | 53.1205 | 140.9574 | 35.6094 |
| 23811 | 98.6439 | 552.4300 | 132.2849 | 243.5353 | 60.3769 |
| 9806 | 98.5849 | 200.1071 | 61.2464 | 52.7609 | 23.5967 |
| 6288 | 98.5849 | 312.9400 | 106.5304 | 46.9712 | 70.3151 |
| 2669 | 98.5849 | 98.2800 | 12.9236 | 31.2787 | 25.3674 |
| 18961 | 98.5849 | 1038.0800 | 525.5580 | 420.0867 | 107.6491 |
| 149 | 98.5259 | 160.0886 | 28.8676 | 71.6011 | 23.9037 |
| 4987 | 98.5259 | 432.9086 | 102.3598 | 166.7119 | 38.0299 |
| 11502 | 98.4670 | 396.4757 | 85.6763 | 890.3652 | 194.6821 |
| 18191 | 98.4670 | 244.8714 | 21.4191 | 148.9512 | 27.8077 |
| 5381 | 98.4080 | 334.1571 | 20.7390 | 186.6949 | 46.8460 |
| 7117 | 98.4080 | 188.6800 | 38.7207 | 85.3973 | 22.5234 |
| 19271 | 98.3491 | 537.7257 | 36.6904 | 278.0635 | 94.5354 |
| 18778 | 98.2901 | 47.4757 | 9.3477 | 5.6255 | 11.9304 |
| 22204 | 98.2311 | 168.5257 | 29.8838 | 52.5852 | 26.0325 |
| 3464 | 98.2311 | 340.9243 | 210.1778 | 86.0669 | 32.5824 |
| 19595 | 98.1722 | 43.8500 | 29.2789 | −4.9781 | 10.2670 |
| 24131 | 98.1722 | 55.9014 | 23.5310 | −50.6076 | 42.0976 |
| 3720 | 98.1132 | 567.1786 | 270.8642 | 273.5363 | 52.6255 |
| 3584 | 97.9953 | 111.1729 | 23.0878 | 37.8885 | 22.2233 |
| 11813 | 97.9953 | 124.5914 | 43.4092 | 31.4443 | 15.9876 |
| 22106 | 97.9953 | 270.0600 | 53.7528 | 133.7708 | 35.2067 |
| 17859 | 97.9953 | 129.1657 | 34.4126 | 39.7049 | 18.5891 |
| 23099 | 97.9953 | 763.7171 | 299.6457 | 250.0823 | 99.0060 |
| 13424 | 97.9363 | 250.1071 | 39.8716 | 108.6408 | 39.6640 |
| 6974 | 97.8774 | 593.1471 | 90.7690 | 255.4031 | 86.0184 |
| 13911 | 97.8774 | 175.5143 | 56.7375 | 77.0473 | 23.9356 |
| 11331 | 97.8774 | 416.2143 | 129.9514 | 183.3316 | 42.7733 |
| 9294 | 97.8774 | 141.3800 | 29.7951 | 35.9573 | 37.6954 |
| 13501 | 97.8184 | 204.5129 | 78.5139 | 49.2592 | 25.1670 |
| 16879 | 97.8184 | 1692.1529 | 550.5139 | 790.1405 | 194.7542 |
| 13591 | 97.8184 | 218.2743 | 49.2799 | 104.8334 | 27.1579 |
| 23141 | 97.8184 | 658.4357 | 350.1177 | 269.3291 | 79.8860 |

TABLE 5WW-continued

VALPROATE
Timepoint(s): 6, 24 hrs

| GLGC ID NO. | LDA Score | Mean Tox | SD Tox | Mean Nontox | SD Nontox |
|---|---|---|---|---|---|
| 22071 | 97.7594 | 657.7329 | 359.9602 | 316.2342 | 79.0731 |
| 5074 | 97.7005 | 213.1471 | 52.2225 | 70.3788 | 35.7884 |
| 8903 | 97.7005 | 42.3057 | 12.9917 | 2.9615 | 18.3033 |
| 4744 | 97.6415 | 178.2100 | 27.2838 | 76.4183 | 27.7668 |
| 9440 | 97.6415 | 411.2371 | 88.3828 | 203.4487 | 63.0305 |
| 2915 | 97.5825 | 232.8929 | 111.5077 | 129.0804 | 29.2902 |
| 8966 | 97.5825 | 479.0857 | 296.9397 | 193.0439 | 61.6170 |
| 6054 | 97.4057 | 91.4071 | 37.0309 | 17.4402 | 18.5831 |
| 18105 | 97.4057 | 190.7314 | 41.8946 | 72.6229 | 34.6599 |
| 14547 | 97.4057 | 347.0200 | 97.6072 | 114.9752 | 64.2502 |
| 4250 | 97.1698 | 181.7771 | 49.2702 | 73.5660 | 28.7053 |
| 8136 | 97.1698 | 251.4100 | 135.5546 | 97.9400 | 32.7582 |
| 17861 | 97.1108 | 142.1571 | 40.5336 | 53.4554 | 22.8540 |
| 3944 | 97.1108 | 504.4800 | 238.5928 | 327.1568 | 60.5498 |
| 21216 | 97.0519 | 64.5886 | 12.7326 | 25.5184 | 14.5233 |
| 6085 | 96.9929 | 460.4929 | 68.6186 | 191.6192 | 91.9653 |
| 6528 | 96.9929 | 192.2614 | 32.2417 | 383.4531 | 96.4171 |
| 2501 | 96.9340 | 343.3143 | 86.0400 | 146.9044 | 46.0380 |
| 10489 | 96.8750 | 18.1186 | 5.4779 | 68.7378 | 29.0330 |
| 18660 | 96.8160 | 241.8414 | 77.4971 | 71.2537 | 45.5412 |
| 21253 | 96.8160 | 553.3471 | 121.4654 | 259.8817 | 71.3944 |
| 14275 | 96.7571 | 220.9386 | 46.8331 | 123.4414 | 28.9585 |
| 24003 | 96.7571 | 297.6371 | 161.3781 | 140.4816 | 44.4433 |
| 21447 | 96.7571 | 265.6229 | 133.7574 | 152.4640 | 36.2267 |

TABLE 5XX

Wy-14643
Timepoint(s): 3 hrs

| GLGC ID NO. | LDA Score | Mean Tox | SD Tox | Mean Nontox | SD Nontox |
|---|---|---|---|---|---|
| 16847 | 99.4125 | 1333.3450 | 2.3431 | 1542.0550 | 330.9283 |
| 15248 | 99.1774 | 152.6125 | 16.74175 | 33.0373 | 23.3117 |
| 15829 | 99.1187 | 173.5325 | 9.6851 | 27.6526 | 78.0679 |
| 14595 | 99.0599 | 326.2025 | 17.7958 | 109.5426 | 98.7261 |
| 4290 | 99.0012 | 299.8425 | 12.4772 | 128.0565 | 76.9802 |
| 21917 | 98.9424 | 42.1025 | 0.2545 | 26.9101 | 12.1660 |
| 11296 | 98.9424 | 168.9225 | 2.4925 | 114.3480 | 38.9118 |
| 9931 | 98.8249 | 168.6000 | 0.6744 | 199.7694 | 104.8456 |
| 10071 | 98.7662 | 149.9150 | 8.0658 | 43.6932 | 35.0172 |
| 18957 | 98.7662 | 191.7350 | 7.0560 | 116.0683 | 77.5849 |
| 16354 | 98.5311 | −120.5300 | 13.7552 | 69.6771 | 92.9085 |
| 402 | 98.5311 | 608.2725 | 10.9491 | 1076.3547 | 532.6898 |
| 20149 | 98.5311 | 186.2400 | 25.9383 | 44.7034 | 207.5376 |
| 8592 | 98.4724 | 228.6500 | 3.0313 | 153.0155 | 49.8198 |
| 26000 | 98.4136 | 103.3150 | 1.1135 | 72.5787 | 37.0846 |
| 287 | 98.4136 | 33.5800 | 0.3569 | 20.6758 | 17.7124 |
| 1255 | 98.2961 | 93.5250 | 8.5551 | 18.7482 | 27.0081 |
| 2008 | 98.2961 | 64.0225 | 8.1607 | 13.8716 | 43.6814 |
| 15247 | 98.1199 | 362.8625 | 43.7127 | 86.1034 | 65.0140 |
| 15123 | 98.0611 | 270.4800 | 34.6748 | 178.1626 | 253.3036 |
| 18360 | 98.0024 | 33.4325 | 3.7502 | 95.6228 | 33.1329 |
| 21029 | 98.0024 | 77.4175 | 1.0390 | 65.5606 | 42.9484 |
| 20713 | 97.8848 | 290.2450 | 34.0678 | 132.3416 | 240.5429 |
| 20431 | 97.8848 | 207.0525 | 20.9517 | 114.4350 | 138.9264 |
| 25693 | 97.7673 | 85.9850 | 4.9693 | 38.6479 | 19.5145 |
| 17758 | 97.7673 | 85.8475 | 14.1070 | 55.9801 | 229.3914 |
| 17958 | 97.7086 | 125.8000 | 3.4578 | 65.6493 | 45.3712 |
| 1704 | 97.5911 | 54.0775 | 4.7675 | 27.6175 | 48.6715 |
| 15421 | 97.5323 | 302.0475 | 4.8608 | 420.6746 | 91.2310 |
| 923 | 97.4148 | 301.5250 | 6.1723 | 193.2205 | 111.0874 |
| 20429 | 97.4148 | 315.0925 | 16.9460 | 232.0102 | 163.1843 |
| 23698 | 97.4148 | 390.6350 | 48.8334 | 200.1831 | 349.5770 |
| 8008 | 97.3561 | 39.8075 | 2.4671 | 12.9123 | 16.0824 |
| 15371 | 97.3561 | 516.0800 | 3.3923 | 536.4018 | 122.2232 |
| 25777 | 97.2973 | 1783.6825 | 11.9118 | 1750.5074 | 569.0072 |
| 1857 | 97.1798 | 61.9975 | 25.9284 | 28.3336 | 191.9301 |
| 18083 | 97.1210 | 81.5350 | 9.5303 | 44.8483 | 64.7282 |

TABLE 5XX-continued

Wy-14643
Timepoint(s): 3 hrs

| GLGC ID NO. | LDA Score | Mean Tox | SD Tox | Mean Nontox | SD Nontox |
|---|---|---|---|---|---|
| 2006 | 97.1210 | 65.4125 | 5.9060 | 20.4439 | 38.3937 |
| 16148 | 97.1210 | 814.0925 | 57.1602 | 485.8379 | 363.5008 |
| 8829 | 97.0623 | 849.6275 | 7.0831 | 778.8023 | 229.4941 |
| 20715 | 97.0623 | 144.7375 | 16.3037 | 85.9585 | 154.1015 |
| 20703 | 97.0623 | 121.3700 | 13.0113 | 43.3561 | 55.1171 |
| 23489 | 97.0035 | 79.5875 | 4.1625 | 34.7983 | 29.1296 |
| 8269 | 97.0035 | 386.8150 | 36.6059 | 335.8389 | 372.8364 |
| 16179 | 96.9448 | 38.0125 | 0.8486 | 30.9613 | 16.0077 |
| 1963 | 96.8860 | 205.4875 | 15.7807 | 114.2191 | 38.1923 |
| 3879 | 96.8860 | 1313.0500 | 12.4122 | 1444.3125 | 434.8641 |
| 17891 | 96.8860 | 74.3550 | 1.7102 | 54.0240 | 19.7167 |
| 1556 | 96.8273 | 160.2600 | 1.8368 | 126.6512 | 36.5046 |
| 25052 | 96.8273 | 140.1075 | 2.8854 | 181.7533 | 161.1909 |
| 13358 | 96.8273 | 52.2600 | 5.1075 | 23.6220 | 16.6352 |
| 19256 | 96.8273 | 39.7700 | 2.2122 | 28.5872 | 27.1895 |
| 23782 | 96.7098 | 156.9925 | 1.6579 | 190.0308 | 47.6908 |
| 16039 | 96.7098 | 653.1025 | 9.1576 | 714.3246 | 207.4366 |
| 4714 | 96.7098 | 101.8550 | 2.2984 | 105.2640 | 54.5111 |
| 8384 | 96.7098 | 68.5725 | 6.6536 | 63.2743 | 76.3445 |
| 18293 | 96.6510 | 654.4225 | 7.2132 | 653.2370 | 378.3348 |
| 9952 | 96.6510 | 1125.0825 | 57.4954 | 647.2010 | 332.2226 |
| 18667 | 96.5922 | 44.5700 | 0.5690 | 39.1859 | 18.9059 |
| 399 | 96.5922 | 53.3950 | 2.0466 | 32.5656 | 14.1879 |
| 25325 | 96.5335 | 621.0625 | 15.2235 | 977.9448 | 544.2764 |
| 20433 | 96.4747 | 182.9700 | 62.2857 | 36.5422 | 43.3625 |
| 20214 | 96.4160 | 56.7450 | 12.3540 | 3.3237 | 22.2773 |
| 5283 | 96.4160 | 91.3425 | 3.0335 | 58.8512 | 23.3649 |
| 6376 | 96.4160 | 83.5725 | 8.5465 | 45.6380 | 49.8197 |
| 1261 | 96.3572 | 185.3600 | 16.7912 | 87.3649 | 37.3470 |
| 23540 | 96.3572 | 197.8125 | 5.8659 | 132.5313 | 37.3581 |
| 17661 | 96.3572 | 380.7200 | 5.2901 | 309.3593 | 83.6555 |
| 15312 | 96.3572 | 189.0050 | 6.3907 | 220.2300 | 126.6273 |
| 8268 | 96.3572 | 462.1450 | 59.5656 | 385.7511 | 495.2149 |
| 13479 | 96.2985 | 108.1850 | 2.5245 | 165.4475 | 58.9929 |
| 16661 | 96.2985 | 159.9475 | 1.6178 | 158.6169 | 39.5370 |
| 21488 | 96.2985 | 17.7475 | 1.8944 | 42.0741 | 17.5997 |
| 16807 | 96.2985 | 1471.5850 | 105.9415 | 867.1132 | 713.2997 |
| 3453 | 96.2397 | 163.8275 | 1.2605 | 150.3854 | 38.0379 |
| 23302 | 96.2397 | 149.9775 | 7.9737 | 81.2128 | 39.4239 |
| 1175 | 96.2397 | 143.9000 | 21.4014 | 41.9411 | 75.6626 |
| 1977 | 96.2397 | 415.0650 | 13.2251 | 287.0983 | 131.3372 |
| 17158 | 96.2397 | 95.8650 | 4.2144 | 57.2976 | 54.1248 |
| 6598 | 96.1810 | 253.1075 | 9.8371 | 122.3600 | 73.7472 |
| 5748 | 96.1810 | 702.4450 | 6.1196 | 716.8188 | 151.1583 |
| 7602 | 96.1810 | 413.5775 | 4.7979 | 350.4778 | 100.6908 |
| 1991 | 96.1810 | 52.7950 | 2.6674 | 28.9671 | 15.4093 |
| 1858 | 96.1810 | 74.1250 | 16.0843 | 43.8919 | 209.3255 |
| 1262 | 96.1222 | 105.2225 | 13.0050 | 42.2622 | 23.9657 |
| 14016 | 96.1222 | 78.8825 | 4.0273 | 146.7053 | 60.0718 |
| 19018 | 96.1222 | 274.4450 | 10.4049 | 200.0064 | 102.0604 |
| 548 | 96.1222 | 270.6425 | 15.5019 | 171.5064 | 193.4176 |
| 21575 | 96.0635 | 394.3725 | 4.1716 | 345.3200 | 89.1984 |
| 1372 | 96.0635 | 26.2400 | 4.0653 | 8.2285 | 7.8665 |
| 8386 | 96.0635 | 229.0900 | 29.5913 | 190.6004 | 196.0708 |
| 4242 | 96.0635 | 86.1225 | 5.4365 | 58.7996 | 38.0990 |
| 1394 | 96.0635 | 31.0700 | 0.7409 | 25.0868 | 11.1810 |
| 25604 | 96.0047 | 27.0575 | 0.4396 | 25.1778 | 11.3431 |
| 20868 | 96.0047 | 52.5075 | 7.0137 | 15.4277 | 19.5018 |
| 25476 | 96.0047 | 35.1525 | 2.8213 | 13.4833 | 14.8648 |
| 10624 | 95.9459 | 349.5150 | 68.7765 | 96.4763 | 94.6633 |
| 19512 | 95.9459 | 38.7675 | 20.5495 | −9.3937 | 17.0421 |
| 18501 | 95.9459 | 320.3400 | 10.6082 | 178.0435 | 108.2443 |
| 322 | 95.9459 | 223.5650 | 13.7930 | 168.4034 | 179.9025 |
| 21851 | 98.5899 | 324.1950 | 3.6777 | 174.4675 | 94.7797 |
| 20341 | 98.5311 | 94.4825 | 3.2952 | 45.2391 | 20.9064 |
| 18696 | 98.4136 | 162.0600 | 2.3946 | 235.7418 | 59.0384 |
| 11215 | 98.3549 | −152.9600 | 30.0345 | 132.7776 | 84.4442 |
| 3256 | 98.3549 | 1659.3700 | 14.2156 | 1838.7773 | 623.0337 |
| 13975 | 98.3549 | 416.7200 | 6.7543 | 255.2859 | 79.3622 |
| 14081 | 98.2374 | 145.0475 | 8.4275 | 55.1742 | 66.6242 |
| 13353 | 98.0611 | 101.5150 | 11.6673 | 231.5008 | 52.3472 |
| 7714 | 98.0611 | 225.2600 | 5.0234 | 148.5496 | 47.5103 |
| 6634 | 98.0611 | 620.5375 | 16.6118 | 389.3899 | 112.6122 |

TABLE 5XX-continued

Wy-14643
Timepoint(s): 3 hrs

| GLGC ID NO. | LDA Score | Mean Tox | SD Tox | Mean Nontox | SD Nontox |
|---|---|---|---|---|---|
| 2708 | 98.0024 | 586.7850 | 10.2691 | 423.5732 | 133.0198 |
| 18088 | 97.9436 | 327.2000 | 8.0398 | 173.4491 | 134.5675 |
| 11354 | 97.9436 | 506.7975 | 21.4223 | 314.5744 | 270.4788 |
| 22574 | 97.9436 | 81.2075 | 8.5952 | 22.9443 | 21.4221 |
| 17715 | 97.8261 | 130.5600 | 1.5368 | 147.2899 | 98.8225 |
| 2568 | 97.8261 | 15.7850 | 10.8130 | 164.2118 | 90.9813 |
| 23125 | 97.7673 | 645.5000 | 15.9148 | 662.2089 | 459.7979 |
| 23725 | 97.7673 | 1004.4725 | 42.3701 | 631.7577 | 161.5521 |
| 3941 | 97.7673 | 117.1400 | 1.9950 | 115.5958 | 87.1463 |
| 19993 | 97.6498 | 306.8600 | 3.3349 | 319.5405 | 118.3228 |
| 11963 | 97.6498 | 83.0950 | 11.2757 | 19.0023 | 29.2775 |
| 9806 | 97.5911 | 79.2650 | 1.9188 | 53.8484 | 27.4883 |
| 3367 | 97.5911 | 1188.3625 | 10.8754 | 1556.1042 | 446.6942 |
| 5602 | 97.5323 | 160.4600 | 5.8640 | 119.0199 | 154.7447 |
| 16915 | 97.4736 | 1062.8075 | 142.4367 | 375.2551 | 620.7577 |
| 3523 | 97.4148 | 261.6100 | 2.4946 | 265.8605 | 125.2159 |
| 2331 | 97.3561 | 1040.9625 | 83.9986 | 288.2437 | 367.0784 |
| 4491 | 97.2973 | 218.1725 | 6.1904 | 137.1534 | 45.7487 |
| 17407 | 97.2385 | 1190.0400 | 14.4779 | 1290.5723 | 344.2359 |
| 4368 | 97.1210 | 400.2775 | 5.4266 | 511.9276 | 133.4210 |
| 9180 | 97.1210 | 372.5625 | 13.7830 | 223.1236 | 70.8096 |
| 10960 | 97.1210 | 886.6050 | 11.8630 | 714.4602 | 134.1032 |
| 23152 | 97.0623 | 1749.2775 | 97.7526 | 1032.3974 | 283.1970 |
| 17027 | 97.0623 | 1301.6000 | 67.6087 | 902.0808 | 639.7305 |
| 6604 | 97.0035 | 64.7400 | 1.6977 | 39.8711 | 18.3146 |
| 21354 | 97.0035 | 742.6300 | 37.5706 | 560.9094 | 527.6779 |
| 19438 | 96.9448 | 112.1375 | 22.8580 | 36.2113 | 24.0275 |
| 2841 | 96.9448 | 132.7950 | 6.5971 | 77.3345 | 62.9878 |
| 6473 | 96.8860 | 87.3200 | 5.8007 | 63.1210 | 68.6514 |
| 19762 | 96.8860 | 53.3625 | 4.5965 | 15.5716 | 26.4597 |
| 2729 | 96.8273 | 328.7300 | 5.9956 | 510.6355 | 200.9746 |
| 11698 | 96.7685 | 86.5700 | 7.8327 | 157.8403 | 44.8530 |
| 6094 | 96.7098 | 129.0725 | 21.1359 | 49.6278 | 26.4543 |
| 16705 | 96.7098 | 22.9075 | 0.5647 | 25.9405 | 20.1929 |

TABLE 6

Laboratory protocols for administration of toxins to hepatocyte cultures and Results of AlamarBlue ® cell viability assays

| Toxin | 3 hours | | 6 hours | | 24 hours | |
|---|---|---|---|---|---|---|
| | low dose | high dose | low dose | high dose | low dose | high dose |
| Amiodarone, ICN cat. no. 15353583 | 6 uM | 60 uM | 6 uM | 60 uM | 6 uM | 60 uM |
| % viability by AlamarBlue test | | | | | ~100 | ~80-85 |
| Carbamazepine, Sigma cat. no. C-8981 | 0.01 mM | 1 mM | 0.01 mM | 1 mM | 0.01 mM | 1 mM |
| % viability by AlamarBlue test | | | | | ~100 | ~90 |
| Chlorpromazine, Sigma cat. no. C-8138 | 3 uM | 30 uM | 3 uM | 30 uM | 3 uM | 30 uM |
| % viability by AlamarBlue test | | | | | ~100 | ~75 |
| CI-1000 | 25 uM | 250 uM | 25 uM | 250 uM | 25 uM | 250 uM |
| % viability by AlamarBlue test | | | | | ~90 | ~75 |
| Cyproterone acetate Sigma cat. no. C-3412 | 40 uM | 400 uM | 40 uM | 400 uM | 40 uM | 400 uM |
| % viability by AlamarBlue test | | | | | ~100 | ~65-70 |
| Diflunisal, Sigma cat. no. D-3281 | 30 uM | 300 uM | 30 uM | 300 uM | 30 uM | 300 uM |
| % viability by AlamarBlue test | | | | | ~100 | ~85-90 |
| DMN, Sigma cat. no. N-7756 | 1 mM | 100 mM | 1 mM | 100 mM | 1 mM | 100 mM |
| % viability by AlamarBlue test | | | | | ~100 | ~80-85 |
| Gemfibrozil, Sigma cat. no. G-9518 | 0.3 mM | 3 mM | 0.3 mM | 3 mM | 0.3 mM | 3 mM |
| % viability by AlamarBlue test | | | | | ~100 | ~50 |
| Imipramine, Sigma cat. no. I-7379 | 5 uM | 50 uM | 5 uM | 50 uM | 5 uM | 50 uM |
| % viability by AlamarBlue test | | | | | ~100 | ~85-90 |
| Phenobarbital, Sigma cat. no. P-5178 | 0.8 mM | 8 mM | 0.8 mM | 8 mM | 0.8 mM | 8 mM |
| % viability by AlamarBlue test | | | | | ~100 | >95 |
| Tamoxifen, Sigma cat. no. T-9262 | 4 uM | 40 uM | 4 uM | 40 uM | 4 uM | 40 uM |
| % viability by AlamarBlue test | | | | | ~100 | ~45 |

TABLE 6-continued

Laboratory protocols for administration of toxins to hepatocyte cultures and
Results of AlamarBlue ® cell viability assays

| Toxin | 3 hours | | 6 hours | | 24 hours | |
|---|---|---|---|---|---|---|
| | low dose | high dose | low dose | high dose | low dose | high dose |
| Tetracycline, Sigma cat. no. T-4062 | 0.1 mM | 1 mM | 0.1 mM | 1 mM | 0.1 mM | 1 mM |
| % viability by AlamarBlue test | | | | | ~100 | ~85-90 |
| Wy-14643 Cayman Chem cat. no. 70730 | 10 uM | 100 uM | 10 uM | 100 uM | 10 uM | 100 uM |
| % viability by AlamarBlue test | | | | | ~100 | ~90 |
| ANIT, Sigma cat. no. N-9883 | 25 uM | 250 uM | 25 uM | 250 uM | 25 uM | 250 uM |
| % viability by AlamarBlue test | | | | | ~100 | ~60 |
| Acetominophen, Sigma cat. no. A-7085 | 1 mM | 10 mM | 1 mM | 10 mM | 1 mM | 10 mM |
| % viability by AlamarBlue test | | | | | ~100 | ~90 |
| AY-25329 | 5 uM | 50 uM | 5 uM | 50 uM | 5 uM | 50 uM |
| % viability by AlamarBlue test | | | | | ~100 | ~90 |
| $CCl_4$, Aldrich cat. no. 31996-1 | 0.1 mM | 10 mM | 0.1 mM | 10 mM | 0.1 mM | 10 mM |
| % viability by AlamarBlue test | | | | | ~100 | ~80-85 |
| Clofibrate, Sigma cat. no. C-6643 | 0.5 mM | 5 mM | 0.5 mM | 5 mM | 0.5 mM | 5 mM |
| % viability by AlamarBlue test | | | | | ~100 | ~80-85 |
| Diclofenac, Sigma cat. no. D-6899 | 55 uM | 550 uM | 55 uM | 550 uM | 55 uM | 550 uM |
| % viability by AlamarBlue test | | | | | ~100 | ~70 |
| 17α-ethinylestradiol, Sigma cat. no. E-4876 | 10 uM | 100 uM | 10 uM | 100 uM | 10 uM | 100 uM |
| % viability by AlamarBlue test | | | | | ~100 | ~80 |
| Hydrazine, Sigma cat. no. H-0883 | 0.1 mM | 1 mM | 0.1 mM | 1 mM | 0.1 mM | 1 mM |
| % viability by AlamarBlue test | | | | | ~90-95 | ~80-85 |
| Indomethacin, Sigma cat. no. I-8280 | 0.1 mM | 1 mM | 0.1 mM | 1 mM | 0.1 mM | 1 mM |
| % viability by AlamarBlue test | | | | | ~100 | ~85-90 |
| Lipopolysaccharide, Sigma cat. no. L-8274 | 10 ug/ml | 100 ug/ml | 10 ug/ml | 100 ug/ml | 10 ug/ml | 100 ug/ml |
| % viability by AlamarBlue test | | | | | ~100 | ~100 |
| Lovastatin, Merck, 40 mg tablets | 0.1 mM | 1 mM | 0.1 mM | 1 mM | 0.1 mM | 1 mM |
| % viability by AlamarBlue test | | | | | ~100 | ~100 |
| Methotrexate, Sigma cat. no. M-9929 | 1 mM | 10 mM | 1 mM | 10 mM | 1 mM | 10 mM |
| % viability by AlamarBlue test | | | | | ~100 | ~90 |
| Tacrine, Sigma cat. no. A-3773 | 25 uM | 250 uM | 25 uM | 250 uM | 25 uM | 250 uM |
| % viability by AlamarBlue test | | | | | ~100 | ~75-80 |
| Valproate, Sigma cat. no. P-4543 | 0.4 mg/ml | 4 mg/ml | 0.4 mg/ml | 4 mg/ml | 0.4 mg/ml | 4 mg/ml |
| % viability by AlamarBlue test | | | | | ~100 | ~95 |

Notes:
1. Each compound was dissolved in HIM cell culture medium (In Vitro Technologies) containing 0.2% DMSO (Sigma cat. no. D-5879).
2. The AlamarBlue assay was performed only at the 24-hr time point following exposure to the toxin of interest. A corresponding vehicle control (0.2% DMSO) sample was also isolated at 3, 6, and 24-hr time points for each toxin.

SEQUENCE LISTING (4486 sequences)

SEQ ID NO: 1 - DNA, 1194 bp, Rattus norvegicus
  Genbank Accession No. A03913
atgaattggcattttcccttcttcatcttgaccacagtgactttatcctctgtgtactcccagctcaactctctgtcactcgaggaactaggctctgacacagggatccaggttttcaatcagatcatcaaatcacagcctcatgagaacgttgtcatttctccgcacgggattgcgtccatcttgggcatgctgcagctgggggctgacggcaggacgaagaagcagctctcaacggtgatgcgatacaatgtgaacggagtcggaaaagtgctgaagaagatcaacaaggctatagtctccaaaaagaataaagacatagtgaccgtggccaatgctgtgtttgtcaggaatggctttaaagtggaagtgccttttgcagcaaggaacaaagaggtgtttcagtgtgaagtacagagtgtgaacttccaggacccggcctctgcttgtgatgccatcaatttttgggtcaaaaatgagacgaggggcatgattgacaacctactttccccaaatctgatcgatagtgtccttaccaaactggtcctcgttaacgcagtgtatttcaagggtttgtggaaatcccggtttcaacctgagaacacgaagaaacggaccttcgtggcaggtgatggaaaatcctaccaagtacccatgctagcccagctctccgtgttccgctctgggtctaccaaaaccccaaatggcttatggtacaacttcattgagctaccctaccatggtgagagcatcagcatgttgatcgccctgccaacagagagctccaccccactgtccgccatcatccctcacatcagtaccaagaccatcaatagctggatgaacaccatggtacccaagaggatgcagctggtcctgcccaagttcacagctctggcacaaacagatctgaaggagccactgaaagcccttggcattactgagatctttgaaccgtcaaaggcaaattttgcaaaaataacaaggtcagagagccttcacgtctctcacatcttgcagaaagcaaaaattgaagtcagcgaagatgggaccaaagccgcagtagtgacaactgcaatcctaattgcaaggtcatcgcctccctggtttatagtagacaggcctttcctgttctgcatccgacacaatcccacaggtgccatcttgttcctggggcaggtgaacaagccctga

SEQ ID NO: 2 - DNA, 539 bp, Rattus norvegicus
  Genbank Accession No. AA012807
  misc_feature (1)..(539): n = a or c or g or t
gatcacgtacaccagggacagtgtctcagaataaagagtaactacagactaggtcactaagacaccacaaatcacatggacacaggtcgaaggtgacagcatctccagggcagcagagaacacgttgggaaacatttttgtttctttgtgtttgaaagaaatgtaatgtatcttgggttcacgtgtctgtatttgccactgcctacaggtcactaaaaaatacctagtttttgaatagtttctaatacagttagcttgtttttcaggccacattacaagattgcatgcattactttacacaaaagtcaaacagaacaatgttaacaccaacacgtcagnactgtagtacattttnttccggaggaaaaataaggaaggagagtgagagtgactgtccttggctcggcactttgtcctgcattcagccgggcctttccaagcactggctgactcatgagacttacatggtaaccttagtgtaagtgtcaaatgtgggactcctgtgaacagacagcatcttcccagggtaaaaaaaaaaa

SEQ ID NO: 3 - DNA, 158 bp, Rattus norvegicus
  Genbank Accession No. AA108277
accctttgaactagaagctttctattctgaccctcaagcagttccatatccagaagcaaaaatcggccgttttgtcgttcagaatgtttctgcacagaagatggagaaaatctaaagtgaaagtgcgcgtgacacacatgcatttcacatatccgctc

SEQ ID NO: 4 - DNA, 249 bp, Rattus norvegicus
  Genbank Accession No. AA684641
cgttctcaataaatattttatttttctgacactccaccctcaatacaaaagccttctggctggagccggattgtgcgaacaggccttgccgcgggcacctgcttgcttagtccctaggcctgcggcacccagacacaaggcagtgaacgtatggctagacggagatggtactttattaagaaacagaacagcaataggtccaaaaggggcagctgcgtcacctccaggggctactccagctgctgtggg

SEQ ID NO: 5 - DNA, 317 bp, Rattus norvegicus
  Genbank Accession No. AA685175
  misc_feature (1)..(317): n = a or c or g or t
ggatgttatcattattgctttattctttgggggataaggaatacagcatttaataaaatatatcangacccaattttatgcccctacagtaatttcaaaaggccattaaataagaattttaatgagaaattatctactgcaacatctcattaggatttctgtcccatgtggccttgcaccaaggagaatgatatcgaaggccttccacacaggtgtttccaacgtcagggggcgctgtcacagccacaagagccaatgccttcttcagggttgcttccaatttttgaagnataaaatatcagcacacaggctctcct

SEQ ID NO: 6 - DNA, 318 bp, Rattus norvegicus
  Genbank Accession No. AA685178
  misc_feature (1)..(318): n = a or c or g or t
catccaacaagaagctacactttattagtgatagaaacagtacaaattttaaaccaagctgtagttccacttttcaaacaccaaaaggggggggangggggaggagggtgtccttgctgtcagataattacattgttaattccataatagcatttacaatatcgttactgtngtttttnagggctcggacagcctttgctcttgacacatttgcttgtgacatgaccaactctatgtccttaacttccacacccgtttcatcaacctcctcttcttcgntctcctcttggacagtcggcgtctgcggtgttctcctga

SEQ ID NO: 7 - DNA, 321 bp, Rattus norvegicus
  Genbank Accession No. AA685760
caaggcccgtggggaccacacaggctcacaccaatgcctttgccccatgcgggccagctccagtaatccctaaggtgacttgaggagcctccaaggactctggttcccagttgtccatttttagcatctttatgttttctgttttacccttccctgctcactgctgcagtcccagccgtgtgggatggggtttcaccgcctgccagcgctttccctggcctcccctctgttcctctggtgtgctgtgcccccaaccatccccagtcactgtcaagcaatgccatcctaagaccatgtgtgatttccataaccggtttgttt

SEQ ID NO: 8 - DNA, 201 bp, Rattus norvegicus
  Genbank Accession No. AA685876
  misc_feature (1)..(201): n = a or c or g or t
agccgagcccggtnttgctagcctctntgggggtggggctgtttaccctgttcggcctggctctgggtacctacttggttcgaagatcccgccggccacaggtcactntccaggncccggatgagaagtacctgctgcnattnctggacaagacgacagtaagccacaacaccaggaggttccgctttgcccttcccaccg

SEQ ID NO: 9 - DNA, 371 bp, Rattus norvegicus
  Genbank Accession No. AA685974
  misc_feature (1)..(371): n = a or c or g or t
gcctcgccacagcctttattgcgcgggcactccaccgggctctgcaggatgcacgggggctaggatgtcagagcggggaccctctggtttgttgagggtgacctatggcgcantgggagacccccagacccggaactctattaatccctggtcaggccaggctgaagagggatgagctgacttggacaagctggattcagcccggttctgtcacttgggtgcattgaagggcagcgcacgctggtttcatcgggttgtcaggagagcgcaaccactccttcttcagcagctgcttcagctgtnagagccgcatgttggggttttcctgcttcaaccgtggcagcttcanctcctcaaatgcggtgaaggcc

SEQ ID NO: 10 - DNA, 290 bp, Rattus norvegicus
  Genbank Accession No. AA686132
  misc_feature (1)..(290): n = a or c or g or t
aagataatgatgacattntcatgctggagaaaaaaataagaacatctagtatgccagancaggctcataaagtntgtttcaaggagataaaaagactcaaaaaantgcctcattcaatgcctgattatgctctgactagaaattatttggaacttatggtggagcttccttggaacaaaagtacaactgaccgcctggacatccgggcagcccgcatccttctggacaatgaccactatgccatggaaaagctgaagaggagggtttttggagtactttggctgttgaga

SEQ ID NO: 11 - DNA, 271 bp, Rattus norvegicus
  Genbank Accession No. AA686361
  misc_feature (1)..(271): n = a or c or g or t
ttcaggacaggtattaggaggtaacaatttaaatatctaaaagatgcaaactgaagttaacctaaaattccgaatcaaaggtgttcctgcgtgtntgtctgtctgtcggtgtagagaagcacctttgttcatcaggttggtggtttcagctactgtagaaaacgttggctgtgatgctgctgtatggcccaggtatgttgtaggccattttgttattgtcttaagataggagcctaagctggcctagaactcgatgggtagcctataaaca

SEQ ID NO: 12 - DNA, 437 bp, Rattus norvegicus
  Genbank Accession No. AA686423
  misc_feature (1)..(437): n = a or c or g or t
cgccgtgagagctgcctcaggaatattacgtcccctcaatgtctcggtttcgtcaacctatcggaactgtgccaggaatgcctntnttagttctgcgctgcgcaccattccttttagacatattcagacatcagttgtttcctctgctccaaggcttgtcaagtctgtcggacacctggcatatgggcacacggcatcagtccttaatagagtggccacattggttcccagtgtcttgaagcctccggtcagagctctgacgtactgcagtgcacggaaaggaaagagaaagacagtgaagtcggttgtgcatcgcttcctccganttcattctggccttttggttaaggaggaaaggctgggtataaggaaaaattttgggaaaagttcaactncaaggaaagagccctttnnggggattcggtgtcctgcaatag

SEQ ID NO: 13 - DNA, 362 bp, Rattus norvegicus
  Genbank Accession No. AA686470
  misc_feature (1)..(362): n = a or c or g or t
gtcgatcataccatgttgaagatgagcgggtggcagcgacagagccaaaataacagccggaacctgaggagagagtnttccagaaggaagtgcatcttcatacaccaccacacctgaaagcagaaaccggtccaattacagtcatggcagctgagtctctgcctttcgcctttgagacagtntccagctgggagctggaagcctggtatgaggntctgcaggaggtcctgtcctcagatgaaattgggggcanctatatctcatccccaggaaacgaagaggaagaatcaaaaacctttcactacttttgaccctgcatccctagtttggtgactnaggagccagggccagcagaggtcaca

SEQ ID NO: 14 - DNA, 619 bp, Rattus norvegicus
  Genbank Accession No. AA799279
cccaagattaaatgattattaaaaaagcgtgccactgtatagaaatcaacattctctcccataattctgtgcattgggactatagaaatgtcactgtccctgctccacatcttcaaattaacattctcaggtcacaatagtaagtcttcccacaaggaaccttccggaaaaacaagctgtttcctcggctcatatttcccgctttttgtagcatgcaccagcaatctatccaagaagtatatattggggagtaaggaggagatccaccagcaagcccacagttgttaacagccataagattagatacaagcacaaagggatatgtcaacatactggcaaagaatcctgtgacagcttgggaataacttttcatttcattcatggtagagaccccactgtccagtgcataggtattgatgagataagccagtgagttacacagccacaaagaaatgatgtcacctaggaggcgaggaatgaggcccgcaaaaaatcctacgatgccttcttcccggtagatggttactatggagtcacacagtccgcagtacttagactctctgccgataaactgtaccatggacctcagagtaatcaccttgaagggatgtgtaatgag

SEQ ID NO: 15 - DNA, 496 bp, Rattus norvegicus
  Genbank Accession No. AA799294
atctgtgtagaccacaggcaggtgtttgtttctggcatggccacattccagatacaagaacgtagagagacccagcaaggcaccacaccctctcatggcagagagggagcagtggggcagggtgagggccagctaataaagcctcccctcccccccttaactttgttcatagggcaaatggctgacggaaggagaaggtgggtaggttgagagggtatgcgtcaagacttggggagaggtagcagatagccgtcttgaggctctgttttcaatgagtagtcctagtcgaccttaaccaaagctccatccgattgtattcttgccaaaacacaacagacacatgcacgaacatggggcgtaagcaataatgtcctctcgtgttctccacggctgctcgaaccaagtggctggttcatttggttgacactgattcgcctttaaccatgacggttcctgttttttatttcacagaaagccaataaaattgtttagctat

SEQ ID NO: 16 - DNA, 545 bp, Rattus norvegicus
  Genbank Accession No. AA799301
gcaaaagttgaaaatgctcatatcagttaccagctcagaacctgggttcccatgggatccactgcataaaatgagtctgtcacttcttgccaggtttgggggccttttctaggccttggatgtattttccagggagccgatactcttcaagcaatagctggccgaggtggtggatctggtttccctggacctgcacctgcagactatctttggccccaggggcaggagagacgatggtgctggcctgacatcgctgctggagaatggcggccactgagcatggatctagaccataggtctccaagttccggaccacagtcacctttttattataagtcttcagtacaagggtgatatcaattggacagagtttccctttctttataatgggttcctggcctggaaatgtcacttggtatgcaggctgcagatttttcaaacacctggtcaggagagagtcccacggaagcttcatgaccaagtgctgctcatttttctctaagatacagtcacataagatgggatccaacttcaccagattcctg

SEQ ID NO: 17 - DNA, 617 bp, Rattus norvegicus
  Genbank Accession No. AA799330
tatttaattggaatacatgtcctgccaaccaaaccataaaacacttcatgggaacccatcacacatgaaaccccagcaggaccaacaagtgcggccttgcacttgtcaaggatgctgtagaagaagaaactattgagtttccgtcttaatcctcttcagaacttgaatcatcctcttggtcagaaagttccggcacagggaagcggagaatggcagctactccagtcagctgaccaagctgttccccagacacgtggagactggagaatatccttacggtgcccgcattctctttcacactgtccaccagcctgacataccggctccgggtggccacatcctgatgccggaagagctcatcactgatgagcaaggtgtcaatcgccaaggcttcattggccctctccacctgcttgagtccatagaatgctcggtcaggttcgtgctgtaacattttgtagaagtcatccaaggcttttacttccccggcagctttcgtgtctgaaaggcggctcgctacagtaggatcacataggacctctttcagggagtacctgtgtccagaggaggcgtgtacctgaaggaatttggagccgttttccaggagcaccttgttt

SEQ ID NO: 18 - DNA, 599 bp, Rattus norvegicus
  Genbank Accession No. AA799336
cgtagccatggcgtctcgtgtcctttgcgcctgtgtccgccgcctgcctgcggcctttgcgccgctgccccggcttcccacgttggctttggcccggccgctcagcaccattctctgccctgagggaatctggagaagaaccgggactctgcagcccaccttggcgctcgcgcaggtgcctggaacggtcacacatttgtgccgccagtacagtgatgcacccccactgacgttagaaggaatcagggaccgagttctgtatgtcttgaaactctatgataagattgacccagaaaagctctcagtaaattctcattttatgaaggacctgggcttagacagtttggaccaagtggaaattattatggccatggaagacgaatttgggtttgaaattcctgatatagatgcagagaagttaatgtgtccacaagaaattgtagattacattgcagataagaaggatgtgtatgactaaagtatcagagccttcttcctcactgtgaggactccagaggacacatgatggcatcgtggccaactgacagcggttctgttcgacttgtatttaaattgtctgagtgttttgccctttaaaa

SEQ ID NO: 19 - DNA, 637 bp, Rattus norvegicus
  Genbank Accession No. AA799396
ggaacaccagcaaatccggtactttattaagacatcttaggcttccctgcattttcaaaaacaggaatgctctattgactgaacacatcaaagggtctctgcagagtccttgggggccagccacaggaggtgtcatgtgattctgcagtcccagagcatggcagctagtgcttgcaatcacaggaagcaggcagtcggttctccatctgcctaggggagggtatccttcattcttttgaaggactgccttcaagtcacagctcaattccagtgtgtagactcggtctctaggactggggacaaaggcagctgccaggtgcaacagtttatgaggctccgccttttatatatgccacgggagcccgggctctgggagccagaagcccaagctggaccaaccgctgctgtgggctgatggccttagcagccacataatcttccctttgatgtccagggtcaatgcagtcctggccccaccagggctaggagaaggtgtatgaaagagaatctcactgtgatctgtcctgtgaaggaaacagcaataaaatttattacccagtcaccacagtcattctgacaggagttctcctagcctctgacctccacttgagagggaactttcagggaggacagggac

SEQ ID NO: 20 - DNA, 573 bp, Rattus norvegicus
  Genbank Accession No. AA799397
  misc_feature (1)..(573): n = a or c or g or t
cacggacaagaagatgaagggccttgagtgtctggtaccagacccaacagcagtggtatccctctgtatgtgctcttgaggtggggatttatagagtgcagatcaaactttggaaagattgcattccctagaagtaaggcagagcagaagccgagcgtttgccatgtgtttgagacagagcacaccctgttgtctgctgccttgagcagtgtgaatgctgtcttaagggctttctgtagagccgccttccattgaatctctctgggcttcacagccctgcatggcctatgctgtgactgtgcaccccaggtcgaggattgtgaggcgtggcttcagtcttgtccctgtcctccctgaaagttccctctcaagtggaggtcagaggctangagaactcctgtcagaatgactgtggtgactgggtaataaattttattgctgtttccttcacaggacagatcacagtgagattctctttcatacaccttctcctagccctggtggggccaggactgcattgaccctggacatcaaagggaagattatgtggctgctaaggccatcagcccacag

SEQ ID NO: 21 - DNA, 591 bp, Rattus norvegicus
  Genbank Accession No. AA799406
gaaaaagcttgcggccgatcccggggagcccggcgggtcgccggcgcggggttttcctccggcctcgtcctcccccttccccctccgcggggtcgggggttcccggggttcggggttctcctccgcgtcggcggttcccccgccgggtgcgccccccgggccgcggtttcccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtaaaataagtgggaggcccccggcgccc

SEQ ID NO: 22 - DNA, 495 bp, Rattus norvegicus
  Genbank Accession No. AA799412
catgaaaggttcaaaaccaaaagcggtttctctttgcagcaaatatacattaaaatagagtctctgtacagccaagggctctgggccctggcttgccccatggccctgcgcctccctggccaaacccaaaaataaatatagtgttattgctctgcagggcgtagaggcagtgctgtcccccatcccttgaggtgggagctgatagggggccctggccaccccagggcctcaagcatttccaaaaacagcttgtgcatggagtcagagttggcaagggccagagctttcagcaggacgtactcctcccgctccagccgtagggcttgcagccgccgaaccagctgcagcaaggctgcccccagatcccccagaccagcagcccgtgccccctcttcatccaggaccaggtcctcagcaaaggccaactcatcctgcaatggcagtgagcgctgggccacacccagcaccagcacctccatccacatactctgcagt

SEQ ID NO: 23 - DNA, 705 bp, Rattus norvegicus
  Genbank Accession No. AA799440
  misc_feature (1)..(705): n = a or c or g or t
acataaccaaataagcattttattaacatttatagcatttaaaccagtaccaggctacacaagacacttctgtaaaatagaatgttctactgcactttcccactgaggcctggccttcttgagtgttctccacagtgagctcccgtgttctctctctgccctaggtcacaggaatacttcatgagcattcattctcttgctgtaattttccaccacttccattctcctatatccgaaaatcatcaagtggngcccacactctcgggaaagcctcaattcttcttgggtgtactcgtccagccgcttaagcactctccgtggctgaggaagctcttccactaaattcctaagaatatcttctggaatatcctcatcaagaaaaagatgcagcctttgcatcatcgttcntctgtgcaggtttttgggcagcatgccatagtagctaacttcacaantcgcactgggtccttcaagtggagctgtgcaactggtaactgtctgaagccaccccgggtagcagtatgtgaagagtacactttttggtccaatttggttccagnnaaatgcatangtcctggggttaatatgacaacatgtctccaaatcaatcagctgatggaacctgggttaagttacccctgaattaatggatgcaatggcccaattttgcaaggctgcatttgccacanggaaaccaattcggca

SEQ ID NO: 24 - DNA, 649 bp, Rattus norvegicus
  Genbank Accession No. AA799442
  misc_feature (1)..(649): n = a or c or g or t
actgaggatctcataatgctaggtgaaagtagcagagttccttttcacttttacaccagtgccaaagaccttttataaagaggttcattctactgaactagcctccactgattcttgggttaatcatcaggcacaattcttgcatatgctttttcacatacagcatagtgatataagccattaaacactccaatattatctgaaacaacagaggaacggccattgctttcatcccagtttgacaaaggagtaaccaatggagcataactcttccctttggcggcactggaacagtgtgatacttaactgctaagcgtccatttttataaaaagccaaagcactgggataggagaccccacaggctacgccgatcagtgagcttctcagaacacagctttcctggcttatattacctgattgcagagcatcagtcacaaagagcttgtaagtaacggcggtagccacaaatggaagggtantcagggatgcataggtcctcaaagcttcatacntaaccttgaaactgtatctgaatactagtttgcccatacgcagacaactactactaatcaanngataagttcacgtanatttaaatctggtcgttnantagatcaaacttctctcaaagattcaacgatatgggct

SEQ ID NO: 25 - DNA, 250 bp, Rattus norvegicus
  Genbank Accession No. AA799448
aagcattttcaaactttatttacaactgtcacagtgacaaaaagtagtttggaaaaaaaaaatgctagtttctccctgagcctcgatacagaacagacagaagtcacaggaggttcatctcacaacaggcatgtcactgaaatactaggattttttttttcaatacgatcagttagaaatacacacaaattacttaaagaaagaagaggaggaagaggaagaggaggggaggaggaggagagggaagagg

SEQ ID NO: 26 - DNA, 481 bp, Rattus norvegicus
  Genbank Accession No. AA799467
aaaatcatgattgtatttatataagtcgaatgcagagcaatttgccacagttcatacacaggtgtcagaatgaggtatataaaacatacagagaaatactttcataggaaagtaggaagttgttcagttctctcccacagtcagcaccaccgtgggaaccctgaggtccaggccccctcaacaaatggctctagagagcagcctggtgaggcctgctctcagtgtcaggagtagaggggctcctggtggggacactgccaaggccaggagactgggcgctctcggcaggacactcagaagctgcttttccctctctggaaaaccctttgggtccttcccagtgtttcagtgattgttttgtaccagttacacccttaaccttgtggaaggagctgtcccaagccttagggctgcctgcaagccaggttggactacaaagccagccccacccaccgtgcctttgttaccagcctctggctta

SEQ ID NO: 27 - DNA, 687 bp, Rattus norvegicus
  Genbank Accession No. AA799474
  misc_feature (1)..(687): n = a or c or g or t
gagaaacttaatttattcccacaatgaaggctaaaggaagatcagaagcaagagtctggtctcctggccctggtatctgatgaaaaggggccaggcctgaaaggcctcggactgttcctggtctgctgagagcttgttcaggcaagatgacaagcagatactgaacagggtcacttgggtggccgataagccagctttcgactcttcaggactgaccacttatgccgcttcatggcataggtcaggggcagcagcaagcccatcatcaacaacatcttgagtcccatgcgttttcgatggtcatgctctggctctgatgcccagcgaaggaaggtggcaacatccttggctacttgtgacatggtagctggggtaccatcgtcatactccaagacttctgtgtagatgggaggagccatgccaatggcctggccaggaaagtaagggttgaaatagaggcttctcgcaatgacaccccagtgggaggttcacagtanncagtgagcaaaggaaacacatantcctcacaacgtgccttgctcgaacgatgtactgagtcaggggtaaagctccatgnntagcactctgcagctcagggtggggtatgntttggaaatatcaaacacttcctggcgcatgacatattccatcctcataggcatctgnacttcactcctaactaggctt

SEQ ID NO: 28 - DNA, 633 bp, Rattus norvegicus
  Genbank Accession No. AA799475
  misc_feature (1)..(633): n = a or c or g or t
aaacactgcattgcactcatatttattgccataattgtgttatggagtcagaagatcaaactgggttctgagtcccctgccctcacccagtgtgccactggttatgcctgtccccaccccctgtacacgcacacacaaaatggacttgtactcctcagttgtgatgcaggcaacatatcaggacgcctaatatatcaaatgctgaatgatgggaatcagagggccagactatagggagctgtggggtgttcaggtggccaccattgctaaagacccaggctggtctcccactgattcatgagtcatgttgatcccctggttgctggggaaggtggtgtctgtggcttcagcttgccgagttgaaggatggagactgaacggctgagctgtgtcctcagcgaccctgagcctgaagccgctgcatctgcaggatctgactgagaatgcactgtacatcctcgtccatctgtccctgaatggcgtacaagagatgggtgcggtataaagccacacagtgcagtgttcctgggcctcctcctgtatctgctgttgcaaggctgtcacctngacacgcaggggcntctcctgctccttgganctggctggattggactgctgcaccttcaaaagctc

SEQ ID NO: 29 - DNA, 681 bp, Rattus norvegicus
  Genbank Accession No. AA799479
gggatcagagtttctttatgggctataggggccacaaggctggccaggtggcaaggtcaccggtggcccggtcaccgatacaggtagtcagcctggatgttggccgcgatctcggcctcccacttgtcaccattgttgagtagcttctccttgttgtacagcaactcctcatgcgtctcggtggaaaactcaaagttggggccctccacgatagcgtcaacagggcaggcttcctggcagaaaccacagtacatacacttggtcatgtcaatgtcatagcgtgtagtccggcggctgccatctgctcttggctcagcctcaatggtgatggcctgtgcaggacagatggcctcacagagcttgcaggcgatgcaacgctcctccccagtacggtatcggcgcagtgcatgctccccacggaagcgcggactcagtgggcccttctcaaaggggtacttgatggtggccggctcccgaaatgagtacctacggtcatgcccagtctcggaagagtccgtcacatcagaaccgaactgcatgtcatcccagattctagtcaaaaaattcggtgccttcaatcaatactgttcgtacggccatgaagctagaggtttgcaataaaatccgtccaggccggcaaggcgggaaaatcaaccaggggaatctaataacccccgcaat

SEQ ID NO: 30 - DNA, 673 bp, Rattus norvegicus
  Genbank Accession No. AA799481
ccatcacaataaaagtgacacagctttacaaaaataaatttttattaaaagcagtaaagtctgagcaggaagacagtacaaagaatgtaaacaatgtaaacaccactacattcagctcagcctgatcggatgctgaaagacaagtctaaatgctctagtccctttgctagcaagatacattaattctattttacacagacaacatattctaatttttactagggaaaaatagtttatcgaagtcgatcccaacgccaaatgctggcatcatcgcagacagctatgaggatgctgctatccctgctaaaactggtttgtcgaatagcagcgccacatttatgatgggtcagtgttgtgcatttggctttatgaggatcttctactttcaaatcccaaacatacagtttgacaacctgactgcccaatgcaagcattaggtttactttaaccatatcatcctcaatttggcaggtttcaacaaaaaaggcattttcacaaaactgggaaatacaaaacgcctaacatccttcaaatcaacataatccaagtagtccgggtaaaaaatcgggaatggatttcgggaataaaggccggaagtttgttgggtaaaaccaaaatcctaaccatcaaaatccttggtggtctcaaattagagggtcaacccgggaatatt

SEQ ID NO: 31 - DNA, 654 bp, Rattus norvegicus
  Genbank Accession No. AA799488
acaaaggattttaattcattccacttaaaaaataaaggtagtctcctcaccccccataatgagtacattaagcacatattcacatacagaaaatgtacgtacattcaattgtttacaagatttgtcaccatgtaatccattgacattcaagtgaagtagatgaacttatctacatgtatatatttggaacttctgtaccccatccatccctttttaaacaaccaagataatacgtctattctctagaagtcagttcatagaggatgatttaaggttagaagtctcttttgaagaattacaatgaagtatttatacaataagggctcagaacttctaaacacaagcttgaagctacagctcactaccttaagttacatcacatccagtgtctgggatttttttttagcaggctgtttagtttgtaagccatttcaaatgtttcaaacaattacttgtgcatcaaggagaaaaagtacaaagagaatgattccttccttttttttttatattagataaaataacatatcatctaatccttctcaaatccaacattgtaacacattactacgcaatgttcaacttgagtttctgggaatcaagatcactaactagatgaaaacagaatttcatggtaccaaacaaagccgcctttaa

SEQ ID NO: 32 - DNA, 565 bp, Rattus norvegicus
  Genbank Accession No. AA799499
aatagttacaaaaaacccacagtttttcttgctttattaaaccatacagtattctttcaaggacagacacacagccaaggatgctatggtgagagaaatcttattttcatggaagacgtcacaggtgctctcttcagtgatgattcttatcctcatgggaagtcaggaaatactcgggccctaaagctaccataaacgcagcaaacccccatttgaatccttttaacattacgctcgtgaacgtgatattgtctgcaaagccgcccatgtatctccaagcctcattgcgagcccatggatccctcagccctcgtgcagcaagcttcttctgcattgcttcaaatggcgtcacttcaattttccactgtctgtaatctggaagttccattttaccatgaccatgtccgtgttcgtgaccatgttcaggagccatgtctgacagaatgttgacccccaggacaccaatattcaagcttcccctcggccggattctggcctcgaggtcaatttcctatgtggtccgattaaatcgtagtcatgtaaagtgttccgtgttaattgttcc

SEQ ID NO: 33 - DNA, 731 bp, Rattus norvegicus
  Genbank Accession No. AA799511
  misc_feature (1)..(731): n = a or c or g or t
gggtacaaaagtatttattttataaaacttgtatttaaaatagagcttatctgtcaactcacaaatcctaatttaaaacataacacattacccttagctaatctgatgttaacctttacaatcaacacccatttttggaattttattaagaacctgtactaaatgaagtttttaatcagaaaacattcccttttaccttaaaagtgcttcttaaatgaaggcaccaacaagaactactttcagatggtacagaatttcttatttcttgaagactctgtggttgaccacttcttcattagttacctgcagcaagacaccttccattttactaccaacaccactgaaggaagcaagaaaagctttattaatgatcacttggcttgcctcagctgttgaaatgaagcactttacagtctttgtggcaccagaatatacttgtccatggttcatatcaatgccatgggaagtgggaaaaactcaatacgggttcctccaccataaccccaattcctccactcctccaggacatagttcctccaacataggtccccccagtccggaacaacaaagttcaccctcatgacccttgtaaaggtgcgctcngccgctcggccaatctggcccaggcaaatcccaaaggggccataatccaacaggcaacgttccggggaatgttccgccaatccaaaaatacgggcaaagtaaccggggccaaagtgcaccacaatgtg

SEQ ID NO: 34 - DNA, 589 bp, Rattus norvegicus
  Genbank Accession No. AA799520
  misc_feature (1)..(589): n = a or c or g or t
gagatgaagagacagtgaagccctgtttgctacttacatgaaaagatttaaaaaacaatcactgcacaaaatacaaaggggcagggtatgctgtggcattgaatttctcctcactttttttcttgacgtctcaagaacaaattaaagtttccacagcaaatttgttctcaaaatgccgaatggtgaaacagttactggcttcacgcttctgaatacctctaatggtttccctgcgctgcagtttgtaggtttccttgtcgtgacacagtcggtaaatgaagaagcccaggtggtccacgttttcgatgcggtcggtgatcaccatgtgctcatggatgaggtatgactgaggcaagtangtcccggccttgatgttaataagaagctccaacaggtttctgggtggcataacaatggaggtgttcagaggaatcacgtagcacttgtccagattaaggtcanataagcatgagtttcttgttaaatcatgcacaatgttggcaagatcgctgtccgcaaactctggtacagcacactgatgaattcactgcgtcttctcaaagatctaanaatctcttcattgtctgtg

SEQ ID NO: 35 - DNA, 626 bp, Rattus norvegicus
  Genbank Accession No. AA799526
aaacacaaaaccaaattttatttagcttaacagtttctccaatacaaagagaaatattaaaacccaggacatatgcacatataaccccccgccccacccccaaagcccaaaaacctaagagaagacaggacaaagttctcttcaatggagagcactatcttcgcttctggaaaatgtttccacgccccattccacgtcctcttcctcttgcagccacttgggccttcaggatagcagcttttcctcggccagcccctgagccttggtttttatttttcatgctctttaacatgggtgcatttttcagcatgtcaggcaaaatcagaaaccggatcttgctgccacgtatgtacacctgttccagctgtgccactcggccgtctctgtatgtgactgtgatgttggacatctggcagttcatgttgtcctctgcctcaatgagcttcccccgatacacttcaccagtgttggtctcacatgtcactatgtggccttccgcttcgtgcaggactttaattggcacaccgatagacatcttggcaggactcttccagctaactgcaggcgtgtttttttgtttcggtcccgggacaaacgttagaaggcgaaagcttgaagcgatggaa

SEQ ID NO: 36 - DNA, 499 bp, Rattus norvegicus
  Genbank Accession No. AA799537
ataaagtacagaaaactttattggaaatctcttgattatatttccaagtgtagctctcatttcctaacaaagcactggaggaggggcttcacagccacctggtcccagcctgagcttggctgcgggagttgtctagagcccgtttcttccattgtgtaggactgaggggcacaggccaccttgaaggatgcttcgctcagcttccctggcctctttcttaagaatctgggacataaaggctgctgtctagaggccactggctgagccctgaaaagaatccgtgccctcaccccccttttagtgctggccctggggggtaaatcctgttcagtaggctatgaatgtgcccctgacccaaaggctgcaatggcacttggccaccactgctgggcacatttctctgtggcagcaaaagcatgcacaggggaaaggctctagtgttacatgcagattactaacagcagttgagagcacctgctccaatgcgtaacggctgctg

SEQ ID NO: 37 - DNA, 512 bp, Rattus norvegicus
  Genbank Accession No. AA799538
  misc_feature (1)..(512): n = a or c or g or t
ggccaagaatcacacatatctgaacgtgctggtggtaccctttggaaaaactcccatttgggccttttaaaactgataatggccaggtggaaccttctgtaacccacttgtttcaccagagccttagtaagtacatgcctgatactgaaaccaaaaccatgcgcactttggtgcctttgtagtagtggaaagtaactgaacctctttcttttcaaacctagatggatcggcaagccgcttaacagaggactttgggggaaaggaccacaaactcagtccatcggtccgtggaagagtccttggaacaagcaactggctattaaaaaggttattttgtaacatttgtctaactttttacttgttttaatctgcctcaagtggcaaacttcattttatgtgccattttgttgctgttattcaaatttcttgtaatttagtgaggtgagcgacttcagatttcattattggattggatattgaggtaaaatttcatttntgtttatagtgctgac

SEQ ID NO: 38 - DNA, 615 bp, Rattus norvegicus
  Genbank Accession No. AA799539
  misc_feature (1)..(615): n = a or c or g or t
actgcaaagtacctttaatgtgtttgcatctgcagcaagcattagatttgctcatttgggcaccataaattaggtgtagcactacacagacaccgagtcaccccaaccagtcaatccaggtgagtaagaaagctgaacaaaacacttctgaaaaggggtgcagtcacaaacccagtacagtttaattgtttcaatcaaaggcttccacttacaattgtttggttagtgataaataaagacagtttaaatgtttcagtaagtcagtaattcatcaaacctgggtttgaattattactgttactattcaactccatccaaataaacatcgatactgcactctcaaacagaaaagaaaaagggacagctgcggcaaatgctaagtttgcgttctgagcatttaaaagaaacaccccactctgcatcctttcctctgccactctgctttgataacgtgaatctgtcacattttacttcaacagataaagcactctgctgagaatataaaaagttataaaaatgtaatcataaaagactaattatggtacgcatgtgaacttttcttttantagaaacaaaaatagtcattgttatctagttaactaagtatcttggtat

SEQ ID NO: 39 - DNA, 553 bp, Rattus norvegicus
  Genbank Accession No. AA799542
caaggatttattaagtcatacatgcaaaacatactgctaactgcattagcaaaagatcaatgtaaaaacactccacaattctgcaactgtcaattgaaaaaagtttgttctagaggtcgaaaggcccaacactgtgttcttgccagtgagttaggttgtacagaacggcgttagcactaccgcttgacagaacctcacagacccaaaggtacgggaagcatgtgtccgcgtgggtgaggtctaaagggggcggcatcaatcacatgacagtgttggtactctggcaagacagtgatgtttcagaatatctaaaatagtttacaaactgtaaagccgcatcacgtgatttctacacccagttactacaaaacgacgggaagcactactcagctgattaaaggaaggtgaaaacaggaacgcacttctactatctaccagaaaatctccgaatgcattatcagaaagatcttatagaacaggtcagacatattgctcgttaagaagaggtcctaaagaaaacacttgctaagttagcaactgtgagggatggcac

SEQ ID NO: 40 - DNA, 623 bp, Rattus norvegicus
  Genbank Accession No. AA799550
  misc_feature (1)..(623): n = a or c or g or t
acttttattaacatgtaagattttgttttcaacatggtaagggttttgacctcaaatgcttatcaggtctgccacacatttatagcttgactacatatgaaccttgaagacgcctcttccttgaagttttgggtccattgcaggttttccttctcagtacacaaagggtattgcaaggatctttcattttacgcccaggatctcctcaaatatatggggataccaacttgtacagacgaacaagacctcatctcccataccgggttccgtttcatttaaaaatgagttaggctgtcccaacaaactcatcaggcaggttataatagatagtgtagcacataaaatttaaaatttgcacaaaatacatctctcctcctttggtctcacacagaaattaaagtccccccatagaaacaatacaatcctccgacccttctcccaggtcatcagtcctagccgtgtaaggcccatccacagtcccagatgaagtctgggcccttcttctgccattgctgcatggagtcctcttctagaattaacgcagcttcctcagaactttcagangcggtgagctccaactccaagtctcaagtgtcacagggggaccaagttcagggagctag

SEQ ID NO: 41 - DNA, 528 bp, Rattus norvegicus
  Genbank Accession No. AA799567
  misc_feature (1)..(528): n = a or c or g or t
gaaaattccatacatggatataaggtgcttttatcaaaaccataatgcatgtccttctcattcatctcctagtcctacatatctatttccacctaaactcatgtgctttcttttacagctcactgaatcccttagcgctgcctatatgtagcgctaagtgcaggtgtacagcatgggtagcctctcagggaccacatatctgacgaaagctgactctcctcccagcagtcatcccaacagatctccaactagggatgggacttcctgatccctaccccacttatgctgagactttgactgagcttaatactcttcaatatttttctcctaaataagatttctaaacacagaactataaaattttgagcagaaaaaagtcttgtttttatgtacacaagcataatctgtgggtattgcagtcacagattaacaagagcataaaaacgagaggcagagcaangatctcttttcangaatgagaaaaaaacccacaaggctccagatctccananagtggtgtgcacaagg

SEQ ID NO: 42 - DNA, 533 bp, Rattus norvegicus
  Genbank Accession No. AA799570
acggggtcacaggcaaatggctttattggcttatcatttaaaatgggcttgtcatcacaaggcttgggaagttcagacacttccaagagagatgttcaaacaaacccctttctaaccagtcaaggggaaagaacagtaggcccgagattgactgcagcgtgagttcagcctactcagtataaccaggcatgccaggcctactgcaagccacatgtgcttttactacctaagagttctagagtctggattcagaactgttactagcagacctgagctcataccctcggtgactctgccaagggaggagggggaggggaacacagattagagaaggtggcccgacacccaccttctaggcctttgttaggggccaagtgtggctctctgggcctactgtgggaacaaaccatggcaaagccactaagaagcacaaaaagttagtgtggtactggcatctccaaaatatgtcctgaaagtacaaatgagcagattccatattcagacacgaaggcatccaactaaaacatttaaat

SEQ ID NO: 43 - DNA, 541 bp, Rattus norvegicus
  Genbank Accession No. AA799576
  misc_feature (1)..(541): n = a or c or g or t
aacagacaataaaagggctttctttttaattcaaaggtatagccagataagtagatttgtttagaaccattcttgtgaaatactttttaaaaaaatacgaccaacttctttgcaaattacagacaaatacctcaactatgatgatctaatttttggtgaataatatacatgattagacagaaataggcaagctcacactggaagattaactatcaaacactcagtcaaaactccgtttatggcccccacttcttgatcgatttctgttcccacttcgtcttctaccgtcttgccgacttcctgaacgactcccctgtcgactctgtctacctgatcggccaccagatcgaccaccagatcggcctgaacggcctgacctgccgccagaccagccgctcctctgtctgggattagaagatgtgtttccatcataatattcttcaatttcaggtaacttggctggcactgagagtatccagtctgagtcantgcactctgcctgtaatctttctgactcacttgtaggaacatcaaacaaaca

SEQ ID NO: 44 - DNA, 464 bp, Rattus norvegicus
  Genbank Accession No. AA799581
agataaagaggtgactttattcagattgctgggaaacccaggccaaagggcagcgatccagactggtaccatctcattgtactctgtgttatgtttttctttctgttgttcaccaattaccctggagccttgtagccagcaggcgaaaggactcctcacctcaaatccattccacagtacccgcccgcccaacaaccagcaagtgaagccttgtgatgaggttccaaggtaacatcctggtttgctgagttttgacaggatctccaacacatccttcaccttggacacaaacagatgggagcccgtcctatactaccaggccactggtcatcctttgccagaaggtgcctgctcatgtttcctgcccaaagactgtataggcgactggtgttctctcggaggaccgacagagtgtgggaaagtgactcctctttgaccctggcaatctctcgaactgtgtgcaa

SEQ ID NO: 45 - DNA, 597 bp, Rattus norvegicus
  Genbank Accession No. AA799591
cagacactatgaattgctttaatggtggtatctgtacaagtgatgtcaggacacaggacagcaaatgcacagtggacatggctagcagacaagctgtgaatgaataaagagttcacactgctcccatgctgtagtgactaagacagctctaagccacctcctcctcagcctcctcctcaaactctccttcctcctcagctgtagcatcctggtactgctggtactcggacaccaggtcattcatgttgctctcaccctcagtgaactccatctcatccatgccctcgcccgtgtaccagtgttggaaggccttgcgtcgggacatggctgtgaactgctctgagatgcgtttgaaaagctccggaaaggccgtgctagttgccaatgaaggtgccgggcatttttaaggcaccgggtggaatgtcacagacagctgttttcacgttgttggggatcaactcgggcaagtaactgctgtccctgttttgggcatttaccatcggtgcggcaccgccttcaataacatgcggcccctgaaaaggtagccactgtcaagtaacgcccatggggggatgagaggagccatcaggtcctaac

SEQ ID NO: 46 - DNA, 569 bp, Rattus norvegicus
  Genbank Accession No. AA799594
cagtacataaaatgatataggacattaaaacatttatgtatatcgtacattaaattattttccccaagcatataagcatgtaatatatatctaatgatttaggacatacatttaaactcaactataaattcataacaacatgtctattctcaaatacattaagataatgcttgttagacatatctgtgttattagacatgcaccattaagtcataaacctttctcttccatatgactatccctgtccccaattggtctctatttctaccatcctccgtgaaatcaacaacccgcccactcgtccccctcttctcgctccgggcccattcgtcctgggggtgactatactgaaactttaccaagcatcgggttcttactttagggccatcaattggttcatcgtccatacgttccccttaaataagacatctcgatgggtaacgggtcaaatcagcccatgatcaacataactgtggtgatatacatttgggagtttttaattttcggatgccttctcaacatagccgtcaaggcatgaggttagcacaaagtccgtggaaccttttagt

SEQ ID NO: 47 - DNA, 506 bp, Rattus norvegicus
  Genbank Accession No. AA799598
acattactatacaataaaacaaaattggaatctttataggtggaacagagaacccaccaccccatgacggactgggaaccaacagagagcttatagactggttgcagctacaaggagtggatgcaaatacaatagaaaaggtaaatttctaaatcaaaggattcctatgatactgttgaaaagctgcttatgttgttgaatgtatgttgaatctttcagattgttgaagaagattacacactttctggatattctcaatgatatcactaaggaagacctaaggtgcctcagactacggtaagagagcctgcaaacaatttaaataataaaatggggcttttttatgtgaatacttttatttttaatgctggtagtttccccgatctttgaaatttatctttcctaggttgtaacaagcacagctcattttctcaggttggcaaggcatgaagtgccagacctttctttacattgtttaaatgccaaacctctacccagatcaccaa

SEQ ID NO: 48 - DNA, 591 bp, Rattus norvegicus
  Genbank Accession No. AA799600
cacagtctgtgcagcttttatttcaacagggaagtaataagatctatatacagtctaaaaccactagaaaaggtgagtaaaaaggacccatggtccatctgggtccaaccaggggcggtggcacatgcctttactcccatcacttgggaggtggaggcaggcagatctgtgagtttgaggccagcctggttgacagtgagttccaggcaagccagagctacatactgagaccctgtctcaaaacaaaagtctatggagtgatatgaatggtggggccgggcaagcatcgtacctggcgtccagagcagggcctgggcatttctctggtacatgtaggagtgaggccttatgaaagaccccgcactgagcagaggcacagaggacactgcctacctgtttgagctgtctacctgtctccacaggacaggcggacattccaatgccatcatcgtaggtccagcctgacttacacacccagaagggatcaagcctggcctgcattctgtaaggatgttcagaacttcacggtgctattcagagcccccgagaatagccggtcgcgggagatcaccagtggagtgtaaatgtcct

SEQ ID NO: 49 - DNA, 663 bp, Rattus norvegicus
  Genbank Accession No. AA799609
aagaaagtacttcagaaagaggaaaataatctagatcatttatatatatattttttaataaaaacctttacataatcttcatgcataaagacccaggggtggccatattgtctgtgacagccccaaatatccgctctttcaggctagtgcctgggacttcccatagccagcagcaatgtggtgaaggccttccctatctgcccctgggcccagccagacctgtcgcagtgacagctttaccttctgagaaatgttcttggctagatgggagggcagggaggaacacccttgacattcttcatctaaactcctctggcaaatcgaggaaaatgactgatgatcaagggtcagagcagttctggggcttctcaagagttgttctctgtagcttggggccactgcacatgatagcatggtgtccaaaggatatacaaggcatgagtaaaagccttgaagatctccgcctccatggtagacagcccttctttcttaaatatgtcaaagaacaaggtccaactctcttgattcccaaacacactgttaactgagaaatctacttgagagacaaatctatagtaagggaaggtcagtcagtcatatatctggggtgagagtcagaactctgggtgtggaaaagaattccctgggttttgggaggttctg

SEQ ID NO: 50 - DNA, 599 bp, Rattus norvegicus
  Genbank Accession No. AA799616
  misc_feature (1)..(599): n = a or c or g or t
ctaaggcactgggtgtgatgggctcggttctgtggctgctctccctgctgctcagaggcaggcacagacagctcctgcgagcatctctaccaacatctctaggctggagaattaaatactccgattttagcagttggttactctaacaccagctcagcaacctaactgatacaatgtatggtgctacatattaataccaagttcatcaaggcctgtgacgagggttccctttcaacagatgaaagataactctcaacggctgttacaatacttaggaagtgtttgacaatgctttcaattccatcaaatgcctaacaaggcggaaatgtaagactcccttagttttggaaatcagaagagagaaatgttaatccctggacagactgacagttggaaggctactgagctgctaggtgaggcctcaggcatgaggggagcctacagtgagaccacctcatctgctggtggctgctttcccgctgctttcctaggggcagtatcttccctccttaccttgacatagggtggtcatctgcttactanggacacatctggatttcagagaactgttcagtgtggacggaatcacggggacctga

SEQ ID NO: 51 - DNA, 539 bp, Rattus norvegicus
  Genbank Accession No. AA799633
gactgcaaacaaagacatctgctttatttgttttccatcagtagcacatactgtttcttgagcatggcagccccatgctcagaggcatatgggtgctcagtcagagactgcagggcatggggaccatggtctgtggtctcatgatcggtcccttcttcaaggctccaggaaggatgctgctcctcagcccttgcgggcggtgctcacacagtgctggtatgccttggccaggtcggagcatagaagtacctcatgcagatggtcacggtagcagcggaggatctgggcctgtaggccagagcatacaggctccactctgcggggctttattgtgctctctgcttttgaagccgcctcgtggaattgttgagaagacagtttatacagctcagcattcttctcttggatgcgttcctgctgctccttgtagtaagtgtcacggcggctgagctcggcctctctgttcttcagttccctggtctgtcaagtggagcaaagaaacaacttgggtccccagaggttgaagaatccaaaaatcc

SEQ ID NO: 52 - DNA, 571 bp, Rattus norvegicus
  Genbank Accession No. AA799637
aagcaaaagtagatgagggtggatcaggttaagtaatattggttaaaagaaagagaaaaaagacaccaaaagttatttccttcctaaggtctcagatagtttcttaagtcttttcttcagctccaaaggaaatttctcgtagcacttcttacagactggtttcatgtcaaactccacaaatttattccacagagaagcagtgagaatggtgtggaagggatagaacggttacagacacactggctttctctttctctgcttctctttatcccttgcttctctctcccgtctggcaagtcgcctcttaagctcttctggcattttctcataacagtatttgcagactggctttagatcaattgcaacaaacttatccttgagtgttagtttggtattgcaagtggaacaggcaaagcagctcacacaccaagccttgttgagggcagagaccacgtcaccttctatgacacggttgcaatggaaacaaacatcaccaaatagctgattatagtgagtctcacaataggccaagcccttcctctcataatggcgatgtccaagaaatgggttt

SEQ ID NO: 53 - DNA, 665 bp, Rattus norvegicus
  Genbank Accession No. AA799641
gaatcagataaggcaaagaatgggaactgttttgaaatttaggacttttagaggtaaccatggtcccctactgttaaaaacaggtatttgtctctcacggttttaagattaagggccagaactatctgcttcacaaatccttgttactctgatttccacatatgatcctaaaggttggacagtggtcccaacagcccgtcaggcccagcttcccgagcctccaactctacttagctgtccatattacgattatcagcttaattctctaagatgtaataaactgacatgcctttgacttctacacactcattaacaagatcattacataacactgcagtgtttcccaagtcaagtgttctttttaatcagatctacaaagcatttactgggatgacatttctgacaaagccacagacttctatcaagcagcatcagtgtagtataaaaagtaagcaaaggaacaaaatagccttcttctttcagcctcatgagcagctgcatttctggggaaggacctacacacatagtaattccttgccaagaaccaggacctctgaaggagggaaatgtggattaatgcattcctttttggtttttaaggagactgtaatagaaatatattaaagatagccttaaatatccaacaatcttctgacttacaactt

SEQ ID NO: 54 - DNA, 520 bp, Rattus norvegicus
  Genbank Accession No. AA799654
ttcaggcccaaacagttcatgagtgcagcatgcagcacccatggtccactgcaggccactccatcagtagcaagacccgaattatcagagaccggtgcctgtggcctgccacccagggtacactcaagacgccaagggtgtgggtttggctgagtatgaaaggtaccaggcagaggtcagcttggggctatgtgagctggccaacccaagggaagagggtaggtgaacagggtttccagtgtcccgtgtaccccacggcggccaagaggctaacatggggtctctggtgctgccaacaaggcctaccctagtgctaagcctgcggctgagtgagcaggttgtgtgttggggtcaggatgcccctcctaaggcgttactgctataagctactctgtcccagggcagtaaggaaccacaggggacattttccccacgaggttccaatgggtcaaatcactgaagccttcagcgcctatggctggcacaccaggggaacaagggcgtgggcgtgggtgtggag

SEQ ID NO: 55 - DNA, 610 bp, Rattus norvegicus
  Genbank Accession No. AA799656
ttttcaacagtttaaataaaaatttttcctcatgatgttaagtgaatgttattttctttgagaatatctcttttttcattaaaataatttctgaaccactctatatgctcgaccttctgtctaacgctcagatatgggtttttcgagaggccacaggtcaccagctccatgaacaggcgaattggtccttgcttggggaaatcctccaggtgcttctccaaaaatatatgctcatggaactctgagccatcatcgtcaagacctgcttcattgttaactgggaactcccacagtttcccctcctttgtccactgtatcatctcctcaaacccattcccaaacggctgttcgcttactgtggctaattgcttagcaaattctatctcccagagagaaggtgctgcttctggttcaggtgcttcgtcgtcaaacgccttaacatcaaaaatcgaaagtcttttccccttgaacaaacatttcctccttctgaaatcagctggcttctcctggctaagcgaactgtccacttcttcgtcaaactgaatctggtgctgtggtcttgaactaactctcatcgaaggggatttggcaattttcatattcgatatta

SEQ ID NO: 56 - DNA, 502 bp, Rattus norvegicus
  Genbank Accession No. AA799657
gctgggcaaacgacctttatttataaaggaaacagtttccgcgtcattataaacagtaagccacatggtgtgaaggcacttggttggggagatgggggcctcacacaggccccaaggcttctgggagaaatggaggctgctgggaagaacggggacttccaggtgagaggaagaaaggactcagagagaaatgaaggggtgggtagcctcccaggctcagctgggatagtgcagtggcttgctgccagtaggaggcacttagaaccagatctgatttggcaagtgtgtgtgttgggggtggggtgggagttcctgcccccaaatgtccccagcccaacctcaccccaatgcttaaggcagcttcataatcttcagtctggggctgccctcccttgagccgcccttgagcagagaatttccggtgcaggcagaacctctgaagaatagccgcatattacttagatggatccggcaggtctgggtggcaagcatgctggcggtg

SEQ ID NO: 57 - DNA, 611 bp, Rattus norvegicus
  Genbank Accession No. AA799664
aacttgaaaagcgatttttattgactttggagggacagtttcttattataatagtaaaaatgctcaagttgactgttgtaaaaaacgacatggtgcagcaatggccagtgtccggccaggaggggacaggccagggtgacagcggaagaagtaaagcatctaaaaggacaagtgctaagagaagagctcacgtgaggcagacgctcccagggcacccaccaagagccgccacacaggagtgggagggcaggggctcttctgtcaccaagattaaaatcccctgaaggcctttgaacagcatgatacagagcaacacactgaattcttgttcctctgtcaacctaaattgagccctgggcatcccatccagccctagggctgaagcagctctgtgtcctctcccacccagagggagagtgccagctagcataccacagtgaggtgcttctggtgccttctcgatggacgttggccccggaccctagagacaggtggtggccaggccaatggggcagtgacaggacctacccagacccatgagcccaccttgcacatggtcacatcagtccttaataggtttctacaggaatctaattgttctgggcgctgaa

SEQ ID NO: 58 - DNA, 541 bp, Rattus norvegicus
  Genbank Accession No. AA799667
ataggcccacttgcccagcaggttgcaggtgatgggttcacattttctaggctcaaggatgggcggcctctgcataccacaggtgtctgagtggcagcatggagcttgctgggcaggaggtaggcgcagatcaactgggtcagctatttaaaggtggtctccagcactggccaaaggggcacttgaatgaagcactgtcacataggtgccccacaagcaagcccagaaaagcagctcagcctggggagcctggcgcctctcccacagtgagggccaggccaggcagagggtgctccacgtttgtcaggaagggctcccttgttcaaatcacattcataggcacagcttcagacgtcagcaggacatggagaaagcaggctgacccggccacagccccacatgacccacccatcctctttaggtgctggtgtttcaatgaggccctgaggggaatggccagctgtcttccacccaggaccacgcataggcctcccagcttctctctccccaacagggcactgtgcaggaagtccagaaaaat

SEQ ID NO: 59 - DNA, 574 bp, Rattus norvegicus
  Genbank Accession No. AA799686
catcatcacacacttttattgggtgcccacagaattcaggcacgttcatgtttacagagctttgctgatacgctgaccttgcccttaaggagcttacaatctaccaggagaaagacaagaaacgtaggtgtgaaagcaatgagtgaacagacactacagactgaaaaaccaccataaacataaaacacatattgcaaaatgagttaatggggatggcaaggatctgagatagcctttgctatattcctgacttcctgaaggtcacaggtttaaactatttgagggacaagagtggagttgagaaaagccacgatacaaatgagataagttctcccttactccctgctcccgggggtcacaaggactacagggatagtgataagacaaaggttgcagtgctcttagcacctctagccacagtggatttggaccagaacaaagctactagttagatgacaatcctggactggttcaaaggaggatcaaagttttttctgcaccagctctatcacacacataatggctcaggtcaaatgtttaagatggccagaggtgccactgtgttaaggagcag

SEQ ID NO: 60 - DNA, 637 bp, Rattus norvegicus
  Genbank Accession No. AA799700
ccaacaaagtcccttttatttagttagctgttaagaaattttttttattaattaaatctctggaaattttcagtgtaagatttagtatcttaacggccgccaacacctggctctgaggtttgatcagccgctcccagtccttattaggagttagagggagaaacatcattatcagagaccaagtcaggtggctatggccttcctttcctggctggacaagttgctcaactcttgctcagaacaggaaaagaggcagttgctcagaaaaataattaatgacaaatttgacaataaatcagtaagagttctcctaacaatttagacttatcaatatgttggtccagataatttttttcatgttgcagtttacttttttctgtatgtaatcttaataatcttactccctgtgcagaaatgaatcaactcagtgcaaaaaatccctaaaactggaatagcctcatcttgctttgggaaaaggtttttttactcctcattctctcaacagatgagcacacatcccctgcacttctgggtctggatgtacacaggcagcttttgatggaactagcaaaagtacctagaggcactatgccggcagcctttggaaaggtcttaaaatcaaccctggccaacagtc

SEQ ID NO: 61 - DNA, 400 bp, Rattus norvegicus
  Genbank Accession No. AA799717
ggaaactgggcatttattacaaatggaggaaggaacggtcactcagtccagcggtggccgcagtgtggggcggtgcatacatagtacaggcgcatggcatcctcagctcgggcactgtgtgactggaagaacactgcctccttgtggccacacttctggcacgggtggtcctcggtccggggcaacgtagggtcctgggacacgtctgcgatgatctgggtcagctcgtccacttcgtgcgtgattttgttgacgtacatgcagctgttgtcggcttcctgctggtaatcgcaattccggcacgcgtacagcagaatgcgattctccttgtcctccttggggtacagcatgttattacattcctggcagaaccgaataccgacgaagccagcctcgtgcc

SEQ ID NO: 62 - DNA, 541 bp, Rattus norvegicus
  Genbank Accession No. AA799721
atgctgtctgaagtcagccagggcccctgagccctgccagggaaccaccatgccacctccatgtgaggatgggagctgggataagggtggcttcttgctctcctcgtcacctgtacctgaggagcccagagtgctgtttccactgtggtcagctcagcctctggctgcctgcaggaggtgggacgcagaggggaggaaggtgagccagaggcagggaccccgttgcacacgcatgcagactttctcagtgtttgattttgtttgttctcctcctttgctaaaatgatcatagttgtgtgaagctgctgccaagccagggatgggtaggacagcactatggactgcagccctctgctcctcaggtgcctgggtccatcctacttctgtatttggaacaggaagagccgcaggttaatgttcttggcagccagcagcttgttgcactccacagagtcgatgatgggcagcggcacatagtctgtctcgttgctctcgttggtgaagacaaagtggtagataacaggactgatcctcacatcat

SEQ ID NO: 63 - DNA, 640 bp, Rattus norvegicus
  Genbank Accession No. AA799724
aaacaaaagcgagaatttattaggcaaacagacttgcagagattccaaaagctgtaatgggtcaatagctagagccacattttcctataggacagaacatgctgtagtcaccaattctagttctgggctctgtaccatcctgagggtggtcctgcttgtaccctgcacgagggactagagcgtgggttcgtttttgcttgcctttttatctttatagtcctttacgctggcctcaaacttgacaagcacatgctggcagacattcaagagctcattcaggcctttctgaaacggctcaacagctggaagtgcaccccgtgtctgaattcgcaaattaattttgctctctgaaggatgggtcgtagtgtaaccacaaaattccacttccgggttcttcatgattatgtaccgcagacaatttcctagtgtatggtcctcctcgtgtagtacaaatgtcacacactgtctatctgttccagctgcctggaccatttccagggctgtcttcctctcgccttcagccattgaggtcttcaatcctgatatttttctctccagctcctgatcgtcctccatcgcggggggcggctccgggaaatcctcaggtggcgctggcgaaaaggaagctcttccccatgtc

SEQ ID NO: 64 - DNA, 503 bp, Rattus norvegicus
  Genbank Accession No. AA799726
gacatttcacagtcaatttctacatgacttcacactttcttagaagaactcacatttggtagtctctaccctaaggagtcgcttcagtatatgggcagaagcaatgtgtctgctgaaggagtcataccagaaaagataggtcagacagtaccataatcaataaaaacagtgtagtacattacaaatgacagtgcattctataaccaatttcagtcgggaacctttctaactgtgtccgatattgccaatacaactgacaagggttctcctgtgggctggtctgagttaaaattgactcctcaccttgagaaaacaacggccctacataatgcttcagaagagctcatagcatgcactaaggccattgctactcacagccttgggcaaccaatgaagattcttctggtccactccagactttctctaagtgctggtctgctctcgggcctcaaaggattctctactggagtctgtctgcctccagctgctccaggaacagagca

SEQ ID NO: 65 - DNA, 588 bp, Rattus norvegicus
  Genbank Accession No. AA799729
cagctcatataaaagtctcttaagaatgcatttgagcacaatatataatagtaataatattataacatacattgtgagaaacttttgaaaacaatataacgtccacctggaacaacgcagtgttacagacgtaggaacccattggtcatgcacattttgtgccattttctttaactagttgtcacaatgctgaacttgtttgaagccatctcgctgacagagcggtaggtctggatggtctctagctggtctaggcaccagtctagttcctccagcgtctccattgctagtttctgatatgattcttctgcaaacaaacacacagacaggtagttaggctgcagcggctgcaggctggccatagccgagtctcctccgcctcggctgctcccggcgccactgacggtgcccccttgctccttcattgtttgcttgccgactccttgcttccaagctctttctggtgctctgcccgggagggggagtggctggtgccaagttttcaccccctcgccgggatgaggtgtcagtgatctaccaagaaacttcctcagaggaagaaggcgggacctcgtgccgaattcttgg

SEQ ID NO: 66 - DNA, 581 bp, Rattus norvegicus
  Genbank Accession No. AA799735
aacataaataaaggctttattgttcagttcggatgaatgacagactggcataagctcgattaattgttccacacatttaagaccccaggatgacagcaaaagctatgcttattggcaatgggcaacagggagggagggggtgggaaggacctgaaggcctctgaagttcaagaaagctatcgggaccgaaaccaacgtcctagaagcaggtccaggatggaaaagggatcatccaaagctgaagatcttggaggatctggatcacttctggaactgtcatgggcttcttgatgggtcactgtggtctctctccggccctcactgtccaccacagtgcggtgttcctccactgtcccatctggcttagtgatcttggtcacagagatgcttttgaaataggatttaggctggggttgaagaagtggacccagaccttcctgggaaacctgggagtcaagatccttgtcctctctggctctagaatggggactcacaggccatgtatcatccaacctatgaaaaggtccctgggacccccaatctggagctggtttggaggattcaggttttgcatgactctc

SEQ ID NO: 67 - DNA, 616 bp, Rattus norvegicus
  Genbank Accession No. AA799744
caaacaggaaattctttattgcaaagatacaaaagcagtcacggcgacatgtacagcaataaattaggtggtggccatgaggcagggtgcagacggggccaacagtctgtgatcttgatctcttctcaataatttataacatgggggaaaaaaagcacaaaaaaaaaataaatattgaaatgaaattgccaagtggcaggcggctgaggatgccaggcctcggcatgatcggcatgtgtccctgacaccttttgaaatagttaaagcttgctttaagaagtcagaggaacaagacagaaaactcacttttatctttaaataaaaacatccatatattattaagttgtgacaatgaaatttcagtgacacgaagccatggggcatgctcacacccttcccagccccctcctggcaggtgtcctctgcaggtgctccagtggtactgacagccctgtctcccctggccgccaagagtatggggcctccacccaggaggaccaccagaggccaggagcgggcagcaagccagtcagtggtcacctgcctaccctggagaccactcatccagttacccggcctgccagcaccaccacagaaagactgatggaggctgttg

SEQ ID NO: 68 - DNA, 671 bp, Rattus norvegicus
  Genbank Accession No. AA799751
  misc_feature (1)..(671): n = a or c or g or t
acacctaatacatgaaaagaactctgaattgaaatccagccatctagaaataattctggtcataaaatgcacaattatcccatgtgtccaaagtctgctgagtttgctctgaagtttgtatttactccaatatctagaatgtctcaggaccacatgctgatactacacagaacagaagggagctgagcagaaccacacgtaaatgcaaacttaagaactttatggtattgctctggtgccttatgtcttaagcactgaccagagagttaagtgtgagctagaaaagttttcagagaaatgagctgcagaacttcctaccccacccctaggttattcagagcaaggagggctgatgtgggggatgagaacctacagactgaacatcctgctttcttcctacctcagtccgacgctggacatcctggagtgtaaggcactagaactggcctgagaagtgctccaagcttcagttcttggtgtgcaaaagaaattgtggcatagatcttttgaaacataataaaataactcccccctcctcttatattctgttattcacagacaaaaagacaaggaggtanatgtttgcaaagattaaaaaacaggtgaatcaaaatatgaagaaagtgtgtatacntattcagatatggagaaccacttagagggcaanagtc

SEQ ID NO: 69 - DNA, 567 bp, Rattus norvegicus
  Genbank Accession No. AA799766
gatgcctgacaattggacaagtccctttctgacaacagaccattatgttgaatcctgcctgcaagacaagctgctcgaattcacttaaggagctggagggcagtgctgaagggggccaggttctcacaggacttaagccaccgctgcacattggtgggcgctgccccactgcttcccccagtctgctggagcacggaccacagcaccacatctgccacagtgagctcattcccaaccaaccacgggcttttccccaaagcggagttcatagagcggaaaacagccgctttttccttactgctcccttctctcagctgaaacatggcgatatccacccagctgtcgatgagggttaggtggacagcgttatgcttctgaccaaatagagagaacaggaagcgtgcgatgttcccttctccttcaatggggcacatcgtttgtacactgaacttcatctgtgtcttgggcacgttcttccaaatcagagtgaagcccagctgatactcgtggcgggactgttttctagcctgctccccgaagcacttgagaagattctcaggtacattc

SEQ ID NO: 70 - DNA, 631 bp, Rattus norvegicus
  Genbank Accession No. AA799771
actagacacctttgataatgatagaatgagtatcttgtcttaaacattctcagcactatgcccttattacatatgacatctaaaaacaagatactcattctatcattatcaaaggtgtctagtaaaaaaggaaagattgacattgaagatgggactagaaacccctacttaggggccttcaaacggtttctcacacacatctgtgaggtaggttattatccacattttgtacaagagaaaactacacaaggttacataccttgtgctgccataatagcaaacagggaattagatccaattagatccggtccttagctttgcatttcttttctttataaactttaaaatataaagactgctagtaattgcattcattttaaaagcataagaaggcagccaaatagtttcccgggtggctttacaaagtgaaacaaatgaacagaaaatgcattcagtgaagacattccaatggtgacgctgtaaggtctggtcaagtggaaccaaaaggcagaagcaaaccacgtgaccgcctgtgggacaggtctcaggaaaacgggggagctgggggcagcagactttgaacacacgtttacggctactctgcaagtatttgagaatgcaccaggtactc

SEQ ID NO: 71 - DNA, 615 bp, Rattus norvegicus
  Genbank Accession No. AA799773
ccacatgtgcaaaagtttcccagagagttgggccccacaatgtgtaaaaaagacccccaatggggcagagctgtgtaaccataaaaaaaaaatagtaagagaaatcagtttcccaggaggcctggcttgggtggagcatgtcactcagggccagtccgcatgcggtgtgctgtttgttctggaactgctttcttctgattgttctttcttttccaagccccttactctagggctatggccaccagacggcctgacagagtcctcaggcatggtggtttgtgaggatgacttctttcacacacagataccccaactcagtgcttgcccactggcatcagccccactatgatccccagggcttccccccaacccgtttaaccccttatatcacagtctcggcccccagcttcaccaagtcttccctcaggacacctttgagggacactgaaacaaaacagataaaggcccggccccccacccaccaagtggcacagtggggtacgggggattgtatcaccccgtcacacctaaggcaggtgttttagtgtctgattctgtgagtgtggataggggggtggcacatctgtgtgggtatgactttggcaggaagtgggg

SEQ ID NO: 72 - DNA, 673 bp, Rattus norvegicus
  Genbank Accession No. AA799784
ggcagcaaaattgtgttaaaaaaaaaaatctagaccatgaacatgttttactgcttcagtttaagaatcccaagccaaataaaaagagcagcacagaaagcagcaagctggttacttccagacaaataaaaaggatcaaatgcaacagcaggaagacaaacactcccccttttccagaaatcacaattccttcaaataaagaatgtgaaccatgtgccatattgaattgatatttatttcaggacatgccatgtcaaaataaaacaaaagagtcaatccctgcttttaacaataatatgtattataaaagcactttacaactctatcccatgtttgagtataagttacagggtatgtgggctaatgattatctgaaagtatttctctattcagatccataatccaagtgctctccaagtgttacaaggtgacagtacgtagaagtggaggaggacagggaggggagtcgggctttccagttaggaattttgttgcaatgaggaggtgaggaagtatgaagttatttttgttaccttttcatctttatactgtgttaagtaatgcttacaacataaaccccgcaggcttcttctgagttagaactcagaattttttccctgcaaataatgtatttacaaatgtgtttattaacttacacagcaatctcaacctc

SEQ ID NO: 73 - DNA, 586 bp, Rattus norvegicus
  Genbank Accession No. AA799788
cagcttctcagaaagctattttatttggatttcacacacaccaaaagcagagaggagactgtggggctggccctctttgggctggagtctctggctcccctgggcagtcggttcccagcctcccaggcttgtcatcctctgaaggctgagtggggtgtctgccctgcaccacagctcttctccaaagccgaggaaaacccatggggaatacagggtaagaggacctaaggatcatgggatgggagcccacattgaacctcggtgaggtagtctgtcgcctgaggcccacacgggtcctgctgaggtaaaatttgtaagtttatttcagggacgtgggtcaggactcctccttggtccccaggacctgcttccggatgatgtccgtgtactcgcggtccttccccttgctctccttccattttctgtacatcaccgaggcgtccacgttggcaggcgaaaaggtgttgggctcattcagcagggagatcacactcaggaggatggtcctgacattctgcgtggggttccaccgctctgagggtagctccccactctgtgggtcatcaactgggggatggaggatgga

SEQ ID NO: 74 - DNA, 615 bp, Rattus norvegicus
  Genbank Accession No. AA799792
agagactcagtgatggctgtcacgaccggaggggggactctcagcctttccagacacttaagtattcgtcaaagagtcaccccagcagtggtgatcacagacatgaaaagatgcgagacgccgcagatccttcaccaccaaacaaaatgttgcggagatctaatagtcctgaaaacaaatacagtgacaacacaggtcacaataaggccaaaaatgtgcatactcaaagagttagagaaagggaaggtgggaccagttactctccacaagaaaactcacacaaccacagtgctcttcatagttcaaattcacattcttctaatccaagcaataatccgagcaaagcttctgatgcaccttatgattctgcagatgattggtctgagcacattagctcatctggaaaaaaatactactacaattgtcgcacagaagtttcacagtgggagaaaccaaaagagtggcttgaaagagaacagagacaaaaagaagcaaataagttggcagttaatagtttcccaaaagacagggattacagaagagaggtgatgcaagcagcagccactagtgggttcaccagtggaatggaagacaagcattccagcgatgccagta

SEQ ID NO: 75 - DNA, 631 bp, Rattus norvegicus
  Genbank Accession No. AA799796
aacaaaactttgtacattttaatacatgtggaattttacatctaaaataacagcgcattcaaaaaatttaccatttatacaaattgttacagaataacaaccagtgggtcaaatacgtaaaataaaaaaccacactgattcttttaaattatctacaaaaggtttgactttctttaaaattcccctgaacatataaaaataaattaattttacttttcaattaaatctaccaattagaaatattacaaatcaaaatatcaatgttatcttatgaatttttcacattacaaaacagattcacaaccttatttacacaagtgaggtaagaagtgtgcagtgtcactcacaggagacatactgcagagcgagcgcgctcttccagctaagcacaccgtggaggtccaagtgcggctggtctttcccattagtaattcatgcattccagacacagatcaatgattgtatccccaattgtttggcctactagtctgccatattgtcacagtcaagctcatggtgactggaactcaaaggctgtgaggcaggtttaggaaccaggcacaggcgccattgttccagtgggtggtttagagagataaacaagcacaaagactcttcccaaatctacttc

SEQ ID NO: 76 - DNA, 596 bp, Rattus norvegicus
  Genbank Accession No. AA799801
ccggcgctcgctacagcgctctgctcggctcgggagggaagtattggagcgcgccaagagaagggctgtggactggcattctccagagcgatccagaggctgcgtgggggtcctttacggccaggacccctaccaggaacgatggtcggtcccgggtccccagagcctcctaggagaggcagagagaagaaaggcgcccaacccttagtacttccttcaggacaatggcagaattcatggactatacttcaagtcagtgtgggaaatactacttgtctacaccggaggaaggaggggcaacccacgtctaccgttatcacagaaggaagcctgcagaagtgcacgtgtgctcagactcggggcacagggaagcgcaaagaaactgcagaggagagacatctgttggtccaggaagcatctatcaaacatcagagcattctcaagagtcatcttggcctattgagaacatctctaaggacctctacatagaagtctatccagggacctattctgtcactgtgggctcaggtgccttaagcaagaagacccatgtggttgcagttgactcggggcaaagtgtggacttggtgttcccc

SEQ ID NO: 77 - DNA, 556 bp, Rattus norvegicus
  Genbank Accession No. AA799803
gagattatagtaaaagagaatttattctatacactgtctgcctccgtgattttaatatgagaaacgtagtgcttatcaaaaattggttagatacttttttttttttaatatactacacactggattctaacccaatgaatgctggcttcagttttcatctccaatctctttcttgatccagtcaacataattcagtaacttggtgtaaaagccgtatccctcaccacacccaatgccccaggatacgatgcctgtagccacccagatatcacgactgcggtccctgactgcaaaaacacccccactgtccccctggcaggcgtcatgcttgagagttgggtccccagaacagaacatattttgagaaaatacatcattactgtttttcgtccggagccacctctggcatgcctctcgatcggctatgggcagacggacaaacctgagattaaaagctattttatcttctgttatcccgaagccgctgacataacccataaggtctttgtcataaaaggtctcattgtctgggagacagatggggaggaggttggga

SEQ ID NO: 78 - DNA, 582 bp, Rattus norvegicus
  Genbank Accession No. AA799804
aacgatcaaaaaacactttgcacttataaataaacgcttctttgatcaatattaaatgaaaactacccagaaccttacaggcctttcagcaggcggcagacatgatgttcggaagatagatgttagcttgctgtgatcagaaggatagcgctttgctgtaatttatttaaaatgtacctaacagcttccctcacagtaacttgactgaaattacaacaggaaaagaaacccagcatttattcctaggtttagacataacccacacaaagttccaactatatggcttctatactttttcgtgaaggtgcgcaaaagaaattcggatctcactttagaccaagaatttcagatgcaataaggcaacctctgaagtccaaagttcaatgaatgcacaacagttcaagcagcagataccacctcagaggaaatatttagtttgcttctttgtttccctccagtgttaatcctgctaatgtctgctaaggtcaaccatgactggaacacatgctgctgatccagttgttcaagaccagcctgggcaacacggcgagacactgcctcagaacaaggagtgaaaacaga

SEQ ID NO: 79 - DNA, 500 bp, Rattus norvegicus
  Genbank Accession No. AA799812
aaataattcgctacaatcctgccacaaattaaagaaaaaattaacatggtattcacagagcagaattctttaggacaatcaaaatcccagagtacttagaataaattaacatcaaattgtgtttatattcagatagcctgattctctcctctgaaatgaaatggagaccattgtaacctagggtgaacgaacacacttgttcttctgtatagacatgaattctttacataaactcaacattaatttgaatcaagttaggaatcctgagaaagtcacccacctacaggcatacaaagacacacacagacagacacacacacagagacagacagacaggcaggcagacacacacacacacacgcacgcaccactcttgagaagcagtgtttctcatggacacttactagaaggtcatttctcagaagggtctaaaattctgaatatttggatgctatcatccccccgcccccaagaaaatcgtcttgtttcaagtgtgacag

SEQ ID NO: 80 - DNA, 475 bp, Rattus norvegicus
  Genbank Accession No. AA799814
agtaaagacaattttgttcatacaaaacaacagtttacaacagtctgagtgttgaacacaccatcaaggacatgggaggagctgcagacatctgggccctgccccaggcccagagatgcccaggagcccctcctccaccaacccctgagggagacacccctcctccagcacgaggggcatgggggaccatggcacaaagactcgtccccaactgctccgcctcaatcctggggagcccccacccaggttgagtagttagagggtaaggtggctggtgggcagggacagagtcaagacatctttggtgcgaagactgtcccacccaccagaccccgtgctggaaatcgagaagaccacacgtggtcctgcccttgccaaacggaggttggcaagtaccccatagttcaggggagatgcatgaaatgcaactgcctttctgggtagataaccttcccagggtcacccatgggactgg

SEQ ID NO: 81 - DNA, 610 bp, Rattus norvegicus
  Genbank Accession No. AA799822
gacgttctccaccaatccctttatttacttacgacaacattctaaaggcagatatgcccattttgatgaacccagcccagcttccccatccctacaaatcctgcaccctctaggacccagggaactacacctaacctgtaagttgatttcaggaagccttgcaggggcccatggttagattgtaccttggtccccacatccaggaccaacaattccagcccctgcctttaacaccaacgtgtaatatggggtacccaggggctgcaagtgcagaacagaagcagccaaacacaggttgtctccaaggcgtgcaaacctgtgggcagcggcactgctcagcctacagagggctgggatgaacacacccctccactgtgcttactactttggcaaaagaacaaaatcaccaggagttttaagaacatgagtaaacttcaggagacagaaaaataaaacagcagcctgtacagaggctcaaggctgcccagtcagccgcactgcctgcttgccgccagcttcctcactgcggaaggatgtaagcgtttgctgccagcagccagagtgactgactcaggctccctttgttagccaccgtgactctcccttggag

SEQ ID NO: 82 - DNA, 630 bp, Rattus norvegicus
  Genbank Accession No. AA799824
caccgtgcacaggttcttttattctgtcctgtgggtgtcaacagtgctgacaggatagtgttggaacattcggaaagcacacacctgaatgttgttacattgcactacatcacaacttggtaactactgaacagttatgtctactaatacagtgaatgaaacatctgctcacaccattccctgtaaacaaggctgtgcactacagtaacacaggattatgcataccatgatatcaaggaggaaaatacctctttaaataaactattctatttataaataaactctgattttctcagtacacatttacagacctgatcaataaaaagaaacaatatatatatatatatttttttttctttaaaaagcaaatgttgagatatggaccacatagaaatccacctggggaagggtagggagcaagcatggggcaggagagttatgagttaactctgtgagcacacaccaacacgaggacaggactgactgggaggagcttgtttttacttgaattccagcaagttgcaatcaatcttgtagtacacataggggtagtattcttgctgactcaggttcaggccaggaatatccataggagcatcaatgatggcagctgcactgctgtccagatgc

SEQ ID NO: 83 - DNA, 511 bp, Rattus norvegicus
  Genbank Accession No. AA799847
  misc_feature (1)..(511): n = a or c or g or t
aacaggatgactctactgtacacgtttgtttaatgaacagagtgtaaaatatttatttccatattcattttagtctaacttctagtaatctggacatgaatggtgaacttgctttactgaagaacatggctgctcaactgaatcgacatgtcccagtatcaattaatttcccggatactctggagcctattggcgagattgagcatcaatttccccaccgcggttaggtcaggtgctcacaaatacccatgcgcatgtgtgatagaaacggactgattcctgtagatggtcattctccacgggtgttcatgagtagatatgtttccacatgtgctagtccccatcgttttgctacaagtggaaaatcaaatgtcttcgagaacaagaaaacccacacagaaagccagtgtttcttttctaccacacatgctctagggaggtgggcangagtggggcttgnggacggaaggggatctgaaccgcactacanatgagtgacangagactgcct

SEQ ID NO: 84 - DNA, 207 bp, Rattus norvegicus
  Genbank Accession No. AA799858
aaaaattcaaagtcttctttattgcaaaaaatatgtctttgacctgaggaaaggagttgtcttccaaaacctttgcgtaagggaaagggaaatcagcaccagtgacccaaaaagcaggcgcatcaaggaattttaatgcagggccttccaaaattcccgcaaaaatctcagccccgaccccaaattgggggcaacccccttccaaag

SEQ ID NO: 85 - DNA, 499 bp, Rattus norvegicus
  Genbank Accession No. AA799861
ggtaacccaaccaattctttattgtaaagatgagtgctacaaaggaggcctagtgtgtagggagtggggggtcaccttctttcaagggactccacaaggtccactagagatgacatatagccaaggaataagcctgagccagggcagcagtggttctgaactctattggaagttggggttctgaatcaagcccactgacccaggtccatgaggaagtgttcaatgtcatcgtagagactattggtgctagacaagcacaggccaagactgctgctgtccagagaggacacaccctcacgctgcacgccttccagatgtgtcttgcacagccatggctccagcttcaccaggatcaggctcttctccttgggcctccctgctgacaagtcttgcccaaaacccaggtagatggtgtaatgtggtgatccttgtcgcctccgggcccggaactcctccagttctcggaagaaatgctgaagtcaaagatgggagtatggca

SEQ ID NO: 86 - DNA, 412 bp, Rattus norvegicus
  Genbank Accession No. AA799871
aactggatataaatccaattgcaaatgttccttggtcacttagtaactttcgaagctaggtcactaaggacggagctcataactgccccagaccacactcggaagctgttgctcactctccactcagtggccatcgtcaaccggcggccttcgctgacgagcagatctcatcttgtgtggggaagccgaagggtcttcttctgcttcagaccctgaaggctgctcattatctccttcctgggatcctgtgtctcccaccagctcccgcagaaacttgaatttagataaaaacagatgccatacaaaataccaaccgcacaccatcagcaacaggacgatcagcagcgtggccacgaacaccagcagagtcagccccacgttgtgccacattttgagtgcttgggggtgggcg

SEQ ID NO: 87 - DNA, 391 bp, Rattus norvegicus
  Genbank Accession No. AA799888
cctgggatgacttatctgtggaaagtagactttagattacttgtccagactcctagggccagcatgttctgaggatagcagttttcagttctatcttttgaattctacttgtgtgtacaccttggtgatgtcattgtacctgccttcaggggcctggtagttagggacaggcggtgtgtaatgtggcccttctttctcaaaggggaataggctggtgtcccgctttatggcttcggcatagagctctgtagactcaagtttcagctgttccagggcttcctgctgggcttccagcatggctctgatggcgtccctctccatctcatgctcctgctgcttatacagtgcccacctcttcagcagaagagctctccgctcactctcctcaaaa

SEQ ID NO: 88 - DNA, 510 bp, Rattus norvegicus
  Genbank Accession No. AA799889
  misc_feature (1)..(510): n = a or c or g or t
acaagagccttttcaagttgtagagaaatttaatagaagtatatacaaattagacactgctagtatgtacaaaagtattttctacatttttgaacaatatcaactatgccacttgcagtaaacaggatgttacaaaatcatccaataaagcattttctattaagcacattacacaacataattcaattttattaaaaaaataacttcaaaatacagaatgatcctggttaggaagaaaagccatttctgtagttcacttgggtataaacagcaaggctgacactactgaatatgagcgcctgtctggtacaggttaaaccctgtccacagtggcagtaggtggtaggtggatgcccttcctctccctatgctaatccccagaacctgccaatgtctctaactcctctggggccatgggactgcaagtagagatttatctctggggtttggtatagttacattgacccttaaagcaggaggaaggcanagattttgaagaaagacgaagat

SEQ ID NO: 89 - DNA, 406 bp, Rattus norvegicus
  Genbank Accession No. AA799891
gatacaaatctatttaatagtaaacatatcaaagatagctttgtgtttcaataaatatattctaaaagtagttcagagcatgctgttgtaatcactaaggaagacttgagactgtcagtccctctgcagaaatgctgtgcacagatgcaaaatgatcaaacgctgagacaataatgaatctcaagaaagtggcgtagccatctcgtgccataatttcttcattttgaagctgcccctctgtgtgtactaaatccgtcaatgatgttttcaggcgggtgcttttcatcactcgatgtggccagaatcacttctgtcccttcagtgctcgagcagagatccaccttcctcatctcaaaatgtgtagccttatatgcaagaagtcctgggttgtgtccccagcagcaaa

SEQ ID NO: 90 - DNA, 523 bp, Rattus norvegicus
  Genbank Accession No. AA799893
aaaaagtttattgtaaaaaaagtaagccattcacaaaattgaatgatttttagcagtacagctaaaacccaactgcatggcagtgagaagtagtagagtggcccagaataaaggctcttctcttaaggatgttccttttagccaataacttctgtagcatgttttttaaacaaattttatgacagcagttaagcctcatagcagattccttcctaaaaaagcaaacaacatttagaactagccttttgtggggccaattcccatcattaaactagtcccaccccctcccattaacaatccacccaccctcccaccattttggggaaatgtatctaatattactttgagccattgctttaagaaaatgggtcaaaggaaggttaaataaaattaaagggccaaaacatattgtcacaatagaaatgtattcattcccttcaagtaggacttaataggcattaattaaataaaaacaattcatctccagaaaaaccaagtgcagcttaactggactagttttggc

SEQ ID NO: 91 - DNA, 505 bp, Rattus norvegicus
  Genbank Accession No. AA799899
gacagtctgaagcttttattcagtgggtctctgtgtctagaagaaggtgtttggcctcttggtggtgaagcgtggtttgtgctggcgccgcaacacacggtggggcaatgggaacttgatcttggagtcgtggaactgcttgacagctggccggcggcacttgccagctgcaatctcttccaccttcatgatctggatggagtgcgcacgggcacggtgtcgggcacccatgtctcggtagcactgtgtgaccgcgccggcagtggtcaggtcccggtactctcggtacatgttgtgagtgccacttcgggaatcatagcgcagccagatgccgaagttcttcacacgcaggggtgacttctcaaacacctgcccacagtacacaatttccccggatgacttcttcatcttcttcagctgcgacacaaagtaccagaagcgggacttggccaccacatggttgggtgcagattcgcattcggtacagtggcggtgtgtggcattt

SEQ ID NO: 92 - DNA, 483 bp, Rattus norvegicus
  Genbank Accession No. AA799971
acataagaaggaattccaaaggtatacccaaggggcattgatcataagctgaacacgcagagggccccaacgaatggcacagagtctgaacggattggcacgttcaacttccattcatgatggctgaatactccttctggtgctcaaccattctcagaaacacttgatatttcttgtcataatattttttatcagcacgctctgggaacacaaccttccccactttgctcattcttgccattgcctcctgcacagaagcaaagtcccctgaggcacaggcacccagaatagcagctcccacgaggacagactccacctcttgtgacagaaccacaggcatgccagtaatgtcagcatgcatttgcacaaaaaggggattcttgcttaggcctccacataagaagagggtactaagagaatgtcctgctgcttccatggtctcaatgatgaagcgagtcccgaaagcaatggcttgaatagtgg

SEQ ID NO: 93 - DNA, 558 bp, Rattus norvegicus
  Genbank Accession No. AA799981
gctaaaaaatgcctttatttccagccagataaaattttttcaactgtatatatggttacacatgaaaaggtacacctctgtcgtcggccttgtttacaagacccagagcttcttattaatgtgagtatcaaacaaccttctttgtctctgaaacataactcaagtaggcggccgatggacctgccacacacgtgttcgaggatgggagtggcacggacttcttcgccaatgagtcgacgtgggatgaaggatgtggagattagattccaccggccagtcagcaggtggcatgcagcggaagcccgcctgctgaccgcactactgtggtggtggcccttctatgaacaggagacaaagaagacagacctatatgcaatgtggagaggcctttcgcagagtgcgaacaccattaggtggaccccagaacgagtaaaggcatcatgaaggtgactctaccgtgtacactactgaagagtatggcacctttttatttgacactcaataaatatctagttactggaaggaagagactcaagacacttgagctgttgtcaagac

SEQ ID NO: 94 - DNA, 712 bp, Rattus norvegicus
  Genbank Accession No. AA799991
  misc_feature (1)..(712): n = a or c or g or t
acaatcagtaatataatcaaatacacaattatatacaaggattatatacattttgcccagacttttacatcacagtacatagtttccattaaaaatattgtttacatttatcaccaaacaataaaacccaacaacagtagtgttacagcacctgttagtacagacagctttttcataaattacatcataagaaaatatacggctgtaaattgggcttttaaaaatgtctttttataaaatctgaacatacaatgtttcattcacagaatgtttttttttttcaatgttctgactgtacccttgtgcataaaacaaccagctggaatatttagtaaatgctaccctccctctaaaactataagcactgtttgaattacttaggctgagctttctttatgatgagtctggcatggagtttggtgagaaaacaacgctggctttgctataanaaagtcatatgatggtaattaaatctaaagattccaggaaataatacatagggaattgattcagaaggcatattttcattagaatactacacgtaagaaaaggaaaggaaatgcaataatgtccaaaagtaaaccttcggaccataaaggttnagaaaaaaacattcaattccgccaaatccagattacatctccattatttaggaaaatcaacagctaattcagggttagggaaacacattcaggaaatttgctanaccgtg

SEQ ID NO: 95 - DNA, 633 bp, Rattus norvegicus
  Genbank Accession No. AA799992
  misc_feature (1)..(633): n = a or c or g or t
agagtgaaatgatggcagtgatgtcaacatcatacggggaacaccaagtccacactttgccccgagtcaactgcaaccacatgcgtcttcttgcttaaggcacctgagcccacagtgacagaataggtccctggatagacttctatgtagaggtccttagagatgttctcaataggccaagatgactcttgagaatgctctgatgtttgatagatgcttcctggaccaacagatgtctctcctctgcagtttctctgtgctcactcctgccatttttgttaagcccctccactccactaccttgagatgactcgagctcaggagagccacctgcctctgtctcccaggtgctangattaaaggcatgcactaccacgcctggctcagaaacagaacctctagaacaacccatttgtagtcccacatgtacaagattatgtggcttttaagcctgctaagacttcagagcacctcgtgccgattcttggctcagggcaaatccctatgtgagtgtataaatcgtaacattcatgctgttccgtgtgattgtaccgccaaattcaaaaaattcaccggacataatgtaagctgcgtgccaaggtggctaccacataatgttggccacgccgcttc

SEQ ID NO: 96 - DNA, 556 bp, Rattus norvegicus
  Genbank Accession No. AA799995
  misc_feature (1)..(556): n = a or c or g or t
aagatgcatttgacatgccaaccccattcacaaaaatacatggttccattgtgtagtaacagtcccactcgtgtgagggaaaacacacgcctctaatgcaaagctgctctcagggttacaagtaaaggagatgcctctgcagttagggaagcgactactgcaatcgtgaacgggaataactgtactccctgcataacgagagattattttggagacagttgataaaaaccatacaactttttagtgttaagtcaaagagtatcaaaatcanagcaaactacaggtaagactaacaaaactactaaggacatcacagagtgaaatggactagggcaggcaattatgatatgacacaggagataagaggaacattaaatgtcanagatctagggaagatccgggtactgattccacagcgctagtagtgatatgggttagatctagctccacagtgctagatcacctccatgggcatccgcaactcccttccaggtctttcacacttaatcagtgtcatcccgattcatacgcacatcgaagcgctctcagaatcatg

SEQ ID NO: 97 - DNA, 460 bp, Rattus norvegicus
  Genbank Accession No. AA800015
cacaataaagtttattatgaaaacaggctcatgtggggacagaggggaagacaaatacatctgggttgggtggctcaggtgaagtagtgcggcttcttcacattgatgccatactcgctgagggcaggggtcaagtcctccatggttagggtgtacttgcgatccttgctcttgctccgggagctgccagaggctgtacccttcattttgcagtgctgtagggcatcattggcaatatctgagatgaatttctgggcagctagtgagatgagccgaattatgcgtgggtctgaagcttcaaagccagcacggttcaggtagtaaccagtcactgcatccgggatcgtaggtgtataatcctccaactgcatcaagaagtccactagtggtgtgctggacactacgggcttcacttctccgttggccgcgctcggtagggcgtaaaccccgtcctcgtgcc

SEQ ID NO: 98 - DNA, 613 bp, Rattus norvegicus
  Genbank Accession No. AA800016
  misc_feature (1)..(613): n = a or c or g or t
gaaacagtcaaaatctagtcaggtagctcttatgacaataatcaaaattaattttataactttagcaatatatatcgaacacttacattcaagtgtatagaacacaatccattaaatcttgaaaaacactgtaacaaggcttgaaatgactgcacggtggcaatctagcgttcctctgcccattctacagttatgggaaactcagctctgtaaacacagccagcaaatcacagcactggagcggtcagttgctctgacatgccctgccatagttttgacagtagagggaaacaattcttacaacattacttaaaaatagatcttagcgatgactcatccttatgtacacacattatgctaacctgtcacagacagtaaatgtcagatttatacactggactctgtggagcaccctacacatttagaacttactatgaaaataaacaaacggctgtcaaatgtctctggatggtctgctccacctgngaggatgganggctgctctgaagcactgcgctcactgctgcttctcaaaggcaaannacangtaaatgcttgtagctttccagtctgactttactaacgttcccagaggtaaactttactgactggt

SEQ ID NO: 99 - DNA, 644 bp, Rattus norvegicus
  Genbank Accession No. AA800025
  misc_feature (1)..(644): n = a or c or g or t
ccaacataaataagctctctttatttctggccctgattgtgtgccgccgtgtgaccagcttcagaccagccactgctctggcggcaggacgcacgacggccgctttgctctggtggccacagacaggccttcattcatacttgcagaaatccttcagtcctgtgggcaggcgcagcccatcaatggccagcctgtgtaccacactcctctggatcacaagacggcacagtgtctgcagagacggcaagccatactccagttggaccaggcgcacactcttggtggaggcaaacacatctaccacagcgtataggggctgagcagctggcagtccccgggcgctgggacccatgtcctccccgttgatgatgatgtgcatgtcagcggtcccatcctcagcggggcagaaaagaacacccaggcggctacggcgcgcaatgggacgcagcacgtttttgtcaaagacctgtctaanaggtgactataaagccctgggcgcttcggcccacagacggtccgggggaattccgaactgcgnatgcgcacatagggtccacaagtaggtttgggtaccgcggggaacgccgcctcgggctccgtttgcacctcccggggcaacggttttgggggccctgataacaaaa

SEQ ID NO: 100 - DNA, 613 bp, Rattus norvegicus
  Genbank Accession No. AA800034
  misc_feature (1)..(613): n = a or c or g or t
aaaaacaaagtttaatcatacttattaataacaagactttatataaaaatgcagagtataaattcaacttccattatttcagttaacttccaattatcctttccaaattaaaacaaaataccaaacagggcaaattgtaaatttaaatccaagactattaagttacaaatggagtaaatcacaaaataaaaatgcttaacattaagaatctacctatcacataagagaaaaaacagaagtgtgtgcattctgaatgtcctattttaccagcatgatgtatggggtccttttatgtacaaactctgccacgggatcactgttatgtctcactgaacttcgtaatcctatgtgcaacatgtgcaaggtggagaagagggtccacacttagcatacaggactgacacactgattccttaagggagttgatgatacggctacagacttcacacagagaaatgtatttggtagcacagagagagctaaacattttgagagttaanaacaaagacagtcagtcattgggaaacattcaaggacaaagagaactgcataatcactctcacaacaaactttattactaattaaaattaaaatttgaggtgggaccctagtt

SEQ ID NO: 101 - DNA, 396 bp, Rattus norvegicus
  Genbank Accession No. AA800039
acagaactcaaagggtctatttattaggaaggaaatgtcagtgctttatcaaagatgaagaggtcagacagagatggtgggatggaggaccctcagctgggacacttcttggccacaatgaggacagcagaaggcacgagtcccagttcctgcagaggccgttccatgtcagcctctgagaaagcccgtctggggaagccactgagcaactgcaccgggtcctggcagctagctcttcagccttctccctcctgcgctcctcagcagcccggcgtatctcatcttcctgtagtttctgtcgtgcagctgacagctcttgcccttgtctcctccgctgcttctctcgttctaaagcttctcgctcctctctttcttcacgttcccgcttccctcgtg

SEQ ID NO: 102 - DNA, 630 bp, Rattus norvegicus
  Genbank Accession No. AA800044
  misc_feature (1)..(630): n = a or c or g or t
aacgtgaaagccgttttaatttggtcggtacacatttaacaaaatatgttagagatacaaggtatttacaatggcaaaacatgtgaaacaaaatcaaactgttttcagacaggaatgctttttgaggcaggatgtcactgtgctgcccaggcggggcccaagtgaacccgctcccacccagctccccagtggccgagtcggagtcggtgagcagtgctgccagaccgcactgctcgtcaacgtcccatgcgaatccggaagactttcagctcccactcactactcgggtctcgagccccaacacaaagtccacaaggcccagcctaggaggtacaaacactagcacatttggcaattaaagatcatctgctgatgggagctggcagggcagtgaagggcaagccccacaaggaagacttcactggaaggaactagagggaagtggtgtccttaatcacgtggccttctcagcctgcagnaaatacanaactgctttaaaagctcacgaggctgtccttacagcagaanaccagcaaccataagggtccaactcttctcagcagcactcccacccttcctaatgcgttgacccttcaaagtgtcctcatacaacggttgacccaaccacaa

SEQ ID NO: 103 - DNA, 581 bp, Rattus norvegicus
  Genbank Accession No. AA800053
acataaaattttatgtataggatcctaaggactgtcagaaaattaaaaagcacatgtaattagattttaacaataagaacttaaaaattatagtacagcccttaaaatcaaagactagttaaaattgaatgtagttctatcaagaactagaaattaagtctgcgtgcatagtgtcacttaaagttccatgaaaatataaaatatttcgatgactgtgactatatctgggacaaacatcattggcttcaaaacttgacactaagtgactttccaatcaacacacgctcagaggcttcatccagtgagtgatattctgattccatctgagatcttgagtccttggtgtataggtatgatctgttgacaggtacaaacatctctacgcatagttaggacacatccggacatcggggtcttccacacagagcttcatctacatcccagagctgttctccaaggcaagacaggcttctcactgctcatccatggacactgtgcgggctccagcctgagcagtaatgtaggagtcacaaagcttacatttcatgcctaagaaatgaaatggacgtgggatctcaata

SEQ ID NO: 104 - DNA, 648 bp, Rattus norvegicus
  Genbank Accession No. AA800062
  misc_feature (1)..(648): n = a or c or g or t
tgctgacatggctgacagtgactgtttattgagcatcatgacacaactgagactgtccaaaactaaatgggtacagtctgccacaaaatacatttcactgtcaattgtgaaaattaggaagataacaagttctgttcgaagttttcataaatacattgatttctgaaaaatattgttaatactatattgtatgaaaatctaaaaaaatatgattagaaggaaaaaacattaaattgattatacatataagaatttaacgggttggggatttagctcagtggtagcgcacttgcctagcaagcgcaaggccctgggtttggtccccagctccgaaaaaaagaaaagaaaagaaaaaaagaatttaaaataatgagtttgtgctaagttcttgaactcaagtttttgaagtgttactggcaggcaaaataattaggaaaaagagaacactattccttaaaaaaaaaatactgcttttataantggtattttatactcctcganaatacaatttcgagagtcagaagtcctatgattggcccattaaatagtgtcaaatatcatcctgaggactccagccaacataatgatactgcactgctgtcactaacagcaaagttgatgacatgggggtctaagaaagaacaagag

SEQ ID NO: 105 - DNA, 374 bp, Rattus norvegicus
  Genbank Accession No. AA800126
ctttaatttctattcagggatccaagaatcttagtaattattaactgaaaagcatatcaatacctgcctgttttaaggtttactatcaccagccttatatctatttatataaagtataattttaaatctcacccatttcttctttcaagactcataagattttcttgccagagactggttatattttattattcttggacccctgcaattttcccaaaccactgcattcacctttttgctataccaaactggagctggtaattcttagttgagtcattttacctaggggaccacggtacagcgataagtcactcaattactaccttatgattgacagttcacactggaatcaaaggtgaattcatgggagtaga

SEQ ID NO: 106 - DNA, 601 bp, Rattus norvegicus
  Genbank Accession No. AA800175
  misc_feature (1)..(601): n = a or c or g or t
ggcagcggttccagatttaatggaaggtgcacggtgcgctgcttcgcaccctgaggccgagctgctgcagcgccaggtatggagcgtctgcttttcgcaacggaacagaagaactgagcatacaacttaacaagaaaaaaggccctcctgcctgcctctgagaccgggggatcaggtcacctctgaccccctgagcctgggggcctccccacctccactgcccttctgaagtcgattcctccagaaggagcctagctaggacagccccaaatgggggcaaacagggagcgggatgctcagagtccccttctcagagcccccctcccagtcattttaggaacaataaatactgtgtgacagtagcaggaagggcgtccatgggctgtatgtgtggcagcccaagcaggctggccaggtgcctgccctcattctgtgcgtaggatgatatggatgcctgaatccgtgaacaccggcccactcatttccccggtccgtanagcaaacgatgcatcttcgaacggtttctgcatctgacctctgctgaaggcacccaggtctcccctggctttggcanagctgcagtcactgaactgtgaggcca

SEQ ID NO: 107 - DNA, 693 bp, Rattus norvegicus
  Genbank Accession No. AA800190
atgggtatagaagtttaatccatttctcttacaaggaggtaacagtaaatagtagaggggtgatcatgtattatggcttcaagggacctcatgcacagggcagcagatgaccagccccagaacctgcccacccacccccaaagctaccacagtggttccggtgaattgagtgctgaaaacagacacctcccagtaaacactgccagggttgaggaaagtgaggcgttttcctgcccatcccgaaccagatacagcaatgcaaggtggtgaatctctggaaggagttttatgtagttctctgacaaccctactctgccctcagggaggagcatggctcctgtagtgggtgggcttaaccgctctttctcactatgctgctgtagcagagtgggaaccaggccctactgcaggactagcagctgagtcagccagggcagaaatatccagactgaccaagtacaaggtttacttgcaaaaaaaggaaggctttagctagtttcaattcctcatgaagtgttatttcctgttgaaaaagcaaaggactaagccaaccgtctataaaattgccagtccttaaccaaggcctcaaatatgggataaaggtctctctttagtctcctcttcagggttctggggttccacatgacacccacagggttctacaggtggctacagaggcatggccccatatgg

SEQ ID NO: 108 - DNA, 543 bp, Rattus norvegicus
  Genbank Accession No. AA800197
  misc_feature (1)..(543): n = a or c or g or t
acaaaacaaccatgttaggaaagacacaaaagtagaagtaaatgtctaagtaaaaactaaataaacatgccaagagctatgacttaaaaatcctaatgatgcactcggctacatccagacccaagacacaaatttactttgccacttaacaaaaaagaagcagaatgcccttcatcttcaatgtatttttaaatgtttgcacattgtgtgtctgcaggcaatggcagtatcatcaagtatttaaacaaagtcacctttcaggttgaatgaacaagtcacatcgaaatgtgcaatatattccaggacagccagggctgttacacagacatgctgtcaaaacaatacaaactccccaaacacctcaatataaatgtttaagaaaacaccagtattatataggcaatataattcattacaaaatacttttcttcataaaactatctgctttagacacaaaaggggtatgtggcccttctgtggtgctaacattaccagcttacacagattcgtctaacactgctctangaacagtgctgagaatgt

SEQ ID NO: 109 - DNA, 556 bp, Rattus norvegicus
  Genbank Accession No. AA800198
ggaaacagacacggtgctctttatttgcattgttcagaatactgtacaaagggagtaaaaatcctattcacactttgcttagaaagaccaaaaggtgaaagttccctatgatacatggggttcaaaaggagggtcaggggggaaacaggtgagtgacctccctctggcccccgggagagggcttgggcagccacactatccaaaggaacatgccccagtcgaaccagcgaggggagagactgctcctctctggcctaacctcgggctctatgacctgcctgccactctgggctgaggagacagtgcccgcagctgtccctactactgccttgtctgggcagggatccttagcactgtggagaccactgaccgcatgtggaagtggcctcctgaccattcccacgcaagccacacaccaggcactgtcccagcccaatctacacaagaatacaagttgagttttaaggaagaacctctctgaaagcttcctcacaccactaagggaagtgtcaaagtaaactgcttctgagggctcacaggcctcttccaacctgtg

SEQ ID NO: 110 - DNA, 631 bp, Rattus norvegicus
  Genbank Accession No. AA800199
gggagagtagcgtttatttggtcctcagagccatctgagacaacatactgaactgaggaagaaattgggttccaaaagagctcatcaagtaaagaaagggactgcacttcccagtggctcaacagttactgtgatcagtaaggccgggaatacggttgctaccaaatcgctctcgtgtgtcgccattacaaaagtacaggtttctcatcacaaattgtcacaaacccaagttacaaaagaaaaatcacatggtgcatatcttaaaagacagtgccccccccacctcataagctacggtaatatcaagcagggagaaggtagcttttgctacccctcggcagtcatcttccccaacagcggggagaaggcacaggaaggagtggggcggggcgctaatttcccctcagtacaagatgacaggtgaagcttggtgggagactggagctggtgaggcttgaggggaggaggctccaggccctgtgttcagtcagagtcactgctggaggaggaggaggaggaagaggaggaggagtgcttcccgtgcttatgatgcttgtgtgatttcttgtgagctttcttcattttcttcctagtcttcttgtctatcactattcctgggcctaccatgcca

SEQ ID NO: 111 - DNA, 476 bp, Rattus norvegicus
  Genbank Accession No. AA800200
gagcacttcaacaactttattggctaaatgtttcttccccagtttacagcttgaactatgggcttattcacagggtctgtcttaatccgtactgaatctggggccttagtagaggctaaaagctagaagtgagagtatgagttagaagcctgctgctaactcagctgggcaacggtccctacccactgccgtgttcagcgatctttacatgtaatggatggatacaggcctgggacacacctgccgccagcctgttacaatgcctctgatggagtcatcaccttcctacttcagggatggggtgacactatggcaccctgtgcaatttgcagaagtacatacgtccaaaattggccatgaagtttggtattaccagctccccaacctgtcaggatgggaggaaacagaatgtgtccatgaaaagctttcggaagtgagacaagtcttccacttgaaccttgatgttgtattgattg

SEQ ID NO: 112 - DNA, 596 bp, Rattus norvegicus
  Genbank Accession No. AA800218
aaagcctcttccttccacactctgccctggtgaagccagccgcccgcacgagcccgtcctccagagtgggccaggacaaggtcatggggaagggcataaggccaaggcctcaaagggccagtgggaaggtgaggacttaggcatagtgggtgcccggtgttagagaatggccccctctgtggtccagctggtcctgcaagcgggcaaactcggccagctcgttgagctcctggaactgtcggtccgtcttatggctgaccagtgagcggtagaagtgaacggcaaagacgataaacaccaggccacaggggaccatgatggcagtggaggcgatggcagccgcctcacccggggtgatgccaccgttgttgctgctgttggcgacgacgacggccggttcggtgggtggcttggtggggcttggctgtcccgcctgcctcttgagcggtaagaacttcacccagcagagcagcacgacttcggccaggaaaagcagcgtcccgatgacggtggagaagcccaagccagctcgatgtggcggtgcatgcgctcgtgcggcgactccttgacggagttgaggttgtggacgttgctca

SEQ ID NO: 113 - DNA, 680 bp, Rattus norvegicus
  Genbank Accession No. AA800222
  misc_feature (1)..(680): n = a or c or g or t
ggacttagcttccactttattttcatgtgcatcatggaaaggtgtcaaggacaaagacaagcccagtgctgcctgctctaagtaaaacacagaagagacaacacctcacccagttcaacagttataaaacccccaacccacagagcagacacgagcagtgtgggagtccaggggtccccacacaacatgacaagattttgctttttattattgttgctttataataaaaacaagttgctatgctttcagcaaaacaaaaacaaaacaaaaaaacccatagaaatttaactaacagcagttcaaggtaaggcttttgaaagatttattgaaataaattatcttcgcctatccgcctgttatccttttctcagttacttgtcaacattctaaaaactttcaggtatgtaaaatacatttaactttgccaataattttagataatactggattttccccaaaaggactaccataaaactatgttttgaaacattaaaaaaaaaaagcttaatccaatgggacataaaactatgtaacctatgattgcatgtttcaaatccttaaatacgtggagaatttgagatctgggaacaagactgcttgaggcatgtggattattcaatgtcctgcttctatttgatgagacccacaggaaccanagcaggagaatgaagggctccggg

SEQ ID NO: 114 - DNA, 583 bp, Rattus norvegicus
  Genbank Accession No. AA800224
accaaaaaatattccaggtacctcttcagatagatcactttcaaaatatatttatagaccctttgccagtgctgtcatcccaaaagctgccagaactctggaagtcccgtggtccagccctcagcccaggaatataggtagagtctccatgatgggtggtaagagagcagtacctgggctgtgctggctccttctttcctcataggtaaggtatgacattaaaggacaataaatacgtgttgaatattagcaaaaaaagattacaagtcctatgctttgttgccgtggctctttgaagttcatctacctcactggcagctggaagacagttctgctgcttcgttctcagctcttggccttctgggctgtgtccacactaaaccctatggctatactgtcttgatttttcaagaattcacttaagaggaagaaagcagaaaccttagctgcaagtacattccccaatttaaattgtggtagattagtgataacatgaaaaactgagggatgatggtggtacagtcacatctccaggggccaagacatcttgcttgtgaactcagtgagtcacaggaggaaaagc

SEQ ID NO: 115 - DNA, 613 bp, Rattus norvegicus
  Genbank Accession No. AA800243
acaatatgcaagagactgattcgtatgttcccagacactctgctgttagtcgcttcctaaagctcttgaaaggcccatctgcctcctttctcttgcgggaatcctgctgctcggtcctgccctgggtaccaccaccaaaccccgttccttcctctgacatcccacagcctgtaacagatggtagagaatttgcgtgaaagctgggtccctggacctctgtatctgtgatctgattacatgaaccagcctttggcgctagccttgggggatggctgctcttctgtgtcacccagtgctcggagcacataagcgcccgcataaaccaggaactgtccggtcacctgggcagcataggatgcgaaccgcagcagactccttaacaaggccttgaagcttgtgcagcggatatcatacgacactgagtacatctcatacatggtggctttgacattgagacagccgaggaagtccttgggattcagcctgtataggtcgaaggtgactctggctattcctgacttctttgtttgtgtgcagacatacttattgcccggtgtccatttctgtcccttttccaagatcatgaagtgtgtgttgtctcttagggtctgaa

SEQ ID NO: 116 - DNA, 609 bp, Rattus norvegicus
  Genbank Accession No. AA800258
acagcaatgcactaaggctgcttttaatggcggcgcagtagagaagacagggttcactagcttgagctcatagaaagatacccattgactcgtgcaaacacctcaaaatagaaatctacccagagccagaccccaggctgtgaaaaccgcacagcacacgatagagatggcttcttgcattttgtggggtgaaagaatgactgtgccccaacactgtgttcagagcgtgggaagaccctttgtcttcagacggtctcacctgtgcctttacttgggtgggagatgggaagaaacatgcttcctcacacactgttttattaatacatgttttgtttcagtaggacgccatccattaggcctgccggagccctcctgggtatttctgggttgtgttgtgtacatgtgtgcttgacagcgacagcttcgcttctcatagcactgtttgccttactgttagaattccagtaaagtatcctttcccacattccttgccaacaaacccagtaagatcctgagtcctcagcaaacatctggttttaaaatctggaaaacagtcctgaaagaaaaaaaaaaaactactttctgaactctgggcttcatgacagtagt

SEQ ID NO: 117 - DNA, 625 bp, Rattus norvegicus
  Genbank Accession No. AA800272
  misc_feature (1)..(625): n = a or c or g or t
aagagagataaatctttaataaaactataaaccaaaacaagactgggaaatgtgtctaaagaatgacaccacaaacggcaggcagcttgttctttacaaactgtcaatgttaacaaacccagtctatgtgactgttaatgcagtaaccttgctaatcagactgaagaggggccaagtggctcacttgtgcccttggtggacacaggagcttgctctcatgactaagcacagggaacgacatcccactcctggttctattactgatctggtcaccaaagtacgcggagcacagaggcctgcagcaccagcgcatcaggcaaaggtgatggaaggttcgctgggctgccacacgctctcatcgtacagatcttctggaagttcttcttcgtctccatcaggaaagtaggtagggaacggcaggctcttacagaaatccttgtatgcaggcagcgtanagtccttgatcttcactaagcaatttctatgtccaggcacagagccattgacatagattatattgtgcttggtgttcactctccacaccttcagcccatacactgtcctgttttggtttcccatttgcccgggcattttagttccaggccagactctggcaatatcccca

SEQ ID NO: 118 - DNA, 420 bp, Rattus norvegicus
  Genbank Accession No. AA800290
aaatacaaacaaaaccaagtttatttacacaaattacagtatttaccacatataaatattgacagttgtcactgtaacagcagacaacttcactttcaagtgagcactttttgaaatatcacagagctccatgcctctgttcttgttctgctaccctgatggctcagtttattacatagctcaaggcggcccgacactcccagcaatccttcagcctcccaggcgctgggactaaggtaggagcctggctcagtgcccttggaaagtactccccatgagttgtgacaaaccctcaaacacgtgtgtaacagatgagaaccagcagttctggctacaggaagaaagaccactgactttcctgggctccttagaggtctgtgctttccatttcccacttgacagaactctgtggcacgaggc

SEQ ID NO: 119 - DNA, 604 bp, Rattus norvegicus
  Genbank Accession No. AA800291
  misc_feature (1)..(604): n = a or c or g or t
gacactacaactcagtaattactttattagaatgtcagtcccgctccagcaggaggaacggagaggaacacaaatagcccagggagaatagatgtgggtactcttcttcggagtcattgggcctcagcaagccagcccagggtgcagagccaccttgtggccagacaaggggtagctccttctactccacagtggaagcctactacaagtccttggtgccctggcaaagttccccccacctcataatccaggcagatttagaccacaggcatcactctgtggaataaagcaggccctcaggcatgttcagttccctcagctttcttgatttcctcagacagtgcctgcttcagtgtaacataggcttcatccaggttgtcattgacgatcaccaggtcaaacaagccaggctccttgctgctctccatgtctgcctgtgcagctgccagccgctttgccaggctctcctcagtctcagtgttgcgctgccgcagtcgttgctccagcacgtccatcgagggaggctgcacagagatgtanatgggatgcagatcagtcttcttgatgctgcgcactccttgtaggtcgacatctagcacgcaga

SEQ ID NO: 120 - DNA, 596 bp, Rattus norvegicus
  Genbank Accession No. AA800296
cagtgtctacaatcaattttattgtaatataatctaaaaacataccatttagaaaataccaagaaaaatttatgtacaagagttgatgctattgcatttggataaagctggcaagttcttgctactagcatagcccaggaaacaccaccgaggaaacctaatatattggaatagatgttgtgccgtttggcccacagtttgatggctctcagagttaacctgaagttgtcaatgtttggtactagatgtaaaatctcatcggttaccctgcaaccattaaggcttcttatgcatcttatatctaggtttttaagcagactgtcatctcgtaggtccaaatcttctggaatagtctgcagtgctaatcttgcaaacaaaatatcaatctctattccatcaaaacagagtttgataactggtacaaatgcctcttcaacagctcttaaatctttcacttcttcttgtaatttcaatttatcatagaatgaggtgaaaaaatcacttcgatcaacatgtcttggtgcaacacacaacgcatcaatatcagcacctttcgtatgtactcctagtctgtaggatccaaatgtaaaaatttt

SEQ ID NO: 121 - DNA, 560 bp, Rattus norvegicus
  Genbank Accession No. AA800318
gaaagtgtctgcaagttttatttgtagactctgttaagcttgaaccataaaagctgcaaaacagtggtttagagagcatgtcaataccatgggggttggtgggtggaaactgttccttctgccagttcctaaggctggaagtggctagggcaggcagtggcgaggaaatagctggatgagctgaagcttgggtggcagtgcttactcaagcctgactcctgcctgtctcaggccctggggtcatatacacggcccatgaagactgggaacttgtgtcgctggtcccagagcaggaagaggaaaggctgctgcacctcaaagatgagtaagtttcgggccacggagatggtggaggctgcggctgcttccacacctgtctctgtcagttccaacaccgtctcgtgtttcatggaagacacctgaagatctgggtcctcagtcagcccacacaggttgagatcgtaagtgaagtcaaagaattccagtttctccatgattgacagcatgtcttggatgctctttactttaatgcgaggcatcatcacgtaagtgggctgaaa

SEQ ID NO: 122 - DNA, 601 bp, Rattus norvegicus
  Genbank Accession No. AA800319
acagttcagaatccatatctagagaacactgccacccacggtggaggaattgacacacacattaattagagtcacttagaaaagtctctctcaggcatgcccacaggacgttgagctagaggatcgcacactgagactctctccccgcacaattctagattgtgtcaagaagacagtgaaaggggttggggatttagctcagtggtagagcgcttgcctaggaagcacaaggccctgggttcggtccccagctccgagaaaagaagaaccaagaaagaaaaaaaaaaagaagacagtgaaagctgatcatctcattccccctctagcaaatgcctcagcgcctcctatctgtccaggttatctccaccggcctccgtgttctttggggcggccgtcagtaaggcaccaggaggctctcatagatctgggcaacctctttcagcttctcctccagctcctgagccagggcccgcagtttattgcctgactctgattttgccccatcacataaatccattgagtcactcgcagctttctgtgagtccaggcagaaaatcttcctgtgcctgaggtggaagggaacacagccatccttcccgtg

SEQ ID NO: 123 - DNA, 560 bp, Rattus norvegicus
  Genbank Accession No. AA800339
ataccatactatactatacaatacatacacttacaagttgccacatggaattctgtgtaagcaatgttgaggtctactgttacaaaatccaagttaatatttcccttacctagatgctcaagagagcagtctagctttgttattttccaccccctccctagacccagctcagaagttgctcgggactactagctaccatctgcttaaccttctcaggcaagagcctaggcagcttctagttatacgaattcaggctcagagcctcaccggttaaaaacaaggctggagatgccctagggcagaaagttgggtaacagggtctatgtccttgtgcggagccctccctgtggggattggagggatgggacacagtgtgcatgaggacgggagaacaaagagcctgggacaatttatgttatactgaactgtccattcggttcattcattccgctaaaccgttcataaaattaagagtattctgaatggcctatgtctttcttctctccccaggactcctagaagcctgcactttccacaaaagttaaaatccaagaggtggg

SEQ ID NO: 124 - DNA, 643 bp, Rattus norvegicus
  Genbank Accession No. AA800389
aaatatagtgataaagcaaatacttgttggcctcatgaaaaatggtttctaaagatctatggatagtggacaatgcctgggggaaactgacttgcgattactagttgctttcatagccacagacatctgttgttgatttagctaacctttcagtagagctgactgggcaaagcatatgggaacggttctgaaggacacagtgaaatcagtgtacgggaactgggagcaactgatcctgggaagctagggctaattcagaagtcttctattagcacctcctgcagttgctcttcagtaccatgaagttaggctagacacgtcaaacctcagtgattgggcaatgtaatctgtggaagcccagatactctcaaagtcatcaaacagtgtttataactgtcaaagaaatttgtgtggaaaatttctccagggcttcccaggttgataaaaggcatgaattattaagttgtaaaggtacttgttagtgttaacaaccaattaaggtgttaccaaggaatctttgggagtgccttcccctgagccccaaaatgggccccaaaagataattactgatttattttgtgctgtctcatctgtgaaacctctttgtaatactgtatcaacattactttattattcccacata

SEQ ID NO: 125 - DNA, 492 bp, Rattus norvegicus
  Genbank Accession No. AA800503
aaaaatagctttatttagcataccaaaaacacagaaacataagaaaattgtatctagtataaacataaaaagttaaatatgataatttaatgtaaatcaagcatttgaaaatgtgaagtactgtaataaaatacacgctattaatacagaacgaagttaaagctacctctgtagttactgggtcagatcatcaatcttgaagttatcattagcaatcaacaaacataacatctcccttttttattagtcaacaggaaaagaagcagttatcttatttatttaaaacatatataattcattgtgacatttagagcaggaaagcaaaaagtacccatttaaggattccagacagaaacaatgtaggtgcaggtttgaaaatcaatatactgcaggaaccttgagcagatcattttattgaaatataaattgtttaattccatttacttactgcttagaaaggtactaagtatactctgcaaaaataaatcttca

SEQ ID NO: 126 - DNA, 572 bp, Rattus norvegicus
  Genbank Accession No. AA800551
aacactttgtaatcagtatattagacagtcatacatttcagtaactgcttaaattctgataaccagatttaagcatgtaagcatgtgacttcaaaacatacaacaaatctattcataatttgctatactaccaacattaaattgcagttacgttggagcctaagttgaatagaaagcctgtaacagacccaaggaacgcctttcctggactatacatgcaaatcacctctcaacatacagatctcactttaatttgtaagttacttgggctttggaagtcactacacccaagcaagggcctttgggaaggggaaaaaggtgatgttttcagtttatatatatatatttatatttaaaatggcacagcagaagggaatgcaatctagaagagcaagcccttaagcagtagcttatgataaactttaggaatgtatcatttctatcactaatatcacaggcgaaatgtattatgccaccttctagtaatggctgaggcaatacaatgcaaaggcatcacaattagttcacttcaacaactagacagaccaacatgtaactaattgttttctttt

SEQ ID NO: 127 - DNA, 496 bp, Rattus norvegicus
  Genbank Accession No. AA800570
cacctgaaaaataaaacttttaaaaaatatacaggacttttaaagtacaggtatatcttgaatggctgaattataaataatgtctctggtcatgttcacagctagggctggagaaaatgtcccaattccagtgaaggcttatagagtcaggaggccagctggaccacaagtggtcttgctgaactctttgatccaaagtggatttaaacagtccataaagcagggtcaggaggggaagaggaatggactcccagacactctcccacgagtccagaggattcttggaataagagatcaatttacaaattattaaactataggactaagaattcacaccatgaatataaatgacaggctattattgaagatacaaagtggcattttatgtttcatccccccagtctctcatcaaaaatttaaaaagtccccatgggcttcctaatgacttaagtcctcatcagctgtgaagaaatctccaagcccagacaccttgggg

SEQ ID NO: 128 - DNA, 551 bp, Rattus norvegicus
  Genbank Accession No. AA800576
acaggctgaagacaggtgcatctgaggtcacctttcctcttgaacaggccatgacattctgctcacatccatgccggttaacttaaagctagaggtataaagtgacatctacagtgtatttgcaaggccagagctacagtggcaagctgcatgtggctgcgcgccaaagctcagtggtgctcagcgaggctcccgggcgctcgctgctctaagcatgcacttggaaacccagctcatcagtcccttttaaacagagacgggatgatgtagacccaccaccaagactcgcggaaggggctacttaccacaacctgcattaatttataaagtgagatcctaagtcaaacattcacagaaaggcatattcactaggagctggccaggcagactgtctttcttagtgacctgtctgctggctgttattatagttagcatttaaaaaaagggggggactgaattttaaaatagagcacttggcggggagagttaatgtgtgcatgtgcggaagccgctccctgcactctgctgtattcaacagtcaacactgcaca

SEQ ID NO: 129 - DNA, 657 bp, Rattus norvegicus
  Genbank Accession No. AA800597
  misc_feature (1)..(657): n = a or c or g or t
atattccaaaggtcttttatgaggataaaaagacaccaaaaatatcaaggtgtaacatttcctttcaaatgatctgggtgaacagagaaaacacatccaaataacatttctgtggattattattattaattataattatacattcatgctgtagtggtaacaacgttcacatttgtctcagtgactcattacaaaggcacaatcaagtaggatgcatgtttaccataaaaaattaacatacaattttaaacagatgaagaaaaggaccagtttgaagtattaaacagaaatacctgtgtgagggtcaactcaatcatttccactcctaagcatctgtactaacactctgtattaacactctccagaggtgaccacgggtcagtgtctgtctgatcaacatccactttaacttgtaacatttgaacatttatgtggagaggcgaagaactaactcagtgagttcttaaaaacccctctttctacttcagttaatcctgtgagaactaaaaagcctttcccctctgtatgaccattcagtagttaagcagttttacattattgacacatttgaggattattaaaaaattgaagatagccatccagtcacagtgcttaacattaaggaaacagtaagttanaagccaggtgagttgtttc

SEQ ID NO: 130 - DNA, 506 bp, Rattus norvegicus
  Genbank Accession No. AA800613
cacactcaagattttatttaaaaattccaaaaaaacccacaaaaatagacttgtacggtaacaatatattacttaatatattatagtatatacttaatacagtatcagttttaacattacaaaaagaaaaacggagtagacgacccaatatatataaatactataaaatcttattacaataaataaagtcgtcataaataaagggtccattggttggggcaggggcgtgggggaaaagggatttggcaatggctttggctatttgctttgggagggaaatttgagcaccaggattctcaggagaggctacaaccaccggacactgaacttcggggtctagtaaaaattaggatactattgtgggagccgggtcttcacagcacttaacattccaggagaccagagtttccgaggggctggtgcatacctgtaaccccagaacttggaaaaggctaaggcaggattatattgagttcaaagccagcctggggtaccctagtaatccc

SEQ ID NO: 131 - DNA, 652 bp, Rattus norvegicus
  Genbank Accession No. AA800622
agacagtaatgcatgtatttatatatacacatatatacacaatgtataaatgaaatccttatataagcataggagttctcttgacagaaataaattataagcaatacaataaaaatgaagcttaatttaacatagtggtttgttttaaataactaaaacagatttatacttcaacaaattttggtcatttgaacacaaactattctgattgacacgtacttttttatacagcaattcaacacaccctgagtttcacttcccaattgatggttaaatgcttatcatactacggaaataaagatgtttaaaatgaagagcctggcatcttggcgtttagttcactgaaattgctttgaacagttcagttagtttatgtcaaaggacctgtatctactttgatttgctctagtgactctggagagctaacgatttgctccaacgcagatatccaacgagaaggtgaaatcaggacgcgcaatgctctgcccaggagccatcacctcactctacagcttctgtatcatcacctggaatttgcaggcaggcattgaagatacttcagctgtcacaatactttttattcccaagtttgacaagccacctctgattaagccacatgtaaacgctagatacttggatgcatgttctaaat

SEQ ID NO: 132 - DNA, 539 bp, Rattus norvegicus
  Genbank Accession No. AA800651
  misc_feature (1)..(539): n = a or c or g or t
acaaacatagactttattaaatgctgctcaatccccagtgaagatctttcattataaaacggttttccatacaactgcaaggcaagaggttggaatggtactgataacaacaggtgtgaaaaatacccgaccaggtaaaaacatacaaggcttctacgcagtcaattcagagtttgcccactgcatttcccttacacaaagccaggcagtgatagctagcagtccgcatcacactgtgggacccagggcctccttcaccctgcaggcaggcctgggacgggcaggttgaggactgggaaggccctgcctccagccttggaggaatgaaggaggtgagctagggtccacccgccggtgctgctctgcgcacgctctgggtgctgctgctgcaggggatttgggaacagtcaacatttggtttacttccccccagcttttaatactttgtgcttcggaagcctggaaacgcaagatgttgcaaaacccagagtatggcagtatctttaatgaggctgggcctttatctcnccaaccgcctc

SEQ ID NO: 133 - DNA, 362 bp, Rattus norvegicus
  Genbank Accession No. AA800663
caagggagaatgttaaatacttcatgctaggtagaccttgttattaagaacccctcccctgtagtaacttcctccagttcatacattcatgagtgcagggtacatacataaatatccacacacacatccacacacactgcctcaagggctggggaagacaaaagttatggccacacatattaggcctctggtggactcatgcaattgctcaacaagagagcaaatggctcaattctccatcgtctccctacagagaccaagaatcctaagacacaaacccaaacttttaacagcaagaggcatctttctgaggatgaaggtaccttatatgggaaaggattgggataaaacaccagaaattt

SEQ ID NO: 134 - DNA, 721 bp, Rattus norvegicus
  Genbank Accession No. AA800665
aaagcacaaaaattgagacaagacatatacatttgtacatggaggaaaataataccagagagtttacaaaacccttgtggctgtcattaccatttggtggctctaggactaaatgggctgacagcatgagggtagcctcaggagggccccagttcccagaggcaggaggctggccagcttggcgagtgcttacaacactcacaaaacacagggtccaggttctcacagtggcttcctaagtgccactgcagtgacacctgtggagcaccccaagatgagtggataggaacctagactccactgagggtgtgggaagaaccctcagaaagaaggctcagcagtcctgcctgcaggacatagttcaggactgatttcctccaaaccaccctaagagttgtaagaggtgagtattgctgaagatgggcaggggccagggtaaggcggaggggcagagtcccttgggaggagagaagccacaacaaacaggtcagcagacacctaccctctcagaagactgctagaggctgggcaggacttgattgacttgtcctcagtccctccccatccccaagtcccaaccaaccccactcactatacattcagaagtctgaagaggggctaaggaaggccccgaggacacaaggtgcggtcacaccatgaagtccaagcaggcacagggtcctgaactatcgtgaacacctgaaagacccccgaagataat

SEQ ID NO: 135 - DNA, 508 bp, Rattus norvegicus
  Genbank Accession No. AA800669
aaagagtagggaaaggaataaaataaaaatggcacaattgacacacacaaaaaaacatggttggggttaggaaagggtgcttgtaagtagatgggggaggggggtccccattacagcagcaaaagccagtgacctaggatgctcccatctctcccaatatgggcaggaacaaccagaccttcttttcaggctgctgtcctgccccaacttatactgccccagccccgcaggaggtggacagagaagtcttcccaggctacagagaggagaaaccaaaccgtgctgagggaggggcctggggtcacaccatgcacgggagcgacagtcatttgctcccaccacctccctaagggaggtaactgtgggggttggagggtggacaccagaggccggcaatgcttcttcttccagcatcaggcaatagagagaacagtcagagcctcctgggaaagtacttgacatccacatcctggtcctgggtcaacttctctaggataggcttgaccct

SEQ ID NO: 136 - DNA, 590 bp, Rattus norvegicus
  Genbank Accession No. AA800671
acataaaacaattttcaaagaatacatttaaaaaccatctagatactgattttatagcattacaaaaaaattgagaggcacaattgaagtattcaaataaaaggtgaaggtgaaggtgggggtctctacttgctatccactgtgtttcctgggactcctcctacaggagccttcccatgaggcagtagtgcactttgaataaatcgaataaatcacataaaatatatacttttatacagaaagtgttgctgtgtcatcactttcaattgcttataaaaaacttcattttgaattgcacaaaagttctctttaaaaccggtaattcccagaaggcagggcttagaactatatgtctaaataattcattacaaattaattagatctctatttctccacagataaaaaaaaaacaatctgtgaagaattacatcatttaagtgggacatttaaaaattttttttcataggaaaataggtttatacatttgtccctagtcagctcaactttctccccctactttaaaacaaatcacagggcgttcagaacttttcagacggagtacctgtgccacagtactgggtgtgtcccat

SEQ ID NO: 137 - DNA, 698 bp, Rattus norvegicus
  Genbank Accession No. AA800673
  misc_feature (1)..(698): n = a or c or g or t
gggtaaaggaagtatatgtatgcagcgtatatcacatcgtatgcagcgtgtaacatatggtattaattgtctaacagtttttttcctggcacttgtatgcaaacagctttaccaagaggctctgtgcagcttttgtaacatgtcatgaagcatgtaactaaatggtgatctcaaagaatacatacaggctactttgtgtctggctgtgagaaggagaatattcacagtggtgttctactgcagttcttctaacaacccctttactaggatgcagtgggactaaaaaaatggaagaaacctcaggtacacttaaatacagcctggtactccctattaagtaagttccagcaatctacttttctctgttgtggaaagagtaaacctgaacaggtaccaacgtgaaaattcagtgtataaccaagtaactgctaaaataaaagttgtatattcatggaaaatagaaatggtaggaaaactattaggggattaaacacattgtttttgcatttaagttaatctgaactattataatagttattataaataactattttagttcaggttgaagcaataaagttgctttgcangtattttctgatttactgaatgattccatggtgaggacnattgggaacatcccataaactgactaatcatgaggaccgttacaagggtaaacacttcacaaggtgaccttg

SEQ ID NO: 138 - DNA, 452 bp, Rattus norvegicus
  Genbank Accession No. AA800678
aaaacatgattacaagaaaagaatacttcatttacgtgtaacactgtcttcatggacgtaccgtggtcacggagtagaaatacaacatgagtatacaggaaaggagaggagagaccggtgtttggccctggtggccccctcacagagacacagaaagcagcagacacctctgtgcattcaatgggacagtggacacttgtgtttggagcagccagagagtcagggaggatgggcaaagccacctctgggaccctaatttcgtgtggtaaccccaaagagatactggtctgcactggtggaggctggctcctgtcaggttcttcgcagccttcagggacaagctgaggctcctgagtgcccagtggtttgtcgcatagcttgctgggcccatgggctccatggtgtgaagagaaaaaaggccaaagtgggcgactggctgatctctaggtgac

SEQ ID NO: 139 - DNA, 595 bp, Rattus norvegicus
  Genbank Accession No. AA800679
atacaaacactttttattttgtttttaatttagaacatgatacatattcacaagatttacactttatatcataccaaagcaatctagaaacactgtacagagcacacttgaacatttagaaggctatatataatctgtggtaaagtcataggcatcgtcttcttcactcattttatccaagataaaggatctgtcagatggtttacttgctgttgattgcccaggtaacatctccctggtctcttctacaggagtcacatctgagatctctgcatttttttcaccagtaacatgttcttgatcatcaccatcctgttggtcttctgtctgttttggtgactcttcggggatgtccttttcttctagtattccatttgtcaggcccgaagaccggaaaaggattttattagttaaatgagggcccttgaggactagtggaaaggaatagaactcatgttaatagagaagccctccagcattgtcattcttattaactatcatgatacgttcattcatgtaacaattttaccttgtatgctgtgtgcattattcttttctagttcttctagattaaagcccctcttcatgattgctg

SEQ ID NO: 140 - DNA, 640 bp, Rattus norvegicus
  Genbank Accession No. AA800680
cagttgtgggagccacagtgcgggcgggcgggtctcacgggcggcggcgggagcgcgagtccgcccgcgtctttcaccttccggagaaaacatttcaagcggaggatccggtatctcgggattccgaagtctcccggtgtgagactcaaatttcaaaatggactggagcctgcgccccgcccccaccctctaggcggtcgggggccgtgggaaggctctggggccctgcggggctcagaagactgcccaggggaggcgctctattgcggaggctcgaactaagggggccacggacgcgctactttggtcgtggccgtggacatagagacctagcccgatttccacgcggaccagcaaacctggcgcacaccgaggtagttggcgggaaggtacagcagagacgacgcaggtgaggccagggtccggggtcggggtggctatcaccggccgctggccgcgtacttggccttggtgatgagatagagcacgatgtcctggtggcccccgaaagcggcgatgtgcagtgcgctccagccgtcgcggttggctaggcggatgtctgcgccgaatttgactagcagcttcaccagctccaggttgccgtcgatgactgactggtgtagtgctgtctggccctccg

SEQ ID NO: 141 - DNA, 632 bp, Rattus norvegicus
  Genbank Accession No. AA800686
  misc_feature (1)..(632): n = a or c or g or t
aataacaagaaacagaacatcagtcccttatttgtacaaaaatacctgaaagtttacaattaggttcacgagccaaagagctatatagcacagagtgaagcaaagcacgcgggataaaggttttgtctatcaattaacaccctctgcattccctgaaaacgtttacatgtcaggtcattttccggtcactgcagtttacactatgatatcacaaatctacgatgagctagtagcgccctcggaggcacagtgatcggacaggctgtcaggtatttaagtgcagaaaggagaagacaaaacatctaagctgaggcacatatttcttcaaagtttaagcaaacaaaaaaagaaaaaagaaaacacgtttggaaactcttaacacctaataatataacagagcctacgtattaaaacgctaaaaacccaaagcatttggcattttccttctcaacttagtccaggtggttacacggagttgttcttaagaaaagaaaatcacaggcagagattgcaaagtcaaacaggctccaaacaaccctgagctgtccccttacattcatgtcaattaaatacaanaataaaagtcaattgtccttcagtctccggttaagggcggctgggtgcccgctaac

SEQ ID NO: 142 - DNA, 533 bp, Rattus norvegicus
  Genbank Accession No. AA800693
tatttgtgggtagtcatagaagtcaacagaccagcacagaacagacacagctacacagtgctcatgtccacaaacacactgacaggggacagcacacagggctgggagacttgggctaagaccacctaagtccagagcacgcccctcctgcacagcagggattgtggggccaactgtgctttgctctaaagaccaggggcctctggggaggtgaggtctctgggaaggactagcagggtcgggccagccccacagtgcagcccatttgacaattggtccaggtttgcaacacatgggtgagattctgacatgctcagtgccaggaatgggcagctataaaccagagcattcacgagtaacaggtttcattcttcgagggctttgttcatgaagagttcacctccatgcacaatacactgacatcatacccccatcatccaaaaaaaaggtgttgggtgttttgtgggaatcactcaggcctgagctttgagaggacattgcttctgccttcctgctctgtgagttatgaggga

SEQ ID NO: 143 - DNA, 629 bp, Rattus norvegicus
  Genbank Accession No. AA800699
ggaaaaaggtcctgtttattattaggaaaagccggatctcagtagcagcagaacatggaatctgctcacaggcctcacactcattcctcaccaaaacaaaatagagtttacataaaaatagatataacccaggaaaccatgtacattggcatgtgaccagtgctatttacatgaaaatatcgcgttgcataagtgaggaataaacaccgccatgcacttcatcctaacgtttaaggtgaaaacgcagcagcacttgcttgcttcccgtgattgtcccactatcactaaaggactgacagacacctgaaggtttcttgtgcgcatctccatctgagtacaacctagatcttaccacttcgccaacaagaaacctctggatggcatctatcaaaccggtatgttaaacaaagttaagggtagttcaccaggctggagctctgatggggatatcaaacactctaagaagcccagtttgaaaatgtggaaagttacagcatcgtcagaatggaatgctgaggcctttcaaagctcagagtcactgtgcagaccggtatggacacacacccagaaaagacaccatcaccctccatcaagagggtggcatcagatgatggtgacattggatgatg

SEQ ID NO: 144 - DNA, 636 bp, Rattus norvegicus
  Genbank Accession No. AA800701
  misc_feature (1)..(636): n = a or c or g or t
agcattttcaaactttatttacaactgtcacagtgacaaaaagtagtttggaaaaaaaaaatgctagtttctccctgagcctcgatacagaacagacagaagtcacaggaggttcatctcacaacaggcatgtcactgaaatactaggattttttttttcaatacgatcagttagaaatacacacaaattacttaaagaaagaagaggaggaagaggggaagagaaagagaaagagaaagagaaagagaagaagaggccagacaggagctcagccacttgtccaagagcagctgggtccccccaacaggctcaaccgctgaggggcctgacgttagctatcagcccctgacctgctcagacaacacacggttgtacaacatggtctagtgaccggcaaaaggaagaagccaccccacagacacacatatacacaaagctgattgatactggatttacaagcacatcccgtcacacggcaagaccaagacagatcggggtaggggtgagaagacaccaanacacaggaatttcaaaggccaaacacctgtccataaagggaggcgagggacgagaaatgccgtgggagaaggggagaaggatgaacagatctctgtagccaaaacagaacagagtgg

SEQ ID NO: 145 - DNA, 584 bp, Rattus norvegicus
  Genbank Accession No. AA800717
gggaaaataaaactttattgaatcaaatgaatgggtgcatctgtttcctcaggcagctggagaggatttggtcttaggaataatagctggctggaatgggtttgttaacccatgagatcggaacagactgggaaccttcagcttttccctttatgtggctgcctgcttcttgctgcagcttcagttttgaattgatgcctggactgccagcggcgtccattattccagactctgccaaaagagggcagccagcctgcactggtgttggaactgtgatcaaagttggccccaactctatctggagggagtttcttcagtttttgcttttccttttctttaagaaattcttcataggagggtcctattgggaggcttccagagctgtgctcctcctcttggatcatccatggaggtgtggcacctttaatccgaggcagaggtgggtggatctctgagaaataggccagcatggtctacagattgactctcaggatggccagggctacacaggaataaacccctcagaataacaaaagggggaaaaaatccagcaaattgggtagatatccatgtctttaaaaagt

SEQ ID NO: 146 - DNA, 663 bp, Rattus norvegicus
  Genbank Accession No. AA800719
gaaaagcagccttttaatatctaattgaatccagtgagtgggaaagactcaaaacatatgtccccttgagaatacctttacaagaacaacaggccagaggcgtctcttccatgggaaactgacatcccctgtgtgctcacaaaagtgaggtctcaactcatatgcatgccacatagtttccaccccatcccaccctgcccaccctccacaggtgacagattcacacaccgaagggactggtttcttaaaccgtggaacagaatgtttaaaagaagataaatctagccaagtggccagataccagaaataactcaggggcagttttacatacacaataaaagtcaactcatataaaaagggaagttttgctaattggaatcagaggcaaaaattacaaatggcagagaatccagctacccatatgagattatttaagaaaaacaaaaaaccaaaccaaaccaaaaaaaaaaaaaaaaacacccccaaaccccaaaagtccctactggagactcccttcattacaaaagtatgcaaacatctcaatataaacgaagcccaggcccacggctcgctctctctggacaggagagcatagctaaaattccccgtgtggaattcatgcctggaccaatgccccaccctttgggaaagaaagggaaggat

SEQ ID NO: 147 - DNA, 552 bp, Rattus norvegicus
  Genbank Accession No. AA800735
caatgtaaactgatcaatgagttgtgattactctgaaattttatttttgggatcctgtgtcacaaaatgacgtgtgtaatgtttacaatgggtatgagaaattgagatgtttttatctctactgagaataaaactgtagataaggttccaagccggcatcaaaagagcagagcaaacttttctgtatataaactgtacataaaacaaggcactatacacttccgggggggacattaaggtagaaaggttgattcagatagattcttcagagtcacaccgggaagtagtacaaagtctttgctcgctttagcaccggaagcagaactcggcacaagccagacctaaggctgaggaggcagtcctgagcctgggagagactggtggcaggcctaggtcaacagaagtgacacagccctacacttggtaatgtccttttgacaccaaagggaacagttgcaagtgaatgaatacatagcttgttaaatacatagttgctttatatggtgtttatataaatatatatatatatttagaattcacaaactatcaaaa

SEQ ID NO: 148 - DNA, 626 bp, Rattus norvegicus
  Genbank Accession No. AA800737
acaaactatctgaacataactttattcacattaaaaaaatcatctgtcatttgatttgacctacacatacccctctcatctcacccacttctcaagcctctcagcacgtcacccacaccttcaccactagaatctacaagtaattagatctaacacctacacagagcgtagaaagtcctctcccaaggggttcttcacttccctgaaaattcctcaaaaaagaaaaaaaaaaaaacaaacaaaacctcttcactcatcccttccacttcactttcacggtcaccatcatcagcaagacggactcccctcagtccaagcagagtcagaagaaaatcggccctcggcaggcagccgtcttgatgctacacccaggagtccggggacccagggtactgttcggctctataagaaggtcgtttagtggagtaaaagtctacgtaatttgtggttgatttcagtccatactgcgttgagtaatcagtagaagctgggaagtgaactcggtcatcaccgtaagggtcttcatagctgcgaggagactgcaggtacagtctgtaagcatccaaggtcttcctggtggagtcatcttgatagtacagctgttggtgctgtaaccgtctgttttg

SEQ ID NO: 149 - DNA, 581 bp, Rattus norvegicus
  Genbank Accession No. AA800738
cctataaaaacaatttatttctgggggcagggagggccagaactttgcaaccagcgcccaccccaccctccagctcctcctttacaaaagaaatttttacagtcaccagtcctgtacagatgctccccacccgccttagtgtacacagctgcctgggtccccctggtccctgtgttcagagcggacctgagccaacaagccagctatccttggagtcggcctagacctgagctcgctttggtactggccactagttggcccctcctaggcctcttcttcttttgggtctgtcctttggcctgtctccctttgcatgactcttcgaagctcgaatgggatacgacaggatgacagccgtgttcagctggctttcgcggtgttgcagtgagagtgtgtgtgtcaccactttcctctcttgctccagtctttgggagtgaagtgcagacacttggagtcaattcgaaggagccgcttgagcatagcccgctcatgccatccacgatgtcttctgacagagtgaggatatactggcccttgtagtaattgatgagattgagatactgcaatgtggaaatgacatc

SEQ ID NO: 150 - DNA, 610 bp, Rattus norvegicus
  Genbank Accession No. AA800739
tattagaggaaatatctaatggctgtcttatacaaatatcagtttcccaggggcagaacaagatttatctgtgttcgaagttccaggatagatagcaagaggcactgtgctcaaaagtatttgtagtatgaaagggccatcataaatacaaaactgttatcttcggtttctactcacagttgacttaacaattctccgtcccgatgaaaggaaaacagtgtatgaagaatccccaagtagattccaaccgaagccacctggtatttttggagctggtgctcaatgcctcagcttatgcagcacactcagggtatggcagaggcagttaagaaaatgagtcaaatttagcatctcagtactacagtgcgctttgcagaccttcggactatttttcctagccaaagtacaggggaattcagacaagagccaccgctgcagaccactatcccattagtgcaaactctggttcagatactgaagaaacatgttggccaattgaggcaggttctcattgttgggatgcattttagtgtaggaaataaactggcgacggaggcgactcaattctgccaaggtcaagggacgggtaaatcggaggtgctccgtggtg

SEQ ID NO: 151 - DNA, 637 bp, Rattus norvegicus
  Genbank Accession No. AA800749
aagcaccaaaagtacacagcaatggttggtacataaaaagcacaattattgatataatttcttaccatcaagtttacaatctaaaataaaacacaagaatattgtcagcccacatcaaagtttccttattttggaattggctactttggcaaatgaatgaggcaaaatgtcctatttcaggcaaagtattaataaggctttgaatatgacacacaaaatattttttgtgtatccattttccatgttacattatggtaactaaggacaaaaagggcacttagaaatttcataagcacaatgaattacttcagattgttctcagaaactcagagatgttcaatgacaaatgccagcagccagtgaaagcctacaattaataggaactagataaagtctttgtcttggccccatttagacctccatctccttccttactaagggctctaatgttataccccacagtgaaaggcaccatctctagatgaattactacataattatgagatcaagcttactggaatattgtctaaagagaagtgagcaaagccagcagtggggactctggctaagtgatgtcacacaagcaaaggcagtcaggcaaggccacgcacatctaaagagattgggaaagcacagg

SEQ ID NO: 152 - DNA, 475 bp, Rattus norvegicus
  Genbank Accession No. AA800753
agacaacagtatgtagtagttttgaatccactgagatgttgctttcaatttgaaatattgtgtatacatgtatataaaaaataatccaatgtatgactcatctgacagatgtttaagatcaataaagtttttgaacatgcatttaggaagagaggggagaagcccaccccgctaccctgttgttgctggcttatttctgcagtggtctcaatagtggtttttagagggaaccatgtgccttcagtcttcagagttacgataagataccataatcaagacgggaggggaaatggggaatgggcaggtattaatcttaaatacattttgcactctatctggtacaagataaaaacaggttaatggggataggtattaattaggaataaattgcagtcagatcaagacataattgccgaattgagtttttaatagactgcatatatagatgtttagccatactctagatcaactcttt

SEQ ID NO: 153 - DNA, 609 bp, Rattus norvegicus
  Genbank Accession No. AA800786
acagaacacaaaacaataccctttttattttttttaaaactctggtgaaataggtttccatacgatatccctttaaaaaaaaataataatgtaaaccaacctgtgggttagtcacacggtacagacgtcacgagtgtttacagatgcttaaactatttacaaatgctattctttaggtagtaaaggtttgttgcaattttccagcactttttcctcagtaaaagaaatggggatgtgttggtgttcttgtataaaaattcataaatggagaaagtcaatttcctgagagaagatttgttcttgaaatcgtttttcttttaaacaattgggaatacagaagtgggctgtgggtgtaagaagcatatgtctaaagttaacatttttttaaattattttaagtaccattaagttaaaatgtttacattcattataaaaatgctgttaaatcttatgcaaatgatttaacactgattgctgcaacgcaaattgcacttaaaaaaattattgtgtacatggaagaaaaatatcttgtttgctaccctgtttacaaattccaagtgacctcagatcagccacgttacaataaacgttgagataagtcagtcagtg

SEQ ID NO: 154 - DNA, 520 bp, Rattus norvegicus
  Genbank Accession No. AA800787
ttagaagcaatgttgggcaaacagacaggcaaatatctgagaagagatatcgtacatcaactagcactttaaacagttgaagagaaaacatggaaagtacttacatggaccagtttcttatacaaatactaaagtgtggaaaacatcccaaaccaaatagagtattaccgtcgagaagcaaaaccagtaaaacaaaacaaaaatacaaaaaaaaaaaatacaaagatagtgtgtattgtctataggaaataatagtgtaaatagcagacataaactggcccatgtaaaatacaaaaatatttattgaaatcagatctttctataaaacagtgctttggaggtatcttaatatgaatccaatatatgatctaaatgtaaattcgtttagaaacattaacagcattaagccagtgccacccacttgttccaattagtccttttttaaaagctgttttgttgattcatgacaaatacataagacctatgttcttaaaagcacaatccattcttttagaattaa

SEQ ID NO: 155 - DNA, 644 bp, Rattus norvegicus
  Genbank Accession No. AA800794
gaagaaagttactagttttattagtttaatgcttcatagaacagaaagaaatctcaaagtcaaacaatatgcactcacttgaagaaaatacagagttagctacctaatggtttgttcttccgtaatgaaaatggatacgtcgaccttcccccgcattgttggtcgaagcccacataatccaattcttccaaaaactcttagcataggtcaatggaaggagtatgaaacattctgagccctaaaaaatatccaggtttgctggatatgttagcaaggcttacctgttcctatctgccttggctatggcataattctaacctagaaactcctttaaaaggcaagtgatttctagactcaagtgttcaacactatccaactagggtcagtcaaaccatcctctcgcacatctgcaagagaagacaatctatgttggcagaaattcccagtcaagaggtcctgcttcccaaagggactttgtgtcaccttagtgacacttaatgatacagtctcacactggtaaaggtgatcaaaggagacaccatgctacagagatataatatcactgacgggttgagcagatcccactggagcatgcacacagaatgcagccagagttaaagccacagatgaagcacactgtaaca

SEQ ID NO: 156 - DNA, 359 bp, Rattus norvegicus
  Genbank Accession No. AA800797
acacccagaacataattatcatatattaatagcaatataacagaataaaggcttgtggggacagccagtctttcagacatggatggaaggttggcgttcattgttggtgaggttggttgaaggctgtgccttcagcttctggttaaactgcagtgagtaagcccagggttagttgctgagaatcatgttgcaagcagaaccatcgcacatgctgaaactggcccacgaggttgtgtggaggctcctccttaatacgatctgtggaaatgagcccggtggcttcggaaagaacgctgccagtaacgaaggctccaggaaggcttcggtctcaggagctctgccatgctgaccctcgtgcc

SEQ ID NO: 157 - DNA, 541 bp, Rattus norvegicus
  Genbank Accession No. AA800803
gacattttagactgacttcgtttattgagcaccagtggagagcaggctgtagtacactagagcagagatgaaccggccctcccatctaggggcgtacagtcggggagaacccaacagcttacagattcctctaccgggggttaggatgagacaggaaggtgatctttacagcacctaactcagtcacctggggcagctggggcctgacctggggcagctgggggtaaggtactgcagggcaggggacatctaggggaaggcacagaggtaagatagcatggggcccggggaatgccaagagctcagggctcagaggcagagtgggggaggtagtggctaagatgtgaggaaaagctccattagaagctgggtttctccaaagggctctgcctcggcctagccacagcatgcccaaagaggagagtctctgcacccaggagatagctgtttgaaggagaaggcctttagtctggaaggatttgctgtggtccactagtatgtttgtggccgtgctggggcagatgctctgagaaggttcaag

SEQ ID NO: 158 - DNA, 335 bp, Rattus norvegicus
  Genbank Accession No. AA800849
  misc_feature (1)..(335): n = a or c or g or t
caagtgagatgctcgaagtttattgcaaagaggaaggcggggttggtgtagggaggtcaaggaggcagagggcaagggagtggagtngtttttgggcgaagtatgcgagggttggcgttgagagcgttgcaggtagggagggtgggtttggattgattggtggggggtgtattgggtgcttaataggtttacggtttgggggttcgtttttaggtttaatagtatttttaatttatttgggtgggatgttggttgtatttgggtatacaactgctatggctactgaggagtacccggagacttgagggtctaattggtttaattttagttttttt

SEQ ID NO: 159 - DNA, 470 bp, Rattus norvegicus
  Genbank Accession No. AA800850
ggatgttaaagtagttacagcaatatacaaaaacaaacaacaacataggacaacccacgggaagagaggggtgagacacacacaatgggactgtacaaatttaggtcaaaataaaggtatatgtattttgtggggtcataaaacatttactaggtcggtagagaaagcagaagtaacagcaatatatgtaaaagtaatgatttaatggctatgagcaagacaaagcaatagaattgtgcttcttttgcagactgtagaccatgaaatgcttagctacagggtccatacaaacatgaaacgattcatatggaagaaacgtcctcacagataactggtggctgataaacacacgctaagttcgaccaaagcaaactgagacttggtagggtcattcatattttaaactcaacatgtttgctctatttaaaaatacctgtagaaactcatagtaaattgcttctagttccaga

SEQ ID NO: 160 - DNA, 358 bp, Rattus norvegicus
  Genbank Accession No. AA800855
ccataaacacctagttacaagttgcacaaatcatttatttttataaaggcagagaagggaatagatctacgaggaaaagtaggggtgtatggcaccagggagggattgtgtcgtggtagaggtggctaggcaggggcaaggtagagagagggggatgacaaatggggggaaggggggtggtgcttagaggggacgtgttggttggccgcggggcgtgagccagggctgtgggtgtggggttgggggggtcgtagggagcagccccaccggctctgcctctggtgagcttgggcaggcttcggtacttacagagactgtgagcccagagcgtttctgtcatttcaccctgtgccccgag

SEQ ID NO: 161 - DNA, 422 bp, Rattus norvegicus
  Genbank Accession No. AA800885
ggaagccttttcaacagaacatttattgagtgccaactgtaagcatctgagctgtgtatgggctgtgagtgacagaggcatgagggggaaaaccaggaaagctgctgctgccccttatcttctctcacagagcagttgctgctcttagctgggttagccctcggaccagcaaggaagaggattaaaatcccaagcatgctaagtgggagggtggtggcgagcttagcttttgtaaggctctgggcgcgttcttcagcaccaggggcgaaataattccagagcaagatctggctgaactggaacggagcgaggactaaagcattgggccaagcctggcaggcagtggttttaagttcctccaggtgcctgaggtcttttgctatcaatacaaatggcgggagaaaaatgacttcggtctacca

SEQ ID NO: 162 - DNA, 460 bp, Rattus norvegicus
  Genbank Accession No. AA800928
aaaaaaaaatgttaaaataaattacacctgccttcaccaccagtacatgcatacagtgtggttactatggctccgggacattcagcttaggacatctcacaggagccaggctctttctcccaccccgaggccggtgtggcctctgcaaccgctttgaggatggcggacgtatggacacacacctctcactgtcataacgtgggggctctggccctattacgccccttggcaaacgaacagggcaaggggaggggctgaggcaggtaatcagctgagctgggaactccatatctcctgccccacacctgagacctgcgggtgtctctctctccctcgctagacaaaggacaagctgagttgggaggacaacagagtgcccgacagacagacctccatcccaacggcagggaccctgttctttactggctctgggtataaaagaaaagacagttcgttaaaa

SEQ ID NO: 163 - DNA, 454 bp, Rattus norvegicus
  Genbank Accession No. AA800942
actgtcaaaagttttattttatttaccctgttaagcaggccctgcttcgtgagaggccctgaccctggggctgagctcagggatccagagtccgacgccctcacacctggcacccctggctgctgtactcctgcaggaagtcattgagctggccacaggctgcccgctgacgggtgctcctgcacaggcgctcagatggcatctcctcgatccaactgtttgagtccagcaagtactgggggctgcgggtgacatggcagtgtcaggacaggtactcaaggacttggctttggacaggcagagctgggtgcctaggatttgtccctaaaggaaggccatagttaagggaggggaagggatggattgggtaactcactctcccttgaggtcactggtgactccgtccatccccatgattaagtactctttgctaggctccaaacgaaggcggcaa

SEQ ID NO: 164 - DNA, 206 bp, Rattus norvegicus
  Genbank Accession No. AA800946
aaaaaacaaaaaccacagggttttatttcaaccccaatgggcagggccccgcgggacttggctgggcagggagcaggctcccaacgggctgaggctggcccccagttaacttgccagcaatgaccgggttccgcagcaccacaatgactgagtccccgcccaggaacatcttggaaatataccggtccttgttgaaaggcttggac

SEQ ID NO: 165 - DNA, 448 bp, Rattus norvegicus
  Genbank Accession No. AA800948
ccatgcaaggagactgtttatttcgaaaggattttgcaataaacacagtgaacagggctccaagtagctgtctattcttctccctcatcctcgtcctcataggagtctatgcctacttcctcataatctttctccagggcagccatatcctctcgagcctcggaaaactccccctcctccattccctcacccacataccagtgtacaaaagccctcttggcatacatcaagtcaaacttgtggtccaggcgggcccaggcttcagcaatggcggttgtgttgctcagtatgcacactgcacgctgcaccttggccaggtcgcccccaggcaccacggtgggaggctggtacttgataccgaccttgaagcctgtggggcaccagtccacaaactggatgctgcgcttcgtcttgatggcatcgatggcagcgttcacatccttgggca

SEQ ID NO: 166 - DNA, 499 bp, Rattus norvegicus
  Genbank Accession No. AA801058
acagtgctagttgagtcatacactcttccagatggacgtattattaaggttggaggagaaagatttgaagcaccagaagctttatttcagcctcatttgatcaatgttgagggggttggtgttgctgaattgctttttaacacaatccaggcagccgacattgataccagatctgaattttacaagcacattgtgctttctggaggttctaccatgtatcctggcctgccatcgaggttggaacgagagcttagacagctttacctagaacgagttctgaaaggagatgtggagaaactttcgaaatttaagatccgcattgaagacccgcctcgcaggaagcacatggtgttcttgggtggcgcagtcctagcagacatcatgaaagacaaagacaacttctggatgaccagacaagagtaccaagaaaagggtgtccgtgtgctggagaaactcggtgtgactgttcgataaaatagcaggcttgtccccatcacgc

SEQ ID NO: 167 - DNA, 574 bp, Rattus norvegicus
  Genbank Accession No. AA801070
gctgggagggttttgcctaaaatacaatttattggggaaactagattttagttttataaacttttaagtctttcatgggacctatattttcttgaattaaattttgtagttctagaacaaataggcaatctacaaaggtgttatctgtgtttcttaaaaacaggcttccttatcttccttatctgttaagcagctgggggattcccgtctttaagcacaagggcactgggtcctcaaatgcctgtcttcaaaagagaaaaagcaccagtcttcaggtttcacgggcttcctactaacaggccccaaagctaagctttgtaaactcacccaaccttctcaacacggaataccaggaaaccaccactggaccaatggagcgcccagaaggaagaggctgccacatgcttgtgtccctgggagccacgctacagctggaacagaaccaccgagtctggccccagagaggaagctgtcacagaaggacactaattggacactataggaaatgatatgatgttggtccttgaaagtatgcaccagtcatctgcaaaataaaacgtgttggaaccctcaa

SEQ ID NO: 168 - DNA, 533 bp, Rattus norvegicus
  Genbank Accession No. AA801165
ccgtctgtttgcgctctcgtgatgtccggccgtggcaagcaaggaggcaaggcccgcgccaaggccaagtcgcggtcgtcccgcgccgggctgcagttcccagtgggtcgcgtgcaccggctgctgcgcaagggcaactacgcggagcgcgtgggcgccggcgcgccggtatacatggcggcggtgctggagtacctgaccgccgagatcctggagctggcgggcaacgcggcccgcgacaacaagaagacccgcatcatcccgcgccacctgcagctggccatccgcaacgacgaagaactcaacaagctgctgggcaaagtgacgatcgcgcagggcggcgtcctgcccaacatccaggccgtgctgctgcccaagaagacggagagccaccataaggcgaagggcaagtgaggcggctgctggcaccggcccgcgtctctacgaacccttccccccccccagagaactctcaaaaaacggctcttttcagagccacccacagaatcagataaagagttgtgtcacggtaa

SEQ ID NO: 169 - DNA, 608 bp, Rattus norvegicus
  Genbank Accession No. AA801187
acatcaatcagtatcactttatttcaagccaaggttttacattaacaccaacaaactaaattgttcattcacattgacaatgtacatggtttctatttagtttttgaaacttgctgttgctacagcatgagactaatctgaaaccacccgcaagtgtaaatgtgtaccctaagggtgttgacagtggaaatcattatgcaagtttacacagctcatgaccatagtgcaaactcattaatgttgaataagtaatttatctgttttgcaaaggtactgaaaaatattaacaatcatcaaataaatgcccagaattatcaaggaacagctaaaaatgaccaggatccaaataggttatttatattagatttccccataaagaactgacaacactaaaaacacattgaaaaccactgttttaaactttgcatgtgggcttttaaaaaaatatttgtgaccttgagattttcagtaatttttaaccaagtatcatttgactgacaatcctgatataatttacagctgtactattcctgaaaggaacatctacacgcggcctgctaaatataatctgtgtctttgcaaatcaatacaaaagttctccaacatta

SEQ ID NO: 170 - DNA, 600 bp, Rattus norvegicus
  Genbank Accession No. AA801230
ggcctaggaatttattcatgaaacatcaagtttcagagtcgttatcttggcgaacaaagaggctgagtggagaagctcgcagttagaggagggtgcacctgcttggcagagttgaagcgacaagttaggctagctcttgaatggtttgttgctggtgacaaagactgaccctaaagcacaggaaaaagtgctcacagggcctaactcccaagaaggtaaccattcattttccagtgcagatctgtacccctaccccagcctgagggtgaattcatagtccagaggcattagatcccccccacagacgctttgtgggcttcatctttcaggtctgtctggacagtagacccactgtaaccagttagaggcagctggtaggatgaggacagagactttacttagatccttcctgtctccacctaggattactcaatctgtccgtgacaagtcagtcccaactggctggcggctcagctcactcagcactcagaaataccctcttgcgggctgtgttggtatacggatgccagcgccactctacatctgcggtagcctcctgctccagtgtgcccaggcgaatcatgtacaacttgagctcaa

SEQ ID NO: 171 - DNA, 648 bp, Rattus norvegicus
  Genbank Accession No. AA801244
aacggtcaaattctagctttattccagagtcaaactggacaatgaaagttgatgtgacattccatgagttttcagttttcacgatccagttagtcatggtaagacaacactacctccacacctaaggacagaatccccaatctttgggcacggtctagcgcactgaggaatccaggccccatgcaaaaggaccaaaccgacgacagcacaagaaaaacaaaaagatcaggacaggacttttccaaactttattagtctgagtccaatcaatgggcagaaactacccagcgacatttattttacttaacaatgattccaaagcccaagaatattgatgtgaaagagaagctgtaattctgttacttgaagacccttgtgatgctatacacatcttcctaggtgtgtatgctcataggaaacccgatacagagagttaataatatacaaggcttcagatatccacgaggggccttgggatgcacacacgcatgacgggaatgttgtagtaatgtggatctcagtacatctcatccacacctaagccagacaagcaagagaacaaggaatacatgttgctacaatgtagaaccaactatcgatttgttccagttaattggaacctctctacctggaaagttagtgtttaac

SEQ ID NO: 172 - DNA, 437 bp, Rattus norvegicus
  Genbank Accession No. AA801255
gctgggtatcacttgaaaacttgtccctgtttcaagggcgagttacttaagacaccagcttatatatagcttctgtgagtctggcttctgcataaactttgtaatgtttgccatgaggtttagtggaaaatgttcttttgtctcaaacttggatattgctacctgaagtaataaacaccccaagccagaaacttggtcagtgctggcaacattttttgagtgtttgtgatccaggaatcctagagtgaccgcctgccattaagatttttccaaggacagagtcatcccaaactcttgtttaattaccagataaccagattctttatcagaattatggaataaaatatgtactgtaacaaataatttttagaagaaaactgtttaagataatgctcttaacatttttttttgcaaacattgaagattacattgaagaa

SEQ ID NO: 173 - DNA, 462 bp, Rattus norvegicus
  Genbank Accession No. AA801368
gctcgatcgtccagaccccacggcgtcaccatgctgggcatgatcaggaactcactgttcgggagcgtggagacgtggccttggcaggttttaagcaccgggggcaaggaagacgtctcctatgaggaaagagcctgcgaagggggaaagtttgctactgtggaagtgacagacaaacctgtggatgaggctctccgggaagcaatgcccaagatcatgaagtacgtggggggcaccaatgacaaaggagtcggcatgggaatgacagtccctatctcttttgccgtgtttcccaacgaagatggctccctgcagaagaagctgaaagtctggttccggattccgaaccaatttcaagggcagccgccaacgcccagtgaccagagcgtgaaaatcgatgagcgggagggcatcactgtctattctacgcaattcggtggttatgccaaggaagccgactat

SEQ ID NO: 174 - DNA, 598 bp, Rattus norvegicus
  Genbank Accession No. AA817722
tttttttttttttttttctgattacagaatttttatttcaattaagcttataaaaatatagctagaaatatattttgaattctaaaagctttttttctaaccagctttaacacaaacatgtccttgcaaaattcaccacctggctgagtttgaaatctgctccctccctgtggaatacaacagagctctctacttagcaaacacatctgagtggagaagtatgtgaccgacttttcgggacccccatgggctacggagctcagatgctgtccatggccttgaactcgctgagggcctgcacagggttcacgtgcttcttctgggaggcccgcttgatcttggtctgtgtctcatcctgcttctctctcttcaccaagggcttcttctcgggggctttcattttccatgacacagcaggaaggttgagggacgccatcccctgtgacttctggtatttggtggaagccacgtaggacgccttcactgtctgcactacagcgttcatcaagttcttggctgcctggatcagggacatggcgctgtccaccccagagacgacaagctctccaccgaggttctgtacttcagccttgacctt

SEQ ID NO: 175 - DNA, 585 bp, Rattus norvegicus
  Genbank Accession No. AA817787
tttttttttttttttttaggtaaaccatccaagcagtttttattcattaatattcataaatacacacagcagcttcattagagatttcaatttcctcttcagtttgaatgtggagtattaggagagccttttgcatgtcaaggtacaggaagcagagatcaccctgcactgctacctacatttacctgctagaagtaaaaattagttaagtggaaatgattatcatatatatttctctcttccttttgaatgtacacaatgtaacaagagtgacagacctgaaattacaatcaccacacaaacccaggatagctgttgtccactttcattggcaaatacagcacagaggacattgtctgcgagtggggaggtcatcaaagaggaggtggtggaggctcatttcctttattactctcttttaaatttaggttttctaaagcgacatctaaaggcataatatctacacagcccatagcaccaaaatctgccatctccccccgttcatcctcgtctgaggacgagctctcttcacgcaccaacgtatacagaaggagctcctggacaaacaggctgcggtctgcacgc

SEQ ID NO: 176 - DNA, 370 bp, Rattus norvegicus
  Genbank Accession No. AA817813
tttttttttttttctttacaggcataggtttttctgtttattacctctcttataaccatctgttataaacaattctagaaggcaaataaagtcactttctacaataaatagagcatcgtgtgcttcacagcagaccagacagagacacgaggccccaagcctcagcaggatctgagccgcatcctgtcctaaagagcagtttttaagtgggactcggagagtgggaaggattcagaggctgaaaaatggaggagagagtgtgggggaaggggacagagagggaggaagccccgagatcttcacataggtttggatgaggtttggtcagagtccacggctgaccagctacctggggagagagaggggctcg

SEQ ID NO: 177 - DNA, 601 bp, Rattus norvegicus
  Genbank Accession No. AA817816
tttttttttttttttttgaattccagcgttgtttattggacgcaagtgttcaacatgggatggcatcatactgtcccatttccagagtaaccaactggcttggttacatgctacaagttgctgcttccaggtgtgtgaattagtaagctaaattcaaacagtaagatagaaacacttttgtatcaaagttgtgacttaaaaaatacaaaagctaaacccacaggtgtagagaaaaatggcagtcctgagagctgccttgaaatgtcagtcttgaaacttgtggggaggccagcacccattaggggaaatgaagggagtgggagcctgccctcttcatccaggcggccttcatactggcatatgtgggcccatccccaggctgggcaccatcattggggaagcatatggagaggcactgagaaggtgtcagggcagggccatccccttcagccagagcatgctgggaggaaaggggcttacttggcacttacaagctttggcagctcagaggggttttctgcccagcccctgctgtggctgaaccaccacaggtctctggctgggcctatggttactgaagactgggtattactccatgccc

SEQ ID NO: 178 - DNA, 605 bp, Rattus norvegicus
  Genbank Accession No. AA817829
tttttttttttttttttacttttaaaaatactattttatttatactcatgtataaaaatggctatcctgtcatttttatatacatactgataatggaaacaattcagtgtcatgcatttcaaccgtacaaagaacataatcatggaagcacggttacaggggaagcagaagagtctgagtagtgatttcattctcactgaggagcggcaccctgaagaatcgagtccattagtaacactcaccgcactgagagcagaggggcgttagcgattgtacttgattatttttactgagccatttcatcttcctcacagtgagaagaaatacaatataaccttaataagaaaacgacctcattacaatctcggtaaaggtctacggcttatggagtggagcagagttcaggtgtgcttgcgggctccggcctcaccgtaccatcccacctgatgtgctggacagaggccgctctctcatgcgcccgcactaactccatgggagctgcaatagaatgaaccatttctgtggcgttcccaggtctcactgaggaagaaaagacttcatacacataaatataacaattgatctgtctataaattatagtggta

SEQ ID NO: 179 - DNA, 480 bp, Rattus norvegicus
  Genbank Accession No. AA817831
tttttttttttttttttccctcttaaaaataaatttattaatgtgtgtgaatgaatagacatgtcacaggtgtgcaggtacccagagtccagcagagggagtcagagcctctggaactggaaatacaggcagttgtgagccaccaacctacggaccactcagctcctcaaaggagtcatccctgagcactggattttcttcagcacccacacagtagttcccaaccatctgaaacccttgtctcagcagatccaacacctcaccactgaccttgaagctgaaacaaaatcccaaattattatttttacagtctcgttgtgctggcccaaactcaagagatccacctctgtctcccgagtgctgggagtaaaggtgagtgccaccactgctcggcttccaaatgacggacttttaaatgaatggactcaaaacaacaacaacatcaacacagtcctcagggtggttggctgcctcgtgccg

SEQ ID NO: 180 - DNA, 612 bp, Rattus norvegicus
  Genbank Accession No. AA817841
  misc_feature (1)..(612): n = a or c or g or t
tttttttttttttttttggttttctgctcacatttattggggctaaagagactaaaacagttaattttcttcccaaagaattgggaaacgaaaacatataatacaacagtaatttaagtaagcacatgaccaaaacttcctggatcacgaaccaacaggagatgtgaatagcctgtagatatcaattccaacagctttacaaaatgtcattcatctaaggcatttctgtggttctcacggccacatgttcacatacataaaggcctctattcatggacagagagatacgttctttaggagcagtgggtgcaggaggcgaaagcagttacacgcttagttactgagtaattttaaagaggaaatttggcgttccaagaaacagttttgtacatccaaaaaaaaaaatcaatgataattttccacttggattattttgtgatgcagactacaagaaaatccatgctggattatttgctttccaaaggccactttcaaagtacagatttcgagtccagaacaaatacccacagcgagaacaaacagaacggctaagactctaacatttgcctccatgtggctttcctcctcnctcgattctctgacattttctga

SEQ ID NO: 181 - DNA, 619 bp, Rattus norvegicus
  Genbank Accession No. AA817844
tttttttttttttttttgccactaataaaatgagtttactttattgtaaaagtttcccaatacacacatgcagagccacccacatatggggctttaacagagatcttataaaattatttccgcttaaagtattaaagtatacagagataaaaatattagaaaagaaaaaatgttaagtcaaggttaatgctcaaaaagggtcaatacccaatatttaaaaagggtcaatctgcagaattattgctaaaagactaagcttagaagtacttagggaaaaagatactatcttttcagaaaactttaaaatctcagggtatgtgtcttaagaaatactacaaaccacaaagcaatgaccctctgaacatttacctgtttcacaagtaaatcaacctaaaaggaagaggtcagaggaaacagcctatgaatcagaactcagatttctgtatttagatctcttcagatctccttagtttttccaatggcaatcaacagtccaataaaaaacttacagttaatataagacagtattagagtaataccacaaaggttcaggcatttctccaaagtatagacaagaaggaagatacatgtagccaatgtctgacataatttgagaata

SEQ ID NO: 182 - DNA, 622 bp, Rattus norvegicus
  Genbank Accession No. AA817849
tttttttttttttttttacaaagatttttatttggttcacagacgaagccattcacttggtctgcttaaaaaagtagagacacaatgatttacatcttaaaatagtttccttgctccagttctacttaaagatagcacaggagcagatccgctctgcttgtcttgctggtttatagggtgcaactcatcctcctgggttctggctgctgggtacagggctgagagtggggttaggtttggaaaaaacatggctgtgggtagcacgagttggcttttgttgtgtttctttgcataggtgttaggagccgagagcagctagggtgaggatccagaacacaggcttgacagtccccatcctgtttgcctgccactggcctggggcatcttgcttatctttgaggaagtcctaggaaatagtttctgtaatgcatcctgatttgaaatcagtgaaagtgttttggcagtgggaaaataacaatcccacttcagagatctcacaaacggaaaatttgcctcgcaaaaactcctttaaacgctaactgagacaaatgattccgtgggcaaggagactgtcagccagagctctgtaaaatgcattctgctagttaacagttctttcctt

SEQ ID NO: 183 - DNA, 592 bp, Rattus norvegicus
  Genbank Accession No. AA817860
cggccgctcctcatcgggcactcgcttctcttcctcagctttgctgtccttctcactcctttctccctctggagagctcgtcttattctgtgctagaacttcagactcatcttttccacacgaaatatcctcttcatcagaaaggactaaaaaggcttcttttggcaaattctcactactttcttgttttgagggtgagccaaaagaaccctccattttatcctccaagtcttgacttgtttcaactggaaggagagaagtttttgaaaagcaactgagttcatcctcagtgggtgcaagtttttccaagatagggatgatctcatctgtttccatagagtccgtgttgtctgagacagtattcttcttgccctcctccgtggggtcctcactggcagcgtcaacaagttctacaggacttttatgcctgtccttttcactttggtcaacttccatgctgctggagatggcctcttcctcaagagcatgctcggcaacagcgtcttcctctaccttcttcgtattttctggaggtagatgatcagaatgaataattgcactgtgtgtttctagagttccttccttctcagca

SEQ ID NO: 184 - DNA, 576 bp, Rattus norvegicus
  Genbank Accession No. AA817892
tttttttttttttttttcagagttggaagtggttcctttatggaaaaactgaaaatataataaaaattaaaataaaaccagttaaaaaagccagcccctggagtttccacctcctgcctctggccctccagaggggtgaggccctggccccagggcagcaaagggtgagggctttcctgcccttcctcttcccccattccatccccgacttttatctccacagtgggggccccccgagaggaaccaaacctgggtatgggagcaggacccaaggccctgtatcccagggagggaggcttggcatgtgtgcccagccccaaagctccgggcctgtagtgtgggcatgggcagggctgctccctgcctgggcccatctggggttggggaggttagttccagatcttgaggaaggagtcccaggagcctgtatccacagccatcccatcatctgtgaccccaaggcagctcacacggttatcatggccagcgaggacacctgcacggtcacccttcatggcatcccagatgttgcagttgaagtcgtcatagccagcgagcagcatccggccgctgcgt

SEQ ID NO: 185 - DNA, 554 bp, Rattus norvegicus
  Genbank Accession No. AA817917
tttttttttttttttttagcatataaaaccaaattttaattaaacatattatctagttcctgaattggctgatataacattaagataagaaagcatgtttagaaatagttaactcagacctctggcttgaacagtgaggcctaaggaacaaaccccagaagtcttgcgtggtcggtgaagcagctcatctatgcttccatttctctctctgtatttcattagagtgccaggacataggtcagtctaatttttttttaatttttaattatatgtacacatggcactgtgggttttagcccatgtgtgtgggtgcccacgaagaccggaggcatcggatcccctggaactacagttagagaaggctgtgcacaacttgttaagatgttgggaactaacagggcagacttcactcttcaaccactgagcaatctctgcagcccctacaaaggtcactttaataaaaatatctctaaaagtatagaatccctcaaaatcagaagctaccattaatgctaaactaataataacaaatgtttcagctttgaaaacactcc

SEQ ID NO: 186 - DNA, 493 bp, Rattus norvegicus
  Genbank Accession No. AA817921
tttttttttttttttttaaagcagcagcaaaattttattcatgtgaactgttaaaaatgaccatctataccagtgtcaaatgagggagggaggggaaggcagggcagagcagggagacgaggggaggagggaggagtcccctctactggtaataaagctccaggttcatcccgtcgtggatctcatagtctcccagagacacgtggtctttaaaaatcgtgtaccactttttaagaacgatcttattccagcgggtgccagtttgagccgctatcagtttcttcaggtcgccgatggtgtcatcggtgttgcacttaacgcggactttctttcctagacggtcgttgcaaaccacctcaatcattgtggctggagccggctttgcctcccgcaacccctaggctcccaagtcttggcagcttcccgcgatctccggcctctccgtttagccttctcacctccaatgtcctcgaacctagcgaccctcgtgccg

SEQ ID NO: 187 - DNA, 386 bp, Rattus norvegicus
  Genbank Accession No. AA817925
tttttttttttgcaattttgagatgtttaataagagtttgagcagctgcatccattcatgccctcttctgtgaggtagtgacagccccttttcagaaaccgtggtcactgccttgctgcaggcacggcagtcctcagaacgggcactgagacagcacctcatgcgtgtcaggtctttaattttttccctgccagagctttttctttctttgcttcgttgttactgtgttttttctgtttaacaattcaattggcagaaaaatggctatcgctggtggacattagggttgcagtgaaaaaaaaatccccctcccccaattcttgcttgccaccgtgggagacgaggtgagggttcctagaggtttcccaacccacctcagagcttcc

SEQ ID NO: 188 - DNA, 523 bp, Rattus norvegicus
  Genbank Accession No. AA817945
tttttttttttttttttagatgaactcatttatttgacacattaagttatgcaaagaaaaatatatgcaactgcataaaaagaaccacgttttcatattattaaacacagcagtggccgaaaatgacgaattgtagaatggaccccaggatttaatgcaaaaaatcacgccgtagagaaaaacgtcaggcctctaacttcacagaatccagcactatgcgggcttctttgtactcctcagcttcttccaagtccttttcgctctctagtatctgccggagatcagtgtaagcagcctctaaccggcgctggcagtctgggatcatcatccgggactcttgcaggatctctgcctgcttcttaatggcatagttctcaccatcttcagccttcattttctcaatcttttcttcttgctgctttgcttctttttcatacatcactttttctttgaccagtcgcttcagcactccggtcttgatcttgatctgcctcacgcgaggatccgccacctcgtgccgaat

SEQ ID NO: 189 - DNA, 386 bp, Rattus norvegicus
  Genbank Accession No. AA817964
ttttttttttttttggtgaaagattttttttttttttttattggtaatggggtctttaagtagtctgaaactaacactcaagaaatctttgctagttaggatctattgccaggaaacattctcagaccttcttatgtatgagattaaggtcaacattcgttggtgagcggagatcactgtgataggcaccttacaatatggcaaagggctgaaatgatggcctcactttccatgatgtgggtgtagccagcttgtcacaggtcacaacaaagagctctgtggaacaccgttccaatcagcagttttcctttgtacacagcggcgactgtcgtaccttgcaacaccgtgccattctctgaataaactacagttacttcctcgtgccg

SEQ ID NO: 190 - DNA, 512 bp, Rattus norvegicus
  Genbank Accession No. AA817969
tttttttttttttttttccccatcaaatgattttattagttaatgaaacagcttgaagacaattcactttgtccaacactcttctagaaaatagttcaagttgtaaacgcacttccaatacataaaacagaattacttgaccgtacacaaatttcagctcaaaatacaacactctgttttcttaccattataaaacccagtccatacaaactacgtaaaaagagaaaacactttcactgatcctgggtacgagggaacagcacaatgaccacatttccccaggacccaggtctagtgctagagctgaggaccggaccccagtcagccacaatacccaagtcctgtaaacaaaatgcagccacttacggaaatcaacacacccttctgcatcggtgttgcttgtaaaccataaaataactttgtaagaaacattacaagttaaaaaaatgatttctgactttgctatagtagacaccagcaaaggaatagaaaatcggtcactccacccaacg

SEQ ID NO: 191 - DNA, 390 bp, Rattus norvegicus
  Genbank Accession No. AA817987
tttttttttttttttttcacaataccagatcaggatttattcgatgaccacattcagttattcagacatagaacaacagattgcataaatatcaatgttcataaaatatttatcacttttgaaattttaatcccatgggaacatccctggagggagaccggacattttctcctgaaacactttatcaaaggcttcagcttgggatacagtgaagtgattcttccagtccccaacagtgcctttcctcatgaggccaataccagtagaaattgattttttcatcaggaggctataattggacatgtcattttctttcatgacttggcaggcactatacttgaggaccacatccagctcatcgggctctagttttttccccaggaagtcaca

SEQ ID NO: 192 - DNA, 504 bp, Rattus norvegicus
  Genbank Accession No. AA817990
tttttttttttttttttgaaattgtttctctttaattgagtacttcattcagacattcctctgttggcttctgctctggaagcagctaggtccccacctcaatatcacaactgagtgaacatgggccccaaaccagggctctcagaacaggaaaacaataaactgcaaagccagcctctcctttcacttaggagggactgggagtcacagagtccaatcccaccctgcagctgtaggccctggagcctggactgcaaacacagaaacatagctgtcaggaacgaggcagcagcctcatcctccagctccagtacctgaccaccagcctcttccagtagggatggacctactcttaagagttttggcatctacttacttaattttcccaagaggtgaaaaatctaccaaaaggaatacataccatggaccagaataaatcagctttctcacggtaaactttcctgagtaacaacttggttgctgagaagcctcagcacattattt

SEQ ID NO: 193 - DNA, 532 bp, Rattus norvegicus
  Genbank Accession No. AA818026
tttttttttttttttttacaaaaggttaagctctgtttatttggagtcacaaggagctgattgagtcactgtgactcaagaccacaaagaaaccctttgcctccacttcagtctcaagcctgtggtgaaaacctcgaccagcacaagtgctcttggggcccattcacaggtttacaagtttctcgttgagggcaatctgtgactgggtgagattggccaggtaggtcaccatcagcaggtcgttgatgttgctgttgagcatggtttcaaagtcatcaggaactatcttgggtacttggttgacaaggctcatcaagaagcggcctactgtgttgtcagcagacactttcccagacagcacatcctcagcatactgcaatacagtgcttagagcatcctggatccgggctgaggcccctcccacttgctgtaagtcactcgagagtccaatcacccggttggggctaaaacatgtcttcatgatgaggtcaactccaatgcgctcagtgtcataatacgcatacttcactgt

SEQ ID NO: 194 - DNA, 565 bp, Rattus norvegicus
  Genbank Accession No. AA818039
tttttttttttttttttacaacttgatgtttattcttttggaatgctaggttcagcattacaggatggttgtcaaggctacccgagtgtgacagacagacttcacatctgggtgctgcggagctccgagttattaaacaaaccttgctcttgtacaactgaggtctgatggttttaagttgatgcctgggtgcagggccagacacaaccttagggatgtttcttacctgtacatacatatatacaaatatattccacaaatgtgtgtatacatgggcatgtattaatttacgtggggaatttataaaattatatatacatacacatacatgcatatctatatacagctccccaccctcaccagtgagctgctgaagtagctcgttagctccgtgctcgattattgctgtctggtataactacatgatttagtgccaaagccagacacattctctggtgtgggatggtcactgtcatatagacacgtgtatccttgtatgccgtgtatgaagagcattgctcccatgtgtcaggcatgccctaccacagtaaactgcctttaccac

SEQ ID NO: 195 - DNA, 366 bp, Rattus norvegicus
  Genbank Accession No. AA818065
tttttttttttttttttgaactcataaaagaggtttattgacattttgcttttttacatagaaagtctctaaaatatgaaaattaactgagtaaatgagaaactatacagtaacttggtcagatagacacaggttgagtagccaaactaaagacagcagtaatgtttaagtaataggattagatatttctagacaaaacaaaccaaatgaaacaaaagagatggctcagataaaaatgagagaatgcagataatgaaatgagattgattggaaaaatgtaagcacaaccagacaactgtgcagcttcaagaatggaggtgagcatcaagcacagaaaaagggaatttcaaagaccagcttgactgg

SEQ ID NO: 196 - DNA, 525 bp, Rattus norvegicus
  Genbank Accession No. AA818089
ttttttttttttttttgattgtaaatttgttcagaattccttcaactttaattgtgggggtaaaatcaagcagccactgaggaaaaatagtccctggaagcagtcgaaacgtttgtgtagtggacacgatgagttatttattagcacaggttgtcacaagtcgccagctgttctcattcttccactgtctccttcttgccagtctcttgcccttcaaagagggggtacctggcctccacatcagcccaagtgatgttgccattggccagatcacggaccacactgggcagttcagagacctctgcccttatctgtctcatggagtctcggtccctcagagttgcagtgtggggggtcttgttcactgtatcaaagtcaatggtgatgccaaacgccacgccaatctcatcagttcttgcatatcgccttccaatagacccagaggaatcgtcaactttatgagacacgccatttcgagtcagagcttccgataattccttgacaaatggcataaactcttggttt

SEQ ID NO: 197 - DNA, 336 bp, Rattus norvegicus
  Genbank Accession No. AA818093
tttttttttttttttttagacccagcggaatttaatgtagtcaaaatgagaacatattcaaatggatccttccttccaattcatccacatccagatgcaccatttccttgtgagggacccagagatgtcagtaaaaacctgccacttggcccttgagatctgtaatagagactaggtatccttatctgtggtcacttgaactgctacgtccttgctcttcccctcattccctttctgggatgtttaaagcaggaggcctgaaggttgaggggatccaggtatcccaacccctctaccctacctgagtaaaaattaaagccattaaacctcgtgccg

SEQ ID NO: 198 - DNA, 378 bp, Rattus norvegicus
  Genbank Accession No. AA818112
tttttttttttttttttccaagcatcaaaccgcaccattttactttattctgcacataaggaaaccaactgattagacagagcaagaatagtgttcaggaattagaaaggaaaagaggtcaagagcaagctttcaacttcctcccaacacggtatcacaaaaatccatgacaggatacctagaattcttgttctcaacagaaagacctccaaggaacaaagatgaatgagtccttagatccacagggatccatggggcttactccaggaagtctgacctacctataagtaagccatccaccctcatcctggcctcatcgactcttactccaaagtggccaatggctgcccgatgctggcagcttcaaatctacttgtc

SEQ ID NO: 199 - DNA, 513 bp, Rattus norvegicus
  Genbank Accession No. AA818118
tttttttttttttttttggaaatgaaggtaatttattgaaactggttttgggagaggtgagtggacagctgggggtttcccacagacaactgttggaagaagctagcgcacggccgggtgggagcgggtgcctagccacagaccctatctgaggcccaactttttcttttccttctgcttcttacggaccacatccagattccggtccttccacatgcttttgcgaagcttgatggggcgtgagcccacgtacttcccattcatctcacgcatggcacgcacatagtcactggggtctttgaagctgacaaagccatagcccttggttttgcctgtgcgcttgtcacggatcaccttcgccttaaggaaggatgggaaacggctgaaggctcgtgccaagatgtcatcgttcacctcattgcccagatccccgcagaagattcggaagtcatcggcatcccactccagcaggctggggtcctcccagctgctccctgctgctgtacgaatgca

SEQ ID NO: 200 - DNA, 528 bp, Rattus norvegicus
  Genbank Accession No. AA818142
tttttttttttttttttccgaagccacggcccaactttatttacactcattgcaaagcatgactgagggtaaaggacaggtaccaggggatggggggctgggggtcatggagactgtgcgggtgcacggtagggttgcaggagaaaaggaaggcggtggtgaggatggacagcccctctttcagtgtcccccaggctcccaggcgtccgggggcagagagcaggtgaggctgccttcaggatttggacttggacacagccagtccaatgagtccagccaggcccgccacacccagggccatgccaccaacaatggccatgcctaccagtccatctggaaaagcaaagagggagacgtgagcggatcagcccctaccctgaccacactcccctccacagaagagggggacctgtatgtagagtctgagggttggggctccagggctaccaagacccttgaaaggtaggtttgataaaggactgtgtgtgtgtagggggtgtgggcagtgttcccaaggcccgggcctga

SEQ ID NO: 201 - DNA, 357 bp, Rattus norvegicus
  Genbank Accession No. AA818163
tttttttttttttttttagttagccactagcttctttatttctatggactgcagaagcctcagactatcacaggtgtaggaggtgacattgctggatagataacaaggggcacaagttcaagtgagtgggaaacctaaatggtcacagcctacacatcacagcgtatacagaatgttgggcatattaaatgtagcagaacacttgggtttctggttgccttgctactaacctgactcttgattttgtgtatgtaagtttctatactcacttacttttctccataagagaagccatacatactgtcactggtaattgtaaagaattacagttccccttatcaaacaattacaatttta

SEQ ID NO: 202 - DNA, 461 bp, Rattus norvegicus
  Genbank Accession No. AA818224
ttttttttttttttcttatacacatgcttttttattcatatagatttctgagacaatactgtaatcttgaaaggaggttcacactattacatcaacagtgaatttcagacagaggcaaactgagcaccataatttacaaatagaaagaccatgctggaggacaacagaagttcactaagggtgcacaatgtatccgagaagttcttaagcctcatcctcgccctcctcctcctcgaactcgccctgctcatcagccgtggcatcctggtactgctggtactcagacaccaggtcattcatgttgctctctgcctcggtgaactccatctcgtccatgccctcgcccgtgtaccagtgcaggaaagccttgcgcctgaacatggcagtgaactgctccgagatgcgcttgaacagctcctggatggcggtgctgttgccaatgaaggtggctgacatcttga

SEQ ID NO: 203 - DNA, 557 bp, Rattus norvegicus
  Genbank Accession No. AA818244
tttttttttttttttttcatggctaaataacaatttattgttagaaatcttttacatttgttggtttatacacttcgatctcagttttgttggtacatcttaaccctggctacccaggagggaaagctcggtgacgacagacttcctctccctccttgtattcccaggctagttggacagtactggcaccatcgtttccttgcatccttacttcaaattcagccttacttccccaaccacgtggcctttcgccagcaaaggatggcttcagagaacacatgtttctgctctcccacaacacagacatctctacctggggttcagtaaaaaactgggagttacctgtggcttggctccagtgtagtgacgggcaaggaaggaaaaaatctggtgaatctgtcactcttcacagtcacatcccagaggacggcagaggcctcgggaaccgagtgggcctggtgcagagaatatacgagagccccacagcgttggcctgatatcaatagcttatgtccttcaggctttctgaacagaacccctgggcctactcaactgcc

SEQ ID NO: 204 - DNA, 425 bp, Rattus norvegicus
  Genbank Accession No. AA818261
tttttttttttttttttggatccaatctctttattgtcagccctccctaccccccgtgccgcccttcacaaccccctttactttcaaacctatagaaaaaccccaagcctgggaatgtcctgggaaaaaaagagcagagtgcttctgcccctttactttcaaacctatagaaaaaccccaagcctgggaatgtcctgggaaaaaaagagcagagtgcttctgccccttggcccaggcagtgcagacaggaagagtgcgtgggataagggtaggccagtaactccacttgcaaaggatgtagcactcactggctgggatgcaatggggagagaagttactgctgccagccttcctctggtactctctctagactggcatccagagatgggtgcctggcttgaggcctgagcctcgtgccgaattct

SEQ ID NO: 205 - DNA, 554 bp, Rattus norvegicus
  Genbank Accession No. AA818288
tttttttttttttttttgagttttcacattaggacgattttatttataatctgattttctacccacccccttcattacatataaaaacatcatcaggcttgtcacagaataaaacactaggaaaaatgaaaaacacattttaaaaggtgcttcatttttcattccattagtaaagccttgacaggctcttgaaacgtcagtcaagtccaggaagaactagaaatgcctgagacatttccatttcagtgattattgcaaataaaaattcctcattgtgtcttcaaaaaaatccctgagaggccagcaagcccattgtgcagacggagagactgaggtcagaactccttagtctcctcatgggagactggagcatgtcagtgaagttattgctttaaagttttagcaaggtttcgcaagcattcctctgctctccactgtgtttctctggtccatggagaagtgaggacggtactggggtctgctctttgaagaacccagtgtgctgctgggtggccccagaagcagcagagctcggtgtgtcctcccaactcact

SEQ ID NO: 206 - DNA, 552 bp, Rattus norvegicus
  Genbank Accession No. AA818380
tttttttttttttttttgctttaaagtctttattatcctgaatataaaagacagaagtcctctaggatataacagagttgatttttttttaaatgtggaaacattatttttttttacaagtgaaaaaataaatacctcttggaataaaggcttatatgctaatatgtgccataaaaaagtagagttttaatatctgacaaaatgtctgtgcaaagaaacaaatgcataaacacattactgctacattaaggcaatatgaaacgtagactcagagctcagtaaagtgacagtgtaggtttctagctttaatgtagctagtattgcacccgatgaggtcagctaggcttccggacaccctagaaaaccccctagctcactagcttccaaaatgcccaagtgggggtgaaattatgacgaagaatatagaaacataatgaagtggccccacctctggaagatgccgaggaggcagtacaatgaatacggaagcactgacctaagaaaacaccaacaaagggaattaagacagacacaaagaggagatacaaccta

SEQ ID NO: 207 - DNA, 539 bp, Rattus norvegicus
  Genbank Accession No. AA818394
tttttttttttttttttacagcctctaagtcatcatttattgatttctagagcacccatcacatgattaaggtgctttacaacaatacagtaaacatcacacacaaaaaaaaaagctcacatagttaaatacagtcaaattacagaacttaaaaaaaaaactggaatgaagcaacattatgtcaaacttcaaaaatattgagaagtggcagtacaaaaaagggtaattccaccaactagagaccagacaatgaaacacaggcaccaagacccgaaggaggaaggtttgtagagtatgaatgagcatataaataaaatttcacaactgggaccaaaggccattaaaagataatatgacacccaggtatcacaaaatagaaaaatcaaatgttcaagcattaccttctaatgacaagaagatcaactctgtgtgattttaaactctgaggtcaaaaagccatcaatattatctcattaaaaaaagactaaaatttgcaatcctctataagaacgttgaacattagttaacagccaacaatt

SEQ ID NO: 208 - DNA, 550 bp, Rattus norvegicus
  Genbank Accession No. AA818406
tttttttttttttttttgaggtaaaacaatccttgagaaacaaactgttttaattttagcatctgtacaggcagaaataataagcaatgaaacaaatgtgaaaagcttaagattcaatctgtaatgtaatacctctatcttattctgatgtcaattaaaaaaacaaaagaaaacaaaacccccaccagccaccacaaaaacaggccaccaagatcataagagtgatcatatatccatcgctgaagagcagtgcctctctcctggcgtcttcacatccgcctcttctgtgtacttatgtacagcacattgtttccgcggatgaatgcgtctccatacttattcttcagctgtccgtttacatactcctctgtctgttccaatgctatattcatgtagccatccaggcaggccaggacccctcggtaatccacgccagagtttaatttcaccacaactgggcgcccgatgatctgctttaagaagtcactaggggtttgcttccgcagactcatttttaacaatccttacagcgggattcggcctcgtgccg

SEQ ID NO: 209 - DNA, 340 bp, Rattus norvegicus
  Genbank Accession No. AA818412
tttttttttttttttttctctgtgcacacagctttattggatatcgctggagcgtccccaagtggctctgattactggtgtgacaggaggaggtggtgaagaagaggaacaattcatttcgggcaatgccttcgccaagacaaatgcgctttcctgtggagaagggcatgaaagcttcactctttttcagtgccccattggcatccaggaagtgttcaggattgaagctgtctgggtggtcaaagtactgtgggtcatggagagctgaactcaggatggggtacacttcagtgttcttgggaagcaggtaccctcggaacatggtgtcttcctcgtgccg

SEQ ID NO: 210 - DNA, 564 bp, Rattus norvegicus
  Genbank Accession No. AA818421
tttttttttttttttttgaaaaaaatgtatcattttatttgcacacttagaaaagttgtacacagaaacttattgtttgtaaaacagaactgttaggatgacatttttatttttaaatcattaagactggttgagaaatagaacaaaaacatagtaaaatgtttaaaaaattaaagaacattttccaagtataaattttataaatacaaaacaaattcacaaatgactttgaatgctaaataaatatctagttaataaattcagttggtactggctacagcacatcagagctagcgaactggactcactcatgtgtagtgttgaaaccctatgacatggagctcagacacactctctatggtgtgttctagcaggctcaccgtggagacaagacctccttactactggaactcctaaggctcaatgacaaaatagagcatagatgaaaaatattttccaagacacctgaacacatgaatgatctcaaaatatacacaagcctctgtaacccagtactgtacccagtacgtctatgcaacttagtagacactgaacaaaagctgt

SEQ ID NO: 211 - DNA, 399 bp, Rattus norvegicus
  Genbank Accession No. AA818511
tttttttttttttttttaatcttcaatcataactttaatctaaaatagaaatgggagggcaccttgacgttggtctcagattcaagtgtagaggtgacgctgtgtagtgaggcttgcttatcctggaccgccaagcatgcagctgacaagcatcagtgcagacacagcacagctgctgaggatggctcagtggtgagaggagctgcctcccacccaagtaggcctatacatagagcactatgacctgggtccttggggtgagtgccgtgctcgccttcccactgtatgcaggactggctgccccacaccaccccaggatctgaccaagcgctatttgccgtctgtgacccttcgccagcaccgccttttcttcctcttccccttcgccttgagtgagtc

SEQ ID NO: 212 - DNA, 507 bp, Rattus norvegicus
  Genbank Accession No. AA818521
tttttttttttttttttacattgtaatctatttattttatacacgtgacgtcataagcaaaggctttgcttgtgttctagctaaactccaataaataaatatgtacagatatgctgagcctacaaaacagtaaagaaaaccttttcttcacaaaagatacacatatgatacatttgttccttacactgacatatgaactcattcctagcttacttaaaacaaaacccttctggactctgtatgccaatatctagaggcatgtacctggtccttttattttatccagaaagcaaagctatgcagagaaaattcctcagtttctttattaaaaaatggcctgcatatggcctgctacttattattaagtgacatttaaatgttctcaagaagttggaaactctttagaccagttgtcctgaaatgactggacaatgccctgtggatgttgtcaaaatgcagcttcttatgaactggctcactggggtgggagtggggtatggtgggggt

SEQ ID NO: 213 - DNA, 419 bp, Rattus norvegicus
  Genbank Accession No. AA818554
cggccgctcctccctctgaccttgactccgcctgaggccagcctccctgaagctggccttgaaactgagggctgatctttttaactgaaggctgctttccctcctgccacccctcttacccctcttgtctttttcacaaaactgtgtcagcctcttcccagagttccagctggagggctgaacacctttgggaacaatatttaagggaatgtgagcacagcgcaaagtgtcctcaatgcagttgtgatatgcacattgtgattactttttatcttagcaaccatttttaacattccaagcacttgtgcagcttggagcagcacatcttagcctaatggatactgtctctccatggaggagaaacacaggaatgggcctgccttactgagagccagcagagcccaggcagactccactgt

SEQ ID NO: 214 - DNA, 468 bp, Rattus norvegicus
  Genbank Accession No. AA818595
tttttttttttttttttaaagctccaacatttattatgtcaatgttaagcacactttttaaaagacaacatagaatgtatagaaacgaggggttagggactcatgctcatctccacaatacgggtaattaggtcggctggtttcacaagggttggacgcctcttcgaccgcggggcagtccgagggccctctgaatgggacggattcactgttccaatgtgggtctgtttttttgttttttacgttttattaaaaaatataaataaaatggcactgcaggcccaggctgggaggactcggcaggactcttgtcttcttggaggctactgtcagaaaacatcacaaactagcaggatgacggagctcgctgacatcggctgggcggcgcatgtccagccccgcccctgggggcttcagagtttctcagaacttaagggctcttgagcttccatccgcctcgtgccgaat

SEQ ID NO: 215 - DNA, 556 bp, Rattus norvegicus
  Genbank Accession No. AA818602
tttttttttttttttttaatggctgaacgagaggttttattttacacaatgaaccattataagacaaataacaacaacatctctgatgtcagcttcttgtaatacttcattgaaatagagacagggaatttactaatataaagagaacatttagtatgtggaggccgcatccctgcagacagacggccactgtgcaggtgaagcaattctaagaaagattcacagagaggggcaaagggtcctttcttgggcatacataccaccaagttcatagcattgcttctctctacaacagataacatactttcagcacagtaactccactgtgatacttctatagaagtgtatgaaaggctgcgcactgtgaatatggacacgtaatttttgttacaacacaaactaagttcttattatcaataatttctctaatgctcatctgtagaggactcgagaagaaatagcaagactcttccacttaagagaagacacaggactgttttcttttttcctttaaactatttcagcctcttcattatttacagatttgtgaaatgca

SEQ ID NO: 216 - DNA, 448 bp, Rattus norvegicus
  Genbank Accession No. AA818658
tttttttttttttttttggagtaagagttatatttatttggatcacgaagtataaatatgaaccaggttttggaaatataggttgtaacagttcagaaatggcactagaaacttccatggggtctgtgacagcacacatcacagttttggtgagaccgtggtctccttacccaaaaccttccctcccgccaaccttctctgtactaagtgataggtatcagttaccaagaatagtcaactccaaaattccctgttcttcctcagcctttttctttactaatgccttctccaaactgttctgtgctctaccaacccctgcatggagtagcaccagaagaatggcaggataagggaaatgtcttgatacaaagggagtgacacggggtgatggaggaccgggaagctgcaggaatgggcgcccaatctttctgcctcgtgccgaattctt

SEQ ID NO: 217 - DNA, 496 bp, Rattus norvegicus
  Genbank Accession No. AA818669
tttttttttttttttttccttacactaatttaaaaaattttaattggttgcatatattaacatgtactataagattcttttctaagaagcattacataataaatggatactgtaaaaagatctgattagttaaaagtaacaagcattaacagatacatacaaaacagcctgctcagaacggagcctgggcaccagccttcccacaggaccttcaaggagggtaggggtaaaagaccacaagaccgttaaaaaaaaaaatcagataattagacacagatgaactgtgaacagttctctcactttccagtggacaaaaagagtaagctttccacgcccactgcaccccagagcacccagggtctccgccatatgccatacacagggctcacggtggacagctgccccaggagccctgacaggcacaagctggagtttgcttgctgtgtgtgtatgtctgtgtgtgtgtgcatgtgtgtatgtgtgtgtgtggagtttc

SEQ ID NO: 218 - DNA, 584 bp, Rattus norvegicus
  Genbank Accession No. AA818700
tttttttttttttttttgcaatttatttctaaatatcacaaacttttaaaaaagcaacacattcatactaaaatacgtgcatgagcaaaaataaaaaataagcacaggagtacgaaaattaacatagtaaaattttaatacagtattctggatacaagtagaatagcactaagtaaaggactgtagttacctcagcagcctgggagtatgggttgagatcaaccaaggtttagaatagccccttcacatttcatcagtgctgaccaaagccaaagcaagctaggatggagactacaactaaccttccatgttaaccagttattttaaggtgacttaccctcacttaatggcagttgaggtaagttaaacagagagcccttacaaagactaagaaccaaatgaaaacttgtttctagcctttgttttaggtcaccttaaactaaaatgcttttacgtacttcttaacattcatgtacacattctttcaggccaaagtttcagcttgggaatcttgccaactgtatgtccaacttctgaacatttgcaatcagacaaatttactgtataaaacagtaagatttact

SEQ ID NO: 219 - DNA, 557 bp, Rattus norvegicus
  Genbank Accession No. AA818702
tttttttttttttttttcaggaaccaagaggattttatttgtgacgccctgaaaccacactccttcccaggggcccagggatagaagcaagggttgttgtggtcctaggaggaaggggtgcccacctctaccctggaagctgccgccatgatctcatgctctgggctgctaggataagggctacacgtcatcctcagacacaaggcagtagaagtctgttcgcgcactgtagtttcgagagccaaggtcagagacatccatttcactggcatggccctctcctatggagaccttgctttcgtgtagtggagttggtggctccccaaagacaggtccacggacacccaggtctccctcagggtctggatccagctctgactccatggcccggccctgggcagcacgtcctctcacgattagcatgggatctttgtcatcctgaagtcgggtttgggggtctccctccacgggtctgtattgcaccttccgtggtagtgccaactgtagctctttccaaaaatcagaggaaggtgtcacggagccaggcttccaaagca

SEQ ID NO: 220 - DNA, 403 bp, Rattus norvegicus
  Genbank Accession No. AA818725
tttttttttttttttttgagagtttaaacgtttatttaaacagaaacgccacaccacttcatcctcatcctttccagcatcaggctaacaagaagctggctcttgagccagtgttggcacagaggatagacgcaggctatactgtaactcaaagcagcactactggaaggcttcaatcacccagcactgcatggagggcgagcaggacaatttacgaagatttagctagagagaccatttgagacatttctgctgtcttcacttttactaaacccagtggatggttgtgacttttgaactggtttttgtttgcatagctgtttggtagggaaaaaatcttatggctgtcgtaggcacaattctggaaagtacaaattgtctctaaggcacagaacttagattc

SEQ ID NO: 221 - DNA, 596 bp, Rattus norvegicus
  Genbank Accession No. AA818741
tttttttttttttttttgttgcctttattttatccctatttgaccatcaaatatgtttacagaagatggtttacaggtgcttgagcatcccactggattctctaccatttcaaggtgcaaaagaggcttacagtgtgtttcattaaacaaagcaaagctgcgacaaaacaggatcacatcaatagtagtatgcatcagaagagtgtagtaatccatcaaacacaattgggcatctgtgcctttcctcaaaaagaacaagagctctacactgaagaatatgtagtgcacaagaagcattgtttgtaggctgtgaaggaacataaactggcataatgtcacttattaattcaagtctcgatgacctatgacctctctgtgaatacaaaggggtccaatgtcttaggcacctgctcatgggactgtatgtttatttccagggtgcacagctccatacaaagacactaaagatgggtttggaacatggcagcatttacatatttgaaaaagttcaggcacattcggatacaaaagaaagggggggaaatgcaaatagaaatttctcttaagtctctgaaacacagtgcaaaattgagaca

SEQ ID NO: 222 - DNA, 600 bp, Rattus norvegicus
  Genbank Accession No. AA818759
tttttttttttttttttcccaaaaaaagatttatttatatatacactgtagctgtcttccgacacaccagaagagggcatcagatctcattacagatggttgtgagtcaccatgtggttgccgggatttgaactcaggacctctggaagaccagtcaatgctctagcccgaaattcttttcttaattatttttactctatatgcattggtgttttgcctgcatgtgtcggggcctccagtactggagttacaggcaggtgtgagcgtccacatgggtgctggaaattgaacctgggacctccggaagagcagccagtgctcttaacctccaagccatctctccaacccgagaagccaaattttcaccgtttaaatatcctgtgatccatatgcagtgctcttctggaaggaagagtccatcactttagaatcatgaatcagatctcacacagtctcaattacagcagctatttccttgaactgtctgtagaaattctgaaactgtgggattgtcatttcgatggacttgctgctcacttggccagaatgatctgccaccttcagcatcactgccacgtacggatacttgagagatctgca

SEQ ID NO: 223 - DNA, 368 bp, Rattus norvegicus
  Genbank Accession No. AA818761
tttttttttttttttttacaccgatggacgttccctttcctagctgacattgtaaaactccaggtagttgggagttaaacacaacccaccgtgggaaaagtaaacagactttcttaaattcgctggtaaaaaattctatcttgcccgaagaggtcgtgtctaagacagcaaatgagaccacccacccaccctttccgcggtagtccacgccaggcgatcagtctaggctgaccagtcccggggtctccagccacttcaatcaactctgatcgcagcaagatttgatttgttcagttctggatctcagccgaaggccggctcgcccacagcagcctgtgggggcgaggtgactcaagtcacttcccagt

SEQ ID NO: 224 - DNA, 561 bp, Rattus norvegicus
  Genbank Accession No. AA818774
tttttttttttttttttaagggaagtggtttatttcttggctcaggtgagagcaaacatgtatcaagcagaggcttgcccacctgactcttgtggaacccggaggagttttagtttattgtacatgcattaaaaagtctttcagctgctgcagaggaaacgtcagaagcgaggcctgaggccggagctccgagtctgcacgggacacaggcgtacacaggtagctcacagtatgcacaggttaatatgagacacagtgacaccggtggcttggcttggctggcagctgccagtacgatgacaatgtggctcttctgaaatggaggcagccctgtcctgcgccatcagccgggccttgcttggctgtacaaggcttcggtgtgtagtgtgctctgggttggtcggaggttggaagcaccaaagacccttaacctggtccctcggcaggcgggacaggggtcattatttttctcctggccagaaatggctgttcctcagaatagataaagttccttagccttagttatcatgcctttccctttacaaggcccccctcgtgccg

SEQ ID NO: 225 - DNA, 537 bp, Rattus norvegicus
  Genbank Accession No. AA818798
ttttttttttttttggtgacgccagatactttactcatctcaggcagtctggactagttcccctcccgtggactccagggtaacaccagaactgtcctagaccatagctgtcctctctggcggctggaggtaggcctgcagggcacggtggaggaggaagcaggtctgtgggtggagggaagcaggtctgaaggtggagggttccagtgtagttgtggctcatcctttcctatcacctctcggggtgcagcccacactctggtcctcgtgtccacatgagggccactgtttctagctgaatggacatatccagtgtcgataatcacccctcctcatcatggttcacagtgttgcttccagggacatctacctagacaatggggtccccaaatgtgcaggcctcctcaatggcgaggttgtagctggaacctgtccctcccttataggtgctggtcacaattctcatccagcctcgctcaccccagggctcgccccatgaattgcggacaatccaatactcgatgccatcattgctga

SEQ ID NO: 226 - DNA, 522 bp, Rattus norvegicus
  Genbank Accession No. AA818887
tttttttttttttttttaccaaaaatagaatttttttttattaaaccccatttctactagtccacaattcttttctgcatcaaagtaattggtcccaacttgacctgattaaatgtccccaaaacattgggggtagtagccagaatgaggtgtgtgagaggatggagcttggccccctctctgtgtcccttgacaacatggcaaaatgcctgacaagaagccacttagagaagagagaggtggacagatcttcaagacagaaaggagggacctgtttctgtccagtgtggtaagaagtggcctgctcctgccctggtcatgaaggagtcctgctggtgtgctgctggttttctcttgagactctgcctaagccacctgaatgccttgttggctaaacctgtctagagacaccctcacagccacccaaaggggcgtctcccaagtccttctaaatccagtcgagttgacaatgaagattggccaactgatgggatataaaaggaaagattccattcttcagta

SEQ ID NO: 227 - DNA, 359 bp, Rattus norvegicus
  Genbank Accession No. AA818889
ttttctttttattttttattacggataggcctcaccatacttttatttggaagaacgtgaattttgtgactttggatttggaaagccaagaaatggtttgagtggggcccaatgagctatcctggcaggaagactttgtggctgtgagtgattttaactgcatacacctggcccaagaggcttcagggagaataatttcactgtgtggcctgcagattgtttttgtggtgttttggtgaagaatgtggctgctttttgcccctgtctgaagagtctacctgaggctaaggtgaagactcagattcattgcaccgacaaaggaagtctcagaaaagcccagcagagactctgttctctgg

SEQ ID NO: 228 - DNA, 582 bp, Rattus norvegicus
  Genbank Accession No. AA818907
  misc_feature (1)..(582): n = a or c or g or t
tttttttttttttttttgaaatttgaagtctttattgaaccaattgcatgttaggttacaaagctatttcacttttccaaaatgctgtttctctttgtagaccaatctggccacaaaaggctacctggctaagtattagccagaaacttctaaatcccagtgtgatcttcttgtggcatttttccaacaaataatgcagaccaaatcacaagatggccacctcactggtcacatggtccttaggttaatgagcagaggctgacaggctgtctcctcactcttccaagaaccgcccccaagtgcacacaggccctgcttcgtctcctcatcggcccatcttctggtctccttcctcaccacaatcttcacctgaacagcagtcaaaaggcgcggtcggtaggccgcggaattatcactgcgcatgcgaccattagggtccgtgcttctactgccgaaatggagaatcccggttccttagcagcaggctccgtatcccgcggccactgaggaaccatccggggatgcagaccgagtacggtgggctggagaactgggagaatggggggcggngggcaagactgg

SEQ ID NO: 229 - DNA, 613 bp, Rattus norvegicus
  Genbank Accession No. AA818911
tttttttttttttttttcagtataagtttttattaaaaagtgcattttgattaatttatgatttaggtaagttgtaagattatcagtatactctctggaataataactttacaaagatttaaaacaaacaaaaatttaaaagcctttttatttccttcaccattattgttttacaatacaaatatcaccttgtgagtagacactacacacacacatacacacgcacacatacacgcacacacacacacgcacacatacatgcacgcgcatacacacactcttgcacgcgcgtgcacacacacgaaacctacagaaggtaatcctgctgcacataaaatacagaaaggatattatatttatatttatatttatatatatatatacttcttcactcttagaaaactattttgttctccacgttggcaagtatagagtagaatacttccccaaacatacgtatgtcaggagtaaaactcagagttacatgcgctttctgcacaaatatattgtaaagaaatagctctctttttgctgttgttgcccaccagcaaacctgtcatgagagtgtggataactaatttatagctttcaagtttcaggtaagtgatcattt

SEQ ID NO: 230 - DNA, 598 bp, Rattus norvegicus
  Genbank Accession No. AA818947
tttttttttttttttttactgtcaaaacgtttattgcaaaatggagtcttagaacaaaagaaagcggagaaaagttcacatcagaatgaaacgtgcgacgccaacttggatttctgaatacatcgtggactcagtgctggaatatcagcttccaactacgaagtcggcaactaaacggccttaccacaccagagcacagtttaatcttccatacagacattgtacatggcatttggcataagacttgctcagaataacattgcaacggagtggaggcgagaagattgttatgcaaacacagtgatgaggcctcctactgaaagctcacactccaaggatagaaacttttccgatagcaggttttcagggtgcagaagcaatgtgtcgtgtcggaactaagggtgttctgcacacgctacaaaacagttgcatgggtgcctgaactctagttggcaataattatccacatgccagaaagttcctcacacaagcaacagagtgcccacaaagttggggtctgagaaaacatggcctgtccaggattccctgatagacactcatttttcaaccacagaatgctgtgctgacagcagccagg

SEQ ID NO: 231 - DNA, 498 bp, Rattus norvegicus
  Genbank Accession No. AA818996
tttttttttttttttttgggggatttaattactctttattgaaatggagtgtggggtggtgagggcacccccagcctccagaatgaggtagggccacatgtattcagttcatactttgcctgggtcttctttgagtgtgactgttcggttgaagacaacctgtccttgatggctatccggatccacagagaagtacccaaggcgctcaaactggaacttgtcaaagggctttgccaaagccacagagcagtccaccaacgctcctttaatcacttgtagtgatgccgggttcaagtcacttaggaatccaccaggcacttcgacagggtcttcagggttcttgtgctggaatagtcgctcatagaggcgaatctcacacaccagaggctgtgacacccagtgaataaaggccttgggcttctctccagcatcagctcgtctacaggtcacctccaagcattccacacagccactggagcccctgacaacatgctgcag

SEQ ID NO: 232 - DNA, 546 bp, Rattus norvegicus
  Genbank Accession No. AA819027
tttttttttttttttttggatattctggaatctttaatagctttgcctcatatgcttcaatgaggtcaaatggctacagaacatttcaaatttcaagtcctcaatgacctgtcccaaaatatttgaaaacaggtaaacagaaacacccacccaagcatggtgcagctcggtggtccacctcacagcctcaggagggcacagggttcacagtgtcctggaacagtcctaccctcttggcagacacaggctgtgctgtcagaagtcaggaagtccacgtagtgagaagttgggagcaaaattctccacttcttcccggagagctgccacagcactctggaacttctcatcccctgtcagcttctccttgaactctttcagtgtggccctcatggtcatgtggctctgaatctgcagagtcaactctatccctctgtggataaagtgtgctatctttttggagtcttcttccataagtcctcgggatgtcaatgctggagttcccagtcgcaggccactgggccgtaacgcactcttgtcacctgggca

SEQ ID NO: 233 - DNA, 583 bp, Rattus norvegicus
  Genbank Accession No. AA819055
tttttttttttttttttagcaatatactagcatttatttatttatttatttatttatttatttatttatttatttatttattttttatttttggtgtgagtatcctagacaatcaaactgaactattcagaaaagaagataaaagatagcacttccttttgccttgcttataggtatgctagttggtttgggctgttggttgattttcttctttgaatccttatatgacaactgctggtatgatgaatgctggtccttaggtaggagactttcagaacagttccagctcagggtgcatcaggtcctgtgatgaagtacattgtgccttctgcaatatgtgtttatcttccaccaatgcaatgcaagtaagtagtctcttaggttctataagacaaccctgaccaacaacttacaagagtatttctcttgtccagtattactgtatttattaggtgatcgttggtgtttggaggggacattatcaacctttcaaaacacatgatcatttatgaagtctactaagagttgtaacttattttgagcaggtgggataattgatgtgaccatcaatgcactgtgtacg

SEQ ID NO: 234 - DNA, 510 bp, Rattus norvegicus
  Genbank Accession No. AA819118
tttttttttttttttttagaacaagtatacaattctggatttttatttagataaagcttaagttacaggaattcagccttctgcacacccatccttccctctgctgtaaggaacttggctcccaggcagccctgaccccatggaaagacccaagcttctacatcacatacagcttcaggatctgttggctcctggggcttttctctctgctgtttcctcgccctggtggaatggggaaagctggggtctctgtccagttaaggcagatgcaaggtgtctgctccttgatgaagctgctcagtccttctcctaagccagaaccatcgatatgagccaggtcccttcctgaagccacgtgtttgagagctatgagggcagtatgctgtggggaagccccaacgagggacaggctgggtgtgtgatgctgatcatgatgggacacctagagacatgttctcaggactctgctagacagacacacccaggctacctggtaaaagtcagttctcg

SEQ ID NO: 235 - DNA, 502 bp, Rattus norvegicus
  Genbank Accession No. AA819129
tttttttttttttttttaagtttctcccaagtattttcctgcagctctctccagaagtcagataagagctgacgtcacagcacaaaccgagtggggacacagaggaagcaccggggatgccgagaggaaactggaccagagactctgtgtcctagtgactgccaaagacacagcctcacctcttcacttgcgtgtacacacacacacacacgcacacaccaagtttcccttgacttcaggctgttccctcagtgcagcaggcattgaacagagagcttcagtttctccttcaaggtcgggtccatcaagggaggcatatctttggtcttcaggacgacttcatgggcctcctggaagaggctctcccccactgcggcttccacccgctgacgccacgcagccagtttgggtcggctctcgaagattttgcagccagcactgacaggatgcatcagttctgtgatggccaccaagtcagccacggagatatggggtcctgtta

SEQ ID NO: 236 - DNA, 555 bp, Rattus norvegicus
  Genbank Accession No. AA819140
tttttttttttttttttcatttccatcccgtctttattgcttctgcgatcagtacaaactctcagcttcagtgctggcattccctccttcctgtctcaggaaccagtcattccaacttccaactcaaaagacaccagagacagctttttttttttttttttttttttggttttttttttttgtttgtttgttttgctttgtttttaataggcatgcaaagattaaagtagtgaaataaaaaataaatgaccctagattgggcaaagaaaaccatctttatgaagaagaaatttaaatgctggatcaaaaaatttaaaagacctggccttatgggtgtgtgtttatcggtaatttaaaaccaggcgaagttggtagtaggcaaatttttaaaaagtgatagagtagcgatggtattatttgaggtaaacattatgtattcaccttctgaaatctacagtgatcttaacttgtgctttcaatcaaatgtggtaaggtgggcacatgcctccatacccacatacatagcatggacccatcacttgtcagtaactcagc

SEQ ID NO: 237 - DNA, 329 bp, Rattus norvegicus
  Genbank Accession No. AA819259
tttttttttttttttttccaaggaaactggactcatttattctttcattgaaagaatttggtctagagttggacgcaggaagatgggagatgctgggacagggagatgtaggaccatcctggtcaggtgatgagagcaaaatggccgggtgtccggttttcctttcccctaactcggagtttatgtagtaactactctcctttcaggagagtaaggagctggtctgtaaaaatgccagcgtacgtggtcatggccgccgagcttttgctgtacatgtccctcagtttctcgtccacgctggtcaggtatgtcatctggtcctcgtgccg

SEQ ID NO: 238 - DNA, 621 bp, Rattus norvegicus
  Genbank Accession No. AA819306
tttttttttttttttttgaagttcaatcgtatttattttttatatagaattgcgaagtaaaacctgtaccaaactccagataaaatggtttgatctgatggatttggccgcacatttcctgtatgtagaacatactggattataaatcaacaacacaggtcccacttggtaaaacgtagaaataaaaaaaagaaaagaaaaaattaagttaaagtattagcacatatacagtgtcagaaggggtctccgtcaatcaccattttgaattaaccgttttcctttctgaatggcttgttttgttccacgaaagttggactttcagaagttgcttctaatcacatcataagaacacagtactccgtgacatgcctatcaattcacgtcaccttctgcagattcctttctgctgaacagtgcccaggaggctgaggcttattctgttttatgtgcttctcacacaccgagaaatcaatcacaggaatacattttacatcctggatactacagtgaaactcggcctaaatatcacctactgctaacacatgacagaatgtttagctattcaaatgcttcagtaaagtgtatcttaccaagagaaatgtgttttgaatcaaactttta

SEQ ID NO: 239 - DNA, 489 bp, Rattus norvegicus
  Genbank Accession No. AA819318
tttttttttttttttttacatttctaccactttattagattaaaaaaaaccgaagagcacaagcaaacaaatgactagggaggacctgaggaaaaaccatggcaaaggtcaacaaggacagagatgggaagggaggggcagagtggagccaggtcaggagagggactttaggtaggggtcaggtgcctctatttgatgacaatcttctgacgcaaggctcggggcccagcgccagggagtggctcggggggtgggggcccggggcccagcgctgatgcagtgggtggtagtccgtgggcagtgatgtacttcttgtacgcctcacggatgatcttgaaggctctagcagtggcatagggtatgtctgtaacagggtcccggtacaaagctggaccgtgggtcactgggcagacctcccgaacagggacctttggtggtcgcccttgggggaaccattcttcaaacgtggcatcatcactgaatgtgatg

SEQ ID NO: 240 - DNA, 516 bp, Rattus norvegicus
  Genbank Accession No. AA819337
tttttttttttttttttgaaaatgatgaagtgttttatttatatttagtctttcttcaatctgaactgtaaccaaattttcaaaggttagcaagtcattacactcatacatctcataatccctttcatcacacagtaggcacacatatacagcatcatgtcaatataatgttatccacacagcataaacagtttaagcagtagacgcatttcacatgaaagaggctctatgcatcacatggcctgtcccaataaagagcagacattagaatgtcattttagcagttataatattgatataatcaatatggctaatttttatacccatcatatattttcataagtcatccatatgtaagaagcaaagaacaaaggctgttttttgttatgtgccaacttcaaaatgacatactaaccagacatcggcattcaaaagctaggttgaacaggactggccttgatgcacatgcagtagatttggtttcagaatagaaaattaaatggtgatgtcagcagt

SEQ ID NO: 241 - DNA, 392 bp, Rattus norvegicus
  Genbank Accession No. AA819356
tttttttttttttttttaaaggtattttctgtttatttggaatggtgacttctccgtggtttccacagttactgggaaaataaataaccctgggcagctacctctgccctaaggtttcaggagttttggagcctggtggtcacttgctcagcaggaggctggcgcgcagcacccggggtacacgtcgaatggtcagcgagacacgggtgccacgcaccaggcgggctccgggcaacgccgactggcaggcagcggcattgggcggcagcgaggtggagtccagctcatctacgtgggtggctgtgatgccgtgaagcagacgtgtgtaagccgtgccccggagcaccagcaggctccgtggttccaccagcagcgaggtaatgggctgctga

SEQ ID NO: 242 - DNA, 422 bp, Rattus norvegicus
  Genbank Accession No. AA819381
tttttttttttttttttgatagtgaaaatatatttatttttttaatacaatagctgccagcaatatactggtgttgatgttccagagagaagaaaatgcaagcattttgtaaagagctttcattcctacccaaggaatcccatgaaatgctccaaggctgtccagcattaccgcctgggagtccaacttttatggcttgggactcaactttttttccttgataaaataatttgtttcccccactttgatcattacaacaatgaactttcagaagtctgtgagttttgctaacaaatgctctcttgctctctctctctctatctgaaccaaatgttgattattgccagctcaagaaactggtgaatccgttacaacacagtgaggtgtggaccaaaatcttcatgaaaaaataatttctactt

SEQ ID NO: 243 - DNA, 554 bp, Rattus norvegicus
  Genbank Accession No. AA819390
tttttttttttttttgtgttccaatgagtctttatttatagacacgcaaatcttcatttcataggactttcgtgtattgtgaaatgtgattttgaaaaccactcagaaacacagagaccattcttagctcacaggccatacagaaacagatggtggggccggacctcacgagcacagtcacttcctaacctttgttctaaatacttctgacacgtatttgctggcatggacagaatgtctacttccttattacgtgagatcaataatatacaattttcttaaggctttgtctaaactgctggtgtataaattttttaagacaaaaatttaaaattatttgtatgttaaaattaaatgctaaagaaacaaactggccaagtttcatttatttcttgacgcaacatctctacagctcacgcacgcagcaggacgcgcaccttggcttcacaacagcaccgggctgcacttgcggctatgatacagcaggggaaggtggctgggaaatgtacatctatacacttcatataagttagaggtggctactccatgaccta

SEQ ID NO: 244 - DNA, 403 bp, Rattus norvegicus
  Genbank Accession No. AA819415
tttttttttttttttttcactttctatgtagtattggatgttacaatttatacaaatgacacattttaggcaaaattaagtgtctactaagaaaccagcgtctctgcagaagcagtcttagataccccagggcaaactaggctgaaacagcatattaacccggtagcaagctttccagattccttattcaatattacaactcccactacataaacattcctgtgccatgcatggacagcagcgtggggtccactgatgtcgcagctactattctaatggccgaacgctgcacctccagttctgccctctacagagtgaatggacgtgatggctggggctccagagtgacagcaaactgcttcttaggtgacaggcttgtggcaaagtgtctccaaagtggagg

SEQ ID NO: 245 - DNA, 385 bp, Rattus norvegicus
  Genbank Accession No. AA819429
tgttttttatttttcttcccttcctaggtgtcccccaaccccatttttaatcaaaggaaaaaatttaaaaccagttcttctgattttaaaagccataatataatgcatttgtagttttttttggttaattatgtttttttaattggatattttttatttacatttcaaatgttattcccttttcccatttccaggccataagccccctatctcatccccctttcttctataagggtgttccccctccaaataatctccctcccccccaacattcacttgcactgggggtccagccttggcaggaccaagggcttttccttctattggtgcccaacaaggccatcctctgctatatatgcagctggagccaagagtcagtcacctt

SEQ ID NO: 246 - DNA, 485 bp, Rattus norvegicus
  Genbank Accession No. AA819441
  misc_feature (1)..(485): n = a or c or g or t
tttttttttttttttttaaatttttaaatttttagatttattttattcatgtgagtgctttgcctgcacatatgtctgtgtaccacctgaatgagtcttcttgtgggtgctgggaattgaacttgggtcctgggcaagaacaacaagggttcttaaccactgagccaacttttcagccctaggacaagtttttaatacttaaatagaatttgttctgataatagactaacagaagggtctggggaacaggtttgcagactctaacatgcaagaactgaatggaaggccaggatgaaagtcaggaagaggatgctgggaaggctaatgagaaagggcatagcctgaaaagtaagatgcagcagaaacacgatcactgctggagaggaaggaaatggctcttgtgagcacaggaggatgggccagtggaccctccagaaatataagacaactggccaagctgacaggctangggaagtttgctcaca

SEQ ID NO: 247 - DNA, 192 bp, Rattus norvegicus
  Genbank Accession No. AA819450
ttttttttttttttttacggttttacaattcatcgaggatttaattaatttttcggtttcagtttacgctaggaactctatatgcatgggttttttataaacagtcatagtttgagggataacagttgcatggatatcaggaagttttcaggtctcatgaactgcgaatgacacatagtttatactggggat

SEQ ID NO: 248 - DNA, 558 bp, Rattus norvegicus
  Genbank Accession No. AA819488
tttttttttttttttgtctgtatcattactttattgcttatgttacatattccaatggataaaatttcgttttaaaaagtaaggcacatgaaaagccttctgtgcaagttccatattatattaacattctattggctaaggagagcatctcgactacagaattagaggcatctagaaaagaacatgatagtttgggagcagaatcctgaaccattattaggtctcacctcatggcacaatcagtcagcaaccccaacgtctgtgttctaacagtggagctagattgccactacagagtcactgaccagagtattcacatatgtacagccaggtccccaagaattagctatacagtcaacgggaagggcagcgtctcactgcagccatgccctgttctagcacaggtaaggaatttggcatcttcagttttttgcatgccgtgctggatgttcacaaggcctggttatacaatgctgaaaaccatggagagatactgctcgtaagacacctgaatccagccatcctgatccgtgtcataacgtctgaatatgtctgtca

SEQ ID NO: 249 - DNA, 427 bp, Rattus norvegicus
  Genbank Accession No. AA819502
tttttttttttttttgtctattccatgtttattctctgggattctcaacaggacttgctttcccgggaagaactggtgtggttccccgtgggaagaggagccgaccaccatgtctaagacactcagaagtacacggagttctcactgttgctgtccctttggtcatcaaatttgcggatctgggccttgaggtgcctcagtttacccttcaggtagtcacagcgagcttgcttatccaggaaaccaggatcagctcgtagtcaggcactgggttggggcggggtcccagatccctgggatgcttctctgggtgcagtggggcccggggttgcagctcatccgcaaacacgatcttccggggcctcgtgcggagctcactgggcctgggctggcattgcggccgtccggcgcggggctgcggacgctc

SEQ ID NO: 250 - DNA, 575 bp, Rattus norvegicus
  Genbank Accession No. AA819527
tttttttttttttttttggagttatttaatttaatttatttatgtaatacagtgtagaaagctatcatggcataagcaatgattctgtacaatcatcctgcagaaaattatttttggagaattcttggtaattggagaccagcagaacactccctccccccacccgtaaaagtgcttacgatgaacagggattttttttttaaatttttttttatcaaagatccaaagatacatggacaaaaaaaagttcaaatcctcaatgcctaatgtgtgcacataaaacaggcacaaagaaatcaatgtgtatcctcgtattcctatatcgcaaagagagcagaagcagcaatctgtacagtaagatgcaatcatggaaaacgaacttttctaaatcatttggaatactcaaaaatgtccaaaatgcatagtgatcaggaaaagaatacttaagagaggagaagcagctaaacgcccacgttcacacgaagcatcccccatcgattttttttaagcgtatttcaagtatgagtttttcgggccacataccacaagaataatatacaacgggctaaggggct

SEQ ID NO: 251 - DNA, 546 bp, Rattus norvegicus
  Genbank Accession No. AA819537
tttttttttttttttttaagtatgcaaaaccttttatttataacagatcaacattttgacatgaaaggaagccactttcgatttctcaggaatgcctagaacccaacagtttgaaagactactcaacaactctactataggtaaaagaaacaaatggctttgcccaaggcaaatttataaacttcatgagttttcactgtgtgggaaagctagcttttccagagacgtaaatgtaatccaagtggagtaaatcaatttatacaacaaatgtgagagtcacgtatatgcatcaactgggtaaggcctcacattgaccccttaagccagtcaccccattccataggcagcactctgtgtcactgtgtagacaaccagccaattccggtgagactgtccatctccataagaccatataaataaaacacatcaatgggaacagcaactgaagtttaagggactaggtggtgagtatccaataataacttaaccaacatcactttcactttagaagggaaaaaggaacgaacccccaaatgtccgaaactt

SEQ ID NO: 252 - DNA, 426 bp, Rattus norvegicus
  Genbank Accession No. AA819554
tttttttttttttttttggtgggcacatgtttattgaccagacacgtgtgaactaaaaaagtttaaaaatcagcaagggaatcaactcccttccctacaagcagacagaatgtcctcttctgcatccagaggctcttgaggttccagttaggatcagagatccctgtcgccctcgtgctgacccctctgttggggcatcgacctcttgaggcagccacctcaccaggaacacctgggatccagcccaggctgggccttgatgctagggcgtgggtcaaggcggtcttctccggatgtccgtggttaccctcagctggtgggtggggacagggtgtcagtgccgaaaagccccatcagctgagcagaggggctgatctgtcattggtcactgttggtttcagatggacgttggcaaagggattcctg

SEQ ID NO: 253 - DNA, 546 bp, Rattus norvegicus
  Genbank Accession No. AA819633
tttttttttttttttttagaacaaaatggttttaatcaattgcgtcaccctcactctcctgggagcagagcaacaaaaaggctcggctcctgcccccagaggacagtaaggcttatgtgtctctccacactgcagggtccaggctaggcaggcgggtgggagacaggaggcagggacgggggaatggcaggtggcttcaacataggaaagcaaagggaccctggccagttctcgagccccagggtctagcccaacactcccgctcccctccctggcttgagaaaggtcatgatgaagagcaggggagcaagtcccagcagcaggagccgcagcagcagctgtttccttcaccaataaatacacttcattaccaagctagaagagaggggtgggaagaggacctggggtgggcatgaagggggagaagctgccacctgtgtctctgagattaaagcaatgagatggtgccagaccccccactactagcctcacccccctaatcttcttaaaactgtgaaaaagcttttaacatggccctcctgtctc

SEQ ID NO: 254 - DNA, 573 bp, Rattus norvegicus
  Genbank Accession No. AA819653
tttttttttttttttttacttctggttttgatcatttatttcagaaaattgaaatatactatactcgacattgttgggcgtcttcaggtcatcccgatgttctcagtttcccagatgctttgtgtgtctgccttgtgctattaattttcctgtggccttgttggtcagatccactgaggcaaatgccagcgttcttccttgcttcagaatatgtgctgtgatcactatttcttctccgatcttagcaggtgacatgtacgttatgttcatgtcaatactgactccgggtgcccctctttctgtgcacattagagccatggtggatatgctgtccacaagggttgccgtcaagccgccgtggagagtaccaaacttattagtgtgctgctcctccactttcatttcacagattagcttttcaggagcagcagagacaagtgtcaccttttccaaaactctatcaaaaccgggaactttgaacataaccttcattatttcccgtagattctgggtcatgttgctcatcgtggacgcaaagcaagagtctgggctctgcgagaatgaactttggaa

SEQ ID NO: 255 - DNA, 531 bp, Rattus norvegicus
  Genbank Accession No. AA819655
tttttttttttttttttaggtttttctacttcttaacattttaatacaataaatacattttgttacctgtctttcaaagaccagcataaatataaaaaaaagcttttaaaaggctgattcccaccaccaccccaccccaccccccaccaaggtatagccataaatcgtgaacagatacaaacgtaaggaagtagagtaggacttgctgctgtgtgcctctcagttaaatgcagcattttcctttcactttgggatgagtatttttaaaccatggtcttcctccctaaatatgtaatatatatttcttaaagctaagacacagacttctataaccataaggtcaaacaaatgtcttttcagcatagacagggcataaaaaggcttctctacgcttctccccagtatcaaccactgatgactgttttccagagtggaggttttctgcacatacaatgtgctttatgtgagagtttgatttgccattcctctgcttttgtttcgctgtgtggtcctggctgtcttgggatttgc

SEQ ID NO: 256 - DNA, 127 bp, Rattus norvegicus
  Genbank Accession No. AA819657
tttttttttttttttctgatccaaacacgctgctttattcatacccggtcaaactggtcagtgcagaacctggggcctactgaagggcctctatcaatgccttgccggccatccacatggggcccat

SEQ ID NO: 257 - DNA, 485 bp, Rattus norvegicus
  Genbank Accession No. AA819672
  misc_feature (1)..(485): n = a or c or g or t
tttttttttttttttttagacccatattaggtttatttaataacagagcactcgcttctttaaataaaatatctcaaagttctagctttgcctcaaacacaatgttgcacccaaacagaaaagcacaaatcaaaccaacagaaagatagttttttttaaaaaattatctccttaggcctctgtctttaacttccccttgttcctatttctatgagagagaccgtaacgcacaggctgaggagacacactgccaacaaggctaatgtgcaccagaccgaagagggacagctcggctttggccagccctcttcctgcaggataccaatcctatgtttgcgtcaatcctgacctgctcagatgaagcggcactcaggcactagtcagccgttgaccatacaagaacagagaacactggagtagacagagctttctccaggaatgctgacaggcgtcnctcccttttgagaagtcctttgctttcctga

SEQ ID NO: 258 - DNA, 456 bp, Rattus norvegicus
  Genbank Accession No. AA819681
tttttttttttttttttcaaggtgttacctgattcgtttattacagaaacagtgaaatacatggacctaaagtgtggcaacaggggtgagagaggccagggcagggcggctcagctggccagccccagccccaaactgacggaaaagccagcagtaggcgcatccctgaggtgcatacccacttcccccaccttgggagcctcaatctagaggactctagagagcatattttcctgagggcccttccgaagggggttgggggggtttcctggggaaggagcctagacccttgaagcagcactcctccacctgaactgctccctcttcaccatcctattgaggtggggaagagactggagccatggggaatgctgtgagggttgtagggacccagcagactggaagagggagttgaatgtcagctgcttgaagaaaggtccacggtgctggcactga

SEQ ID NO: 259 - DNA, 590 bp, Rattus norvegicus
  Genbank Accession No. AA819717
tttttttttttttttttcattttaacatcttctttaataagacattacagcacagtgaggtcccaagtgtgtcagctaaacatgggggtgagaatggaaacaggcttaatgtgaaccccattcctttccacaactaacgtaaatacagaatacaatcagatcagtcccttgctattttatatcacctttgaagacaccaacacagtttctaaacaaacttgtctgttaagataatctccaaattaaattacagagatgtttgagctgtcatttttctccttacaacagatttaactgaaacacaaaataggaccatgctggcaatccccatgctaagaatgaagatccatcaactattccctatcactgagatacagaatgaaatgtgtcttcagctgctcataaaacagttaaatacaagattgaaaatgttttattttgaattacaacagtgaaacgaacaaaaagaattaaactgaaaattgtgaacaggttctaaataaccagtttgttactaaaggaaacatacatctgtgtaaagcacttttgaaagctctaaaattgccttttaactagaatgtcactaagat

SEQ ID NO: 260 - DNA, 517 bp, Rattus norvegicus
  Genbank Accession No. AA819788
ttttttttttttttgttagttatcatcaagatttaatcaacactgcttgagaacagtaagtgtgaaagctagtacagacagttcagcaattcaacacagatttgttattggatccattatgtgtgggccatgttttaggccattttcagagcatgcccaggaaagcaggtttattctctatacgatcccacatgaattcactgtcacgttgaaatgacatccattttattgatcaccacgggattaaaacaagatgataaacctattatctaatgaagaaaccaataagggcaagcgcagcgacagacaaaatcactaatagtggtgatgctgcttcaccgggctctctgacttcctgaaaaggcctgttcctaaaacctgtaatctcagtctgaagtaaaggaaggtggctccttgatggagaggaactgtggctctttggtgatggcgatggagatggagatggggatctgggtggcctcactctctgtgcaacggcacaccttccatgggggtg

SEQ ID NO: 261 - DNA, 593 bp, Rattus norvegicus
  Genbank Accession No. AA819816
tttttttttttttttttgagttacaataaactattctttattatcccagcaatttccagggaaaacagcctactggcttagactacaccatctctgtggttcatgatttataacaattcatctcgttacagtacactctgaaatatttacagtatgatagacttaaagcagagaggaaatcacagcaaaggtaagccttctagatccacttgtgggtcattaagagtatatgcacaaccacacgggagagacaaccagcctctcccttcatatatattcctttttattttcttattttaccttcccaaaacagagacactcaacagtagttagaatggtcatctcccaacagttaaaaagctgcatcacccaatgggtgaacaaaggaagaagtggaaacctaaagttcagctgagccagccactgtggagcctttagtggtgaggtcttccgatctcagtgatgtcttcaacatacaccatcattttagtggaaaaacaattgatttggtgaaatgagattcatttccagacaggttagtaactgcattcactgaatttcacactcttctttgtgaactgtgaagaaaatga

SEQ ID NO: 262 - DNA, 389 bp, Rattus norvegicus
  Genbank Accession No. AA819828
tttattttttattttttgcattattttaaaaaatccatcattaccctggaagcctttagaacagttttatcttgaaacacaggacacttttctcccagtgcacagaattcaagtttacgtggttcagctgaagaagtgtatgtttcgtgtttaagaggacaacagactcaactcatcactattaagagagcagctgtcccagcatcaatgggacaacatcactaacaacttcctgcacaacagcaagatggtcagtccctgtttgttattcacagggacagcatgacaaggagagtgagtgtccccatctgacttaaagcaggctagccccttctaatctctgctgctgagagccaagacgttgtgaggtttaagcttccaatgactca

SEQ ID NO: 263 - DNA, 254 bp, Rattus norvegicus
  Genbank Accession No. AA819840
tttttttttttttttttagggagaacttactagtattatttaattaggttgatgcaaaatcagactaccttctaaatgtgtttaaacccataggtaaatgctacccagttttaattgggaaaagtactttgaaaggtgatggataaagagactcggggctgctcaggacattgagaataagtgacggccatgtactcagccctaaggaagatgttcaagctacctgccctctctaagcatcagagaacaattca

SEQ ID NO: 264 - DNA, 510 bp, Rattus norvegicus
  Genbank Accession No. AA819870
ttttttttttttttttcgagattggctgtctttattactgaagaacactctgtgcttaccaagggatgaacagcttcttatcaatttactgcttcataattcaacacctactatgtgcctttgtcactacatggtgacccatggtgaccaagaaagtttctggctcccggaccatgggacggtaacaaaagtgcagtgagcaaagggagtttcaccatgcaaggacttagggttttgctccacccactgtttactggaattaacatgcactgaagaaactaaagcctttaaagggcagagtggcattgctttttgttgtggtagccctgggtgggagctggtgtgctaaagcctggctaagtgtgagagggttagagccctgctgatcacctgccggctgtgttccctccctttaacagttgagtgtttctgaagcaggacctgagcaggggctgcctcctctctgaggtgccgggttgttgcactgcctttgtcttgttttgcgtcctc

SEQ ID NO: 265 - DNA, 520 bp, Rattus norvegicus
  Genbank Accession No. AA819879
tttttttttcctgctggtctcagcagattcaacatgctgtatccagaacacatggttaagtctttaatagttcctgaaagccattccatgaagtggatcgctgacagggaagtgcatgtggtgcccaggggaaggtgtccaacctggtgtatagtcagcactcagtagggcctacaagagtgggctgaatttctatttctaatgcaggagattaaaaacacaagtgtgagcagtttaaagatagaagaatcacattatgaaaaaaacaaccacaaaaatagagaattcagacccttcccaggtaatttaaaatatctgtttctctcaggttatacataatgaccatagacaagatggtcaaacagtgtaaacgctgggataagagtatcagatggtcaatgggccgaaatcagtggaatttagaaaacacgttaactcagacagacagacagacagacatacacacagacagacagaaagttttaaagtatagcacagtctaatcatcatcagaatcgga

SEQ ID NO: 266 - DNA, 632 bp, Rattus norvegicus
  Genbank Accession No. AA819905
tttttttttttttttttcacttgagaataacacactttatttaactcaatcacaatacagttagttcaaggaagccaaacacttgcccagtaaccaacactacaagcctcagtaaatgccaataaggatccacacgtgtgactatcaattatacagaaccaagtttacatttctccagcttgaatttcttgattagattaaaccatttgcaatcctgcactgccgcagcacctcattgaagccctcacagagcttgacatcgctctggttctgagcacactccagaaactgcttgatctctagagagcaaggtccaaaagactgctggttctgcagcggggctccctgaggctcctggtaagtgatgtcaggcctcgcaggctcagcattagcccctccgctgaagcccccagtgatggcgtgacccagggtgtgccccaccgcagaacccacagccacaccggctgcagtggtagccatctgggccatcaggcctggctgccgaggggcagcagcaggtgagccgactgcagatggggcggcagctgtggctggaggctgagctgctggtgctcttctgggagcagccctcatctgaggggcccggctggccggaggagtcacccgggaag

SEQ ID NO: 267 - DNA, 448 bp, Rattus norvegicus
  Genbank Accession No. AA819918
tttttttttttttttttacagtaaaaccagatatttattatttatactgcatttgtcatttctcaacaatacaaagtagaggcaaatagtaacactccataaaaatgctgaatcccatgtcctctctaagtccccagccctccctcaaatactccctcccaccccttacagaactctgtcctgaataaaacacttaaatacatcataaatagtaaattatgaaaaaaaatagcaagaaactgtttctttccttcttgtaaaaaagaacatggcagcaaagacaggcagccggaagccggctggggcgtctaatatagacagttacgtggggctggctaacctgctgtcagggtgagacgggatggagaaggagctaatgtggtatttccacagctggcctcaaacaacatgcactgccccaccgtaggaccagatgggccgtaactga

SEQ ID NO: 268 - DNA, 412 bp, Rattus norvegicus
  Genbank Accession No. AA848238
gttcctagtcgtgggtgtgctgggtggagtgtgtgaaacacgacgtcatcaaaggagacagacagtattttgactaatatgaagtagagattaatttacactacattgtacatggagtaattcaactgaataaaagtgtcacgggtaaagctttttaacggttaatttctgtcaaacagtagatgacaaatggccgatcttatcagtgtctctcttgagccccccttccccctgctgtccctccccagatggggcgttgagtccatatttaaactggccatcctcacagttgctaacttagcaagtgcttttctttaggacccccttcttaacgagcaatatgtctgacctgtactataagatctttctgataatgcattcggagatttttttggtagatagtagaagtgcg

SEQ ID NO: 269 - DNA, 672 bp, Rattus norvegicus
  Genbank Accession No. AA848306
ggttacaaaagtatttattttataaaacttgtatttaaaatagagcttatctgtctactcacaaatcctaatttaaaacataacacattatccttagctaatctgatgttaacctttacaatcaacactcatttttgtaattttattaagaacctgtactaaatgaagtttttaatcagaaaacattcccttttatcttaaaagtgcttcttaaatgaaggcaccaacaagaactactttcagatggtacagaatttcttatttcttgaagactctgtggttgaccacttcttcattagttacctgcagcaagacaccttcctgccaaaggaaaaaaaaagtatctgaagaagtttatcatgtttgtccaaagaacctaagtaacttcagtggtggttttaggattaaagcagactcactgatgtgtatacgccctgaatatcacatttctggaaaggcagtaaagcctagaaatcagagggcgggcggttttaggaaatttcaatagccaacctacaacattttagggcaggataatgggcaaaaattactaccacattttaacccaattatttagtcagggtacataaagggttttgttgctgctgttgcacagaaatttctactgtccttaacctatcagactcatccctgacaagcaggtaaaggtgg

SEQ ID NO: 270 - DNA, 561 bp, Rattus norvegicus
  Genbank Accession No. AA848354
gagaaggcgtctgcgcggccagcctccccaccaccatgggagtggttgcagggatcttggtacaaaatgtattaaagtttctgttaaaatttgggactgtcagtttttacctcggatacaatgccatgcaggacttcttccctaccatgttcatgaagccaaaccctcagtgtgatgacaaaaactgtaggaagcaacaagaagaatacaagaagagggcaccagcgcagcccacgcaggagactgcgccccaagaggaggaagaggtagttcatgaggacaacgagtggggtattgagctggtgtctgaggtttcagaagaggaactgaagaacttgtcaggtcctgttcccaccttacctgaaggaattacagtggcatacacagtcccaaagaagagagaggattctgtttctgaagtaacggtggaagattctggtgaaagcttggaagatctcatggccaggatgaagaagatgtagacagtgggctggcacctgccgtgtttccttgcttgcgctattactcccttggaattaaacagtcagaactaataaaact

SEQ ID NO: 271 - DNA, 685 bp, Rattus norvegicus
  Genbank Accession No. AA848402
ccaggagtccattacttttaatttatataatttgaaacagcaatctcaatgtttataataaaggactcaacttgaattctaatgaagtatatagaaggcagaggtggttgctacatactgaagaaaaacaaaaccaaaagccctagtaggaagtactttaatcatttttcttagaaaaaaaaaaaaaatccccagacactcaacaacagtttacaacatttcaacaaaaggtactggttgggagtggttaggtttaaatattgggaatgtgtggcatctgcttcattacagatggacggatggcatatgcagtcacaaatgggagatttctagctgcttggccactatcaaaacactagaatgacattttctttacagtctgttttccttcctgctatctccctataccacagaaatgccaccatctgaagccccgtggtggctggctcaggctcattttcccttggggaaggtcactcctgagtctccatgctttcttcttcttctccctgaggcggctcttctgtgttctcttcctcttcctctccctccttcttctcaggcggcttttcataggccttttctgaaggtgtcacaatcactccatcccaggtagatatttcagaagcaagataactgggcgtcccctcctgcccaagggatcttccgaaagcctccgtgggga

SEQ ID NO: 272 - DNA, 558 bp, Rattus norvegicus
  Genbank Accession No. AA848407
gaaaaatataaatgctaaaatatctcatcttcttcatctcttaattccataaaagtcacaatagaaagcttcataaaactgtaaaatactatgttataggaattttagatttcatattggaaaaaaaattattagtaatatattgaaatgttttctgttctttatcattttgttccaccatgttgatcctacttcatttaaaataaaaagatgcatcatttctccaaagttaataaagacttaagagaataaaaataagactacctgaaagtgtgtactgattgtgaaacgtaatgtgtacggatatgttccagccgtgaacttggctgcaaggaggcgactctgcagtcgatgcacattgtaggcctgggacaaagttacttcaggttctaaggattcactgggtgactttagccctgagtttcagtatttgcctaggaaacagaattcaggattcttgtgtgtatccacagagcacaatgaaatgagccaggaataagatagatccaaatctctggtcgaaacacagcctgccccattcacatatattacagaagg

SEQ ID NO: 273 - DNA, 564 bp, Rattus norvegicus
  Genbank Accession No. AA848437
caaacaatagacatttatttttcacttctcaggaggttgaaagcccaaactgctatcaggtttggtttcccagtgcctctccttggctggttggcagctgccttccggctgccatcctctctcggggtgtgaacaaaccctcggggcatcttccgtgtcctttaagtcagatagaagtatgagcctgccctaagaacctcattcgacctcaatcacacccttaaagtactatctccaaaaacacttacttagcatttggggcttccacacctgaactttagaatccagcccatagcaaggaccccacattgtctttctgccatccctctacttgctacgcaccatgattctcagacaggaatgctgtaaacccgatcccatagtttgtaaatatctgttaaatgactagatccatttaagtcgagctttgggcttcagagtagtaagagcctttggcctacacagaatgcaaagtctggaagagaaacaccattttccagctctgaggtctcccatcttctcattgatagttacttggatacggagaatctcccagagtctgag

SEQ ID NO: 274 - DNA, 507 bp, Rattus norvegicus
  Genbank Accession No. AA848470
  misc_feature (1)..(507): n = a or c or g or t
gaaacaagcccattcttgacagactaaaagttaagttaatacataaaatgtcctgttcacttgaaagaaaaatccactttttaaatggacaccgtcctgttttttaaaaaaaaagttgactttttgtttgttctaagtgccctttgtccggaatgttgagactcggttaagacttgggtattgaggtgaanggtggcaggaaggactgagagagtgggcgcgacagtagtggcaaggggcgtttccagcatcacatacagttccacttttctttggggccatgtcctccatctgcatggacggatgcatgctctgcctggtcagcacttcacacagctcctgctggtgctggccttgaacctctctcctccacgggagagctgcgccttccttcacttaagcactcagcatcatcctcctcagcgcagcctgtggggcaaggtgtgagtccatttgtcctccggttttacangcacangagactgttaacgtctactgctgtagctc

SEQ ID NO: 275 - DNA, 501 bp, Rattus norvegicus
  Genbank Accession No. AA848496
ggatagaggtttgatttgctcttgaatgttccagggtggagacaaggagaaagcacaggtgtggaggtctactcagtgcagtcgtctccctcatcctcatcctcaccgtccacagacagagcagcgtacttgcttgcagaactgaacttagaggctcggttctcctcagatttctttggctcaggtgcagatctggagtcttgatcttttttgccgtccttcctatccaactccttccagtggtctctgctccctccatccccaggaccacggctggagtgtccagtctggcctttggtggtgctcaccccatccactttagtttcatctttccttgatggtccttcctcagagggctgagctggagcaactttccctccaccacttgtaggggacggctgctctgtgtctgagctctgagatcgagcaggagggttagagcttcgcttcacccacgcattctcctttggtggaggggctggcattacctttagaggctgg

SEQ ID NO: 276 - DNA, 609 bp, Rattus norvegicus
  Genbank Accession No. AA848508
acatgccagcaagtatttattattattgagaagtggtcaaaagacttacaaggctcattattataaccacatgtatgaaacgtcacttagtgagatagaaggaaagagacatatatatgtatttatattaaaaaaatacacacacgtgcactctctcaagtgtttgtcacacggtgctatgaaggaggcatcaggctatacaagttctgatatacataacacattaaagaatcaagcatttaaaaaccatacttacagttgcaaaaataaagtttcttttctccaagcattttgatctgggctcaagcaaagcaaagcgaataatgaacaccgatgattttcatatgattccacacacattgaaactatcaatatacaagagctaacaaacaaaacagcaaaaaaggaagttgtaggaatgaacaaagcatttcatccaaagtctaacagtctgtttaccccacccctgaacattacagatcataatttatattacttgtgtagcaaggtaagccagaacaaaacaatcaacagaaagtcctgactgccctcagtcggtccaacgctcccctagtgcaacagcatcatttacctgaaggatcatgtgtc

SEQ ID NO: 277 - DNA, 549 bp, Rattus norvegicus
  Genbank Accession No. AA848530
  misc_feature (1)..(549): n = a or c or g or t
cagccattcattttcaagcccccacatgggaaatggtaggggaatatctgtaggaatacaatttattgtctgctcctccactcagaagtagccctgtgtctgtccagtccacacttagaactttgtcttcatgtgcagctaggtcgtagagaggagccttacaacttctcgtatcccatagcttcaccatgttatctaaagagcctgagatcagctgctgatcatgggtaggtgaccacttcactgatgttacccagcctgtatgtgaggtgagggacagcgacaccaaagagccatctttagttcggggatcccacagcctaatgtgcctgtctgtgcttccagacgccaaacgtttacagaggggagaataggaaatacaattgaacaccttatttcctgtcagagttgacttaagacctccggactcaacatcccacactctgactgtgtgatcccaagaggcactgcagacttcgtcagcatctgaccagagtactgaggaaattgcttctgtgtggccanagagggtcaccaagggtgttcttg

SEQ ID NO: 278 - DNA, 467 bp, Rattus norvegicus
  Genbank Accession No. AA848540
gggataaccaaacgttggtttggaatgagtgtgtgcatgagttgggagagtgtgtaaaacaaaacaagcaaaacgtttttgaaactttttgccgtgtatggagtcctaaagaaatgcaaagtgcaatactccctaaccctcagatttgcagtggctcccatttcctctggaacttgaggctgtgctgctccattcatctgtgaagttcagttttattgtgcttgtcgtggttccttctgtgctgtagtgcaaacttaaaactggttcacctgtccctggtttggggctcagcctttcattattgttatcagattgatgatgtgtatggtggccagacgcctcaacaggctgccttggttcactatctggagaagacagcaaagaggtggaacgagggctttctatggcagctgcagccacctgagcctgaactgacccggtagaggacgtagaaggctgaagaagtg

SEQ ID NO: 279 - DNA, 497 bp, Rattus norvegicus
  Genbank Accession No. AA848639
gagagggcaggtgtccttttcccaccatcaacatgtgcacgtagcaaggaagcctgtcggaaagaactggtgctttctgaaggagacaaggactgagggcctcctcagccaagagaatcttcctcccaagttcgctatccgtgtcactttaaacagcatgctgctttgttaagttgctgtcagtgttgcccacctcccacccctcaggggttagaaaagttgattttacgtagtgccatggtaaagccacatttccatgcaatagctgggtgattccccaattcactgacaaatgacttgtagcttcagatgcctctgtgcatcagcgctcagaaagggaggggtctaaggagccccttttttggatgaacgagaaaaggttgcctgaaacagagtagtagatgccacgtgattgactcctcagactggcaaagtccaagtgcaatgcttatgagttgttctgcttctttcttatgcagaatttcatttgtatgatc

SEQ ID NO: 280 - DNA, 466 bp, Rattus norvegicus
  Genbank Accession No. AA848696
caaacaatttttacataaggcaacaactgaagtatgatttcattcaactaggaaggtcgcacttggagaggaagaaaacaaacgaaaaactcctcacaggaaagccaggcgttcttcccaaagcccagagttgacattttcagactttcagtagaaatgtttgtttccatgaaacaaagtcacaagtgcagtccgctttcgaggctgttcccatcccatcgccattttcgagactcaggggacgatgcttgtggctttcctcagtgtcaggtaacctgtgaccacatctgatggcagcctgcgaatgtaggagaattcctcaacagtgctgaaccgcaacttgctctgagggtctgtgtagttggcaagaaggccagaaacatcagaatacttcttagctggcttaaaggatggaggagcatcaatactaaagtagttaggatcgttcagttgccatggcaacgcc

SEQ ID NO: 281 - DNA, 389 bp, Rattus norvegicus
  Genbank Accession No. AA848780
gttaacttcctacagcggccaacacacaggacctgtgcaccgaagcaattaaccttcacatactttgagtcttacttgagagttaatcacacatgtaaccaacaaaggaatgtcgattaaggttaagactccccaaagggaaactctgacagaatttcaggatgctgctagaatgggttggctaccttaaatctcactgatggctccatcagagagaccgccccatctctgctgtctcacaaatgtactggggagggaagaaacaagacagacaacctactgttccctaatacatatggcttagcacccagagaaggtctctgccccggggacatccacatgggtcaagcttccttaaacgaggcgccatctttcatttcaggacaggt

SEQ ID NO: 282 - DNA, 651 bp, Rattus norvegicus
  Genbank Accession No. AA848804
actaggcaaagaattttattaaccttttccaaactttattcccaggcgtcttcagcttaatttgctgcaaagaatgaattaggcttaagcgaaactgaaaagagctgcagtgtccggggggcttgggcttaaaaatattagagatctagattttatcagatccataataaacaaaaaatttttaaaaagcagtcatgatataaaacagcagctcctattgtaacttctgccaagtgtcaccttcttcagaagttgcttcgattcagtttgcctcgttcatagcttcatcaaaattctccaccagatctggaacttcatcatcatcatcctctccagtagcaagtggtgcttttccatccacagattgtttgggcagagcttcagccagtctcctcaaactggtcagactgtctgcaccaagctggttgaggatgctgggaagcatttctgtcagctgctttgtctcggcgtggcctgtaatggtgaaggtgtttgctgccaaagacgcctgaactttagggttgttaaaatggatcactgttccttggtttgtaaacatgttcacctcttcaataccagagatattgtttacccctaacttctttaaggagaactgcagttttttatcgtctgctgtggctgttctgtgaa

SEQ ID NO: 283 - DNA, 616 bp, Rattus norvegicus
  Genbank Accession No. AA848807
attttaaaaataagtttattcatgtatatatttacaagaatatatttaaacattcatcaaaaactaaagagtttttaagaatttctcaaaatcgtttactgaagctttggcaatctctttacaaaatacttcatcaggaaaagatacgaacttgtccaaagacacatagttaggttttgctggatcatactgtgctttgcccaagtaggcaagaaacaagtgtctttctttaattttaaatactcttgtattaaatacctgtgggaacttgacaatgatatggtggggaatattcatcacattgtgtacataatcaaaagtctccgtaagttttcttttgtttgcagttagcatcttagggatcttggtgaccatatgctgaatttcattatgtttaaaaccaagttcaaggcggtaaaccttcatgttttccttcacaggctccagacttcctgttagtagccttggaagacgaacaaccagatctctagtcttcttcacactcagttccagttctttctgaaaaaatcccagtctgttatctagtctttccacggagaagctcaacagaaatggtgcatttttgaccatacaggcaatatctgtcttactgaaa

SEQ ID NO: 284 - DNA, 457 bp, Rattus norvegicus
  Genbank Accession No. AA849003
  misc_feature (1)..(457): n = a or c or g or t
gccggctgacttaactttattctgtaagaaatttagagagtgcaagcaaatattgatattgcatcaaaaatgaatttaactctgtacagcattaaaactttaaaaaccagtgttgacactaacagatcaacaatatctcattttagaacaaaatgctatcggtgtctcttcacagttagatacacaaacagacaatgtgatatgatgtaacttctgaatctccagggagccagggagttcagggagcaccactgcaccagtgtggagttcagggagcaccactgtaccagtgtggctgctgcatactctgaaagtaacaaactacacctgggcgatggagagaagcaatgaaccaaccaagggggagggcgggaagaaaagctggtgcctggggttccagtgtanagtgcattgccttctgctgtcctggtgactcctttgtttgctcggagtgaag

SEQ ID NO: 285 - DNA, 502 bp, Rattus norvegicus
  Genbank Accession No. AA849092
  misc_feature (1)..(502): n = a or c or g or t
agtcttatcaaatgttctttaatttcatagacaatatgaaacatactgtgtaggcacacaatagttttgcagtttccaagtgaacacagattagaatacagaggttaaatgctgctgtactgaccacagctggaacttcagataaaactttatataaaacatacaattcaattatcagccaattgaaaactttactcttctcataatataaaaatgatactttgagatacaaattttcttttactaaacaaactatataaacatttaaaataatcatttaaaactcaacattagaatttataaagattcactataaaaatatatcggcagtcacttcttttataaaggtaccgtaggctacacacagcagtctcgatgtgagatggcctcagtaactctctcagaacctgacagactacggtaagatgattataaaatccctcaggagagctttggtgtacatcttcaggttatttanacattttaagggcgtttgtaaaca

SEQ ID NO: 286 - DNA, 306 bp, Rattus norvegicus
  Genbank Accession No. AA849132
gcctgggctcctcctccctcttctgacgaccaggcattggtcgctgcctatttacagcacaggggggcttaggactctagccccaatactgctatccatcttcacttcatccggccaagtgagcctacaaatggcctctgggccacctccttccagacttgtctacacccatggaaatgttggcccagctgggccaggaaaactcttggcagcccagcactgtgtccctcctctccttctccgggtggaggtctgggacaactgaggaggggtgactaatactgagcacggggagcaggcgccagc

SEQ ID NO: 287 - DNA, 401 bp, Rattus norvegicus
  Genbank Accession No. AA849222
gtgtgatctgcctggaggagctgcttcagggggacacgatagccaggctgccttgcctgtgcatctatcacaaaagcttcatagactcatggtttgaagtgaacagatcttgtccagaacaccctgctgattgacccttctgggcctgcttacggactcctctcaaagggacagccagcccctgttcctgggaggaggctcctcggacactggacagagctgagcttgggacaccagagagaacagggcacccttctgcactggcttccagaaaacggtcctccccgaggacacccagtggatgagagcgagtctgagagaagaatgaattgacctctatccttcccctcaccctcgacccaggagggaaagggcattttctttttcacctttgaaaggcg

SEQ ID NO: 288 - DNA, 359 bp, Rattus norvegicus
  Genbank Accession No. AA849263
aaagggaacattgctgggacctttatggaggaaaacaaaagacgtgtttgcaatttgaaggtcgtgatgattgatctgttttgacattttaaaggaaaagtgctagaggtaacaaggaaagatcaatgggaattacagaaagtcaactatgatttttagttgctagttgccacctctggacgggtgtgcacggagaccgcggtcactgaagagcagacatggccttctgaagcagctgcaccagaatggggtaaactggtgcgaattctttgccttccctgcctctcactgaatgaacaaaagccttcaagggtccccctaaaaaggaggaacctgtccttttcagatgggtgatcatc

SEQ ID NO: 289 - DNA, 532 bp, Rattus norvegicus
  Genbank Accession No. AA849391
acattcagcaaactttatattgcaaaaagataaagaacaactgagacaggtgtttgctttcctgcacaagaatacatctacctgagctcctctcacagctttgctttgcaatgttcacataacacgtatcaattctgacccaatcacaatggcaatttcttacaatgtagatatgaaatctatatactaatctactgaaataatcttcaaaaatttttatctgcgattaaccattaccatacttcatcccaagatgtctctccttttcttcagtgttctctctctggaagctggaatcctttctcatatcatgtaaagacatactaaaagcacaggaaaaaaaatggtcatcttgttaacataatgcccgtaagtctggtgagataatgcccatattttagccttgaaacataaagtcagagttaaagcgtcacttaatccatacagtacattgttaattatccacagtgccccagaagttccctatctggctgatcatctattgttagaccatgactcaatcaagaatgtg

SEQ ID NO: 290 - DNA, 395 bp, Rattus norvegicus
  Genbank Accession No. AA849426
ggcagtccccagcacacttctttattgaatgcaaaggtatgaacgtgtaattacaagacatacaaacaaagagcctatgctgatcccctggggtggggtagtaactacctttcctgggacatgctaaaggcctgctgctcatccagttgtcggccctgcttttaacagggtctgttgtccatggcaaagcagctgcctttttgtctgcactggacagcagcagcagcagcagagtctgcagtgctctcttcccagtcatggaggctgtgggtccctgtccctgcccacatcctgcctctgcttggctgagcctgaaggagggcacgacaccagttagcccggcccaagcctcatctactgcagcccagacttcatcctgcagtaactactgtacg

SEQ ID NO: 291 - DNA, 535 bp, Rattus norvegicus
  Genbank Accession No. AA849497
  misc_feature (1)..(535): n = a or c or g or t
gagttcataaactttattcctacaacagtgggtctttagcacaaaaagtacaagaaaagagagtttcgcctacaagtgcctctcatgggcagggttctgttcctggtgcagactaggaatgttaactcccttggttctaggaccagcatatcttaatctttcaacgaagcagatgatatggaagtcctctggagactgaagccacttgcctagtctcttgagcaaatgaacagacactgctatcatttgacaaggaattcagactcagaacagagacaacaaagtattttaaaaaataattattcatagacttgctaactgtcacttataaaggctagtgcaggcccanagtaagaactggtgctttctgagaaagctgaaaaaggattagaggtgccgcctgcttctaggtacgccctcacttacactctgcatagctaactctggttaaggacatggtgttcaagtctctgttctgggcttggagatctctgtagcctaagagagtatcagtgcatggttgacctgagccctg

SEQ ID NO: 292 - DNA, 426 bp, Rattus norvegicus
  Genbank Accession No. AA849586
aaaagcatcaaagccataatgagatagagaagtaacgccagccaaagtcaagaggacaaaacccgagcaagttattcctgctctcggaagctttcagcctcgggcatccgacaatcctgaagaaaagcaagctggggatgagctcttcatttgatacgggaataagagttccaaagcccagggacgaagttcaggatcaaactgttgcaaactttaagccaggtgctcggtgttgctgtttaaatctcggctcgagcccagacaaaacacaccaagccaacatggttccaccatgtcaccatgtccttgtgacttcaggagctgagaagagcactcttattctgaacaggagacggcacacaggagtggttccgacaatattgtgctagccttccgtgcgaaaagcccctacctctggaacagtgt

SEQ ID NO: 293 - DNA, 667 bp, Rattus norvegicus
  Genbank Accession No. AA849714
  misc_feature (1)..(667): n = a or c or g or t
cacaaaatacaaagttttgcaccacattacagtagtgttttaacagggagactcccaaggtgtccactgggagaggggagttacacaatagtcatttgtgtcactctgaatactgaaggagactgacgaagggtgctgtccaggtagaacatgcaggttattgcttagaacttgcataaacttcaaaatggctcacacacgaagtatacaaacatttcaaaagtttaatgaaagtaccgaaaagacactttctatcccttcaaacaaagcacaaccagacaccaaaccaaagctcctaggttgtattttaattactgatacatcttagtaacactggtttacaaattatctggtcttatgttttgtaaataaaactcagtcttatggaaattattaagcatatcttgacaatatcatatattatagcatcagaaaaaaacgtacatatcactatagcgagtgcatgtcctgcggttcgaaagtagcgtcggcaaataagatctacgttgaaatgttattacaaacccaaacaactcaaaaacttcataatttatcctacttgtaagagtataatctacacaaaaaattccttaaggaaaaagcagacacaatccgcagaaactattcaagcaacanacaaaactacagggcacatttttatttacag

SEQ ID NO: 294 - DNA, 608 bp, Rattus norvegicus
  Genbank Accession No. AA849715
gcggcctttttcagagaattttatttgagtggttcttacaaagattgttgcaatatgaaagtcatttgtttgatagaaatatcaagctgtcttgtcaaacacactgaagtaacccaaaaatatatttcagagctcacagagcttaaaaagagcaaagattatatgcaaccagacaaaacctatttccacatttcctatctcttgcccaagactgttttactcaatctgttacatcaaccaccttgaggaaatgcagggatcattttgtttggaatcttaagacacactaaaacacatagtatttacaaagaaacttttacagatacagtaattgaaaaatttaccatcaagaaatattttgaaatcccccactttccaaatggtcaaggtcaaatgctaagcagccatttagcaacttagacttttcacactccaaaagtgtattctggaaacctttgctgaaccatgagccgaatacatgaatgtgaaatgtaactgctgtgtaaaaagttaagtttctgaaacattaaaacattacctgtctgcctttgtacagaaagcacatttgttcccctagagctattctatagatccttaatgtaattttc

SEQ ID NO: 295 - DNA, 604 bp, Rattus norvegicus
  Genbank Accession No. AA849763
gctcctctgactctaacaacgaaatttaaatagaaaggtctttcagtctctggagtaaatcaccgtttagaaaaataatactttcaaagtaaagcaaaatcttttaccaaaatacttatttcatttttcacattgttctgagacagttcacagctaccttctatccgcttaaagaacattgctcaaattaatacagttttttttcttgcccttagactgcgtggggaaaaaaaaactaagaaaagttagtgaaggggaggttccagaagatcagtgtggcatccacagaacaaggctctttggattgtctagcacacttgacttttaatgcattcataacagccataatcctacggatctggctaggatgctcacaacagcagcccagggacagtaaagtaataaatattatctgcaaagaaaataatttaacttccggaaactatgtttcttaaaaaaacaaccagtttctttagcggcatccttctcgtttggcgtaaatgctgcttgagtccacagtagtggcgcctccttgccgggtagcaggacgcaggaggtgctgagatgccacggacgctgccttggggactccccacagtaaggt

SEQ ID NO: 296 - DNA, 600 bp, Rattus norvegicus
  Genbank Accession No. AA849777
cagaagttcctttcccagacccaggcccctgaggcagagaaagtaccaacctaacatgccttggatatatgctataggtggacagagcagggacaccttcttagagagatgatatggaaaaagaagcccaagacagtcaactgaggagaaagagactaaagggagggaaaacacgttagaacaaaagaaacaaagccctaccacacaccccaagttcccataacccaaatgctagactggaagcaaatcagttcctctagctagaaacgattcctacaaatgacccactgcagcaagtctaactgttccatacatccacacacatctgcctaacaggagcagcccagcaaacaggcatgctcttggccaaagaggtcaggaccattgtgctagtcccttgaccacccaggattggtgggcagagcaagccagagggcatgcaggaaaccttgggactcagaaatgggatggcagaggctggcactgtttaagccccatacacagccaacctgaacagtggggaacagggtatttgcatgagcttccagagcctggacagcaagtgagatgtagggcagcagacccaatgcaaggcctgca

SEQ ID NO: 297 - DNA, 550 bp, Rattus norvegicus
  Genbank Accession No. AA849786
tggggtagacaccacctggttacgtcattctgccccccatccgactccacatgaggggcagatgaggttgaagagtgtaagtagtagtatatacatggcaggggttgaatcgataggtacaagttctgtcatatttacactatttcacatattcacaggtataaaggagccaggggctggagagggggcgagttctggctctgttctcttatataaaaaagcaccagtgtcctggactggacacccactgctacacagggagcagggggcccaaagcctgattgtcaccgactgatatcccgactggagtcccacaacttggtgttgggtggctcagtccgaaggcaggcgaagaaagggtgctgaagggcttcacctaaggtcagccgcttagcaggttcatactcaagcatgttttcaatcagatcgaagagctggtggtggtcctctgcctctgaggtcagataccgccgtagtggtttgcagttctcacggacgtagcgcccagctgaggtgttctcatcccaatccaggcgaccccgataaaaat

SEQ ID NO: 298 - DNA, 591 bp, Rattus norvegicus
  Genbank Accession No. AA849789
acattatatacaggtcataaaaggccacagcagtttttcaatacataaccctttaaaagtagagggcactatgaaggacagacaagtatcaagatgaagtccagtaatgagggtgtatactcagtgcagtatttctgaggagtaacaatgcagataccaacaagccatccacatttagtttacaactatgctatagttctttgtgactctagtcatttatggctccacatcagagagcttcccctgccaccatcagtgtcacaaacataagcaatggagacacttgctattatacaaggtcttttacttggagctctcctttcctgtggggtctccttagagtatactttagtaacttcaaattcttaaatgtgtaatactgtactctctttgaatagtaactcaaaagcattggtttttcactttgaaaatacagtctttaaacctataactggtatcggtagatcaatataaaaaaatacagtaccaagctacactggtatatttccatattaagaacttcaaaatatacttatcactgagaccatagtccttgcattaattttcagtccactatgaacaattatctgc

SEQ ID NO: 299 - DNA, 515 bp, Rattus norvegicus
  Genbank Accession No. AA849790
caaactcaaacctcaactttattccgcaccctcacagtaaaactgtacagtgtagaaagcaaaccccaccagagcaggcgcaaaggctacacccaggaccacgtcactgcaaaggtgacagggtcaccagaggctggcaaccacaaaacagggacaccaagagctcctcttcaagtcccaccacggttctagagcaggttcaagagccctgagatcccagcaacccactccagaaccattaaggagctgccaaggcccggcaaggcctatagggcaagggtgtctttgaggagcctgcgcaaaggggtggtgactgaggtgcccagggcctcggtgatctgaaaggagatcttgtaaaggtagggctgcacgtcccgcaagcccgtgtcaaacacgttgtccagctctgactgagtgggcatcttgggcaggtactcgtgccggctcatcacctccacaatgttgataatcttctcacacagcttctctcccaccttctctctgcagatctgccg

SEQ ID NO: 300 - DNA, 582 bp, Rattus norvegicus
  Genbank Accession No. AA849796
gaaacaattcaataaaccatttatttgcaaataaataatgtatgtctaccacacctaaataaacatttaagaactagtaatactaggatataacctcagtattacattgtaaatggggaatcaaagtccagagttaggatgcccaggctgaggcgctgcctccgacttaactgctaaatcatgtggggagtgatctttgatactttaagtcaacttcaatacagaactatcctttggttactccatacagttagggaacttgttttctacacttaggcatgacccttcaattaaaatggaagattcttattatgaatcaagagactcatctacacggttggaggatccacttcatccatgctctgatttagtctttctgaatggactggtttctaacctagactaagtacaggcctgaaacttcaacagccatcaggaaccatggagcgggccatgaaggtgcttcgaagggccacagactttttcaacctgggacagactgcaacactcgtgccacaccccatatgacaaaaagctggaaaacaaggtgtgtgttttcacttatgtatcaccagatgcaac

SEQ ID NO: 301 - DNA, 423 bp, Rattus norvegicus
  Genbank Accession No. AA849805
aacattaggaataaatcactcattcaatgcaggtgtgtatggggagctgggagcttccatgtagatgagggaacgtgcaggaggaaggtggccagaggggatgtccccactgtccagactatagacagcaacatcaagagagtcacaaagtagccccctcgtgtctcctcccatcttgtccttccagaggagtctatgtggtgcctagaggcaccagggcatctggaagtgctgggctgggagtggagtgcagtgtgtggcctcaaagttgtgcagatgcttccgagccagaaacagcgccagttgcctccgtccatctacactcatgtcttcccccacactccaggggaaatcaggcccatgctctgcctggtaggagcgaagcacagacacacaccagtcctcatccacctcccagcgact

SEQ ID NO: 302 - DNA, 446 bp, Rattus norvegicus
  Genbank Accession No. AA849827
gacttgtcctaaggaaactataaaacctgctggctaaggacagtagctaggagggaggccagacgaactctgtagagaacaaggatgctccaaaaatgcagtgagaacgggagacagttgtgacgcctttcttttcctaaaggtaacggacagcggagcccaatggactgctgtccaccctttccctgctcagttccctatgagcgtaagagtaagggctgtgcacacgtaactgtggtgcacacgtaactgtggtggacacgtaactgtgatgcacacgtaactgtggtacacaccttgcacttgggttgtaaggtggattgatcttcaccaaagtaaaacacaggattatgggacaacactctagctgtaccttcgtggacggcagcctgtgaaagctgcccagaagacaacctgagatcagaacaccaggctgtgtttcgtac

SEQ ID NO: 303 - DNA, 392 bp, Rattus norvegicus
  Genbank Accession No. AA849843
acatataaaagagaagaaaataatatatatgctttaatcagattagtttcatgaacaaataaaataacacattagagaaaaaaagtccttaaaaatagttgtatttatattccacaatttgctcaaatactggttttcttagaaactttctacaggatgtttttaaacaaattcttcacatttcacgttgactatgtacttacggaacttcagggagatagttctgttttaatagcttaatctgtactaatggcatggcacgtgtcacatgcagtccatgtgggattctaacatgacactgagtgagttttctgacgtcgcccatccctttgatgctgaaggcagtgcatctgtggaaagaagggactgcagattggggtcactgctctctg

SEQ ID NO: 304 - DNA, 259 bp, Rattus norvegicus
  Genbank Accession No. AA849876
caaaataagatcttgctattatacaggtttctctcttttgactatatacagaagtgcaaaaagtcaaccttctctctagacttcccaacatgctaaattgcagcatcatcaaccctcaagagtttgcacacacgctaaaattctcctcacgtaaactttgagtatttggattatcaacaaaacgtcccttgttctatttattgattatgcagcttatttataacaaggcctgatattcagggatttcaaaaatattaaa

SEQ ID NO: 305 - DNA, 459 bp, Rattus norvegicus
  Genbank Accession No. AA849939
acatcaatatcaacaacactactgatgaggactgaatgtataaggttggggctctcttgcaggaacctcagaattcaaaaagcagtttctaaggaagcaatgtggggaaaaatctacatctgaagtatttctgaaataaaaactgaaggccaagaaatcaaatttctggttgcgagatgacaaaacatctttctctttctgtttctctctctcaggatgcacaggtaggtatgcacaaacacacacacacacacacacacctatacacttcagaaaacaaggaaggtatcttaataaattatctggattcatatatgttattttagtctgtttcacttggaaaaacagaacaaaaacaaatgaatacaaaaccccaaaacacagaagctaccagttgagagtcacagactgatttccaactggcagtgtaatcttccaacaggaaaataacacctgtgt

SEQ ID NO: 306 - DNA, 607 bp, Rattus norvegicus
  Genbank Accession No. AA849965
aaattacagggccagccagatattctgataagaaattcacttttcctcaggagaaaggaaacacttccatgtcattaacaattgtatacatctcccactttttttaagggttaaaataaaaaaatcacattaagtaactgccttaagtaaaattaaccctttacaacaccaaagaaaccacacccaggataatcgttctggtaataggaacctaggaaatgatcacactttaaatgcaacttttcaatcttgaatgttttcacattgttctgtttaaaaacaatccagagccttctctgccttcctcttccagtgcgttcattagtgacccagttctctgacacatggcacccatctgccacagcaaggctctagtactactctgtgtttgcccaagtggaagctgcattgttgcctcaagttctcagagctggctaggcaacaagacaccccttccattcggtgtaatggctgctgtcaccagatcctgactcagcgagggtggcaaggactgggtcacttagctcagctgagtctgcttcctacccagctgaggatttccttgtccaggacattgaatactttctctatctctactggagaacat

SEQ ID NO: 307 - DNA, 590 bp, Rattus norvegicus
  Genbank Accession No. AA849966
aaattcaattggctattagaactattaatgattctcaaatgttacatgccattgttgtagtttttaaccaaagcattaaagaagtgaaaataccagagaataagacttttcagactggattgactgggaaaggcttggataaaagttaaaataatcattgataatttcaaatcaagtggccctatggaatagtaattcttcatgatggagtccacaattggtcaatgaagaaagcttgttgcagatgattgagagcgatggagagatagaactgcgtcctaggaagggagtcctggacacctcacttctctggggacctgtcacctgcctccttccttcgaaggaggatgaatatggactccactgtaccatcaccgctctgctgtgaaaagcagaggaaggtggcccagaggaaaccacaaagtcccgtgtatgctgtcctccagttcacagggacaaggctgaagttggtcagcttatatgtattccagaatttctgcctcaggtccaaaaatatgtcatcctttccctggagaatgctcataccgacgtagaaggcaaagagggctactggccctccgacagtctga

SEQ ID NO: 308 - DNA, 513 bp, Rattus norvegicus
  Genbank Accession No. AA850038
ggaatataacacacaaagactcgaccaaacagttcagttattataacttttacagtatacagaaaggttgcacttaaaaaaaaaaaaccttcagtttttttaaaaacacaaagtgtaaactctaagatactgaatcaatcacgtcacctataagtgccaacagtgttattttgtcatgctgatttcaatggtactttttaaaaagggggaaatatcaacaattataatacaaagggcttgcatctatacaaacagatataggattcataacaattcaagaactaagggggggggacccaattcaaattacaaaagttcactttttattcaaaacctcagcttgtgtcttggacacgttccttggctgccaataaatgccacagttccttctcttaaaatattttttttaaaaagctaggtttgtcatggtatggggtgggggtggggaagctaagtgttgatgtgatccctccagcttgctaattagagtgctcaacttctcctaaaaaaaaa

SEQ ID NO: 309 - DNA, 500 bp, Rattus norvegicus
  Genbank Accession No. AA850076
  misc_feature (1)..(500): n = a or c or g or t
tgcagtgtcttcagaggcaagcaggtttgctccagcgcccaagtttgttttagaccgtttccagttcacacagcctaggtgtaaaagtgcgccagagtctttgagagctggggacacaagctagtccttatccggttacccatcccccccccattgtcttatcgttgacgttaaccattctttaagtctctgcctcccaagtgctggggttaaaggtgcgtaccaccactgctgggctgtccaggttctatttaaatacaggaggacacagactgatgatcatgagagctacctgagacccgagaccacgtggcacttgctaagtgcanaaccaacccttgctatcctactgtttggttgaagcagtaaggatgtgagatgagtttagaaggtggtaactacagcagccaagccgttagctcagtggtgaaacttttggcccatatttctttaactgcctttgcagttgtcattataaagtcataaggcccagcagtgtc

SEQ ID NO: 310 - DNA, 503 bp, Rattus norvegicus
  Genbank Accession No. AA850164
aggatgttaacacaatataggtcatgcaagagcccagtttaaaaaaaatactaaaaagaatgtaaggactgataactggtgctgccaattaaagattgtcaatcaatttatcaccaaaagtgctatgagaaaacatttgagtctgacatggttgtagtgatccttcggatttgtgcctgacattgacaggtagctatctgtgttccatgcctcagaggagcagagtcctctgtccaaaacagccatcaaccccccaccctctcacagtcagagggtgcggtggctctcggcaccctcagataacctcgagctgccaggcccccgcaggggtgaagggcgagcatttggtgagcatcagctgacggtttccaggtttccactgggaaccttgaagttttcgtaatgaaatctgtaggacttgcgagtcatcctcctggacctgacatgtagtgtgacatctggggaagggtttccaggacaatgaggatgcatttgaacagaaa

SEQ ID NO: 311 - DNA, 419 bp, Rattus norvegicus
  Genbank Accession No. AA850195
cccaacacaaacgggctttatttcaaccagacaagtgagttcttccattagcatcagcttcttcaaggctcaagggtatggaaaagaagggcggtgctccacaaggtagagaggcgaagactgaccaaggagtaactctattgcctttcaaaaagcccttggaagggtaccctcaatccaaaagaccattagctctcctgttacagtttgtgtacaacaccctcatttgaaagtgacgcgtctatcttaacgaaaacatcccagaatgtccatagatgtgagtgtatcataaattatatctacgttttagaaatggaataaagtaccaatctcagtttaaatactaaaatagaaataaaaaacaaaaaaacaggctttaacgttattacttgggatgtctcgttacacccttcctaggt

SEQ ID NO: 312 - DNA, 524 bp, Rattus norvegicus
  Genbank Accession No. AA850244
  misc_feature (1)..(524): n = a or c or g or t
gtaaagccattcagatggataactatttaatttcttaaagacagttgtaaaggtctctctctgaggacaatgacttggtaaaactggggcacagccagtcccagacactggtcgtggctacagtggctttttgggctcaggatcaacacgcatcagagtagactgggccaacatgtggtggcgtgtgcaaacaggctgccctagaccagcccaggccctttgacagcacgtcctctgcaccaaggcccctcccttctggaagtggaaaacttcacaaggaaattggagccatcttttatcccagaagcctttgctgctgccagggcaagtgggctggtgtggactcttgtttggggatgtttggaggctgaggttatatcactccttagctagccaggcctttagtatctttgtaaaaagcatgtatttatagtgttttagattttttctaacttttgtattttacagcattgtnacccattgttaaagagccatgttccctcttcttataagcgccttctaat

SEQ ID NO: 313 - DNA, 511 bp, Rattus norvegicus
  Genbank Accession No. AA850247
gggaaaccagctcacgtttaattgtgattttaaaattgtacaagtttttttacatctgccctcccaccccatgtgtcgactcttaaaatgacagaaaaacatcaccaatcacaggttgaatggtttagtaagtttaccccttcagttcctatatgaagcacccagtattccttaaaacacgagtctgacctggcagtggccaacagtaagtttcatcttcagagttgctatgatgcagtggcacttgtccagaactggtaccttcccatagctggggaactttaaatgtaccagtgaaaaaacctgtttccccttcaaggggaacaaagaacatgactcctcagaacccaaccagtttggctgaggtctatctgtcccatctcttaggctcctttcccccattcctttccttttctgcagcagagcagtaaagaccaaaacctaacctgagttacaaaaaaacaagacagtgatggctatagagggagtgacatggagcagctggcgtgct

SEQ ID NO: 314 - DNA, 428 bp, Rattus norvegicus
  Genbank Accession No. AA850364
gccagtgctgtgcatgacagccgctgccactgcaggagagcgagtggaggatagctcagcctgtgcttccgagggtccccagcccaagctacatcttcaagagtctgctggctctttgtccattcatgttctctgtcgaagatggcttgtgggtgagctctggaggctaccagaagttgctttcctttgtaataaccgcttgccaaagctgctgggaactgtcaggggaagagaagggacatcaatgcaaggaaaaatgtagagatgagccaagagaaaaatgagcccaaggtactaagtctcagtgaggtggcgctggagacagagtctggaagggtggctgggatggatggtcctttccatctgtggctgggcagagccaggtttctctctcgtgattcgaggactctgaaacccctgtcctgaga

SEQ ID NO: 315 - DNA, 492 bp, Rattus norvegicus
  Genbank Accession No. AA850378
acagtggacgatgggaagaatgtacaggtatcttctttcaataaagtataaaaatctgtttatatacagtgaagtataataatctttaattgggaaacgtatttggtactcctgatctgtttatattaaaactgtgggggaaacgaatatctcggtaagcgctacatttccagtcgatcgcacctggcacggaaagcgtcattgcatcttaggtcctgcttggtattataagagactaatttgaagtcctaggattcaaaataaacatcatttggaataatagatatatacatcaaaaatacatctagaaaggcattggttagtgctattaaaaagctgtgtgctcatggggaaggtcagtcgaaagttacctggtcatattcttactcctcatctccactgtccatgtcaatgtctacttcctccgtgtccacggcccgggacaggatgtccgccatgagtgcttcctctagtttctttcggacttgttgg

SEQ ID NO: 316 - DNA, 438 bp, Rattus norvegicus
  Genbank Accession No. AA850402
tttctaaattggttttatagaatttgttctattcgttgttcctcaagaaaaattggtcttcaaaatgaccaccaagatatcttataactaaatacataagagaagagagaaggaaaaactatgaagcaaagtaagaagctgtgaggagagcacaggcagctgactggtttactaaggaaatgtagaaactgtaatatagccccggtaagattgcatgagagaacttctgcttagtaacaaggctaattttaggttgtatatcatcctcggtgtttaacatgagaagcaaggaaggcattctttttacagtgatttaaatttgagaatgaaaactgttcctacctcctcacaagggaaaaaaatgagagtagacatcctctggttcatttggctatttgacagaattcttaccctatcctcagcctcagttaggaaatg

SEQ ID NO: 317 - DNA, 294 bp, Rattus norvegicus
  Genbank Accession No. AA850450
ggctctcggggcaatgtcatcttttcaatatgaaaaaaaacaaaaaagccaagtttaacacaaaatacaaaggtagggaatgaccaatccaaggaacaggagggaaatggcaattaaagtgtttctggacatttagagaacaaggccttgctgccctgcccccacaaatccccatgcaacgtcccttggcgaaccaacacagggaaaacacctccaatggcaaatttggctcaggacagctaggacataaatggggataatactgttaatacctctcctgaggccgaaagatga

SEQ ID NO: 318 - DNA, 422 bp, Rattus norvegicus
  Genbank Accession No. AA850582
gaggttacctctagcgtcgaaaccagagccagctgttaagcagccagaacgctacagtaattgaatacatgaccatttctcttttagcacgctctttattctcctcttccagaagttgtagacgtctgtttaatttgattatctgacgtctcaatgaagccgcatctaccacagacatgtcctctgacgctccttcaacagctgcatctaggcttgaaatgccatacctgacgttgtcatgatgaggattagaagtggcggcagctgacccaccacgcaacacaggtatggaatcgtttctgaccaactgtccattctggcgaacagcattttcactcatagagcgttctctttttagcctgccaactgctcggatctcttcgctttgaggaattggaggtggtccttctaaatccaggaaa

SEQ ID NO: 319 - DNA, 330 bp, Rattus norvegicus
  Genbank Accession No. AA850634
gcaatgtacttttattggaggccatttttaaaatttaatcggagacttgaagcgcgctcagatgctcagggccacggattctgcagagtctcccgcctatgtgcttcagctcaggcacatcctagaggaggggttcctctgacatttttaaagtctatttttagggttggggatttaactcagtcgtagggcacatgcctagcaagcacaaggccctgggttcgatccttagctctggggaaggaaaaaaaaaggcaaaataaaagttgtaaagtcgggctggaaggatggcttagtggttaagagcactgactgctcttccagaggttc

SEQ ID NO: 320 - DNA, 451 bp, Rattus norvegicus
  Genbank Accession No. AA850686
gagaaaaaaatacatttgacatagggaatccaagtatgaatgccttactgctaatagtctgattcagctgtgaccgcaccaactcggctcataccaccccggaaccagggttcattctctgttaaccacttacgcgagaggccagtcctctaaaccttacaagtttatctacattgtaattgagcttaggaatttcaggtacccaaatagaactatgtatgtacaattctgctttattgcacagggtcacaatatatagcaagtgattataagaccaaccacgagataaatgctgataggcacacacatctgtctctaaccacaaaagaagccgaacaccaatttgccacaatgcagaggctgtgttgactctgctgcagtcctgagggttcacgggactgacatgtgttaaatgcaaaactcgtaggttcctggtgacatcacataagac

SEQ ID NO: 321 - DNA, 581 bp, Rattus norvegicus
  Genbank Accession No. AA850733
cagagctggggactgaacccagggccttgtgcttgctaggcaagcgctctaccactgagctaaatccccaacccccctgtgtatctttttaaaaataaggtatggtggtgaacacctttaacccaggacctggaaggcagaggcaggcagatctcttgaggccagtctagtctaaaaagattgagttccaagaagccagggttacagggagagattttgtctcaaacaaacaaacaaacaaacaaacaaacaaacaaacaaaatgaaaagaagagaacaaggggacaagggggtttgggtgatgtcccactgctccagctgctttcagcttgaggccagtaggagaatgacactaaccagaaaacccagatttagaaccgcaatgagaagaaacacctacttttggaactcccactctctgttgtccaaggggcacacctgcctggttttgagccaccgagagatgcagtggaaatgaaaagcgtgctgaaagagaagacaagggttcccacgtcatcatagcccccgctgccaacacctaccacagacggcagtgaggacgatgacaacaggtctgagac

SEQ ID NO: 322 - DNA, 425 bp, Rattus norvegicus
  Genbank Accession No. AA850812
tttattttttttttccaataaaacatttttattctgtacaatatatatgtgtatttaaatatatatacatatatatatatatgcagagaatcttcaacaaatccctgagttcacgggaacccaggatgctaacaaaggtaaggaggagtccatgcctagaacaggaaataggacatccttccctttcctcctggttcccggcaacagagggaaggggtggtcactacaaaatactaaaacaagaaaattttaggttaagagcacggttggggatgaggaccccaggatgcacatactgcattaggtcctgtggctaccacactatttgatgtagcacggaagccagcataactgggggggggggagaatctgacatgcagctgggctttggtgggccaagtcatagcctggcgaacccatgcctg

SEQ ID NO: 323 - DNA, 551 bp, Rattus norvegicus
  Genbank Accession No. AA850885
acttttacgcctgtaggaattgcgataattatagtggcagatgtaaagtaggctcgggtgtctacatctaggcctactgtgaatatgtgatgtgctcatacaataaatcctaggaagccaatagatattatggctcataccatacctatatatccgaagggttctttttttccagagtaataggtaactacatgtgaaataattccaaaccctggaagaattaagatgtacacttctgggtggccgaagaatcagaataggtgttgataaagaattgggtctccacctccagcggggtcgaagaaagtagtatttagatttcggtctgtaaggagtatagtgatacctgctgctaatactggcagtgagagaagtagtaggacggctgtaattagtacggatcatacaaagagaggtgtctgatattgggttatagcagggggttttatattaatgatagtggtgataaagttgatagctcctaagatagaagacaccccggctaggtggagggaaaaaatagttaaatctacggatgccccagcatgggc

SEQ ID NO: 324 - DNA, 276 bp, Rattus norvegicus
  Genbank Accession No. AA850886
aaagaaaattttattcaacatacaacattttccagcaaaaaggcaatatacaggaggattggtgtacactgctgctacagaaacaaacagaagcactgggggtggggtgggagttatgtttacccctctgcaattaactcacaattacatgtagatttaccatttccagtaagatttgcgtgaatggatactccatttggtggggttctgatatgtcccacattttggcgcattctgttttcaccttttttctccattggaaattgagacacacac

SEQ ID NO: 325 - DNA, 496 bp, Rattus norvegicus
  Genbank Accession No. AA850916
caggatacaggcaagctgtcgtgggttttagagaagactatttaagtgagaaggtggtcgctatgacaactgcagaaacaactgtagtttctcaaagctgactcctgctggttctctgaggaaatgcaggtagaagctgatctgtgtatgccacagcattgactagatatctaatagggtctcttctcctggaggcatcgtagcctgggactccttagctacaagggacgctgccccaggtaggacctaagtactctctcatttcccagggcctggttaacccacgggcaatagggacctaccaagatcacttgtctattccaaccctgactttattccatcctgaccctagcttcccctagccttcctaaggggctctagatcaccctgatatgtgggtaaatctattaattatccccaaatcgcatcatcccttacctttaacaacatcctggtacttttttccccacctacatatatgcgtgcctcatcaaac

SEQ ID NO: 326 - DNA, 617 bp, Rattus norvegicus
  Genbank Accession No. AA850917
gcaactgcaaaatatacaaatttctgaaaggcgcatcctgtttaaaagcttgcatagcttcttcccaggtcttcgacagagacaattacacggaacatgaagaagtcatcagtcacacattgaaagaaggccccaaaccaatgaacaattaaacccaatctatacagctttctagttttaggctcccttatacatattaaataaataaatagcacatctgctatcaaaataataaaaaaataaatttcaagtattacaaatgaagatatcattggtgtggttccaacagtttttcttctccccataaatcaaggatattgcccattgttgaaggaaaagggagaaacttaccccaaaaaacaaatatgcaaagttaaaagcattggtccccattttatcttgttgttttgggtaggagagtggaagttctgtgggtgctatccaccccatccatcaagtcactggctttcagaggaagccacgttccactcgcttcaagatctcctgggcctgatcttattcttcggtgtccacagaatgtgaaaccacattgggcaaagccttgtcttgatgacctgacttaagctggtcacacatgaccacccttgtctcagcct

SEQ ID NO: 327 - DNA, 655 bp, Rattus norvegicus
  Genbank Accession No. AA850919
accttgtgctatagagagaacttttattcaggcatgttattttcacccccaaggaagggggggggggattcattaacactctccttttgtttttaagaagtattaagttcattctaaggcacggagaattcacttctctcctttgacctttgtcattgttctgttgggtcacagcttactgctgacagggtgtggtaattcaacaacaagtttcccaatatttttccccgagtacatatagtcaacagcctgaaatatggactccaggccaatgaacctcccctctggggccaggtgtcccaggtccacctcacacaccaggtccccacgagtgtacagctgtagcaagtgttccatggcagcctggtacttgtcgaagtagtggttcaggaagaaacccctgaggctggctgacttcttcaggagtttggccggcaaagctcccgctttgactggtgaaagtcctgtagggctttggtaaccagagataaacccaattactatcaagcgccctttggtggctaaggcatccacggccaggtcaaacatggctcccccaacagactcatagactacatcaactccttcagggtactcctgcttcagaactgtctccacgggctctgttctgtagttgattggccgatcacaccca

SEQ ID NO: 328 - DNA, 423 bp, Rattus norvegicus
  Genbank Accession No. AA851017
tttaggttcacttctaagttatgtaaaatatgtaatgtcacaactgagaatgactttctgattccgtcaattttttgtaacacatgccttatcacgatgcgtcaataccctgtgggacagtaggtcttcctgggacagctgatggtgaaaggaaggctgcagctcgttgtgagctggctacgactaggagttagtcacagaaggttcaagttaagccatgtcttcccagctttaggtcctacgcagctcctcactgagagcttcttggcagtgaactgtattatgtccttaggtttctccagcacatcatccacatctttccccgatggctcagacgcactatcctccactgattggtgggatgatggcaacttcgtctccaggctgaagcaggagttgttgatctccaagctcgacatactc

SEQ ID NO: 329 - DNA, 481 bp, Rattus norvegicus
  Genbank Accession No. AA851029
atagaacaactacaaccatattaacaaaccaaaagcctgtgcacagaaacaagacaaggaaaacaaattgagatgttaacacagtctttgggtaatgaaaatatgggtgagtttctcttctacatgtccatatcttcaaggctactagaatggtcacatactgcatatataagcaataagggcagcctactagaacactatgataaagacccctcaaaggaactgagaaaacacacttcactgtaatccctccaccactgccccactattccacacttttccacatttcttcctgctgttgacactacatacttatcacggacaacctcacattctcacccatggtgcacagatccaggtgttaccagaagttcattggaaatacagcttttctccacctcagttcccagttttctttgagtatgccttacatttttgatgcagagtacatacataaagtttgttacccaaacactgaaga

SEQ ID NO: 330 - DNA, 438 bp, Rattus norvegicus
  Genbank Accession No. AA851050
gatgaagtacacggaagttagcacacctgacggatgactatagcagctaatttttttttttttttttctgtgcagcccagggtaagctcaaacaactcaaaatcctccagctacagcctcatgagcgctgcagttctgggcatgcgtggcctctcccggcctagcttgctagttttatatgatggtaagtctccatctataaatatgcaagtgtacagaatacatgtgtgcttttcgacctggtgtttctgtatgggaaagctgccccgagaggatgctacctctgttcttctgtctttagtgatgtttaaatggtttgcattattttcatgaaatgaagtgcgttaaggttaggagactgaggctggtaaaggagaagtttcctggagatgactgtgtgcaagagggaaggccacccaagggcccttccttctgagt

SEQ ID NO: 331 - DNA, 498 bp, Rattus norvegicus
  Genbank Accession No. AA851161
ggtaagaacagattacaactgaaatagtctcataatagtgtggcttggattgttaggtatgcacgtctgacagtgctgcctcttcgaaatccaggaaacacagcagagtctccacggtacaacatcatttaatggtcagagacggttgtacagtattagaatcagccacagagctgtgtgaggacaggatccagtcctctcccacagcaggcaagcacttactggacaagagctggcatgtggctgggcccacaacctcatcccgtgatagctcccagctcccactcttcctcaggggagggtgtgcaccccacatgcaagaagaaccttgcccttgtcaggtgggatgggactatgagtatggtcaacgggaagctctgtggaagtgtctgacaaagctcaagggcaagggttaccccagctcgccaactcccagtggcgctcactttcccagcttcttcatacgagcatcaatgctggcaaaattcccctcaactg

SEQ ID NO: 332 - DNA, 412 bp, Rattus norvegicus
  Genbank Accession No. AA851184
ggtgacgccagatactttactcatctcaggcagtctggactagttcccctcccgtggactccagggtaacaccagaactgtcctagaccatagctgtcctctctggcggctggaggtaggcctgcagggcacggtggaggaggaagcaggtctgtgggtggagggaagcaggtctgaaggtggagggttccagtgtagttgtggctcatcctttcctatcacctctcatcatggttcacagtgttgcttccagggacatctacctagacaatggggtccccaaatgtgcaggcctcctcaatggcgaggttgtagctggaacctgtccctcccttataggtgctggtcacaattctcatccagcctcgctcaccccaaggctcgccccatgaattgcggacaatccaatact

SEQ ID NO: 333 - DNA, 405 bp, Rattus norvegicus
  Genbank Accession No. AA851192
aatatgtctgagtcagggctcagccttcctgcagtccagtttagtttaacagcctcctcactgaggtctgggctctggctcctgacggctccccttacagcagcacccgaggagtcccattgggagtagctccagtcttcttgggtaaccgactctgggccttccgagatttcaccatcttcatcctcacctcgaagacttcatggatggccttccggaagcagtggaaattataatcaataaggccttttctttcaaagctttcctctctgacaaagcaaacgagcgccaagaactttgtgacctcttttagataaagaaccgttgtattattcagttttataatggctgtcgagtccttgtcatacggggcgcccgctccatcttctttgagggcataaatac

SEQ ID NO: 334 - DNA, 465 bp, Rattus norvegicus
  Genbank Accession No. AA851202
taaacaaaaatgaaattttacctcaaatatccaatccaataatgaaatctgaagtcgctcacctcactaaattacaagaaatttgaataacagcaacaaaatggcacataaaatgaagtttgccacctgaggcagattaaaacaagtaaaaagttagacaaatgttacaaaataacctttttaatagccagttgcttgttccaaggactcttccacggaccgatggactgagtttgtggtcctttcccccaaagtcctctgttaagcggcttgccgatccatctaggtttgaaaagaaagaggttcagttactttccactactacaaaggcaccaaagtgcgcatggttttggtttcagtatcaggcatgtacttactaaggctctggtgaaacaagtgggttacagaaggttccacctggccattatcagttttaaaaggcccaaatgggagtttttccaaagc

SEQ ID NO: 335 - DNA, 526 bp, Rattus norvegicus
  Genbank Accession No. AA851214
  misc_feature (1)..(526): n = a or c or g or t
gttgaagtttttaaatgttatttatacctgttacattcactctcaccctcaatactgatgacagatgtcagaggcaaaacccagcacaaacatgaagaccacaacactgagcatccctgtgctttcagatacagtaagcattcagtgtacagtagtccttccttcacactttagtaagacgctgatgcagtgcagcagtctgcaaagcactttcacacagtccgtgcagaagacatctgattttttttaaagttctgtgatacaaatgattaaaataaatccaggatgaacaagtttcaaaacgcatagtgttctgtgcatgagtccattttctttaaactctgaaagaaaagtggtaagaaaacaagaaaagaaaatagctgctgcattctctggtcttctccattgctggtcaatgctcttatttactctggcatgtaaggacggatgtgatcctctatggtgccaactgcccagtgggtgagctgttcctgcggcaggtanaggcagatgctgcataacttga

SEQ ID NO: 336 - DNA, 527 bp, Rattus norvegicus
  Genbank Accession No. AA851230
aagtcactacccaccaggggtttaattctttttatgtcagttcagaaaggggccatgctttgtccccatccaaaggaaaagatctgcagggcaccctgggaatgtccaaacccagaaaagccaaggggtagtccctgagcaagtagagaagtgggtcctggggctcaggccgcctcctcctcttcttcttcactctcctcctcactctcatgatactgtctgtgattggtgttgacaaagaggtcagaatcatcttcagaacctgacccttctcctgacagctgtggctcagcggggagttccggctgactctctctgttcacattgttttgtttctcagctacctcagaaaaggcctcaggccagtgaccctccttctgtagagagcggacatggttcttgcagagcacaaaagagatctcagccttcactttttctccttcttcaatagggtcaacaatgaggaagtcccctctcttgatccagatgttcttgcggtatttggagggcatgctcaccaggaagcg

SEQ ID NO: 337 - DNA, 494 bp, Rattus norvegicus
  Genbank Accession No. AA851233
tgaacgttttcgaacaatggcacaaataggtagacaaagctaaacaggcagcagggcttacattgtaagtttatagttaaaactacggatgaacatttcagtgcaccacaattccaaactgcaacgaagacggtaggtactcggggatccagctgaggagagatgggtcactgcagctgtactctgtaagcacctattagcaacttcaccttggcaaagggtgcttccgtcaaccttataaacaacttattggggccagcaacagggctgaatgaataaacaaagtgactgtccagaaaaacaggtagctggaatttatcatttagcaccacggcttgcacactgcatggtccacaaagccgagcaatgacatctttacccaagaagtttgcatggaaaatgaagaggaggacaccagatccttcaggcatgttctgagggggcatgtaattgaaatctgttgagaaatcgggccactcacagagccgatgaca

SEQ ID NO: 338 - DNA, 494 bp, Rattus norvegicus
  Genbank Accession No. AA851237
  misc_feature (1)..(494): n = a or c or g or t
ctgtttgcatcaccacggagaaacagaaaaggaactattagtgcacagaagagagatcccatgaactgattacctcccactgggccctgtcccttaaaagttctgtcacccaaacgcctccatactaaagaccaagccttctgtgtgtgagctgttgggagacaaactacagccaagccacagcaataataataatccttgcttataaatagggcttaattatggtttttaaattacgattctcgttgaaatgcagcagatgtgggtacaggagaggagaaaagagtctgtcactctctgaaggtgtgagtatatctgtcaggatccagtcttcatgtaaaccaagagataggcagtttccctccaacgatatatgtgatccccataggtacactggacatccttccaggtcacccaacaaacatgtgaatcattgaagcagaaccattctccatccacgggattccggatgtangcacagtaatgaccgaagt

SEQ ID NO: 339 - DNA, 579 bp, Rattus norvegicus
  Genbank Accession No. AA851238
aaaagaattctaatttgcatgtttgcagtctgttctggagaatcagggagggtcccatccagtagggaggggtggaaagaagtcctttcctccagaaaagattcttgagagttgccaggaactcaaagtgacagatgccattcaaatacatcataagggtctgagcacagtgctggtacataccagcaatcccagtactgggaaggtagaggcagaagaatctaagttcaaggccagcctggtctatacagtgggctccaagccagccaaggtcacatagtgaaacccactttcaaaacctccacaaggccttgtccccctttcagagtctaaacagctaaagaacttctttcccctactcagtctggtttgaactttgattccttgataaggggcctacaggggcaggatacagagagcaactttgacaatgttacaagttttctctgtggaaatgaagaacactcccaggattccaatgttaactaaagttccaaggttaactagagatttccggaagggggtggtgcaagttaatttatcagttttaaatatctacaaagtgccaggatctgacac

SEQ ID NO: 340 - DNA, 567 bp, Rattus norvegicus
  Genbank Accession No. AA851253
cagtcttataaacaaaactttattaaatggtacaaaagatcctgtgggagacaggaccaccaaccgtgcctgtccagaacaaaagttggctgacccacaccttgcttttggggtgatggctggagactcctgggaatgtagcctgcaaaaacaactcaatttcagaatcactcctacatggactaatagcattctcaacatttagagatatcttcagaaaaccataggctcaccactagcaatctgccggtaattccagctatttaaggtgatatcatcatttgatatctttgtttcagagtaatgacagctaatcactgtacagaccaactcacctcagctgctgtcaacaccatctgcagtcccccagtgcgttctcaaacttgaaagggacaccctcatgggaggccatggctgctggcaatcttccaccctaacttcccaacctagaaagcacagcagttgttaaagtccagaccaagttaatcctaaacaccagccactagcgtgggcttgaccgcagtcagtcggggagaagttatcgtcagttatcgactctgacggcac

SEQ ID NO: 341 - DNA, 638 bp, Rattus norvegicus
  Genbank Accession No. AA851255
actggaactgagatttaataatgcaagaatgaaaggacctctaacagtgactacagaggtgaaggaaccctaagaactggggcaagatgcagcccaattctgactcctgtccacctgaaagtagccccgaaagcggcttggcttggtcactgaccacaacctaagctgcttctcggctaaactcctgcacttgtggtctggatgcttgacagactttgctcaattctcagaaacccacagctccaggagacctgactggttttgcctcactcttctctaggcctagtgaagccaggggtgctggtgggtaatctgtgtttatagtcaggtcagtccaactctaaatgctggcctcctctccactgggcagagagtaaagagactgagaacttagtccagtgctgtccactgttaactactgcccccaggagatgtccggcctctgaggaagacataccttagcagagccagcagctccctagaagaaattttgcacggaaagcaactaagagttcttatagggccagcaagggggcctaagacaaaaatggccatggtggccaagtgagcactgctttattgaccacatctcacactccaggaaacatgtggaaactgaacacagagttttgctggaa

SEQ ID NO: 342 - DNA, 619 bp, Rattus norvegicus
  Genbank Accession No. AA851264
  misc_feature (1)..(619): n = a or c or g or t
gaaatacgtttattgaaaacttacatttaaacaattagtaacttgaacatgagcaagatagcttcaggaacataaaacataatatcttagagtgttctaaatactacatctcctctaatgtaaaaggagataatcaagattttatcttgcataagggcctgggtaccactagcccaacaaacggtttataaactaatacttatctgacaagtaacacaacaagccccagcctatggatggtaaagtcttcaaacacctagcaagcactgagtttcacaagtgcgggaagcaggagggggaagattaacaggtgcttcaagatcccgcccttctagcaagggtcagagagtaagtgggaagctctgtgagggttgcagtgagcagtaatttggctaagcgaaggccttgtagcaaatgactactttgtaaacttactattgttgccttacaaccctccatcataactgtttggttttcaatgaccagaacatatgctctaagtaaaacaaaatcgacttttctcaagaaagtaacagtggtgagctgtgccaaagtgtttgatggccaagaacagactgaattgttgctcaaatatccgagggttgaagcnacgtatttt

SEQ ID NO: 343 - DNA, 499 bp, Rattus norvegicus
  Genbank Accession No. AA851273
ggaaaggaacagttttattagcctggagttgaaagtctttgggaggccatatggtgggtaccgccacggctgtacaggaagtaagatgaaaccctgtccaaggcttatttggattgtagagccctggagaaggcaaactgcccaaggaagaagtagatgcgggagtcctcgccggcctgtgctatcttactgcactgggattcctgaggctcctgctgaggcccttgcttcagtattgggcactggaccatccggcctagaactttacccttggggtccagtttgatgcaggccaggcatttccgcttcctcccatttggtttgattgtacactccggctttttccagtccttcttcaggcagctggtctgctggagcttaaattccagcctcacaaaggtgccagctgataagaacaggtcatcagcactgtccacaccgatctcctggaaggcccactgcacaagcgggtgtctgtggaactcctccagagccacct

SEQ ID NO: 344 - DNA, 282 bp, Rattus norvegicus
  Genbank Accession No. AA851279
aaacaataaccaaaaatacaaccacttggaaccaggaagggagaaagaaaatagagatagcgaggttcaaaaagctgaaccacgcttcccaaaatgctcaggtcaaaccccaatgagaagatgccacgaagaaggaaacagccaactcaggagtcctgggatatctgaaatcgataagaaggataaaggtgagtataaaggtttgcaaaagtacctcaggaaactggggtgggggggaaatgaagggcaaaaaatgcccatgatctgctcctcgtgccgaat

SEQ ID NO: 345 - DNA, 208 bp, Rattus norvegicus
  Genbank Accession No. AA851318
aagggaaggccaaacccaaatttatttcagtgccggcaaaagcttacccaccaaaaaaaaaaaccccacccagggcgacagaagccccaaaagcgaggcaaagggcccagccgccaggcggaaaacaccaaggatgcatggcgggcacggcccgggaaaaaagttaggaagcggcaacctggggggggcaagggccaggcttcacttc

SEQ ID NO: 346 - DNA, 495 bp, Rattus norvegicus
  Genbank Accession No. AA851347
agaaatcaaaatatttattcacatgattttaaactagtcaaagctatttctttagcagtaatgatttaagtgcaagtgatgctggctttcacattggcgtcctccagagtaaagacaggtcagttgttcttgaataaatcaatgcagctctgcaacagggagacattgtttctggcatgctttatttccagttcagacatttcaattaggttctttcgaaatgctgccactctcttccgtttgaagtttatcagctcttcttttgcagattcagaaagctgttcaaacttctggcagcattcctgctgatgagtctctgccaacttgacatctttgctttttaaccgggccttgtccaaagctttgtttgaattctcatagtcaattagggcctttgtgcgtctgtataggagatcctttgcagcctctatgttgagcatgtagtatcggaggagctctgtcagttttaaatcttcctcgtgccgaattcttggc

SEQ ID NO: 347 - DNA, 534 bp, Rattus norvegicus
  Genbank Accession No. AA851352
caaaacaactatggaagtttgtctagatctccagctggtgacttattgcttgattttacttctaggccatcggtcaaagcgaactaaagctctttgcccaaactgagacagtcagacagggaaagctggagggagaagagacttcctaaacaacatcactatttccaggaaggctcttctgcattcccaaaacctgtactttgattcctaatatcaaagctggctttggttttttgttttgtttaaaatgacctttacactatagagaaacagtactgcaaattaaggattcttctcctggcagaaatgtccggcaaagctttcccttaatcaagcaaacccactatgcctatctatgtcacatggtctgctatggcggaaagacgctggctcttctaggccttgtctcaggatccacacatcagacactcctctctgttctccaaagagcacaccatggctgctgtgttcctctccttctcttcttcctccttcagtgccttttccttatctttcagcttttcccctcgtgcc

SEQ ID NO: 348 - DNA, 400 bp, Rattus norvegicus
  Genbank Accession No. AA851401
aggaagaaaacggtttatttggctcatatttccatagccctttgttacaggaaagtctaggttgcaggaccttgaggcagctagccacatccacaatcaagagcagagagagaatgaatgtacatttgcagtcagctcactgtctccactcttacacagtcctggacccaagcctaggggatggtgcctcccacagtgggctgggtcttcccacatcaattaatgtaatcaagacaatctcctacagacatgcccacaggccaacccaattcagacaattcttcattagctctcttcacaggcgattctaaactgtgtcaagctgacccaccactggagaggtgagtggatcaaatcctttgcaaggatggagatcaggtcttcttcctttgggccacac

SEQ ID NO: 349 - DNA, 474 bp, Rattus norvegicus
  Genbank Accession No. AA851443
caagagacggacttttgttttaatacagtgacaataggaaagccacaaagtaaagacacacaggacagcagggaggacagggctacttaaggagctttgccacgttcagactgggcaccacaatctcctggaagatgggcacatacttggggctcgcttgcatggggccctgctccagtgtctccatgatggtctgcttcatgtcccggctggcgtctcctcgcagtgccagcagcgcaccaatatggtcatctctgatgtctggatatttgctgaccagagttgagacttctaggtacagcacacacgggtccgtgagcttaatgacctctgccactgcaacgattgtgtcacagtgtccatctgcatcctcaccaaatccagatgccagcttccggaacaggaagcggagctgttccgcctctctgaccatcttctcagcaccctccttgcgctcttcagcactccgaaagg

SEQ ID NO: 350 - DNA, 418 bp, Rattus norvegicus
  Genbank Accession No. AA851455
gagtcaatggtctaactatgctgttctagctggcctagaactttctatgcaaaccaggctgacctgaaatttagagatccacctgcctctgcctctctactgaatagcaagtgcctactgaatagaaatgagttctcatgaagtgcctcacaaaccttccctgctgggaaccaccaaggcagcttggatgaatcaaggactgttcaagaactagatccaggaagccttctcagtaggaaaacccaggaccatctttgttaatgtctctctaactaacgtaagaagcacatcaattctaggtgtcctgagaactggcagagtccgcacaatcccaagtcacaaccgtctacccaactctcacctaataaaagtctacttgcttttcaagtgttttctcacttttatgcactgaaagact

SEQ ID NO: 351 - DNA, 364 bp, Rattus norvegicus
  Genbank Accession No. AA851456
aaaaacctgattttctcactgtatttatgtgctagccttgttccttctgggtgtagatttcatgggtggggccggaaggcagtttgttcaagtggcagttaccgtggctccctgattaaagtcacctgtccaggcagggtcctgctgacccacctcccagtccttcacaggctggctcgcttgctctctatgatgcccctccagtcatcactccaggaaagcagccgtctcctaatggggggcagggccaggtgctgattgtggcagcacgtgaacaagatgtgctcccagcttggggtctcctctaggccttgaatgttgtctttgtcatcaatgagcaagtctcccatgaccactgtcttgt

SEQ ID NO: 352 - DNA, 343 bp, Rattus norvegicus
  Genbank Accession No. AA851466
gaggtgtaactggctttattgggcaataaattggggcaccgcagtcttgggcctgtctggcagcagagagtcctctaggcagaatgagctgtgtgtgtattgcaggagtgcagtcagcctcaggcaaacttcaccaggcggcccagtgtctcggcagctttctcccgtaccccaggcactgggtcctttaggaggagctgcagggctacaatgagctgttccaggtccacctgcgtcctttgttcaggctccgcatgcaacaccaggaaccctgtgaacatgggggcagcagctcggacgtcgtcccagctgcttttgaagtagaacaggttggtgctcacga

SEQ ID NO: 353 - DNA, 375 bp, Rattus norvegicus
  Genbank Accession No. AA851620
cataaaccaaatactttattatttgagaaagaggaggccaaattacaaaaccttcatacttaagaccacgcctaagacttctgaggacttccatgactgttagattcaaccatgtaaaaccgtcatcttagctgacaaaactcgggctaaacttggcaatttcatgtggctcgactgcgtataaactgactgaggattaagcttttgactcgagtatgttcctagtcccatgtctgtttatattacacacagatgtcccggcgacaaacaggtccctgtgctaaaccgcaaagcatttctctctgggcatgcaggccaaggcaacccaggactggcacagcaggtcccagctggtcctgcatcccctgtgtggtc

SEQ ID NO: 354 - DNA, 318 bp, Rattus norvegicus
  Genbank Accession No. AA851660
aaaaaaatagtttaataaaaacgcactaggtaggttctacaggcagctttcatggtcacttctgaaactcgctcaccatcctccaaggaaacaatgctatgtcctcctgttaaaaatggagtccttgtgtcacagagaagtagctgacagtcaccgggcacatctccctgtgtgcatatcgtcaatatctctcagcaccatcggccttggaggatgttgcggtggaggtgagaaacgtcctcatgctgacagaagctcatcttcgctaccacggggtctgcgtgagagcttgacagagaattctaatgtcggagtcag

SEQ ID NO: 355 - DNA, 499 bp, Rattus norvegicus
  Genbank Accession No. AA851739
  misc_feature (1)..(499): n = a or c or g or t
gcacttcaaataaattaaaagggacaaccgtcaagtgttcaaattgtgaagaaatatctgaaaacctagagactccaaactgcggtcttctaacctcattctttgtccgatggcaaaacccacgcatctcagaaccccgtttctccctactgaggtgagagaagcattcacaagcggagcccagatggaggagaaagctgcatctgactggaatgaacattgccacgtactcgctaatacgggtttcactttatgaccaaatgtattctttaaaaataagaaggggcgagggagctgcacgttttagagactgagcttactcggggctagcacactaactctagtgcctttaatggcagtagcaactttgtcctccgaagtcaaacgccatccccagtcaagccttgtgctaccagctttttaggagatgttacctaaactttattaanagaaaagagcaagtttanatatagacactggactagcccagtctgtattt

SEQ ID NO: 356 - DNA, 494 bp, Rattus norvegicus
  Genbank Accession No. AA851776
  misc_feature (1)..(494): n = a or c or g or t
aaagaaagccttggaaatcctttattgaagactgccatttagatgaaatagaacagacctgtattttctggagtggtttttctgacttgtattccttgaaggaaaccttaaaacctaaaacatcagctaggagactccttttactggccaatgaataattcagttagtaagagaggctagcaaagaataattatgtaaatttttttagtcagctacagccatgctgaattggatcgggcaaactctgattttaagttgttagttgtgatccgtgtgtcaactaagacagacagacaccattctagtaactttatgtagatacagtctaggagacactgttctgctgtggtcacagtcacaaaaagaggtgcaaaatcagttactttataaatactgataatttgcagcattaaggaaaaggacattaaaaaccatcaatctccccgaggacatctangaccagggctcttcttttcctaagagaaccaaagttt

SEQ ID NO: 357 - DNA, 527 bp, Rattus norvegicus
  Genbank Accession No. AA851785
acattctcaacagacctttaatgaccggggtgagtttaggaacaaaaaggtagatagtctggtcatagggacgacaagaagtgaggacctcagtaagctgtctgagactgctgctggcggtagccaccacggcgcatatagccttcattttttcggtagccatccttttggtctcggaaatagccgccataggttccttgcttatggtcaaacacacgttcattattctccactaggctgccaagcttctcagccagctgcagagccaagttctgttgggcagtgggctcagtacggtgcatcactaccgtctgcgttggctggtccagggaagccatcaattcttcattaatgatcatcttgctgatgatggagtgaacagtgggcagatccagctcaaacatatctgagagtgtctccatactgattgagtcatagacactgctataggtaaaaaggtaggtcctcagagactcttcctggatcttccgaactagcatggtgcgaactttgtcagcctcagggaa

SEQ ID NO: 358 - DNA, 520 bp, Rattus norvegicus
  Genbank Accession No. AA851791
ctctctcttccgcttgggtttagatatcgggccctgggatagggcagccagttgttcatgaactgcccgaagctgctcttgcagctctgccaggcgatgagccctttcttcctcggagtctgagctttcactctcctcctcctcatcatcctcatcctcttcctcctcttcctcagaggagctctcactgctactttcctcactggaggactctgaagaggatttggccaacccgggaggcaaggcagtagagacaggtaaaggtcctggttccagtggctcatctggcatcttggcatagcggaactcaaacacatcctgtaacttccgggccatagccacgacatcgtggtctggaggattgtacttatagcagttggagaacatgagccgtacatcagcagcaaactcctgtgcatcccggtaatcgcggttctccatcttccgcttgacagtgctgaggtccatggggtgcttaatgatgtcatggtagtcatgaaggccaagagcagaagcgtcc

SEQ ID NO: 359 - DNA, 477 bp, Rattus norvegicus
  Genbank Accession No. AA851873
cccctgctgtctcgctaagcagcccacacaggacagaaacgggtagcactgaggaatgatcagattgttttttcctttcccccaatatttctgcccccttccctaatccctgctccaaacctatttagtatcaggaatggttagtaaatctgaagaaacagctaagatggaggccgggcattcagaggcctgggcctctcctcactagggcttggactcccagtgactgctctgctcatgggggagcatttctccttcaaatactttttttttttttacactggttcacagatcagatcggcactttgactctgaacctggcaccaaaaggcacaatatctgataccctgtaaagagctactacagatgctgcgtatggacaggcaaacggagccagtcccacttaggaacgggctcagacagggaggggagatgaaaggagtgtggggagaaaacctaagccaataccttttacta

SEQ ID NO: 360 - DNA, 579 bp, Rattus norvegicus
  Genbank Accession No. AA851938
caatgtcatggaaaaaaatacaaagtttagagtctagaaccaaccaggtagatttaggagaggggtgtgtgtgtgctgctggctagagacacagctctgcagttctgtcagtgcctacctgcgtaggagcaccagtcaggagcccagtgagcatttcaggatcagaaggaggcctctggaagcagagcaacccatggctggtcatcatctggccagactctgcttgtaatttagcttgctctctccccagattcccactggctatgcttgaccagggagtgtgtcagcctgctcccagcacagaaaagtaatgagctaccacctccccagggctcaggtcccagcctctacccttgttctgggtagagttacaggagccgagcaaaacagatttcagaaaaacaaagagccaggaactgtggtgcacacttgtaaccccagctcctagggaaagggaggcttgcaggagcttgaggctggcttgggctacagagtgagactgtacctcaaaaagccaaaaccaaacagacaaaaacccacgttcatttccctggaatccaaatcaaatatggtcctgtt

SEQ ID NO: 361 - DNA, 591 bp, Rattus norvegicus
  Genbank Accession No. AA851951
  misc_feature (1)..(591): n = a or c or g or t
attgtaaaatctttttttttttttttttgagacagggtttctctgtggaaatatttattactaatgacgagtatatgaaattttgtcttgaagcacagtgtggcacgggtaacagtcttactagaatgaggtaaaccacattgctacatttcagaacactgtttgtaaaaagccaacatcagtgtgagggttgagactgcttctttctcaccagatcagaaattcttggggtagtctttgcgagagcacaccggaggtcgtcttccacgacaagcctacttctgtacttggacttgatgaccaacaagctggagaaccctgtttcacaaagagatgttgttgcgaatggaaggaggagtcgcaacaccgtctcagacagaatcgggtatgactgcaaacacttgacccagaactgtgtcactggcattgtggagaaattggctctcgccgcatcactgtttgtaagctcgatgaactcgtcctgtgctgtcttggggacatcttcagctttgactgtgaatgggtttctggcaagtgcaaacgggacgtcaggtanattgggaaagtaccaagaaatttcaccggcaagca

SEQ ID NO: 362 - DNA, 481 bp, Rattus norvegicus
  Genbank Accession No. AA852011
gaggcagaacagattttatttcctcgtagttggagattaagacttctgtaaagacttcaattaacaagaagtgtcaatttcacctgaagtttacaaactgtaaagccttgctaaaccaccaggacacagtcctcaggagcacactcattttccccatgcctttcagtaccagcaaagtggtgctaggctttgactctgagaatgagaatttcagaggctttcctctgcctattttgtgctaatgcagaatgagtatgactaactttgagttactaacacaaaagcacccactttaatgccaatttatttaatataatgcttttatagggaaagttcttttggagagaaagaagagcactctctcctgggggagcaggagggcataattaagacacggaaccactatgtttcaactattatgaactattcttgaaactattatgtttcaagaaatgctccagctttactattgtcaaaaata

SEQ ID NO: 363 - DNA, 519 bp, Rattus norvegicus
  Genbank Accession No. AA852027
gaaattaataattctcaatttattaagaggtctacacctttacagccacggtgccagctctggcccggcaaggtcagcctggcagcccctttcctacatccacctggagctcccatgtggctgcagcccaggactgggcagtgggcgttcctggtggcagctggtggcagaggtattgaggtggcacatacagctttgtctctacagaatagttccagtagggtacagagtccaaatccgtgatgaggaatataggatgacttggggacaaaggctgatggtcctgccggtggcccagctgggacaggctctaaccagcgctgccttgactgttgccctgggctgcagccagctggcagggtggagggggttctgagttctaccaacagtcgcgcagccctcttcgcagaacaggtgtgggactgcccctccccggctgggccttgggaactctgcacatggggcaactgcagatgaggtcccagagaggacggagctgctgccgccaatcctgtgggg

SEQ ID NO: 364 - DNA, 449 bp, Rattus norvegicus
  Genbank Accession No. AA858457
tttttttttttttttttcctggggattagcccacattttattttacagtacattcataaaagttcctgcatttccaaggtaaccagatcacattccggtgagcacttcaggtaataaaaatcatacaatgactctggctttaaaaacaaggtatggtgatgcgcaggaatatgtcttcccttcaatactgcagatggcaattcaccacgaagtaagatctccaaagcccatgcccccgggatccagtgtgaaggcatactacctatgttacaattaaaccacataagacatgggagaaaaacggaccacttcagagctctaaagcccccgcaatgcaatcttccccttctaactgctgggggacacgcagctttggtgccctgaaaaatgagagacggcaaaatacagggtgatttcactctgaaacacatggcttttcaaagctactt

SEQ ID NO: 365 - DNA, 454 bp, Rattus norvegicus
  Genbank Accession No. AA858573
tttttttttttttttttacaggaaggggaagatctttattgcaaagtggagcttatcaaaggaaaaagacacaattctccatgtccttcatttcagcttctgcttctctttctttcatggaatctccaggatgtcactcaaagccagaattgactcttgctctgcgttggaggttcaggaaccttctatgggcaggaggatgtcccctcctcgtgatctctttgggttcatcataaagaaagccaagtagataatcatttcttcgtcggtgggatcttgccatgtccccaaaaatcatcacagagtagcccctttggaaggcgcaggtggagggatcaccagactctcttaggcatgtagtttcctgaacggtgaactctaagttcatgaccagtgtgtcttcatccaggacattaactctcttcagggagctccgcgtcgcccgaaacaggta

SEQ ID NO: 366 - DNA, 472 bp, Rattus norvegicus
  Genbank Accession No. AA858588
tttttttttttttttttccatttggctctttttattagagaaatcgagaagacagcgagtagggaaatccccatagtgaatggaaccatcacatagatgcctttctggaaccccaaccttctatgatccccaaaagtgtgcttgtgatttcagcaacttacaaaggggagaggaaatactgagaaaggccactatttaataatgaaggagtgaaggtgtctctaaactgggctccaaatctccgtggtggttgtcattgttacctccccttgtatcatcaagttggtgcccttttctgagccttatatctggctctggagtcctggtgcaccccaatcggtgttcggttggctcgttcatgggataccaaagccttccttacaaagtggtctttctttctgtcccttcttcttgggagaatggatttctaagggatggtgagttgaccctccttccgacccaggcaatctgt

SEQ ID NO: 367 - DNA, 410 bp, Rattus norvegicus
  Genbank Accession No. AA858590
tttttttttttttttttgcagatacaaagccgtatttatacatttatttatatgtctattcacttacgaagaggaccatttgggggacaggaagcaagtaggctgggtggcacctccctgccttcctcagagtcagagtgagtacatgataaataggagtcagagccatggagaaaagggagttaaccagaagggagacgctctatgaacacgcaggctgctaaggggtacagcatgggcagggatctgtgctgcgggccctatatacagcttaaagcgagggggagattagcccagtggctataggaacagcagaaggaagagaggaagggagtgccagctaggctgtcagcttccagcctgtggcccttacaccttcccctaagcccttctacatttggggcttaagg

SEQ ID NO: 368 - DNA, 576 bp, Rattus norvegicus
  Genbank Accession No. AA858600
  misc_feature (1)..(576): n = a or c or g or t
tttttttttttttttttagtcagtactgcagcagctccgagtttaataattctcataggctctatataccttacagtcttgggaaacaaagtcacaagccagcagggtcaatggctgatggacattggacatctgtacctatctggaggcctccttgttccttcctccaagattaagagcattcagcccctcaccttgagcttcaagcatatcgcctcttacccttcatgagtcagcaggccagaaaatctgccagcagaccctggcctgacttgactgcctgataggcaggatttcacagaagcaggcaaaatggctcctgacagagagatgccagctagaaagggagtttgctttatttgccattccctgtanggctggtgtcctcaatgagatgcaggctttgggagttcctatacacctcagtgctctgtagaagctgaggacccttgacctcacaggtgtgatcactctgcangtggagatgtggccaattggttgggtgtcctcactcttgaagcaggtanggtccccatagagatcctcagatgtcagcacccagctctgcacactgct

SEQ ID NO: 369 - DNA, 476 bp, Rattus norvegicus
  Genbank Accession No. AA858603
tttttttttttttttttgccagcccattggccactttatccgaaaagctcatagcaccatacacgaaggctccactgtgctgggggtacacaccacaccgggttagtgcccaggacaggatccaaaccacgcccccaagctcctaaccacgcccccaggcgcctcccatcagccctaccgtatgggggccaatgaggtcagcggtcatggctagggaggtgacaaggatggtggcacagcctgcacccaacagcaatgcggccccatatacggccacacccaggttatctgccagggccacccaagctgcaaaggccaggatcaccagcagcccggtgaagtaggtcatgtttctccctatgcgcctgttgattggcttcatgaggaaggaggagaagaagccactcaagtacatcaccagggggatggtggcaatgaacttcttgggcaggctgagagaataggtcagatacatg

SEQ ID NO: 370 - DNA, 504 bp, Rattus norvegicus
  Genbank Accession No. AA858607
  misc_feature (1)..(504): n = a or c or g or t
tttttttttttttttttggctgtttaagtcagtgtcttgattcccccacactctgttaaaagaaatcttatgtcatccaagagcatgaaacaggtaattaaactaagtagtacctctttggaataaaagatgtactgttttaaattgtgttgctgtgtgtctatgtgtgggtgtgtgtattccagtgcaggtgaccttggaggctanaggtatttgatctcctggagctggagttctgggcatatgtgcctgtctgaccccttgcgggtactgaacttgggtcctctgctagagcagtcatcttacaagctgagccatcctctggtgcagagacatgttttgttgttgttgtagtttgtttttatgccacagtaccgtggtacatcccacagaggacgcaggcagcagcaccaggagcttcaagatacagaatgccggaggagggcttggattgcggctggcacagggttaagtcttacgaaaaagagcccaacatatgcgaaa

SEQ ID NO: 371 - DNA, 522 bp, Rattus norvegicus
  Genbank Accession No. AA858636
tttttttttttttttttggcagtcaaaacactttattggcagaataaaaaagtgcagcatgggaagtattgacctgccagacatttagctcctcatattcatccagagctgcctggaactgggctggtgtgaagccacgtgatatgcagcgctgttcagcctcagaaaagcggacactccgtccccctgataccaactcacggacggtagcaaatatcacatctgctggcctctgggtcctagccgtttgtcccttttcacccagaagggagtcctttgacatctccatcaaccttatggcttcattcacatcttccttctccacaatgtctaccatccgaaggcgagccagagcagtagaaagtcggagaatggccagcagggtccgggcagaagtgtaggtggcatccttactggcccgggcctctcgcctcatctccacatacgctgcagtgatgtagtcagccagagagtcaggcactgtgggctgcctctcgcggcacatggcaatgtaccgtctca

SEQ ID NO: 372 - DNA, 480 bp, Rattus norvegicus
  Genbank Accession No. AA858640
tttttttttttttttttcaggaatgtacaaatgtctttattcaaaaatacaaaataaattatctgtaggcatggacaatgacagcagtaaaccattatgtattgtcaaaggaaaccagtaactgatggttacagtgatcagccagccttctcttcagtcattttcttcaggtgacttctctgaagttattggtgaggaacctgccttgagcttcctgccacagttcattgataagggcggcgataatgaatgggaggatgaagtggaatgcgaagaagcgtgttagggttgctttgtctactgagaagcctcctcagattcattcgactagggtagtcccaatgtaagggatagctgataataggtttgtaattactgtagctcctcagaatgatatttgtcctcatgggagtacatagcccatgaatgcagttgctatgactgcaaatagtagaatgattccaatgtttcaggtttcta

SEQ ID NO: 373 - DNA, 520 bp, Rattus norvegicus
  Genbank Accession No. AA858660
tttttttttttttttttaccaaccttttcagacatgactgatttatttgatgaattcaaatttcacttgtcaaagtatattgaggggcagggtttgggttaattatttcattagaagcaatcacattttttttttttttacagttaattgacatggggtagtatctagaggaaaggcaaaactctaaaaaacgacagcaaaacacaacgtcatgtatgtgggtgataattacaaatatcagcaaaggaaacaactagcttatactactgaggtgtgaagcatgctaacactagtagtgaccttttagttcaactcaacccacagtctgcactgagttggtgcaagacactaggtactaggaatatggtgaaaacacacgcacaatcagacatcctccatctccttagcaagtacactaagagcatttataaaagtggtatcgtgaggcataaagcactcttctaaggccatggatggagatgtttcttcaggtgacaccactgagttccacttcaatctg

SEQ ID NO: 374 - DNA, 275 bp, Rattus norvegicus
  Genbank Accession No. AA858674
tttttttttttttttttcaaacaggaaattctttattgcaaagatacaaaagcagtcacggggacatgtacagcaataaattaggtgggggccatgaggcagggtgcaaacggggccaaaagtctgtgatcttgatcccttcccaataatttataacatgggggaaaaaaagcacaaaaaaaaaataaatattgaaatgaaattgccaagtggaaggcggctgaggatgccaggcctcggaatgatcggcatgtgtccctgaaaccctcgtgccg

SEQ ID NO: 375 - DNA, 539 bp, Rattus norvegicus
  Genbank Accession No. AA858758
  misc_feature (1)..(539): n = a or c or g or t
tttttttttttttttttcaagctcccttcatgctctttattaaaactatgcaacattctccatcctttttatctccccaagcaattccaccctagtccaaaaagaaataagaagaaggagaataatagaaattggaccagttcttaagtttcttcttccatgtttcttggaaaacagtgtgtagtcaattcttcttcatccgtggcttcactgtggcaccccatttccagtgattgatcttctctccaaacaggtagaggctggcactcaggatgtaactggctgagaagaagagaataatacccagcgggctgagggaggcaaacacggggtacacccagtttccggtctgaacgtagcgccaaaggatcctgataatgtaagcaaaattacaggcacccagcangctgagtcctagcttcttcgatggatagttgtgtggtctgagaacggtttcagccagggaaaagggaaatatggaggtatgcattgcgtgattaaaccatgctggaaagaaatcatccaagcccttggggtaa

SEQ ID NO: 376 - DNA, 554 bp, Rattus norvegicus
  Genbank Accession No. AA858760
  misc_feature (1)..(554): n = a or c or g or t
tttttttttttttttttaatttcactttttattattcaacattttatacataataaatacaaactttttacagccactgtaaagaaagcgcatctgcacggaggctctctctgagccctgacctgtgcacggtgatgccgggttattcggcctggagagaagggttatttattttttttttttaaaaaggaggcatatatttttacaactttgtttcttaaaataaaattagcagctcttccaaaaatattttaaaatataacaaaagagttcgaataactctgaggttatgggaaactcaaatccatggacaatttggttagctcaacagaatatgggtggcaggaactgctctattatcagcactttgaagatcagcanatttgaaaatcttaaaataccctttcaattttttaaacttaagaataagtttgataaacataaaaagacctcaaatagatcaacagataaatgcaaaaaccaaaaatccaaattcatggagaagattcatcagagtatcattgctaaagttattgaatgactgaaaatccctt

SEQ ID NO: 377 - DNA, 359 bp, Rattus norvegicus
  Genbank Accession No. AA858788
tttttttttttttttctgttcagattcctttattgtactgcaaagtccaatgctccccagtcttggctcctcttcaggtactacccagaaacttgctggagagggcagatgtgtcttgaggcgcctctctaggtgtttggcaactattttccaatggtctgtcctgtccagcgtccctctcttcccttaaactgcctgaggccaattctgccatccgcatagcaagagggcagatgctgagaaagtgctaggaggcagcgaggagacagagcgggaacaggcaaggtgtgttccagagagagatggagatgagagggtgggaggaggctgtcaccagaggcagtggaaccctcgtgccg

SEQ ID NO: 378 - DNA, 515 bp, Rattus norvegicus
  Genbank Accession No. AA858816
tttttttttttttttttggattgacagttgtttactgacagagaacagcaggctggagaggctccaagtgaagggggagacttttgggaagactggagtctgaagttggaggagtccacagttgcaagagtgtacggggtcagctctggtccatcttgccggggtgagtgggatcttcacccccttctggggtggcaggtggttcagccacctccagaatcagttccaaggcaccgtcaccgcacacccggcgtacctcctctcctctggctgctaggatctcttcaatgttcctcttccccttcaggtcagagaaccagcttaggttgtctgcgatgatgtggtggttctggcaaccagggcaagtcacgatgaccacaccctggtgataggccaactttgagatgtgcttggatgaccgagtcccacagaccttgcaggtgtagacgagctggtagtggtccgctttcacgcgccctaacgccgccgcatgctctgattccggcgcggagctc

SEQ ID NO: 379 - DNA, 537 bp, Rattus norvegicus
  Genbank Accession No. AA858879
tttttttttttttttttgaacaatgcaaaggcatttattatagaagcactctcagaccacactggaaaggtccactcaggtggatttgggtggagactactctgtccccattcccattcatgcccttcctcatcacctaggcctggagcccccctcccacggcttgcgggctacaaaagaccccacacaggagccttctccaagtagtacacccccatcagtgacagatctctgcatttatagcaagaacagttcccactcctagcaggatcccaaactccatcccaaatgaatacagatctctgctgatggtttcgggggtcaccttgcagggtgaggcagggtgaggcgggtctgcaggaccctggggcgttaggtgaggatgtcttgagcctggtgttctaccagcagctccatgctcttcacatcagtgcaccagagctccagacggtccttcatccccttgatctgctgcaaatccagcactcgaggctgcacccacgtcatgtgaacccgcttgtccacctcgtctatgct

SEQ ID NO: 380 - DNA, 551 bp, Rattus norvegicus
  Genbank Accession No. AA858928
tttttttttttttttttaaccatttggctagaaattttatttcagaaataagcattcagtgtactttaaagtgattaaaagttatttatggattactgtaataaatacttctcaaaaatagttactctgtaaatacacatacaaacttcagtgaagaactccttgccacaaacaagtgatctgtatcaaaatctgatgtcacagggaagctgaacggtggcctggacgggggacagaatgctcagggagtctaagaagcactccccattacatttttcattcaaatacttcccaaggccaacttaagtttgttttgttagttcatgcataatctgacagggaacataggaagccaagagttttagaagaaaaagcaatcctaatcttagcataagccacaaagaggcttttctgagagctgtcaaagctgtgttgagaaaagcaagcatgctttcaacgagacactgaggaaaacaccctgtccgactacaaatattccaaacatttgaaaacaagtgaatactgagcttcggagtatgttacactgggca

SEQ ID NO: 381 - DNA, 512 bp, Rattus norvegicus
  Genbank Accession No. AA858982
tttttttttttttggctcttttaagtttttattatttaaatacaccatactagagcaaatgtctctgaaaatatcacaaataaaagatttttttttcttcattcagcaaattagaagtagggggggatttctacatagtagcggctgtgagcctcatttttttttcttcttttctttttttttaacctttgtcatgggcggagcaacatcaggacaagaacactcacatgcatacatacattgtattttacagagatacaataaaagtgtctgtgatagaactatcacaaaagccacgtctctttcctttttaactcatgttcaggtttgattgaaacacatctcattacaacacttaaatatacaaagagcaaacagaatgtagttaagagtaaaacagggctcacactccggccggtgccctgctaattgttaatgagggtagaaagcagattcgtgatgcctcttctaattagcttcattagtcattgccctcccccccaagcaccctc

SEQ ID NO: 382 - DNA, 565 bp, Rattus norvegicus
  Genbank Accession No. AA858990
tttttttttttttttttgaagatacacacatttgctacattttacttattcaataaataaaacaatacttgaaaccttctaatacatctttgcgcacacattcatcaaagcatttttaacgtaggaaagcatgacagatgaaagtgtgcgtgcttatttggaagacatctattgcatttattctctaaaaaaaaaagcaggcctgaagggtcacgttactggacattttaaacatggtgacaggttatcttctaaacctcaaggaattctgatggtgcgaactgtagtgactatctgctcctactaaccaagctggacaccagcgagcagaggcaccacagccgtcattcatttctttctgttgcttccagttgctagcatagttgcaactcgcataaatatatttaatgtatccatgtagatcgttagcatcgaattgatgggatcatacttctgagctccgtacgcgggtgttatttctgcacgtttgactactttctgagtatcatacagaaggaacattctgaaaagaactaatccaccatacattgccactgagtacaga

SEQ ID NO: 383 - DNA, 296 bp, Rattus norvegicus
  Genbank Accession No. AA858994
tttttttttttttttttaaaacataagcgcgaccgtttctttattaaagtagacaaaaaggggatggggcagcttcggggcttggccccaaccccagccccaccccgggctggcgctgtctgataggagggaatctgagggagacccatgggtcaagcaggagagaaaagggcacgcagataggctcggggtgcacaggggaacgagaggcttctcaaggacggtaacagttcgatagtgaggaacgcatggaagaacaaggaatgcaatggcacactgaaggccggctggggagc

SEQ ID NO: 384 - DNA, 541 bp, Rattus norvegicus
  Genbank Accession No. AA859000
tttttttttttttttttaacatcgactttttaatcaactttttttttaagcatcccaagacactgtccctttactgattatttccctttaaggaatctgaataaaggttcaatgtgaggtacaaatgaaatgcttatattcccagacttagtaacccaagagtagctgactgcagagtatgaacatacaccatgttagaagaatatggggaaaaacactgaatttacagattaaaaatgttgaaacgggcttcaagacaggaaattaaaacctcctcttggggtgagaggcctttactatctaagccagaagttaactgcagaaagctattgctttgctacagttaaacccggaaaatcacaaagcgatggctaaagcatcacgaagaaggtacagcgagaacaaatgcagtaaaagcatctaaactagatgttaacctggaatttctcaccttacaacactggcttcatttaaaaactgtctttataaattatgtggcactgttctgttccttgagctataatgcttacatctataaaaa

SEQ ID NO: 385 - DNA, 554 bp, Rattus norvegicus
  Genbank Accession No. AA859010
aaatattcatctttataacaaatgtacatttatacaagttagaatgactgatagtgacagggacggttatcacaaaacacgacagagaagcatttaaaaagttggctacagtagggccagccagacggcccagtgagtagacacttgcctccaagcctgataacctgaattcaggccccgggagaacagactcctgacactcgaactccgcatgtatgcagtggtacatgtgcctcacccctaataaatatgttgtttgtgtttcgacttttcaagacaggtttctctgtgtagccctggctatcatgaaactatggtgaccaggctggcctcaaactcacagagctctgcctgcctcctgagtgctgggattaaaggtgtgggccaccaagcttgctgcagctcacaggctggctcagggcttgctcagagctggcattccagctgtggggaggtctaaggcctgagctgtgtactgtcagccagctaagctcagagacagagggagaccttttgggctgtggaccaatgggtggaaccctctgcattcactg

SEQ ID NO: 386 - DNA, 423 bp, Rattus norvegicus
  Genbank Accession No. AA859019
tttttttttttttttctgaacagaaagaacttacatttatttttttttgcttggacatagtttgtccttagacatatcatattttggattagaagctttgaattcagtcttcttgcattgtggcaacagtcgctaagattaatcaccatataacaaaaaagtttatatgcttattagaagaaatgagctaaacaatatttcaaatgtaaattgaaattgaattagtaataagcatgtgtatttctaaacaaaggttcatccataaggtttactaataaatctattgtgattttacagacaagtgggataattgatgtgaccatcaatgcattttgaacgaaatggaggtgatcctcttaattttctatatccaggtttacacatgaattcaatattctcccctgattgggaataaatccttcc

SEQ ID NO: 387 - DNA, 147 bp, Rattus norvegicus
  Genbank Accession No. AA859114
tttttttttttttttttgggttttaatttaattttatttttgtcacatgggcagtataggatggtgttagcccatccttactccgcttgcattgactgtgcctcgggtcttaagacgctaaagtgtcatttagaactcactcccaga

SEQ ID NO: 388 - DNA, 376 bp, Rattus norvegicus
  Genbank Accession No. AA859130
tttttttttttttttttagcttttgtttggcctttagtctgaaaaagtgttgcttgaaagtgtacaacagagagcgggtgcaagcggctaggggtcacagagccgccaataaaaaagaatgtccttaaataaagtgttcacagagtaaaaatcagaactaccagtccttccctccaacacaacagagcacaggcacagaaccgatagtcgatgagcccaaggagtaaggaggaggctggagaggacagcagaggctaaaagaaaaggacaaaactcagtctcgggtccaagggctcagaacagtccaagtgggcagggtccggttgactgctagtcccgcttggccttcttcttgtcactgttgccattctcttca

SEQ ID NO: 389 - DNA, 533 bp, Rattus norvegicus
  Genbank Accession No. AA859218
tttttttttttttttttacagtaaatatttaatttggttccatcaactattccagtacattctcctggtatggtagcaaaaccatgctaagcagggggttcatgaggtatgggaggggtcattgaagagaccccagaatcactgaacccactccacaggcctactggttctgcaaaatgaaggtttggctgacaggatgtcaagttgggaaagaaagaattcaagatgggactctaggtctcagcctgtatttttgcctgtaggaaggaagatgtgcagaagagctggggcatatgcaagttctaaccgcgctgtgtggaaaacacggctaagcctctccacctgtctaggaacagggtcctcccttaagatcctctgtcactctgtgctagcttcctaattctgcgtttcaaattctgaatcctatgtgcccacttctgaaggattcctgcgtcaagcctgtctcatgtacccaaacccttcccattcctatccttttcccagccctttaagtaggattctggcctcgtgcc

SEQ ID NO: 390 - DNA, 606 bp, Rattus norvegicus
  Genbank Accession No. AA859230
tttttttttttttttttaaaaataaaaccagagaagtttatctgaaaattaatcaggcattttcaaatactctttcacaactgagattttattggtcgaggagtagagtacacagacattccaattcttaacacacgtacccaaactctgaagagccgtagtgttcatgtaccctaattctgaagagccttaatagtgttcacgtacccaaacgaagagctacatattgtttttctgtgaacttattccagtgatgctccagcctcaaacttggccagtttccttacgacctctcataacaaccgaatgctcacaatgctcagttccaccaattcacaattttatgtcacacacagaacatactcaaaatcaccatctttcacagcacattatcacaactgttaggaaaatggactgccatgaccacagacatcacagttctgacagggcgaggaccaaagactggctttcttacaaaatggttctactagaaacacgggaccagatataactgaaaatattccagacacgaatgcatgactgagaccccaaattgccatttagtatgctttgtactgtaggatataaaactagccccctctacgg

SEQ ID NO: 391 - DNA, 477 bp, Rattus norvegicus
  Genbank Accession No. AA859252
cggccgcaattgtttatttttgttggttttttgttttttacctttccaatgcgattttattagtgcttgcttccggaaaggagatcgttggtatttccccacactggcctcccctgggcagactccccacagacataggcgagtcattcttctgggtaagaacaggacattctacgctggggctgggcaatgactcaccgttattcagaatggtgacacagagcctgtgcgccctctctgctaaggcatgcaagaccctttcctctctgatgttgcaactgcagaaggctgagtccgtaaagaacagaggaaaacgcactgggccaagaagccagagaggcagatagcgataaataaacccaaagaaaagacgtttggcactaaacccgcctcctgggtggaatgtgagtggtggcacgtgggctcccccacgtggccaaaggtgttattgcacctgcagctacctgcctcgtgccg

SEQ ID NO: 392 - DNA, 490 bp, Rattus norvegicus
  Genbank Accession No. AA859325
tttttttttttttggtcatagggtttaatggtctcaaagagaagtgcaatcgtggtcagagatacgggccccccgacagactctccctttggacttcaatagaaacgatgtggtgtcctggtaccatggcgagacccagcacacggggttcccccgcagaaaatgaatcagaaggcttgaggaattcttgcgcagagcccaggatgacattacagtcacgatcggtgcacaggaagcagccgactagtgtccttccgtctgtcatacgaatacgcatggtcttgttgagcaatgcctctagctgctgccgggcacgcgctgcaggcgagtcctcctgttccccatcagagtccccggcgctggagctgctctgacgccgactgcaacagccattctcctctcgtagtagcatggtcggcccagctccggccattggccctgggacctcctttgggccttaaacttcctaagagcgttttgcctcgtgccg

SEQ ID NO: 393 - DNA, 453 bp, Rattus norvegicus
  Genbank Accession No. AA859330
tttttttttgcataagtagccattagaatatctttatacaaacatcttctcccctcgcaaatgcacttagctcaaaacacccaccttttttcatgtttttctgcggaggcagtggagagagaggagatgggagatgaggtttgaaagtgttcctcaggtagactaaagtacttggcgattattcccttcattaagaaagtcagctttgtaactgagaatccattaaaagtacagtgtgtccactttattaaaaaaggtgtcacctgggtgccacaagctcatgtctagcattatccattcattgctgcagggtttttaaacagtgtttcaaatgacacacaccaagctgggcagtgtggtgcacacctttaatcccagcagaggcaggcagagctctgagtcagaagccagcccagtctacagagttccaagacagccagggccctcgtgccg

SEQ ID NO: 394 - DNA, 558 bp, Rattus norvegicus
  Genbank Accession No. AA859348
tttttttttttttttttaaggatcatcctactgctaagtcagtgtctcctcttgattctagtgttttggccacgcctcaccaaatgtctgcaatgatccagtactcacaacatgttcaggaggagctgggtcagattttgacagagggtatgggaagggaaaggggagaagaaatcgacatttattttattatttattttaaatgtttacatttctttgtgttgttccaagcctgaatagaaacagatagcattaaaggactctgttcccaccccttctctgtctctctctcccccacttgtgctaacttaggataacactctctatttcgttttgtttctaaagtgatttgtggacttgtgccgtgtgaactgcattaaaaaggttctgttttcaaagatcgattgtcgttcctgtggggacagtggctcctaagaaatctgcattgtaggagaagacaatgaaagaccctggccctgtctctcaaaacttaactctctgtatgatttaaaaaaaaattccatttactttactttgtggttacttgattttgaggaa

SEQ ID NO: 395 - DNA, 566 bp, Rattus norvegicus
  Genbank Accession No. AA859351
tttttttttttttttttatagttaaaaatattgaaatctttggatccctttattccatggcctttattaaaaacacaaagtggccagatctttttccactatagcttaaatatcaaaaaagatttattagtaatttacagttagcaacaaacgtgtacagagtcatcggtaggccgcaggcctacacactatgttagtgatgttttacaggtgccagatgattctgaaaactccatctttttgatggaaaacaggagtcagcattaccacaacagaattccaggcatagcaggaggagcgggtcaactgatagatcaacgagtcttaatgtcttaaaaaggagaaggttacttatttgaaaatacagcaaggtacattctcatctatgattatttacattcacacacttaaaatatctgttatttgaacaaatcctgtgatttgctacaaaacgaagtccatacactatgcatgaataatttatgctttttagataatggaataaagttatcaaatcttcatttgtgttccaaacattacaaaggaaataaaaaaccttaagcctg

SEQ ID NO: 396 - DNA, 561 bp, Rattus norvegicus
  Genbank Accession No. AA859362
tttttttttttttttttgagacttatacaatcgctttattttctgtccccctccccgaaatgtaacaacattaaagccattccaacgtagatctatttctacggctccttgcatatctcattgtagctgaagttagatgtttcagtaacgaaatgaaggttatctcatcaaaatggtggcacatctcaaagacgggtttcttgttcctgtaactctctgcctatccctcaaaacctaaaaccccctacggtccagagctaacaggaagacagccacattcttcggggaagaagggacagccgaaggggcggggccgggagaaggacaaggaattggggcagaggagaccttcacttccactttctcagcaggaggaggtggtttctgagaaacaggcttagagtcggcctccctgcggatcacttgaatggggatgtgtccaggagggagatctggtccagctaggcctggcttgctttctggtttgttttcgggttgggtgacagggggaggctctcgatgggtcatgggctgaggcctgtcaaccactgtgtgcacacg

SEQ ID NO: 397 - DNA, 406 bp, Rattus norvegicus
  Genbank Accession No. AA859372
tttttttttttttttttgtggttcacactttattgcaaatcaaatgggtccttcctggggaccagggcagcacagtgagatctaatctctcaggccaggctggggattcaggggtctggtacagtcctccgaaaatcagtgagggaagggttggatgcagggcagagacaagggagggggtaatttgcgcgcctgctgccttccttggatgtggtagccgtttctcaggctccctctccggaatcgaaccctgattccccgtcacccgtggtcaccatggtaggcacggcgactaccatcgaaagttgatagggcagacgttcgaatgggtcgtcgccgccacggagggcgtgcgatcggcccgaggttatctagagtcaccaaagccgccggcgcccgacccacg

SEQ ID NO: 398 - DNA, 496 bp, Rattus norvegicus
  Genbank Accession No. AA859401
tttttttttttttttttcatggtggtacacagctttaatctcagccctcaggtggcagaggcaagcagatctcagggtctaagtccagttctaggccagccagggatagagtgagatcctgtctcaaaaaaagttttttaaagtaaagacaaggagatacttgaaaaagaacaatgattaatctcagcatcgattcccaagaacagaatgaattgtgacagtgaacctctatgagtgttcatgcacttaactgcacttaaagatgtcaaacaacaggacctttgtctgggtttgtaatctgtcaagtgtgacaagacactggtgcttatggtggggttgatttctgcaccgccccctatggctaaaatgtgcagactccatggccacccccttacagacccgtgttcatccctgcctgttggtcaactgtactgtgggttagtgtgcacctgctgtctgagaaggcctctgagaaagggactggctgcaaagaacc

SEQ ID NO: 399 - DNA, 451 bp, Rattus norvegicus
  Genbank Accession No. AA859468
  misc_feature (1)..(451): n = a or c or g or t
tttttttttttttttttatattaaatgactattttatttacacaccctatcatatccataaataattgcgccctctttgtctgcacaatggttccttgacatctaacgattacagagtgaacatctaaaagtagatgggggcttactccggcttaggacatggtctcttgtgtacactcaatatgcacacccagtaacacagacatagaccagagagggtggctcccagggcctcctgggctcccagcaccaatgggaaaaccttgcccatacacaggtgagttcctgacaactggagaacagagagatgcaggccagggctccgccccacccaccgcagggccccgcccacctctggagcagctccacctttgttcaccctggaaggcatctctttggattgcaaatactttaattcacagaggggatggggtangggctggggtggtgt

SEQ ID NO: 400 - DNA, 458 bp, Rattus norvegicus
  Genbank Accession No. AA859479
tttttttttttttttttggagctggggaccgaacccagactactgttttttttttaatttgttaatttattctgagtaaacatttgctcataacactttctcagaactacaaatgaatgccagagaattatctccgtaggtaaagttggttgttgctaaacctaataatctgagttcaatccctgaaatgcccatcttattcctacaaatttttctcttcttttaacacttgggctgtggcatatacacaatacacaccagcacatacataaatgatttttaaacccaagtaaggacctgtggagagccgcaataacattcaccaccacaagatggcgctggcttccactgtgccccacgtggaaagccgggatagcttttgccattacaagatggcgctggcctccgccgcgccagccgacttcctttcaggaagttaactgtgtgcgcatgtgcaa

SEQ ID NO: 401 - DNA, 489 bp, Rattus norvegicus
  Genbank Accession No. AA859502
  misc_feature (1)..(489): n = a or c or g or t
tttttttttttttttttgctgtaaaaatagtttattggtttaaaaagtaccttccatgattttcaaacactttgcataattcattttatttatacagaaacactgggaatgagaaaagaatgcatggctttttccacatttagcaccatgacatagccaggacacttggaagtttgctgtgtggcttaggctactctcaaatggacagtgatccttctgtcttcatctcttgagctgttccccaccattcccaacctcttgctctgtttgctctgggaagggaggaacccctaactaggaaggttttcacttctagccacactctaacaccaaggaaatttgggctggcaccaacagctcggcagggacagggtgggcattcaagagtaaggtttcaaacaactgccagcattgcatatgagattcccaaaggctcanaggcagaaaagtcatctgtccttatatgagggtctcacttaaatttgagtt

SEQ ID NO: 402 - DNA, 469 bp, Rattus norvegicus
  Genbank Accession No. AA859509
tttttttttttttttttgttattgtattttttattaaaaaaaattaaataaaaaacaatccatgatatatataaaactgtccatcatctgcctgagtccatagctcacggtggggatgactcagaaggggcacccaagggtgtggctggagcagtctctttttcttcatatctcgggggcaggtccagcggaagatgcccagtgtgtgaactctcagaggatgaacctggcccacaaatggtgtatatgacttcccgatctctctcagaggctgctccctggttctcaggagttggggtcctgctgagattaaaaagactggagtatgaaggtgggttttcgatccggtgcaagctgttagccccaggatatggagctgctgctgaagactcagcaaagtaaggtggtggagggggcgggaatattatcactgagtcacccacagtgatgtggacaggttctgtactgt

SEQ ID NO: 403 - DNA, 425 bp, Rattus norvegicus
  Genbank Accession No. AA859519
tttttttttttttttttacagtgtaaaagagtaaaacacattttattatatatttttttttctttgaggaaaacagatgtgtgatagaggctgttatgaagtcttgaagggatcaaaactgggcaaggtgttttcaagccagcaagctccagttttgcagaacagctggatgacagtcgccaccagtgaagaccgcattaatacccacaagacagattgcagccgccatcacacacccgagacacagcctcagcagaactgccgggacttccagccctgggaagtaacctcggacggagggagccatcgcatctgggcatgcagtgaagcgggataggtgaaagcggcaggaggaggaagagcatgcgctaactccgctgggtacagagggtacggggcccacacttcacggctactggggtaaa

SEQ ID NO: 404 - DNA, 499 bp, Rattus norvegicus
  Genbank Accession No. AA859524
tttttttttatttttttgatgcaaacgcaagagatttatttttccagcgtattggggtctaccttctatcagcccctcgtgtcgagtgactgtcgggctataacacagtttttatactttttaggggtacaggttatgtcagaaaggttgcagtttaaacttattggctaagcatattgacctttgaatctattggctagcaagcatatgacatacattcgaactctatttggaaccagaaggtcaggtgactatcagtcagtacattctgtggtttttcaagaatgtccctgctcctcctgagaactgtgggcggagaatggaacttagcctagccttgacctgaagtgggaagctggtacttggcctaatcttgacctgaggtggtgggtataaggctggtgaaagcctctaaagtccttcacacgtaccccataatctacctactttctaccaggtcaagcttcttaatagctcttacacttcagtaagaatgagg

SEQ ID NO: 405 - DNA, 548 bp, Rattus norvegicus
  Genbank Accession No. AA859536
tttttttttttttttttactttttaattgtttaactttattactgtcgcaccatttatacaattacatataatttcaatgcatccattgtacattttttttattttttgttttttttttttattttccattttccaatgggtggtgtgttggtgtctgagacacaggtggaagaaactggagctgcaatgaaggcagacttttttatttttcatttccactgaccaataaacagaactacaggtgcacccaaccacggacatgcattaactcgtcatgagaaatctaggtaggctaagtatgatgagagaatgtttgtcactcccaaaaatatctggagaggaagaatgtagggttggcattgagatacaatgtggacaagctaagtgggctccgtctgaaagttggcattcatccacaaacgttaaaaaaataccaaaataagaaaaggctgtaaattaataaggaaacacagaaaatactgctttcataaagatctgattgccttggcactggccctgtgggcagaatcaaacgcctccctcccca

SEQ ID NO: 406 - DNA, 533 bp, Rattus norvegicus
  Genbank Accession No. AA859585
  misc_feature (1)..(533): n = a or c or g or t
tttttttttttttttttggtggtttggaattcttttctcttttgttaaaagaggggtaggaaatggggaccaggtacccctgggctctgggaaacaggcatgcagggaacccttgcaggcaggggctgggtagaagagtcctggagtttcccataatccttcgcaggaaacagcaatgctggcagataaggaggtggagtgaggcagggcccttcaaacaacagggtggcgggccaaggggcttggggctcactctaacatgcaaagtccagctgccccataaactaggttgcttttgaagagcgacatacgtataaatacataagacacagctacacgcacacatgcggagaaggctctgcattcccaagggtanggatctaggcctactggccccaagacaggagtcatcatgtgtctgccaccaagtgattctctgaaacactccaggtggtggggccaggcaggtaagtcttcgttgggatggctgcttggtctccaaggtgctgcccactaggcacccaagccacttt

SEQ ID NO: 407 - DNA, 423 bp, Rattus norvegicus
  Genbank Accession No. AA859593
tttttttttttttttatgatttgaactttattcaaaagaacgattatcagaagcagtcaaacaaagacacatacagggcagggtccagcagggtctcgagcacagaggctccctgtcctgccatcacgggacaagaatgcatcagtctgaagcagagctgtgtgttcatctgcagggaagctgctctaggtctcaactggagatagaattgaaccatcgtttgtaggtagacaggattcacagagatgttgaactgaagtcaaccccctcttcttccctttagaggtccttctagctcaaggcctcaaccctgtaatcgatgacaagctggtagtggctagctaccatcctaggtcatctctcgacataaattctgctgtgacacacaaggcagacaagtaacaacgacactccatactctca

SEQ ID NO: 408 - DNA, 314 bp, Rattus norvegicus
  Genbank Accession No. AA859612
tttttttttttttttatattgttatgcctgtgatgagtttagggttgattgttaatagtatgaggggaataatgtgtacagctatgagtgttaattctcgtgtgtgggaaggttggaagttgtttatatggctggttggtggaagcccttctttgcgcagttgaaattaaatcttgctgactaattaacttttttgttgatcacaataagggcaaagaaaaaagatcaaattagctggacacatttctgtaaatatttttaaaaaaatgctgccaaatgttctgtatctatgggtttcgtatgatcgtcaacat

SEQ ID NO: 409 - DNA, 539 bp, Rattus norvegicus
  Genbank Accession No. AA859626
tttttttttttttttttaaatttacacttctttatttagtatgtgtgtgtgcaccatagcacacatgtggagttcagaggacagtttgaaggagtcacctccctccttccaccgtgtggatcttagggaattagccttggctgaagcacctctacccaggacgcctgcccaaggagcagggtcatcaactgcttggagtggtgcccagattgcaggctggctctgccgggacaccagctggtagaggccccaaactccagacagaacactgcagttccatgtgccctttgccccaaagctgccgagaaaggctgtggtcgaaagggcactgggaacggtgggcctccatgtcatcactgcttctccccacccccaaccctaagctaacacacttgtgctctgggtgtggggacagagaggcagggcccatagccaccccatgttttggagtcagagctctctgagccagggtcacggtgccaggttgcccttctttcctgtccacagttcacgaagctccacacggcagcccaggtctc

SEQ ID NO: 410 - DNA, 524 bp, Rattus norvegicus
  Genbank Accession No. AA859631
  misc_feature (1)..(524): n = a or c or g or t
tttttttttttttttttgaatattcagtgcttcatttttctccaataccagtatgggtaaggacccaagtcagtcacagaaatccatacactttgcacaggcagcctgttcttgcatagtcactgccccaagcagccaagctgtggaggagaccacctgactgcatgacgactcccaatcttcatacacattttcagtcaggccagtctgcagtacctaggccccaagcagcaagatctcagagtcccatcagaccagccagtggggcaataattaaccccttcttagccacagcttttgttctattggtatcctggagtctgtgaccggctttcccatggggaccaaccaccctactgaccatattgtaacctgtgtgacaggctantgctaccattgatccgtcccaggtcatttcatacaaggtggctttcctaaggcccccatagacccctcacaaggtacctacacatggcagccaattcggaatggtctactaacaatcatagcccatcctagacatt

SEQ ID NO: 411 - DNA, 283 bp, Rattus norvegicus
  Genbank Accession No. AA859648
tttttttttttttttttgcgactttgaaagattgtaatatattctgtggaaaacattcggcagagcaaaagccctccctgggccctcccgcagtatgcaaccagtggaacggtctggaaatctgcagctctggaaaggtccctggctcagtccttgaggaatgcaggcagctatatgggaagaacctgctccaggatggttctggatgagatggggatcctatcagggaagatgacttcaaattcgataacaaggtctccacgtttctcaggtgttttgggga

SEQ ID NO: 412 - DNA, 546 bp, Rattus norvegicus
  Genbank Accession No. AA859652
  misc_feature (1)..(546): n = a or c or g or t
tttttttttttttttttaaataaaaagccacaaatttattgtaaatctagaagtaccagaacgtcactcatacagatcagcgatcctgtggtggttttcgtttttgttttccccacccttcccaacattggcacccctgattgttgacagactgaaaaggacacacgttttcctgtctcatgcagtagacgagagcagacccctcagaaaccagttataaatattaaaccatctcgaacattcgtagtacaaaatcgcttgtaaagtgctaaagtcagataacacctgcaaaccgaccctcgagcctagagcatttatttctcgggggcagccccacagagcttgccacatccatctcatttcactcgagtctgctctttcggacagacacgttgtcttccagtcactcgccctcccccaagttttacagattgtcctactagttctatggctgataagatgctgtattaaacgtggcgggtggtgacgcacctcaccacttccgtctcagtgcanagaagagattcaagcttgtgtgtacctgta

SEQ ID NO: 413 - DNA, 371 bp, Rattus norvegicus
  Genbank Accession No. AA859663
tttttttttttttttttaagagcttagaaaatttatttttttcttgaaatgacacacatgggcagggaggtaggacttggtgtaggttggtggaaaccgtgtcccccagcatcccagttttcctctcagttctttgatgagaggtctcctaaagactgggaggcggagcggagagctcccagttctaagcttggaatctaacttgaagtgcggagggtatggggatgtggtgggagccatgggactttgttctctggtaaaaccaaaaaatcaaaacaacaaaactccgagtcagctcggggatacttaatttgcatattggatgctgggtttcaggaaggatgttgtgtgttggtccttgcctcgtgccg

SEQ ID NO: 414 - DNA, 417 bp, Rattus norvegicus
  Genbank Accession No. AA859665
tttttttttttttttttcacgaccttttttgcttttattcttttggtagatattcaaggcatgggcagatgctcacagagcatcgccaccacagagacaagttcctgacagtgcccgtgagtctgacgcctgtcagctccacaggcacggggctgcacagcactgttctgaaatgcgtccctcatttcatctttgggaagctgggcagacccaatgcgaacaggccgggcctgtggtaacagacgcagcagcttgcttgctaggaaccaattctccatgctaaaggcaaacaaactttgcacagcacctccctagatccgcagcccaagcagcagacaggcatgagcagacacacgccgaaacgctcagcagagcgctgtcacccacctcaacaacaggcaagcagctttgggctca

SEQ ID NO: 415 - DNA, 522 bp, Rattus norvegicus
  Genbank Accession No. AA859693
tttttttttttttttttctgtgtcagagccagcccaatccaggtgggctgctgggagggtttactctcattttctcctcagacttttctgagaagcccagaaaaccacggagaccagattagtgtccttaacatctcaactctacagtagtcggacagccacgtcctaaatcctgtcagctacttcaggctaaaatccatcaagtgctgctgagcccaaggctaggcgatggagaggtggcttataactcatccctcatggcctgcatcctacttcctgtctccagtcactgccttcccgagtaatgagataatgaagaaaataagagtggatggaaatcaccaagcagaaattacacggtgccattagcaagcactataaaaacaaaattacaggttaccctcatttcccatgctcacacctgtctaaccagaaacactagattaatctaaccagtatatgcaagaggaaaacctcaaacagtaatttcaaattttaaacctgtcagccattcaaattgtt

SEQ ID NO: 416 - DNA, 483 bp, Rattus norvegicus
  Genbank Accession No. AA859700
  misc_feature (1)..(483): n = a or c or g or t
tttttttttttttttttcaagctccatcaacttttactttcatgagtaggagagtgggggtcagctgttcgattctgtgcccaggacagcaattgctgcctggcgcccactctctatacagtcattgacagctaccccctcataggaggccccagccaaagtcaggggcaacctctgggccgtcaggaattgcagagctgagtctagtttttgccagtggcctagtgtatactgagggatacagtttttgtgtagatggaccaagcaatggcttggttgctctttcagtcctaactgtgtggcagccgcttcctgtgctgctcgttggaatagctctggagacaattcatggccattggctttcagcttctgtaaccagtaacctcccaacatcacagtcagtctgaggcctgnggggttcccatcctgctcaggaaaagcaaccgagtcatacacgattcccaggacggtcgggtcttctga

SEQ ID NO: 417 - DNA, 477 bp, Rattus norvegicus
  Genbank Accession No. AA859722
tttttttttttttttttgacaggtacacaattttatttaacagcatttaaagtccacctcagaagagggacaccagagaattctttttttttttcatttaataaatacaaatgaataaaaatactttgttttgtacagagaccgcctctcctctcttcctcccccgcttgcttgccaggaagggctgaggatggcaacatgccctgtggccgctctgcatgggcatctccccacacagaccgcttctcacagagagggcttcatctcagtggcctacaatactatttcggtacaatcccctcctcctgcacctaccaacaccagactcttgcctttcaaacagaccgactcccctgggagaaggaaagcacaggcccccacaggtgcccgcctggagccccatagctggggactcgtgacaccatgggacatgcacgctggccactgacatgtgggcacgggacagaagcagacagt

SEQ ID NO: 418 - DNA, 435 bp, Rattus norvegicus
  Genbank Accession No. AA859740
tttttttttttttttttggcctagtgccctatcccttacgttctttaagaggccctggcaagcccttagtggaggtgccatgactttttcagagtccatatgcatgcagccaagggttgtgagctgtccctgagataggacagggcccactccctgcctctgcctcactctgcactcaggctaagaaggggagggtcaccacagacaggagtgggggccattatgtagcacagcaatattctagatgttggcaggtgtcactgctgccccagagcaatggcttaatcttcacgtgtgtggtataggatcaggcactgggcacttgaccttggggtccatgggcaagatgagttctgattgtgcactgtccggcccaatctagggccacctttatggtggttgatcactctgaagatatgggtggcaagatgagtt

SEQ ID NO: 419 - DNA, 458 bp, Rattus norvegicus
  Genbank Accession No. AA859750
tttttttttttttttctgaagtaaatagagacatgtagagtcttccctccatgtcaggctgcacttcattagccccagctcagtaatgcagggaaccctagtgacccatcggccaagaaactcccagaagcattaaaaaaaaagttatattccgctgccaagtggatagtcatttagctgtttgtcccttgttttttatttattccataattatgtttgtgctttttcttgtgtgaacagtagtgaggcgtatgtttttatgtggctttagagaaaacttcagtcttcaaagaactgttctaattagttccttctcggaaaaagttatgcgttaatttgtttcaaaatatttaggcattctttgaattataaacttgtgatgcagggatttgtgaacgagacgttcacaagtgaagatgacttcacttagcatctgtgtaaacagaataagatgtgta

SEQ ID NO: 420 - DNA, 455 bp, Rattus norvegicus
  Genbank Accession No. AA859757
ttttttttttttttgctgactgggcgaatttccaatttattgcacattcttgtggggtttggggttaaggagatgccctctaccgagagccggatgtaagcccatgcgggtgccttgtcccagctgcccgctttccccatgggcctgaggctgggtttccatgcaagactgaaagccaggcacacttaacatttataacaatacaatacaaatatttacttaaaattctcacaaaaacataagcacctttaatccatcggaaaggcacatgtggaatgacatttggcctctgagtggatatgttgagggttggttttttttttttttcttttttaaatggaggctttggtgacctttacaagaccacctcagaacatcttttgaaggtcagggggaatacatatcttcaagttgaatttttttaaaaagtgattttcaaatactgtcccgcccca

SEQ ID NO: 421 - DNA, 517 bp, Rattus norvegicus
  Genbank Accession No. AA859827
tttttttttttttttttatatatatgtatgtatgtgtgtatttataactggttacacgttggattcataattaggcatcaccagtactagttggcacagtttgtcacttaagctcagggtcaagttcggtcaagatttgctgttccaaagtacaaaagggcagaaaggaaaatcaaggcatttcatctccgtggtgttttcttaaatacagtaatttcagaggaggcatatgtacaggtgaccaaagcctctcgacccctcctgcgtcttggagctgggggctggggtatggagtcagggcacgggggggtcaatgtggccggctgctggactctgacgcctgcctcttgcgggaaggggtatagccgttgagatagccgttcgtctgccgcttggagagcccgccgttcaggatgtcctgtatatgctgcacgatgaggttgatggccacgagattgtctgcacctctaggaatgatcacatcagcatatttctttgttggcaagcagaactcctc

SEQ ID NO: 422 - DNA, 504 bp, Rattus norvegicus
  Genbank Accession No. AA859829
tttttttttttttttttgagaaatagaaagctattttattaacacgctttacatttacagttcattagctaatcaacatcaacatgcaaaaataagcgctagatacaaacctctacaatatggttttgtgtgaattacaatggttcatgtctggaaaacccgtcagtacttactttagctgaactatcagtttccgtaatgaaaagcatgtacactctaggactacggaaccacctggcaaggcctctgcagaaactcagtccagtggctttcccgtgaatacattctcaaagcaggagataaggcggtgctggaaggtgagacgctgaacctgtgcacagacacagccccagacaccctggccacaagggcagctcggaagcgtttattcagtgtctcatagggcaccttgagggtcgggtactcctgcaccttcagggtcatggacagctgggccgccgactcctgcaccgccatcttgggccggccctcgtgccgaattct

SEQ ID NO: 423 - DNA, 268 bp, Rattus norvegicus
  Genbank Accession No. AA859870
tttttttttttttttttagcagtagagcagatttattgacgcagcagtggtcaggggagcggggacactgaggtaagacaggcctcctgacgcctgaagttacaggttcttttcacgcactggtcacaagaacggcatcaggcaacccttcacaagcagtacatcaacttgtgtgcaaccagcagtcagcctcctccaactccttggtcaccaccaatagcacctcgcacaggccttgagccaaggcatctgccaggaaggctctgac

SEQ ID NO: 424 - DNA, 426 bp, Rattus norvegicus
  Genbank Accession No. AA859877
tttttttttttttttttgctggttcaactatttattgtggagtactttacatgcaagaacacaaattagagacagtgtttggaagcagaaccagtggggtagggagacacaatagttgtcactctgagccaccctccagaagcagctctacccacagaaacaggacagggacaagaatctgactcgtgagacaacagaataacaaactcaacaccatcttttcagcagctccaaagatcctcagatcctcacaaaggaagtgcaaactttaggaagaaactacccagctctcccagagagcctgagggcatgagtgtggcaggagggagcagtcaggacagaggattgacagttattcttgggagctaggggaagcctagcttagaccccatgaacgtgaagggctggggatgcgcactgggctaa

SEQ ID NO: 425 - DNA, 599 bp, Rattus norvegicus
  Genbank Accession No. AA859897
  misc_feature (1)..(599): n = a or c or g or t
tttttttttttttttttagccagagatgggatctttatttcacaagtttcaagatacagtacaaaatgagtctgtacatctctctattaacaggatttgtttacacaattataatacacttcaccagccgttatactgcattccattaaatataaaataaatttacaaaaagtctagtatggtgttccttcacaatgtcagcttatgttctttaaatacgtccctcagcgtttatagtggtcatattttgatcatatcaacattgtttttaaataaaagagaaatagtgtcagatcgttcaccaataaatagtaaaggaagaacatctgaatgcctccttgaacataaccaaaggggcccttcatctgcatacaaaaccggcttttaatgtgtaaacagtctctttaagatacagatcattggtatatggggctatttcactangggtattttcttgaaacccctaatgggtgaagacacttaggtcctttttcaaagaacactactcatttaaaaacctgacaatatagcatccagaaatagtttctctcgtatctgatcaaattttttttttgcataaaattgtttttttttttttt

SEQ ID NO: 426 - DNA, 520 bp, Rattus norvegicus
  Genbank Accession No. AA859898
tttttttttttttttttaacaagtctttttttatttgtggattttttacatgtatcctacagtcttgttttatataagatcatacactgcagctgacaatgtggtgattggacaaccaagacaaacagcacttcccagattggctgtaacaatcaccccacaccatgctgctggtgtgttctccctcggcaggcttcaccaccacagcacagcaccgcacagcacagtctcaggatggatggttagacagcacagcattgctgtctcagggtggatggttagacagcacagcaccgccgtctcagggtggatggttagacagcacatcactgccgtctcaaggtggatggttagacagcacagcactgctgtctcagggtggatggttagacagcacagcattgccgtctcagggtggatggttagacagcacagcattgctgtctcaaggtggatggttagacagcacagcattgctgtctcagggtggatggttagacagcacagcattgctgtctca

SEQ ID NO: 427 - DNA, 548 bp, Rattus norvegicus
  Genbank Accession No. AA859909
tttttttttttttttttctcatcagtcctttattagtacacatcagacggggccaccctgccaaaggaggagtctttcctccatcagtgtgagtccccgcatgaaggcccatgaggacattgttgtcactgctgggacattgactaggtgagctgagcctcatgaactgaaggacgacatctacaccagtttggctactgaatgacagctcttttcaacaagacagaaaacagttttcagcttaacatgcaggaggccaagtgacctgtgtggagtctgccccacagctctccgtgcacgtggcctccctccccatttcccagaaatccctgttgtgcgtaaatgccgaggccaggactgtgttcccaggggagagagatggcattggctgatgcagggccacaggtgttccacactttgtcccttagtggccactggcagaacttttagccaaaagcaatccgtattgaccagcagattaagctggaggttttgcatttattcagtttttccaacaccaaaggcatggcgggcaagctcgtccatca

SEQ ID NO: 428 - DNA, 568 bp, Rattus norvegicus
  Genbank Accession No. AA859920
tttttttttttttttttattttataaaattagatccaattttattaaggatttcagattacatatttcagacttctagaggagaatagaaccacttggggactgacagatgtcacaagaaagactgacccctgaagctccacacagcattttcccattagacaagagccagctacctctgcactttggcaacagctacctcctacagaaggaagggaagactgcgctagtctgtaaggttactgaagaggagatctgtaagttataaactttaatgttcaagaaaataggctgtgtttagatgaactatgattacagaaaatagcacaaaccatctaagaaaaagcaaccaaatctttttcaaaatgaagaaaatatagttggttaaggatttccagtagttaaaaatttcaggaagattggctatagaatgtattcacattctaagagcttaatattaaaatctcacaaaaagaactatcacctccaaaaaaagtttcttcaatgtaaattttattaacagcaggaacttcctccaagtccaattcaattaaaccctgtcagagtgc

SEQ ID NO: 429 - DNA, 534 bp, Rattus norvegicus
  Genbank Accession No. AA859933
tttttttttttttttttgcaccaattcaagtttggttttattagaaatcccaccataatcagatttttaaagactggatggttgccttgtaacttttccattcccatttagaaagataactagaagcaatgacaaaaataaccacttaaaataggggattcttcccccgagtttcttgtaagcgtaagtccaggcattccactcttccactcagaaaagaaaaataaaaggctttggagcacaccaacctttactcagatggacaaaacatctgcctccagttctcacgttagaccaggacgcatatccagagtggctggtctccatccagcccatgcttgctaaagcagccgagtaaatcccaaggtcagtcccaaccccaaccttcaacagtatgaactgcttacacctcttatgacacaagccatgcttcggcggaagggtcgggtcagacacccctcatctcccgtgggtgaatcacaacagcagtcatgtttgtgttctcttccctacagttcagtgtgcaaagccatt

SEQ ID NO: 430 - DNA, 460 bp, Rattus norvegicus
  Genbank Accession No. AA859952
tttttttttttttttttaagttttatttaaaaaaccttcggtgcaatattaaaaagcaatacagccaggtggaacagtcgacagacagaaagggaaggagctagaggacccaaggtcctttacctcacctgttccccagaagctgggggtcaagggggagggtctgggggtggtgggacgaggaaaaaccaccacatccatgactgtccactccactgggtccgttggcttctccttgcgcccaggaggacagccaaatggtgtcccatcagccccaggtagggctggttttcctggaggcaaaggcacaggagatggagaatctggagcagctgtaacacaagccgatcccccttctttattcatagctgtcatcgagaacacctggtgtgtgcagctgccaggtgctggtccccgcccttcatcctggccctggaaaggtccacagggcgaccactcc

SEQ ID NO: 431 - DNA, 409 bp, Rattus norvegicus
  Genbank Accession No. AA859966
tttttttttttttttttcaactttattccagtaatttaagagaagattaaaataatagataatatgaaacagatgaagataaccgagctggtacaggtccaggccagcctagtataaagttaaggaggcatggagaatggtgaggcaggggagtggagatctctgttgcaatggcggaaagcagcttggagtatggttgatggtactgtctccttctacacgtgtgttcaatgtgttaacaaatgggaaacggaatcctgcctcattctaaaccagatggtaagagaaatatggcagaacgaggttgtggtatccaggcggctcgggcctgctttgaacactctaattttttcaaagtaaacgcttcgggccccgcgggacactcagctaagagcatcgagggggcgcc

SEQ ID NO: 432 - DNA, 425 bp, Rattus norvegicus
  Genbank Accession No. AA859971
tttttttttttttttttacaaggaagcaactttattactcgttcttattactcattcccagtcagtttctcttcttgctcttgccagtgactttggacggcgtgagggctggagctgtagcctggtacagagtggaggatatcttgttgatgttatacagaccaaccatggagaagatgaatcaagtggtgacacagactctgtggatgaggccatatgcgaagagtgccaattcttatggaaacgccttttacagtcatcgctgatgtgctcagcagatacagtcttgaaggtccggaggcctcttggggtttctacatatcccacaatagccacaaccaccatgggtggggtttccacaatggtcacaggctcgacaacttcggtcttattcaccttagatcctggccggtcaacttcccgga

SEQ ID NO: 433 - DNA, 506 bp, Rattus norvegicus
  Genbank Accession No. AA859975
  misc_feature (1)..(506): n = a or c or g or t
tttttttttttttttttggtaggtgattttctttaataattttgttaaaaactccagtttttttcccagagatatcagcttctttatgcagctagctccccctctgatcctcaagactatccagatttagggttggggttatcaatccaatttattaagtcctcagggaggaggaaggccacatccttccatcatagaccctttggccatcttgacagtttctgctttctcctgtctactcagatctgcctttgattcctcagagagagggatctgctgtcttgtgtgccctgaaattaacacccaaaaagagactagaaatcctcagggtgtttcttaggtctcctcaggaacagccagggacagaatgatcctaagtatcaggccaggcacagcaagctggagcaggggtagaacagactaaagttctttaccacaaaggaggggaccacactgtanagggaaaataaatagaatagcccagggtancagaatccaggcccccc

SEQ ID NO: 434 - DNA, 441 bp, Rattus norvegicus
  Genbank Accession No. AA859977
tttttttttttttttgtcggcttctactctgcctacctggtggcagagaaagtggttgtgatcacgaagcacaacgatgatgagcagtatgcctgggagtcttctgctggtggatccttcactgtccgtgcagaccacggtgagcccattggccggggtaccaaagtgatccttcacctcaaagaagaccagacagagtacttagaggagaggagggtcaaggaggtggtgaagaaacactcacagttcataggctaccccatcaccctctatctggagaaggaacgcgagaaggagatcagtgatgatgaggcagaggaagagaaaggggagaaggaggaggaagataaggaggatgaggagaagcctaagattgaggatgtgggatctgatgaggaggatgacagcggcaaaaaaaaaaaaaaaaaaaccctcgtgccg

SEQ ID NO: 435 - DNA, 499 bp, Rattus norvegicus
  Genbank Accession No. AA859980
tttttttttttttttttgcaagggagggaagagtttatttggctttcaattccagttacagttcatcattttggggaagtcaaggtagacgtttgaagcaagtaccatcctgtctggtcaagcagagaaataaatgcactgaaggcgcttgctgctcactttctaacaacccagaggcacacttgttggaacggccaatcttctgactagaatagctagaatacctaccccaccacctcagcttagaagaggtcactgaatccaatttccattacaggattggtcttgatttgatcaatgggaaaccacaagacaacaagcaagcaggggtgtttgagcgaagagcctgaagttcaaaccagaagccacatccccattccttgaatggatcatattgggggccgtgcataacggtgcatgtctttaattcaagtactcaggaggcacagaaaggtggatctctgggaattgaagccaagctcatctacaaaacgatttt

SEQ ID NO: 436 - DNA, 528 bp, Rattus norvegicus
  Genbank Accession No. AA859983
tttttttttttttttttgcatttcattttttattaccaatcaaaaataaattccatatattgtttagcaaatattatcattgttttgtgacaaaagacacaagagtcataacaacaaaactccccgagagtcaaactcataacaatgccaaaataaatcacaaaaatatacaaattaaaatcttaatgcaaaataaataggagtcatctgctatggcggctgtgacttgcctacccacttggacgccgtctgtggagtcctcccctgctgggaagacacgcagaccaggccagttccagggtatgagaaggcaccggtctcaaacttcatgttctccttgcctgcttccacctccaccttcccctgcaggatgagaatgaagcagtcggctggcttgttccgggtgtacaggtagtggcgggtgcagtgcttgttgtgctcgtcgaacctgagctcctgaatgacgtcagggtacttgagcagccggagcaggatcttctctgacatcagggagggactgaactgcgg

SEQ ID NO: 437 - DNA, 458 bp, Rattus norvegicus
  Genbank Accession No. AA859990
  misc_feature (1)..(458): n = a or c or g or t
tttttttttttttttttcaactttattccaataatttaatagaaaattaaaataataaataatatgaaacagatgaagatagccgagctggtacaggtccaggccagcctagtacaaagttaaggaggcagggagaatggttgatggtactgtctccttctacacgtgtgttcaatgtgttaacaaatgggaaagggaatcctgcctcattctaaaccagatggtaagagaaagatggcagaacgaggttgtggaggagggtggacactggctttctgaagagccccaccagagggtaatgctggaatgtaccgtgtggttagcagtgagtggcaatgactggagagggctcactgaacatatcatgcaatgaggggttanagggaagacccacgacttggccagcagagccggggcaaagagagagagggactaggtcccagaagcaagagaaaagc

SEQ ID NO: 438 - DNA, 570 bp, Rattus norvegicus
  Genbank Accession No. AA859996
tttttttttttttttttatttttatattttatataattaataaaacagtgcttgtataaaaattcacacaaagttgctagagagcatacaagttccaaaaaatgtcctgggtttgtggtacattcagttttctaagggtgcactcagatcagtgtaacaggcagacatgacgtggtatctcgttctctttggtaaaactattcttgttatatcactcctcacagtagtcactctgatatccactttgtgcaaggtctgcgcttcctgggatgtcagacatactattttagtgaacatcagaatgtcggggctaatctctagtcctctggatacaaggcaaaaataatctaaaacacggagaatttagatggggacaggaaaagcaattgccaacaagattttatgagacccattaaattctgaaaaaataagtattttatattatattgcttcatggaaaaaaaaatgcccactggagcttcctgtacggatggggaactgaggaccatacagtccagcaggggcacgaaacagctcccagagtgtccagctcgtttcactgaaagggac

SEQ ID NO: 439 - DNA, 305 bp, Rattus norvegicus
  Genbank Accession No. AA860014
tttttttttttttttttctttcgtcaatcatttattggggattctgggaaagacctcagggacggttcattgaaggggacgaaatacgtcatagctggtcttggtctcgcggcgattgcacttaccggtacttctcattcaggacagaacataggatcgacatgaacttatcacaagcttcatggacctcacgggtaaagtcagtcgggaagtgtgcatccaatgtgaccaccagacagtgagacacgagctttaacttgacctggtctacacgcaggatgtaggcgtttaactcgctcaactta

SEQ ID NO: 440 - DNA, 607 bp, Rattus norvegicus
  Genbank Accession No. AA860015
  misc_feature (1)..(607): n = a or c or g or t
tttttttttttttttttgcatttcattttttattaccaatcaaaaataaattccatatattgtttagcaaatattataattgttttgtgacaaaagacacaagagtcataacaacaaaactccccgagagtcaaactcataacaatgccaaaataaatcacaaaaatatacagattaaaatcttaatgcaaaataaataggagtcatctgctatggcggctgtgacttgcctacccacttggacgccgtctgtggagtcctcccctgctgggaagacacgcagaccaggccagttccagggtatggctctgcccaggaaccagaggttggaagaagtgaaaaattgcactatgaggaggaagtcatcagaacagtaatatttggaaataattatgaccctctgcaagaagtgattctaagtgaggaagggaggggcggggcccggctgtcggtgactgtgtatgcacagaggtanctgtggaagtgtgtgcacctgctacgtttgcctcacacccaccacagggttttgctctacctggcacttaggtctcacagtaacacagctatgcacctcatctacagactcaggagcatgccgcacctacag

SEQ ID NO: 441 - DNA, 550 bp, Rattus norvegicus
  Genbank Accession No. AA860024
tttttttttttttttttcaatgttcagtttcctttaatgacccccatctcccttgaaggataggtgcaggcagctaggtgactggcaagacatgttcacttgaagatcttgccttgattgacggctttgccaacgtgctggaaggccccctcccaggaaaagtactctcgaacgagggtctgggtctcctcgctaccaggatccagtttccgccatgtatatgactcatagtccacctgccaatctggactcagcggaaaggcaagatcttggcctcggaagacccaaaccccagaaatggagctgctgttgttggttccaaacaggataacactagcaaaggcattctttctcagtttgtccaatcgctgaaacatcccagtgatgaggttacagctcatgaaggtctgggtgagctcttcagggaagcggtactcagcataccacagggaccagccatccttatcaaaatgctcccaaaaatatggcagcgccacagagagggtgtcctcattggagtactttcgcttaaactcatccaacacaaagg

SEQ ID NO: 442 - DNA, 442 bp, Rattus norvegicus
  Genbank Accession No. AA860030
tttttttttttttttttgacattccacaaagaaatatttattgagcgcctgccacgtgccaggcaccgtttaccccccaatgagaaaacaaaacggaacaaaaacaggacagaggcagcagaaagaaacaaagggcagttggaaaaaagctaagggaactaagcgcttgaagagctcctggatggccgtgctgtttccgatgaaggtgactgccatcttgaggcctcgcggtgggatgtcacagacagccgtcttgacgttgttggggatccattccacgaagtagctgctattcttattctgcacgttgagcatttgctcatctacctccttcatggacatccgtccacggaagacagccgcaaccgtgaggtaccggccgtggcgtgggtcacaggcggccatcatgttcttggcgtcgaagacctgctgggtgagttca

SEQ ID NO: 443 - DNA, 459 bp, Rattus norvegicus
  Genbank Accession No. AA860044
tttttttttttttttttggaggttgcgtaactttattgtgtagacataaatattttgtttaaatattaaacattaaaccttttcctgacatccagacagaaatagggagagcaggaacaacaggcaagagaagaaacagtccactgaacagacgtgtgactcctatgccatccacaggagggatttcagcatgggttcaaaatgccaagaagctaagtttctaaaaaattcacctctactcagcataaacctctttactgttttcccctacacagaggagaagaaacccagaaactgaaaactgaaccgaggtgatctgctgcagacctcttaccactctacagccctcattacacatcctgccatgctgaagagctcttcctgagaaattaaaaactttaaccctggttattcccaaagaacaccttgagcctggttcggtactaaagggtcaagatt

SEQ ID NO: 444 - DNA, 393 bp, Rattus norvegicus
  Genbank Accession No. AA860049
tttttttttttttttttcagtaattcaataatttattcctctaaaaaagtgtgtaaaagtatatagctctcatccacaaggtatatatgaatgacatttaaaatggaggcctttgtcattgtttctttttatcaaagtctttagtgtattgaaccagcactgtgctgtagttcttaaatgaacgtcaaatagttttgtattcttcccaattgtctgctatatataaaagaagctcactgcaaaatgcttgaaggaaaaaggaaacaaaaaagaaaatcagaacttcccagaaatgtacagcttttacatttaaaaaaggctctgagagatacatacaggcatgccggaccagccctcccttctctcgaataccatcaataaagcctcgtgccg

SEQ ID NO: 445 - DNA, 533 bp, Rattus norvegicus
  Genbank Accession No. AA860062
  misc_feature (1)..(533): n = a or c or g or t
tttttttttttttttctgagagccacagaagtcctgctaacacctggacaaggagcctggtgtagcctcctacaccacacagcttcgccaaagccacgaagagaaaggcatctactcacgtgcccaggaagacatccttggcctcagcatagttcttacacacttccttatcctcaacaaagtcagcagctattgagggcagatcggcaggaatgttgtcatgttctgtctcagcgagacactgggatttctgcagcactggcttatcacagcaagcctgcagtttgctggagatagtggcctggttctcacacatgtacttggcaagttctgcctgtgagaatggaaggcaaaggtttcagagaaattctcttggctacattttatccccgcaccactgttgggctgggatagcctatccatcctgctctgagccattcgcaaccaaagtggcttctagaaacacactctcagccacgaagtgcttcagtactatgaccagaacattccaatgggattcgaganagactgtt

SEQ ID NO: 446 - DNA, 308 bp, Rattus norvegicus
  Genbank Accession No. AA866240
tttttttttttaaatttaaagggaacctttattttaacccaggaatgggtacacaatgacacaagggatcaaaaattgttatatgaaaaaaataatacaagtggatttgtgcaaaaaccccaaaaactgcaagtgctttcgggatcttaaaacaaaattcaggatgggtgataaagggaagggactgggtaaaaacctgaaggggatttcaaaagggaacacatttaaacccaaaatgcccgatttattcaggaaggaatgaaccaaacctggaaaatgggtggcaaaaaggcaaaaccattcaaaac

SEQ ID NO: 447 - DNA, 254 bp, Rattus norvegicus
  Genbank Accession No. AA866291
ttttttttttttgttttcagtagtttatgcatactttgtcacaaatgtccggggatagggtactggactcctccaggcaacatacaaaataggtccaagggacagggtgggctggatttgtgataagtagagactgggttggtaagagagcctggggaggggaacacggcatactaaggatggggctgcccccatgttgagcctgctcattcctggtgcaggtgcccccccacctgcaaggggatcttcaaggt

SEQ ID NO: 448 - DNA, 410 bp, Rattus norvegicus
  Genbank Accession No. AA866293
ttttttttttaaaaacaaaattaatttttattgcggtgtgtacagatgttacatctagggtgtggagaacttgccagaaccgtgtgttaagttagggatcccattagccacagctgccttctgagccatctcagggacatatcctgcttttcaaaataagggtgcgatggccagcatgctggcagtcaccacaatgaaaacgagactttacattagagataggtggaggatgagctcgaaggagccgatagccctaataatgacctctggggccagcatagcagtcgtggattgccattgtccagcctgttctatgctttacttttatactaaaggagaatctctctccactgagccactgttgtcctctgtcccatagagctgagccgggttctaaacagtcatcacct

SEQ ID NO: 449 - DNA, 405 bp, Rattus norvegicus
  Genbank Accession No. AA866302
tttttttttttttttctgggaaggcatctttactcgaaacggatcaggagaagccttgccgtagagggggcgtggccatggtgtgggtggagccctgaggtccagcctttcagccagttggagctgattgacttgtccagcgccttgcgcggtctgggtgtgggtggagcttacattccagacctcacaccgttggtctccaggtcagtgaggttaccccgtagggcttgctcctcttcgaaagctttgaacagagagttgaagttacctgctccaaagccctgtggcgatagaaggcaagtatgagctggaaacttagcaagcagttggtgctacctgttgggtgcaggctgtacctggtggttgtggcgttggatgacttccaagaagagcgtgggccggtcc

SEQ ID NO: 450 - DNA, 480 bp, Rattus norvegicus
  Genbank Accession No. AA866321
tttttttttttttttttcagtacagaaatgtttaatggttgaattgtacactggctctgacatatccagaaaggcaacttttcatgttccaaaaatagattttatagaaagacttacatattcataaataggtaatgtgaaaattttcacaatgtgcctggcatccttgggctggcaattctgcccctgcccaggccctgcaggggtgagtttggctagaggcccactgctggcagtatcctgggataggataatctattcaatgtgaaccaggggcttccagtagatcccctccagctggggtctgtgtccttggaaacagacttccacccaaagagacatgaagcccctcctctagtacctttagtgggcaagacctctacaactgctgcgccccctggccctaccagcccttctgtgggaacttcctcaccaacaacatcaacctccacccccgcctgctgttcagtaactgttcaa

SEQ ID NO: 451 - DNA, 256 bp, Rattus norvegicus
  Genbank Accession No. AA866358
tttttttttttttttttaaaataacaacccctttattagggaaacctgtggggtaggaggaaacaacagctgttcacccatggggctttcttcttcggggcccaccacacaaaggaaccccccaaatttaaacggcccttccccccagttcccatgacacagggtggacatcaattcaatttcaaatgatgaaatcctggttaaaggcttttcatttaagaaacacttaaatgataacacatataccccttttagg

SEQ ID NO: 452 - DNA, 422 bp, Rattus norvegicus
  Genbank Accession No. AA866364
tttttttttttttttttcttttttccttttttacttacattaaatacatcgataaatcagcagttgcattctgttaccacgattgttatgttaggagagtgaaagaaaggcaaacactttcttaggaaaaaaaatataaaggcagaaaagatgagccctcccctaaaaactgatcagaagaaaaagggtgacagggaggtggggagagaaccaaacccctcaagcccaacagagctcaaacaaaggcagaagagctggcaggaggagagggaaggcagcagacaggccccggaactaaggccaatactgttcctaagaagggaggaatggaggaagtgaaagcctgggagatgggttcccagccccaaggcaataaaacatcttcatttttgcacaggagttaagttttcaagagacttaga

SEQ ID NO: 453 - DNA, 462 bp, Rattus norvegicus
  Genbank Accession No. AA866383
tttttttttttttttttaaaaatagtttatttatttttaaaaccattaaggcaaaactgtaccctgaaattaactctttacattcctcagcttacagtaggatgttccaaacatacaggttcccataaattcaggatataaatcaatgcatacagtcagttcggtctcctacggagaaaacgaagactcgattttttttttttaaattaagattaagttatagccattttctaattgcccggaaccaatcagctcatgtgactagaaaattctatttgcccttctgtgttcaccctgattcctgatgtcctggcgagccctgtatccacaacaagctgggggttggggtgtgtgtgtgaggatgctggtaccggctcgacaagtcttattcaggcctgttagtatcacaggggtgaagggctgcaagctcccaggtctgataggatggcaccaaggacatta

SEQ ID NO: 454 - DNA, 466 bp, Rattus norvegicus
  Genbank Accession No. AA866409
  misc_feature (1)..(466): n = a or c or g or t
cggccgcaaaggtttttttaatttttttttaattttttcaatttttatttaaagctgtactccaaaccaaatccttcaaatcaaaaagctgtttcaaacaaatttgtacaaatatcatgataccagtgttttaaagataacctacagacaattataaaaaagcaactattatacaaaagaattctatggtaaactgtttttataaaaccttttagaaataaacttgtttcatgatagaagataaaaattaaattaaccctaaatacattaattgctctgaagatgggctgagtgttttgaagtcacattgcttctttgagaaagggcgtttgaaccaggcactacagtaacagatgcacaccgtaccctctcactcgagccctctcatctctgggtttgaaaccctttttccagaaatggataagcaaaacctaccaaacaggagtgctgggtcncttaacttttg

SEQ ID NO: 455 - DNA, 543 bp, Rattus norvegicus
  Genbank Accession No. AA866414
  misc_feature (1)..(543): n = a or c or g or t
cggccgcaaaggttttttttatttttttttaaaaaatatattgctttgtcaaaaataaaaatagttgtttatccatattttgaacaagctactgtctcctactccaatgggtcaaaacttgggtttcgctcccccaagactcagtttagctggggttggacacagcaagtctctcatgagggctgagtgtgtgggcaaaaccaaggcacggaagaagcactcagaaaatacacagttaataaattacaaccctcccatcctcccgctatccccatccatgtccagagcagacttatgtattggcctcaccccgcaaaagaagcttgaaccagcccctctgtgtccactaggtctagggcctttagtagatggctatggaatgtatgaatgaatgaatgaatgaatgaatgaatgaacacctggtgagagagagcaagtacttaggaatacgagcctcagtcnctcacctgtatcttactctcatcagaatatctctctagatgcagagaagggagacttggggtgggggtgggacagaaaatg

SEQ ID NO: 456 - DNA, 519 bp, Rattus norvegicus
  Genbank Accession No. AA866426
ttattttttttttttttggaagtagaaatatttattcagaatataagaacgtttgtaaaatattataaatgtctctgtataaataaatggcgtttttttttttaaacaattctatatcaaataacacaaattagctattttacagcagctaaaaactaaaggcatctggaaacatttaaagctacaagtgaatctaaaactgacaaggtatagtacagtgtgtagtagccactttaaaatgacactttccatacaagcagaacagtactgacagatgcagcagacagatgtgctttaagaacagtgcattcaagcaggattttctaattcaagtggtataaaaaacattttcaattaataaaaaagttaaatttcatgcaaagtaagttaatatgtctaaaagcaaattagaaatagaagtgaacatttgtagttgttgcatcaggaaggtaagtgccccaacaggagcactgcagaagaacgctgcggactctacagaatcccttccacatctcaacc

SEQ ID NO: 457 - DNA, 534 bp, Rattus norvegicus
  Genbank Accession No. AA866454
  misc_feature (1)..(534): n = a or c or g or t
tttttttttttttttttcccagtgtgtgtcctttattctccccagaagccatgttgactcccttctgcaggctgatggaaggaagggcgctgcccttcatgtggactgtgctgtggacggatctgactgagaggagccccagtaccaagcagaatggagttgagaagccagggcgctcactaacagagcaggggacaagtggcctccttagaaggtgtgcatgttctgggtgttctgaggtaacaggcctgtccacatggcctgcatgtccattgatggcctcccaggctgctagtagaagtgaggctgttgctggcacgacgttactgcaagcagcaacagagttcgcgtatccacaaagctgagcatgtctaccacttagacatgcagactccttgtgtcgcagagcccctgggtcaccagcggaggtatcacctgncgggcgcaggcatgcgatcgtgaccgttccctccaacttagtcgaaacctcccgctgccgtggtgctaaaaaaaaaaaaaaaaaccctcgtgccg

SEQ ID NO: 458 - DNA, 523 bp, Rattus norvegicus
  Genbank Accession No. AA866459
cggaagcccaggtttttttttaattttttttacttttctataaggatcatatcattaaagccctagaggctacttttggctttaccttaggaatgactcttgatttgttttcttttgatacagaagcaaactttgttttttaaaagtgcctgagggagaagctatactgtacccccaccaggtaatgcactaagtgaacagcatactctaatacccctcaactatcttctgggcaatttatatagtaaaacgtgtaataaaaaaaagtcatggttatcaaatacaggcaatattacctcccctcatttaatctcacttcaaagtgctaactgtaaactaaggactggtttctgatgagggtgataactgcttggttaccagtgcattgtgttaccactttaaccacattccctttaaaagttaaaaaccaaagacctgtagtgaattttcttgactctctgcttcgtcctttaccctgcctcagtcagctcccactgccagcaatgggttaaccatcacagcc

SEQ ID NO: 459 - DNA, 505 bp, Rattus norvegicus
  Genbank Accession No. AA866477
tttttttttttttttttgaaggtttcaaaggtactttatttctttattttttttcttcaatatgccatgttttaatgagtacatgattctttgacttggcattcatttatgagttggttttttgaaacaattccttgattattgtatcagctggcatgactactgatctctccattcctttggggtgactctgccaacaggggacaggttccattctattccaatttgtgtggctgtatatgtccatgcagaaatacagaagatgcttccacctgctaatacagcatttccatatttgtcatggaaagtaggtgtcttcttctgatggctctgccttgccaccacttgctgaatgcttcgaacttggagacgacttagtgcgtttttggccaagggcaacatcgcggagacaaggatggaactgcggtgactacagctgctacctgggtgcaaattcaccccagctacccttgcagagtcctgaaaaacaaataaaaaaaacctc

SEQ ID NO: 460 - DNA, 543 bp, Rattus norvegicus
  Genbank Accession No. AA866482
  misc_feature (1)..(543): n = a or c or g or t
ttttattttttttttttaaagaaaaatacagtttatttcaggcgtacagtaactttcagagcactgctatggtccgtccgtttgtccgaagtcccaggctactaagggagaggggagggtgcagaaactactctcttgatgaattttgaagctcagctctcagaaagctgattccaaggttaaatcatgaattaaacaagaaagtgttatgttattaagatcttaagcctcatccctggacttaaaacagcccaactttcccaagttcaccacttttagttaagtccttcaaactctcaagggtattcaagggggagaattcccaggaggatgaaaattctggtcggttggggaatgctctgtgggaggctanggtggggacattggggaatgtagacttctacatctctcttccagctgtatgcttttctcacaattgccaagccagccagcctcccactgtggaattccggtcctttccataaatgtacctgcctactttccacaagcctggcttctataaccacatccacacctatcacc

SEQ ID NO: 461 - DNA, 541 bp, Rattus norvegicus
  Genbank Accession No. AA874803
tttttttttttttttttggtaacttcaaatatatttttattactttctttttcatcttagaaagaacatgaaacccgcatgcagcactcatgaatctcagcacttacatagcagattcacagccgtccagtgcggcctctactgaggggcagcgtgtggcaggggcgggtactgaagcaatatgtacacaggagagggtgcagggtcatcctaactccaaaagaggacctcgctgtttgcatatgcaccgaagggggagtgcgctttctgtgggggcgaggggaacagagctacgtgggtctccccatgccagtaggatgtgtagctctggctggatgtcatgcattgagtcctgaattttccccttttcctccacacagttttctcacgctgccgggggcttctgatgcttcagaagcatcatctaccaaagcagtgagcctttcagaaaccctcagaggttgcgagagaaagacccagctcctttaaggatcgcttgcctggttgggataggggaatgagctggggtgggggtggggct

SEQ ID NO: 462 - DNA, 494 bp, Rattus norvegicus
  Genbank Accession No. AA874827
tttttttttttttttttgcagatgcaaaaccttggttcacgtttaatattttaaatatcctacagggtttctacagtatcaccattaaaatccatgaacagggaacattaaaacactgcaatgcaatataaacagaccaaagagaagtgcataccagtgcatattttcaacaatttaagaatgtatcaaagaagtaacaatgtgaataaaagaatgtttgcaataatttttaaattaaaagccctcctggtgttctcttcagggtcttaacggtgagaagacgatgaggttaccgccaaaggagaactgtcggcctcgatcttgctgtctggtgtcctctcgagtgcatgggctagtgcagctgaggtcaggtggaccaagaagatggcattcagaagtgagacttttatgtagcagtactgactgggacagctcagctccttcttgtaaggagtcacgctgtgagaaggcatttgtctcagggtgactcatca

SEQ ID NO: 463 - DNA, 517 bp, Rattus norvegicus
  Genbank Accession No. AA874832
  misc_feature (1)..(517): n = a or c or g or t
tttttttttttttttttgaccagaacagtttattgacaagatagcatataaagacactacagagcatcaagcagggagccttttctagagatggttaatcaggggcaccccatgggaaggcagctcctggtgcagctgccggaagaccatggcacagtggttcctctcctgggtcttgccgagggcgtggtacagcctggcctggaagtacgacacatccctgatgcgctctctacagtcgacttttgcaaagtagttcttggcttcagtgaggttctgaatggctgcttccagagcttctgctttcttcactgggtcataggaagctgctgaagccacttggcacttggacactaagaacatggcacggcctttgtccaggatggccccatcggccaggatgggctcaatagccatgtggagaagggttaaggcctgttctgggatccccaggatganctgggcataagccaagttgagcacagtttcagaggccaagtactgtaaccggtattct

SEQ ID NO: 464 - DNA, 530 bp, Rattus norvegicus
  Genbank Accession No. AA874874
tttttttttttttttttcacacaaacacagagtgtatttttattacgtaaaacgttgcattggtgagcaacaattatttgtgtggagagctcagaaaggcacggcgaccagttgcctcattcatgattgcagccacgattttgcaccttccttctagtgggtcctgaagtctaagtggcagttaagcttgtaaatcctgtcggtttctattcaatcacaggaaagagtgcaggatgggcagtactctcttcagaatttacatctttagaacagttcgaatgctgtttcccgagtgcatcagatcaaaggctttgttaatctggtcgaaggacagattgccagtcacaaattcgtcaacttttacctttttggacatatattcagacaccagcttcgggacactctccacactcttccagcctccaaaggcagtgcctttccacgtgcgtcctgtcaccagttggaacggacgattggagatttcttcacctgaagcggccacaccaacatcagaatggtaaccctcgtgc

SEQ ID NO: 465 - DNA, 495 bp, Rattus norvegicus
  Genbank Accession No. AA874887
tttttttttaattttttacgttttagaaaaatttattttatatacaacttatttgaaaattttcagtatgaacaatttcaacagagtcctttagatgcaatttcttttgggttcactgcaacactttttgtaatattatatgttttatagatgccaataagtctatctgaaatctcaaacatattatttcgaagagagattattatgaactgtgcattttttgtttgctcgtatatatagaatgcaacaatagacacgtttttaaaatccagagcggcatcaatctcatccatgaagtacaggggagtgggtttgtagtggtgaagggcaaacaccaaggccaatgagctaagggttttctcgcctcctgaaaggttaaagatcttcttccaacttttcttaggtggtcgaacactgaacatgattccttcagaaaaaggatctaaactatccacaagctccagttcagcatcccctcccaaagtgagcatttgc

SEQ ID NO: 466 - DNA, 504 bp, Rattus norvegicus
  Genbank Accession No. AA874889
tttttttttttttttttatagactaggaaatataatttatttcataaaaattaattttgttacaagaggaatgctaaaggttatttacaagttgtttacagaatgaacgggtggggctgggactatccccagtggatcagaacccacagacacacagccatgttcacagcctgacatccaagctcccacacacccgacctctactagagtcccagaggagtgtgggaacctaaggggcctcgtggagcatcccaggataaaaggacacttaagcccagagaaagcggttatgtgcctgaagtcacacagcatagctacaacttggttcccgggcttcccatttctatgtgcgggctaacagtgaccagcaagagtatgcccacggggatgagcatctttggcaggaggagctgaggacactctatgaggcaccattcacctagatgccaggagcacctcggtctcagtcttagagtcccacttcaggagccactgcggaaaccc

SEQ ID NO: 467 - DNA, 529 bp, Rattus norvegicus
  Genbank Accession No. AA874912
ttttttttttttttcactttcaaactcttaagccaagtagagaaagccctaaatacctgtgtctattttatatcagtcactgggacgttttttaagtttttatttattcaagtaaatttaccaaaaaaaaaaaaaaagccccctaagcacaatgacttccatttcttgacagtgttctctggcgtctcacgtctgtgtgtttaactgttgtcacagcaactgatcttcctcttgggatttttatctgaaagcacaatgcatcgagtctcttgaaaatcgaattctcttgtagctctttttatggaataaactttatgcactgctaacgtaacattctcaaggaatagacataaacacaaatgtatgcctgaagctgatttttttgggggagggggcaggaaacgatactctgcttctagaagctttttgtttagtatttcataaatcattgtttaaccatttgtgtggagcataaactattcagtggatcatgtctgtacattgtgtaatgactgaaaagcacataaat

SEQ ID NO: 468 - DNA, 492 bp, Rattus norvegicus
  Genbank Accession No. AA874927
tttttttttttttttttagcaatataacatcaattttattttaaaaaacaaaacccaatccacctgacctgtctgtccctcaagggacctaatagagacctcaggaagggctagctctggccaagcaggggtaggttgtcaggtgtcaaagaagacactgtgctcatggactctgctccctctctcagcccttgtcttttgctcctgacaagaggaacaactgatctgtggtcctacgagctctgctgtacttgaggaagacagcacgcccatcctcctggtctctttgctcccccttcaacggatactatccttctctccgccaccctgagcagatggtgaggactaaagtggtggccggggacaccaagtgtctacggagcccacagggctcagaccgtctgccccagtgacctctagtcactaccatcgggcaggatgcctgtggtgccaggcactgactgaattcctctctcacgccagccacactaa

SEQ ID NO: 469 - DNA, 536 bp, Rattus norvegicus
  Genbank Accession No. AA874928
tttttttttttttttttggaaataaacacaacacttcctttattatataagtttggcaaacagcacaaaaatccagcaacattttaaacatgtaaaaaagtcaaatgtcaaacagtactgagtatagtttgaaacattagaaagaatgagtgcagagttaggattctgaagctagcagagcaaggcttggtttctgaacatgtacatgaaacacacattaaaacacaacaacataatttatctttacaaaacccacagccaggcaataggaaagcacatcagtggggaaggttctggcccacgtgtgttcactgagtctcacatatggaagctacatctaccctgaaataccatgtgcacagggccaggcagggaaccgaggctgctactgaagttaacaattatttgagaataataatgctcaattaaatccttctgtatagcaatttctattataataatgaatttattccgctgcaaatctgagaagctgagacttatttgttggcagtataaaatttctgaccagtatcaaa

SEQ ID NO: 470 - DNA, 350 bp, Rattus norvegicus
  Genbank Accession No. AA874934
tttttttttttttttttaaggaaagaaagagccaactctttaatacagagccttcattaaaatgtcccagccctgcgcagctgctcttctaaaggggcggccaccaagggtctctaccttcctaagatgtagcagacccttttggccactcattaaataattgttcccaggatgggggtgggtgtaagggcagggcccctgccaccttcctcggggacatttgtgcatgtttacgccttttctgattgtgtcagtggccgaagcatggcaactgggcatcaataaacatctcttgaggaagtgggctcagtgtgctggctcaggaggagcactgggcggggtgcctggca

SEQ ID NO: 471 - DNA, 569 bp, Rattus norvegicus
  Genbank Accession No. AA874990
cgaccgcttcgccgcagaagtatctccggatggagccttcccccttcggcgacgtctcctcccgtctcaccacagaacaaattctgtacaacataaaacaggaatataaacgtatgcagaagaggagacatttagaagctagttttcagcagacagacccaggttgtagttccgattcacagccacatgcatttctcatcagtggaccagcatcaccagggacttcatctgcaacatcctcaccattaaaaaaagaacagcccttatttactctaaggcaggttgggatgatctgtgaacgtttgttgaaagaacgggaagagaaggttcgagaagaatatgaagaaatactgaacacaaaacttgcagaacaatacgatgcatttgtgaagtttacgcatgatcagataatgcggcgatatggagaacagcctgctagttatgtttcatgaatcacgctttttgcatttgtgggctgccttgttccttgttgagttgttgcaggaggtcccagctgtgacatacagcaatgccagcgcccatctgtgaaccaggttatttcaagcttt

SEQ ID NO: 472 - DNA, 438 bp, Rattus norvegicus
  Genbank Accession No. AA874993
cggccgcctcactggtccttgtcgccctcgtccaccgccgccgcccgccaccgcctcgttccctttcgctggcgccaccgccgggtctcatgcgggacccgcgcttctcctcaggaaactgaggccgggaggccgggcgcctgggcaaccttgaagtcggcgctgaacggctgctgccgcgatctgtccacggtggggggcgagggtggcgagcaactccgaagagaagcagaaggaggcgccaccgtccgcgactggtcgaacgaggagagtcgtgatgaggcggtgaacagctgcgtggcccggtgcgcgagcgaacgcaggaggggcggcgaggtacttgcgaagacgaaaggccctgtcgtctcctgtagtcacccaaagaggagcgccaccatcttgggagaaacacggatctcgccctcgtgccgaattctt

SEQ ID NO: 473 - DNA, 542 bp, Rattus norvegicus
  Genbank Accession No. AA874995
  misc_feature (1)..(542): n = a or c or g or t
tttttttttttttttttcagagtgctatacccaatcatgtaggtgtaatttatttatgttggaaatacatagatcacaattcttaaggaaagagatgtgccccccaaagtttgcatttgcacacatcagctacgctgagggcattgtcctcgggtttaacattaagacccagtgggaaagcttatggtcttatacactgggtattagccatgctaggtatggccatctgtcagacaaaggggcctagtctcctcccacaagtcatgtcctaagtcatctgcgtattatggcaacaggagcagcagggctggctanagagaggtatggtttggccagttagtattgacatcttagaatcctgggggtacatgtgttgtaagaagccaccttcagaaggctgacggtactatactggagaagctgtggaacaggctgcactgaccagggcaggctttcttagagaagcctcagctattggtttcatacagtttccatttccaaggaggcaagggcctgtttggtatgcanagagactaacaagg

SEQ ID NO: 474 - DNA, 516 bp, Rattus norvegicus
  Genbank Accession No. AA874999
tttttttttttttttttataaagcaattccaaagtttattgccatagaaaaaactgatttctcaaagtcaattcttattctctgtaaaataatacacatgaacagaaatcactatacttttggtccaagatatgttgggtttttccttcttcttcagatgatggatagatgcagccaaaatctatgaacgcgtgtacttgccccaaatgtgcagcataaacacagaagcgatgaacagaagactcatcaccagtactgggacagggccaactttgagccctggggaatcttctgtgtagaatcgccacatccccccagtccctgcagaggtggtgcggcctgcactccgggttccgcagctggcattttttctctgccggacagtggatcccgccgcccgtgcggccactgctttgctaggagaacgcccagaggagcccacgttggtggcactaggcgttggacccggcatgctgatgtctaagaacagtaggcacaagagatatgaagatgaaa

SEQ ID NO: 475 - DNA, 459 bp, Rattus norvegicus
  Genbank Accession No. AA875017
tttttttttttttttttgagtcaaccaagatattttattgtgaggcagacatttatttacaggacagacacagaaacatccccactgccaaaccccactacaggggtatgcctgcctttgctttagttcttcccagctaggcagatccacagaggcctgaacaacacagttgggaaggccgttgatctcctgttcctatatgaccttaggagacggcatagcgaaaccacccaaaattgcccaaacgattcaaagtatctgaaagtcacttttgatatttaaaacattgtctactgttctagctgtaggatcagaggggacctacatctcaaactgtgtggtgtgcgttcctttgtagttcaacattcatatcaaacaacgcgcatgagccccgggtgtaacacacgcttgtctgtgttttaactgttgctggttcctcagttaaaggagtctttggta

SEQ ID NO: 476 - DNA, 530 bp, Rattus norvegicus
  Genbank Accession No. AA875019
tttttttttttttttttggctttatagtgaaagtttattgtttttaatccaagtacaatcagctactagttacatacagtaaaaaacaaaacggccaccaagcaatgatgatagtctgtgacaggtgcagaggagggaatcttgttgggagtcctgtggatccacacctgacttcagcacttaagctgaccctccctccccagatcagttaaaaaaaatattaacagtgtcttgcttgggtagagcaagattctaaattttcttggggacactggagaacttttaaaaatgaaagtggtaaaacaagattgaaacgtggagacacaagaagcttcctgacaaagaagcttcaggaggtcttggcttcaggtcacctcaaatcgaatcagcttagaggagtgactccattcaaaccaaggctcatatgtatttggtccggttgagggctctctcagccaggtggccgctctcatccgtgatcttctcccagtcagtctgcccgaccacaaaacctatggcccttcaacatc

SEQ ID NO: 477 - DNA, 580 bp, Rattus norvegicus
  Genbank Accession No. AA875032
tttttttttttttttttctgatcttaattcattttattctacaaaatgctactcagtggaaagtaggaaagccaacaagacaacaagaacataaaacgagaacaaaccccgagggaaaataagttttaatatgttcttccctccatagcagcaagctctaaacagctttccttagtgcaaatactgtaggcttgtgtcacacacagtacacagaacaacgcaacacacaccaccacagatgcttctgagcagagatactcctcaaaaatttaaaactatacaaagattttttgagcacgtggtcctgcctggagaattcgactagagagaccctcctaggaccatttcaccattactgtaaaaacgggacaaaaggtccccagaaaggaaattagaattccccatggagccataaaaccttgtacaactcgtttgcctccagggtctaatagcaaatttcactgcacgtcattgacatatcccaaatacggatgcataaagcttgagtttctacgatataccaaaatacgatatatatacaactcccactgcaaaagaaaccctgatacctagtctttat

SEQ ID NO: 478 - DNA, 551 bp, Rattus norvegicus
  Genbank Accession No. AA875037
tttttttttttttttttccacttcttaaatttttatttatttttttaaaatttacttgtttctgcataactttgagtgatgttacatgcttatacaggatgctggggccagtagtagccaaataaaggcatcaagacatgggtggaaactggaatttccagaggttgtaagcagccatgtgggtggtgggaaatgtccctgtgtcctttgcaagatcagcaacttttcctagtatctgtccttctctccagcattcttacacattgattcagttctaccaggctgtaagttattggctataagttatgagtatcagcggcatagcaaaggctatatggcatcattagacataacctgcaaaagggcacaaatgcattcaggatagggagagctgaatgcaggcatcataagatcaggctggcaggaagaaagtatcctcatcttggaacatggtttccccctacttgcccatcctgacagagctttggattggtggagatactgaagagaggactctccccatgtagtaaatgtgtctttatggagatgag

SEQ ID NO: 479 - DNA, 459 bp, Rattus norvegicus
  Genbank Accession No. AA875042
tttttttttttttttttccaagagaatgtcaaaatgctttgctgcctaaaaggacattgaaggaacaagcatcagccaggtcctgacgtcccaagttgggcagcttttcagtcctcgagtctgactgtgtccggggtttgagggacgtgcagtcatacagagaatcatcatggcgagtgaatggaagcaacatcaggcgtcactgggcgcagtcacacagtggattcctaacattcagtgcagccgcccgccatacttcatttacaaggctttttaccctctcctggctgagtggagaagtatccagtgacccagttcttcacggtgtggaggaagcgtggaacttaacaaacgcaatggccgccagctccttgcagaactcctctaacacaatcacaccctccagcagcgtgatgtggtcaacgatggggccttcgggctccaagccaagcagtcgct

SEQ ID NO: 480 - DNA, 560 bp, Rattus norvegicus
  Genbank Accession No. AA875045
tttttttttttttttttcatgctaaagactgtaggaatagtttaatgctttcattacattatgtaataataatatcatagtctattttacaagttaaaggtatgagaatgtatgaaatagaagtggtaggaaaaaaactaaatgggtcagaaaggtaaatttttttcaaaaccagaggccaaagaaagcctatagggcccaagggaggaggcagggcaggtgacaggcgcagtgtggctccgagtacggggtttgttcccatgtttgcaccaggaaggagttgaggcttattccctgcccttggctggggttgggagtttagtcttgtcagtgacgatggaggtttgggagaaaagccgactggccgcctttcagagctggcttcctggtgccacaggtgggttctgtgttgaaggaatcagctggagtatcaaaatcaaatgtgcagaggaacaagtacagcttcctcctgcccctgttccagattcttggaagtgcacacaagttctctcaaacgtagaaaagcctcactttggatgtgctgacaagaagatcatcgt

SEQ ID NO: 481 - DNA, 549 bp, Rattus norvegicus
  Genbank Accession No. AA875047
tttttttttttttttacaagagtgcagaagagagagagaaactagtaaaggctgaaagaaaattcattgaagatagagttaaaaaaatcgtagaactgaagaagaaagtctgtggtgattcagataaaggatttgtcgttattaatcaaaaggggattgaccccttctctttagatgccctcgcgaaagaaggcatcgtagctctgcgcagagccaagaggagaaacatggagaggctgactcttgcttgtggtgggatagctctgaactcctttgatgacctgaatcctgactgtttgggacatgcagggcttgtctatgagtatacattgggtgaggagaagttcacctttattgagaaatgtaacaatccccgttctgtcactttactggttaaaggaccaaacaagcacacgctgactcagattaaggatgcaatcagagatggcttgagggctgtcaaaaatgctattgatgatggctgtgttgtcccgggtgcaggtgcagttgaagtggcactggcagaggctctgattaaatacaagccca

SEQ ID NO: 482 - DNA, 547 bp, Rattus norvegicus
  Genbank Accession No. AA875050
tttttttttttttttttccaagaaacaaacattttaatgcagaaaaccatgataatctacaaatgaatcacagtggaggcctataccggaccccctcaggaactgtaaggactgggacgtggacactgaactgacaacaccgtcagcatctggacatgcccaggcagctgtgctggcctcacggcacctaggccttgcccccttgccttccaccattcattccccaatgggaagaccagaagttaagttcagaatagaagggggagaggtggaggatgctgctggctctggtacctgccccatgactcaaggccaggcctactcccaggtctctgtccctctcctctgcagggacctagcaggaacacgaggaggggacctagggaaggggtggctggatggcatctggcttggagaagttggcagcctcagataaggcagctgctggaggaactgtcaggtgcagctgggacctctccccccaagatgacagctgaattggcttcctgctggcttggagctcagcacctctcactggggcatacat

SEQ ID NO: 483 - DNA, 528 bp, Rattus norvegicus
  Genbank Accession No. AA875084
tttttttttttttttttactggtactaaaggttttactgtaataaaccaaatatatttacaatttatacaaatgttgaaacaacaaaaatacaaaaagaaaaaaaaatcacaagatgcaaaaccaagaaacaagttcactggagacaccactgctctacaaagactcaaggtgaattgaactgcgagaaacagaacggtaagctcgcagtcagcaaaggcaggacggcagacagcagcttgctcctctattccacacctgtggcctcggtgtgattgtggtgtccaaagttagacaggtgagtgtctactgatagacttggtgccttctttttgtagacgcaaagcagttctgtgtcaagatttggaaacaggtttcttcagtttttttgatgttgtttttgttttttttaaattataagttctatttctacaaattccaaacatttggcccaattcaactgtaaatatgaagccatggtattctcagtagatgacctcataaacggtagcctttttgtcccctgagc

SEQ ID NO: 484 - DNA, 580 bp, Rattus norvegicus
  Genbank Accession No. AA875089
ttttttttttttttaatttttggtgctcccaaggtttacctgggttatctatcattaatttattattagcatctccaaaggagttatacacccaaagtacaatattccacatttgacttatcaacattaacccaaagatacatcaaagcccaagaaaaagacataataagaaatcaaaatattgacaaactataagagcattatattgcaattgctaaaaaaattgggtgtaaaccaaaattactaatgagttttacaggcactatgtatataatgtgcaaatgtttgcaaaggttttctgggatttttggtgttttaagaaactgtcaaatatattttttacaaatataaagcttccttctcctacctaaaggcaattaaaaatctttgaagtttatcaatactcaatacagaacacagatgaaccagacaaattcttttttgttctggaaaagaatatcaactcaatgtttaaggtgtcaaaagacataacaaatacaactgtctagaagccacccagaaaaattgtcatcaaagcctttgatcttcaaaagtcaccatccaccagctgaagaatttt

SEQ ID NO: 485 - DNA, 498 bp, Rattus norvegicus
  Genbank Accession No. AA875090
  misc_feature (1)..(498): n = a or c or g or t
tttttttttttttttttgataacagcagttgtggttttattgtgtccaacaaacacatcaataaatgaacttcaagcctgagcctgtaggtgccctgattctccttgcccaggcctaggcaccagcccccttctcacctgttccggggaggagtgggtataggaggtggcctggctgtaatgtctaactcacgtgaggtgtgcacatcagaagcacaaagtgggcaccggatgttgtgggttataagctcacttgatagcacaagcctctgatgaaaggcctgtcagctcctaggaagctgctactggttcgcctggttctgttcaggcatctgaggtaagaaggaagggctangggcgtggcttagcccaccttcaccgggcagcaggcatataaatacagagtataaatatagttgggctactagccgaaaaacaaccaagaaacaaccaggagagacggacactagccatgtgggcaggtcaagactgtgccact

SEQ ID NO: 486 - DNA, 335 bp, Rattus norvegicus
  Genbank Accession No. AA875097
tttttttttttttttttggggaaaaaatgtaaaactttatttttttttcaaagcagtaacgcatctcagctgtgttcagctacagtacaaagaacaatggaatagcaccagggaatttctaaaaagttcacaagatccgtgacaccttcctcttctgatcattcttctcggctaaccaagcaaagaaagcagagcccccactttccattccttcagctactgtcccaccagcggtctgattttcatccgaacggccctcagagaataatccgctcctctgaagggaacccagaccactccgttctctatctcatagggactgttgttcctggggt

SEQ ID NO: 487 - DNA, 511 bp, Rattus norvegicus
  Genbank Accession No. AA875098
tttttttttttttttttcgttagaaagcactatttatttcttcttactcttgtttcgtttctcttctttcagcttctttttggagactctgggtgtgctggcctttttgtataggtgatacccaatcaggcccaggagtgctggcaccatggccatgcctaccagaggcaaaatgcccttcagcagcttttgccagtagttggctcgaatcaaggcgatcagctccacatcatactgcaccactgcatcggctgggatagatggtgggtaccctctctttccataagccaagtgagaaggaatgactgctcttcgcttctcccctacacacatgtccagaaggctctgctccagacctgggatcacctgcttttggccaagttctatgaccagaggatctctggtcagagaagtgtcaataatgcgtccatctgccaagctgcccgtgtagtgtatgtggagcgtgtctccaaaggcagcggattccgtgcacgattcagggggctgcacc

SEQ ID NO: 488 - DNA, 583 bp, Rattus norvegicus
  Genbank Accession No. AA875121
ttttttttttaaatacattaaagattgtgctcatctccatgcagcaatggagatgagcacaatctttaatgtatttaaaaaataaaacagtgggcagaacagtgcacaaagtcctggttctcctggatcttggagagaagggatggggaggaaaccagctctctgtggagaatgagttcatggcccacaggcaagaaatgttcccacatcttctggatgcggaaggctctaggaaaggggcagagaagaatgctggtggaaaagggtctgaccctttctctttttctgagggcagaactggcagagtggaaatcctgtacacccttgggaaggaagagcacaggctgccctgccctttagcagtggtggtgagtgcccaagccaggaaacacacaagagaattatttcttcaaccacacgtttcaagaaaatgccataaatatgttatttaatattctcgtttcatagcattggacacatagctcgatatattgaaatattgattccttggagacaaaaatgaaaaaaaaaaaaaaaaaaaacctttgcggccgctccaacatcagcctcgtgccgaattctt

SEQ ID NO: 489 - DNA, 490 bp, Rattus norvegicus
  Genbank Accession No. AA875122
tttttttttttttttttaggataaggatggaaccactaggatttatttaaaaaacaaaataaaacaatgatataaaaacagcaagaaggcctgaatccaaagtttttcctctaatagtaccaaataccacaaggtacagggtattatacaaatgtgtacaaatctttaatacaaatacaacagggctaggcttcagaggaaaacaaacacgaaaaagcccgttctcctcaggagttcacaactgtctgtagcaagggcaatggaggactggctgcttcctaaacgatacatgccttccttggcctctcctgggtgccgttcctcacagcaaacttctgcaggttcaaaggaggttctgacatgttaactcaaatttaaatttctgctttgcttgatttcagttcccacatattcctgttcctgtctccatttctcagattacatctcagcactgctctgagctgagatggggacagagcctccagaactc

SEQ ID NO: 490 - DNA, 494 bp, Rattus norvegicus
  Genbank Accession No. AA875123
tttttttttttttttttcctcagaataagatttattaagctgatgtatgtcagtgtctcctcctagtccagtgtagggtgaatcaagcaacattagaagcaaggggatcttattattccgtgacccaaagcattgtatcgcgccagtatgagagagttcttgggaaatggccaacttaaacacgctcttggagaccgctctgtactgcacagagcagtctctctgtgtggtcacagggtgagtgactcctgttctcacaaagtgtaaaactctcagtggagttggtgactcatgcatagtcatcagtgacaccgtctcctctctggtctgtctaatccactgtgagccttacagagcctgcacattcctgatgccaccgcacagccattttccaggcacgttgttgtaagaaatctataattcctgtgacgttaatggcggaaagagcgctggctgggcgtttgatgttcagggaactgggggagacaatggga

SEQ ID NO: 491 - DNA, 136 bp, Rattus norvegicus
  Genbank Accession No. AA875124
tttttttttttttttttaattatttaaaaagaatatttaatgacaacgaaaggaagttcaagaatatctatacatctatgtctataatctatattatatttatgcagtgggaaagcagatattgaaatttgtatag

SEQ ID NO: 492 - DNA, 569 bp, Rattus norvegicus
  Genbank Accession No. AA875126
tttttttttttttttttatatataaaatcacatttatttgagactgggactttcgaagcccagtctggcctgatctagtgtccagaagcactgattagcagatgtgttttcctctagctggctacaatggctgcggttcattctattcagatgtcagacaataggcacagctgggttccttattcaaaatctgaaggagtctgggaggaggacaaacacatagatagaatcaagcttaggccaggaaccagaaactacggattgctttgttaaaggccaaggaggcttcaaaagcgaacacagctggagtctcatttcagtctccattttcgcaccacttcagtggaagttccatgaaacagcccgatggttctgaagtgccatcaagtcacttcgagctccagcaacttaggtttccaggacatcttctagaagaactcgatcatcccttccacgttatggggccactcacctggcctcgatgcccacctggactcgaagtagccctgcaccgcgcctgtaccctgatgacgacggatgcagaaaaggtgagggccgccctcgtgccg

SEQ ID NO: 493 - DNA, 596 bp, Rattus norvegicus
  Genbank Accession No. AA875127
tttttttttttttttttcactattgtatgcaagaccctttccacataaaaataaagctgttgttgaattaatattattcaagtctcttggattgctgcctgaaattgcagctagaaaagtctttccagataaaaatgatgtgcctgaggaaaaacagatactcagtatggtaaccctctgcctcgacctctgccagctgatgtgctaatgtgtcccctgtatccttgtgagtatccaggtccttgggcaggagaagtccaggtctgtccatgcatgaggctggggccacctggattttcctgtaagttaccaccatagttatagttgtgtatctttgctggcaaggggtgagtactctccggccctgtggaagggtcactgctgtttgtgaggaccgtgataggaccatggctgtactcaaatctatggtccttgtctccactaaacagcatgggaccagcattgaggtaaatgtctccgtatccagctactgaactgggaaatgactcggtgaaggcagaagtctgaggtggaccaccagtgtgagatgaagtagtactgtagttatccagagactgaatatctgagtttccgat

SEQ ID NO: 494 - DNA, 569 bp, Rattus norvegicus
  Genbank Accession No. AA875129
tttttttttttttttttaggtattttttggtgtttatttaaaaattaattagtatttaaaaaaacataacagcagctaaatgtcaaatgacagcatttctgccatatttatttttgtacagaagctagtagaaaaaaacaaataatgaaacaacccaaactgaagaatggtgactctactttgtaaccctgtgtttctcaaagattagagggtcagataacttcgcacaaggtggccaaggagcgtccctagaagtccaggcgcttcttgcctccggtcatcccgctacagcctgtgcccagcagagtggtggatggtgccaggtcctgtctgcttgaacggcccactgtgtctgacaagtctggaggcagatgcagtcgctcaatggtgaacagcttcctttttaacttaaaagctaagtctttgacatccgattcatcacaagtcaagttattaagccgaggaatcttccgtatatggattagaccatgataatccttatacaatgggttggtctctctctctgaaccaataaaaagatccagaccaactactgtatctgacaaatt

SEQ ID NO: 495 - DNA, 503 bp, Rattus norvegicus
  Genbank Accession No. AA875146
tttttttttttttttttgataggcattaacgttttatatttttaagtgaccaaatctaataaaatgaaaaacaaaacaaaacaaaacaaacaaaacaggtttactaaacaggttcaaaagacaacacaggagataagcagtaaaaccaaagcgtgagtggcactgtccatgtcaacctccaatctcctccagatcacattttggtttttgctttctgtttaaggtttttaaaaagtgaagcccaggagtccggcaggccaccctgtgctcagcagcatgtccgtctcgcctgcatcaagctctggcccctgtgtccctcagcagcaactgcaggttgtggcttgtgaacctcactcctgtgctatgcttctcagcacgtatttgaccgtgtaggcaaaggccgcaaacccaactataacaaacaagttcgccaaaacgccgcccaggagtccatgatgcctgttggcctgtgggagcccagcaaggtttgggccagcagcagg

SEQ ID NO: 496 - DNA, 517 bp, Rattus norvegicus
  Genbank Accession No. AA875148
  misc_feature (1)..(517): n = a or c or g or t
tttttttttttttttttaggattttgactgtaaatgttttaatagaaatacacaatctttcactttctcagacagcaacagagggggtcctaacagcaactagaacatggggttttgcacagggatacagcatagctgactgcaaagctgaactgctaggtttgccccacagtcagtggaaggagcgccagaaggtgacacaaaaaccgttgacagaagctgcagacctggaaaatacttgggtgagatgaggtgtgtcaaagcagccagtttagtgctaatccactctgggctcatttcaaccacacaagatgggagcgtccaccctcgagctctttttttctcatgtcacttcaccacttggttacatggaatgtggtgaagagactcaagacctcttgtggtggccctaagatgtgtattctgaaccagttcctctttggggggctccctgcangaatcctggtgatttgcaagctcaggttcctactacatacagtttttaccaaaaacaaaa

SEQ ID NO: 497 - DNA, 455 bp, Rattus norvegicus
  Genbank Accession No. AA875172
  misc_feature (1)..(455): n = a or c or g or t
tttttttttttttttttcacttgcattttatttttatttatttttgctttaataatgcatattctgttcacgcaataggtgtaaaaggcaggaagcaggggtttaacttggctgatgataaaacaatcaagctggaatgacatttctagtctcgtgaacaacctcaaagcaggagaaacggaaaagtcacagctggtaccaaagagcaggccagacttctcagcggattcctcttaggacctttggctagggtgagagaagctgtgaagacagtggcctctagtggacagggataaaagtggctgatttttatttctttatttggaatcttggtagctgcatcacaaaagctccaatcaaaagggtggtanaaagaaggcacagatcattgcaaataccagattttttctttctctttttgtaaatataccatcatatataagctaaaatttctc

SEQ ID NO: 498 - DNA, 559 bp, Rattus norvegicus
  Genbank Accession No. AA875205
tttttttttttttttttcacacagggttgcttttatttccacatccaacttgagcagaggccctgccacaacctgaacagctgtgaggtgctgggtgcctccagagtttctggcacagtaagtgttgggtgtgcagacttcctgatggccacatgacactggcccacacaggaacagcaagtccatgaatggaaatcccactgagctggaagtggaggctctggaaaccccatgggcagcagcaggagttaaaggagccaccaggaacactgcagtgaggctccaatgcagacagggctgataaaaacccaaacagggcattgtgagagcagaggctcgagtgtccccgctgaggacccggggctgaaggcacagagctgtgtcgggatggaagaaccctgggtgcactcgcagtccagagcacgaaagcacaggtgagaacccagcccgaggctctctgtgaagagtgtggccttggatcttgggcacggcacagtgacacacagtgctgaggtcaatcctgacttcccagaggaatgacctcttcagtgacaaaaaa

SEQ ID NO: 499 - DNA, 462 bp, Rattus norvegicus
  Genbank Accession No. AA875207
tttttttttttttttttcaattttaactctttatttgaaacaattccagagacaagttagttgtgacaacagtttctcactacaacacaagggtaggcatggctcactgaaggaacaggccaggcacctcagtacaatatatacattttaacagtggctaaactgatgacagttataaaaacaccaaaaagaaggctagggaacagcaaagccaacagggaaagaactgggtgctccctctgccagacactaacttttctgggcccacaaaggtaagatggggaagagaagacgtaggcagtaggacaggaccctggcccacagctcctcacctatcttttgaccacaaaccccatcctggatggcctaagagcctgaagttctcaggatccacatgcagcttgtcacagtggagttcactgaggctggcaaaggtgcccttgaggttgtccaagtgtttca

SEQ ID NO: 500 - DNA, 422 bp, Rattus norvegicus
  Genbank Accession No. AA875217
  misc_feature (1)..(422): n = a or c or g or t
tttttttttttttttttcattagaaaataaagtgtttattaagaaactatacactgaacactcctataagtccctgtggaaacacaatgccccattgtcatagcacaaagtgaagaaatgccagaataaaagatgctgtgatggatggagcccgagaggctggaaatgaggtcatgatttacaacaattaaaaacatcatcctcaagcttactccttaaagccacactcaggagtagatctgaacccgagggatcatctgggtgatgagatcactgagaggacaacatggagaccccatgcttccaagcaggaaagtgagactggaacacggctggacttcaggctttctcgtgatggttgggtcaagagaatggctantgtgtttaaaaggtanctcctggtgcttgggtttggattttct

SEQ ID NO: 501 - DNA, 540 bp, Rattus norvegicus
  Genbank Accession No. AA875253
  misc_feature (1)..(540): n = a or c or g or t
tttttttttttttttttattaaaactgatttttatttcttttcatgtgcagtttttgtattgtgtggtgaactcctcaaacagccatttgggatccttctgtatcattttactagcatagacaagagttcatacaaacattactttgaatatccgtaacaacttgagcatgaatgttttggttggttggttggttggttttctgttttgttttgagacatagcctcaagctgcccaggccggcctcagactcaccacaaagctgaattcttggtcttcttgcctctgtctcctgagtcctaggattacaggcgtgtgccaccacactgtggtgtctgtctatgctcccagtgttggcatttccgatacagtctgatttaggacagttcctgacccacaagcctgactctgaaccctataacacctcactgtanggctggcaaagcaatctagcagaaccccaccttccttacagagttcctgcacaaagttcaggtcaatacagaaaacgcttctgatgaagcgttcctcgtgccgaatt

SEQ ID NO: 502 - DNA, 483 bp, Rattus norvegicus
  Genbank Accession No. AA875257
tttttttttttttttttaaaaaaaaaaaacaaaccaaaaacgatcctttaataaaattagcccattgaatctccccacttcttaaggttctaaacttgtaatagctgcaaaagttccagttcagaagccagaggctcagtccagacagggattcaccgacttgtgctggtatctgggtgtttgggttgtagtttgagttaagggagagggatagctaggcccggctcctctagtcttctgcggcaggtatacaattcttctgtccacaggccaataggcgttccctgaccctttccagtttatcttggaaaaattggcttcacgttataacatgccggcctacaaatgacgacagggtcaactggtttgagaggccagtaagggggacacagagtgaaacagtatgatccgcttctcaccaaagtccggcaatcaactcacttctgaaaggtccaagagagggctaagcaccaagctgaaaac

SEQ ID NO: 503 - DNA, 548 bp, Rattus norvegicus
  Genbank Accession No. AA875261
tttttttttttttttttgccaggaaaataggtttaatttttctacgtgcacctcagaagttacaaagcacaaacgtgatttttttctactttacattttatctctattagatgtgtgtgcacagatgtgtatcttggtgtgcaggtgtaaaccagaggacagcttgtgggagttcgttctctccttccttgtgggtcccagagatggaactcgggtcatcagacttggagtcaagggcctctttgatgaccagctgagtcatcaaaaggaagaatgttctaggtgtggcctcacagaggcagtggttttgagcagcctagctgaagagctgaagtgagggctggaagatacaaatgggaggccagagatgtgactttctctggcctcattctggggtgtgtgtgtgtgtgtgtgttcacaaccacacacatgtatgtacttgttgaggccacagtcacagtgaagaagtctggaggaaagaggctcagccccaaatgtgttccctagcaagtcaaaggcacttaatccaagtctgtgagctactccaa

SEQ ID NO: 504 - DNA, 469 bp, Rattus norvegicus
  Genbank Accession No. AA875263
tttttttttttttttttactttggaactcagtactttttatttacaaaaaacgaaaacaaaaaggaggaatctaaagctgatccactggagacacaggagtgatgtggcaatggtgggggctctggctctggggaggcacaggggtcccagcctctcctggcgtccccacggtgaccccaccttgcctcaaaggctcaatcaatggtccagcagttgggccactacccactctgggtacaagcgatttccaggagcctgagttcccagctcaagggagctggaatgacaggggaaactgaggccagagaatgccctggtttctgctacccgcctcactgtggtgtgatcttggcagcctcagcccggatgagggcaatgaggtcctggttgatgaggaagacaaatcgcaggctggcgatctccaccacagagttgttgctaaggcgccacttggagccacacagcaca

SEQ ID NO: 505 - DNA, 466 bp, Rattus norvegicus
  Genbank Accession No. AA875268
  misc_feature (1)..(466): n = a or c or g or t
tttttttttttttttttggatcagggcgggtttattcacagggattctgggatcctcacgttcggcttggcagctctacctgcggtaccagatcttcagcttctgttcgcgtttgatcttccgctgcagctgcaagatgccgtagagcagcgcctcggccgtgggcgggcagcctggcacatagatgtccactggcacaattcggtcacagccacgaacaaccgagtaggagtagtggtagtagccaccgccattggcacagctccccatggacaccacataccggggttcgggcatctggtcgtacaccttgcggagtgctggagccatcttgttagtgagcgtgccagctacgatcatcacgtcagcctggcgcgggctggcacggaacaccacaccaaagcggtccatgtcatancgcggggcggccatgtgcatcatctccacggcacagcacgccaagccg

SEQ ID NO: 506 - DNA, 514 bp, Rattus norvegicus
  Genbank Accession No. AA875286
tttttttttttttttttgtgggttaaaaggctttattagggaaacatacaggggcaaggaccatccttgggagacctcaggacgctgtcctccaggttgctgggcaggtacagtccccaggagcccctgctcagaagcatctgacctgggaggcagtaggaggggtggcttctactagtgaaactgccccctgcccccccagtacttaagctgtggccctggcacccattccttgccagggatattggtaacaggaggcagtgactcatgcagcaggtctaaggccagggtcaccctgctgcttcccacaaacacaagtgccgctcaccagtctccactggggcctcgtctgggactgtgacctgcccagcctaggagtccactagccacccatccctcgctgctgctgctcctgctccaggcttcgctgcaggacctgctgctggttggcaatgacacgacggataccattgacaaagttgctctggtcatgcgggatgaggccaatgaagat

SEQ ID NO: 507 - DNA, 394 bp, Rattus norvegicus
  Genbank Accession No. AA875327
tttttttttttttttttgttatgtaaggttctcttttatttaaaagatcattcacaaaataccatatccatagactcactttctgtcatagaactgaatgtgttaagtgtttggaattccattcttacagagtcagctgggcgcccagcagtgtggatggacgtgcctgttctgtcttttccgcattggagatggattagatcatctgaaagcatcagctttgattacaaccacgcaatgcatgtctccaattctgtgtgctcatcccagctggatacctaccaacaggccaccacagccgcctagctagtggccccagctctttcccagaagccaaggggtggctggcaggaagctgctggctaacgagcaagctgcgcacctcagcccttct

SEQ ID NO: 508 - DNA, 494 bp, Rattus norvegicus
  Genbank Accession No. AA875428
attttttttttttttttgcacttctgtgtttaataagtcacatcttcagttgctcctggggtggaatgtgagaccttgactcttgtagtgatgtcagtgggtgggcatgaggctgtgaagaacatctttctgccacacagatgacatctctggagtaggtacatgtgcacgaggagctccatagtttcacccacagtacacctgctacaaagtccctgtaggcaatggctgccaagtggctatgtgacatctaacaaagacagtggacacctgaggtagctagtagcccagcagagacaggagtacaaccattagaggaggcagatccaagaccacaatgctcttaggaaccatagtgctctcaggatgtggtgttttcatggggacattggccacccacccccttgggggagggtccacaactatctggcttgcagctcactcttactgatagtcctaagggctaaaatgatgctggtggactctcagggcga

SEQ ID NO: 509 - DNA, 437 bp, Rattus norvegicus
  Genbank Accession No. AA875470
  misc_feature (1)..(437): n = a or c or g or t
cggccgcagttgtaactttaatggttttcttaaggttggcaacctcactctcgatctgctgcttcaggcccagctgctgctccttgtgcaggttggcacggctgacttgctcttcaatgcctgacagcacaacctcacagcctacgcaccactcttgcagggtttgggcgatggcgctgaggtcctggcgctggatgtcccgtccaatgctgtagtcaacctctagccgctgattgcgctggtccagagatccacgaaggacatcggcatacacttgactttggcagccagagtgacaactgacagatgtcgaagcttgttcttctgagcctcagtaagtggggggaggttcctggcttcagctaagtagtcagcataggtcccatangcaaacactgtgagcagccggaacgtggaggcaaagtcgctgtctgcca

SEQ ID NO: 510 - DNA, 512 bp, Rattus norvegicus
  Genbank Accession No. AA875495
tttttttttttttttttgtataaaaaagatttattgaaatttatcaatgacaaacagacataaaactcaaagtttggctcttctcaggggcgggagaaaaatgagttacagctgatctgtacaaatgagacacagggtaggaaacagcacgtcacttctaaagcaatctggaaggggggcgctgaaggcacacgcactctctaggagaaatctgcggccacttcagagtcccaccaggtaagaaaatacgagcttgcattccttttccgtgctcctatgtatttgagaaggaaaacaaacagaacaaaaacccagaggacacacagggcgcttccagagcttagatttgttaaaaggttctaagctggagcgcccgaggagtcctcctgccatttctgtaaaacaaattgctctaatattttacagaacaagatagaacaggttggcttttctgaagaagctgaaacacgaaggttcacttctttcccattttacgtgtctcctaaacctgc

SEQ ID NO: 511 - DNA, 473 bp, Rattus norvegicus
  Genbank Accession No. AA875496
tttttttttttttttttaagcttatgaatagtttattacatttcaacaactgtattgtgaatcaataaaacaaaagctaaggacaatgagctcaagttatcgattcttaagtttcaaaatagaacagtaggaaagctatgaaagtgggggggtggactttggggtgtatgagcaataggaatctaaagcatcaaaacacaggctaagaaagtctaggacacaaggaagactccagcagctccctcagatgtctaattccggtcatttacttttcactctaaaaagtatcttaaatttttaatatttattagttttttgttttttcaagacagggtctcacatatagctctgcctaccccagaactcacaatgaagtccaggctgaccttgaactcacagagaccctctagcctctgcctctgtcgtgctggaattaaaggcacatgcaccactatgcccagcataaatattta

SEQ ID NO: 512 - DNA, 529 bp, Rattus norvegicus
  Genbank Accession No. AA875506
ttttttttttttttttaaaaaaaaaaaaaaaaacttggacttttcataactcaggggattccctgaaaaaattacctgcaggtggaatatttcatggacaaaattttttctccccttccaaattcagtttatcaccactaaagaacaaagataaactggcctcggtcccagctgctgtgtttgggtggagattttgtccccttcccatgttgctctccccacattgtacactcttggggcttatatctcatgttcttctccagagaatataaattgtagttcatcacgggaggatgggaggggaaaggtagggagggcccagtccgttctgtacactgtcctgctggctggccacttcatctcttttctccaggactgcatccatggctcattccggctctggtggaggtgggtctgtcttagatacatcaaggtgttaaaagtctacccaacttgcagacagatccaaaagctttttttctgaacgaatcatgtcttactaacctaatcctaaaagactaattttagt

SEQ ID NO: 513 - DNA, 451 bp, Rattus norvegicus
  Genbank Accession No. AA875509
cggccgcgttctacgtcaggagccgctgtcgcttcgctcgacctcccgagcgaaatggtctctcaagtcccggccaccgggcctccgcgctccccatgaagggtcggaggccgcgcggggagtagcagcggtctgcaggcgagcggagacggacacaccggggacctctccgaccaccgtgcttctgctgcgcgcctccaggccaatgtgcaataccaacatgtctgtgtctaccgagggtgctgcaggcacctcacagattccagcgtcggaacaagagactctggttagaccaaaaccattgcttttgaagttgttaaagtctgttggagcacaaaaagatatttacactatgaaagagattatattttatattggacagtatattatgactaaaagattatatgatgagaagcagcagcacattgtgtattgctcaaatgatctccta

SEQ ID NO: 514 - DNA, 403 bp, Rattus norvegicus
  Genbank Accession No. AA875523
ttttcttttttttttttcaaagagcaagttttatttggtgaaggcaaacatcatccaaaagaaaccagacaggcaaggtgctgtgattagggagcctctggggccacacaggaatctcacactgggcaaggagcaggctcgagacacgtaaatgtcctcagccattcagcaccatccggacaagctccgccccatgggcccgtcaccccgacaggatatgcctcacaaatgcttcatagttaatgcaaccgttgctgtcctcatgccccgccactagcatctcgacttcttcctctgtcatcttctcccccagtgtgactaggacatgacggatttcagcacccatgacagtgccattcccttctttgtcaaacacacgaaggccttcaacataatcctcgta

SEQ ID NO: 515 - DNA, 547 bp, Rattus norvegicus
  Genbank Accession No. AA875537
ttttttttttttttaacaccaagaaaacactttaatcaaactacagaaacaatggttatagtacagaatattcataagcaaaagatacaccatgttttaagtacttacaaagttacaaaccatttgcttccttaacattttctgttttttttttaagttcacaacacaagtatcagatttaccattttgcgctttttttttttgagggaaggggggtgtatttatcatcagctagatgtgctcactgtatgctccattatttatatgcaaggcccgggtgactggaagtgcagttgtcaggcattttaataaactggacagccatttgtttctgcacgacaaggcatctttacacaggagcaatcaggagaaaacaggaaacagccaagcactctgcactgcaacacgccaccttaacagctaaccagcattactcaactgctacacaactgcgcctagtgcacaaaaatacataagagaagagattagaattgtgtcgggtaaacaatcctttaaaaaaaaaataagtcttttcacctgaaaagtc

SEQ ID NO: 516 - DNA, 471 bp, Rattus norvegicus
  Genbank Accession No. AA875563
cggccgcacgaggacaaccagagcttccagtacgatcatgaggccttcctaggcaaggaggattccaagaccttcgatcagctaagcccggacgagagcaaggagaggctggggaaaattgttgatcgaatcgacagtgatggagacggccttgttactactgaggagctgaaagtttggatcaaacgggtacagaaaagatacatctacgataatgtggctaaagtctggaaggattatgatagggacaaagacgaaaagatctcctgggaagaatacaagcaggccacctatggctactacctgggtaagacaccacagcagagatggcacagtggggagcaaggtcacaggaggctcatcatggctgcctccttcacccaaatgtcacaaccttcaagtgaaacctgttgtgtaacatcctcctccacctactaagaatgtaccaagttgcttcctttgactgacata

SEQ ID NO: 517 - DNA, 492 bp, Rattus norvegicus
  Genbank Accession No. AA875577
  misc_feature (1)..(492): n = a or c or g or t
tttttttttttttttttatattaaggaaatgtggttcttttatttggagttctagcagcatggtgtaggtgtttattcagacaactgtaatatggagttaaatgcaaatctaaccccccctcccccaacaggatgccgtgattctaggaagtctctggggaggaatgttagagacctctccccacaaagcaggcagagtatggtggggaaccaaattgtggttgagatcatgcaatgaagagggctggagggaatgtcactccagatgacacaaccacagtaagaagggtatctgagaaacctaagcaaaatatcaggttggtacaatcctttgcctactcatcacatggcacgggataccacatctcatggcactttctanggtccagggcttgtcctgaaacgctggtatcacaccatggtcatgaccttcatggctgctggctggaaccttccgatcttcttcttcagggccttggaggcctttatgcg

SEQ ID NO: 518 - DNA, 516 bp, Rattus norvegicus
  Genbank Accession No. AA875615
ttttttttttttgcctgtctccatggtcctggtattaaaagtatatgccaccacacctggctacgtgtaatttttaaaaattgttcaattaaaagtatcactagtatgccaaagcataccaccagttcacaaaaataagaacattcttttagaactagtattaatagttcctttaacttcaatcatttaatttaaatttagtttaatccccttcaaaaacaggaaatatccctatatatgatctataatccccatacccctctacatatttatctgtagtttaaatatctcaattgtagctgtctctgaacacattaaaagcattacctaccttggctcccaatatcagaaacttctcccgtgtccatctttgtatcatcaagaatgacagtttcatcaatgccaccttcctcctcctcttccttctcagaatcttcaaggtcaccccaggagttttctattccctctccaatctgggcagttccaggagtccacagcacaggtttagaaacactt

SEQ ID NO: 519 - DNA, 404 bp, Rattus norvegicus
  Genbank Accession No. AA875620
tttttttttttttttttgcttttaaaagattttattacaagcaggaaaccatgcacttccattgcaagccattgtaagcagaaagacagatacacttcaggcaaggtaggcttttattacattggctaatgctcatgttcaagtgaggctctggttcagtctgggctgccacctgccatgcctgtgatgtgggacagccagcacccacggctttgcggcctttcacgctcggatagctggcaacaaggcagtagtaaaaaggagtccaacttgtcagttttgagtagcagctaaggccttcccagcacagaggacaaagggcttgttatacaatgagatgatcatgacattctagtcacttgtaggaactccaccttagtctgggtcctaagttagcccacatc

SEQ ID NO: 520 - DNA, 332 bp, Rattus norvegicus
  Genbank Accession No. AA875629
ttcttttttttttttttatttttactttaaaaaattttttattgcacatttattccagtttggcatgctcaagctgtgatgcttgggtagagggcagagaacaatttatgggagtgtgggctttctcctttcactacctcatgggtcgtgagatggaattttaacagggagtgtctttacccactgagccctctcgtggctttaaggtactgtctccactcttcaccttcccagatgcctctgaaagtctcattgccaaccacttttacagaagtgaccaagaaccttagggtaagggcagcgctctagctaggcagagctgatgagtgaag

SEQ ID NO: 521 - DNA, 424 bp, Rattus norvegicus
  Genbank Accession No. AA875639
tttttttttttttttttaccttgtgctatagagagaacttttattcaggcatgttattttcacccccaaggaagggggggggattcattaacactctccttttgtttttaagaagtattaagttcattctaaggcacggagaattcacttctctcctttgacctttgtcattgttctgtagttgattggccgatcacacccaacagacttcagaaaagctgatttttcgtctgaggagcaggttccgacaacatggcacttggctaactttgaaagctgcacagcaaactgacctgtgcccccagcggctgctgtaaccaaaactttcttcccttctgacagctctccaagctctttcaggctgatgtatgcagtggtgccattaaccagcaaggtgagatattcaggtttcactgaaggcata

SEQ ID NO: 522 - DNA, 440 bp, Rattus norvegicus
  Genbank Accession No. AA875641
tttttttttaagaagccttgaagggaatgtcaaatctattgtcttggtatatgtaatccatctccataaaaggagaccgtataatgcctgagtaagcagaggacttgctgcttctgcgcccactgttttgattaaaactgagaagtgggcaggtgagagggctcagcaagtagaggtgcttgctgccaaacacagagacctgagttcgagtcccccgggcctacatggtagaaggcgagagctagcttctgcaagttgtcctttgaccaccacacatagataaataacaaatgtaatttaaaaaaaaattttaaagaaagtttaatttaagaaaaaaaaaacaacagaagttttagactgttctcaggttgggaaatatttttttcccactttcctaaggtgtttccccctttgctacgttaattatcacagccttgctt

SEQ ID NO: 523 - DNA, 501 bp, Rattus norvegicus
  Genbank Accession No. AA875661
tttttttttttttttttaatatttcaaatagtttaattttaaaaatactctattcagtgctaaaataggtcttcacttgctgttacccatttccattttcttaaacttctctttttttcagacaaaaaataaaatcataaagtttaattaaacatgcagattttaaagaaaagggaacgttctagaaagtctgagctgaaagagtactgggggcaggtactgtggtcagaacctccaatcatggctggggttttctgtggcaggaggcagggatgctggaatgaaacaggtgaagacaggaagctgcgcgtgtgcgtagtgagcgtgaggaagcggaaggttctcgggctgctgtattattagattttgatttttctttctccttgctatctgtcacaggcacccatttgaatatcctcagggacgtgtcacccacagtcacccatttcttctcccatttgtccgttaaatccgggtttgcagtaagtatttgcagagacg

SEQ ID NO: 524 - DNA, 485 bp, Rattus norvegicus
  Genbank Accession No. AA875664
cagccaccatggccaagtacctggcccagatcattgtgatgggtgtgcaggtggtgggcagagcctttgccagggccctgaggcaggagtttgcagcaagccaggcagccgctgatgctcgaggccgtgctgggcaccagtctgcagctgcatccaatctctctggcctcagcctccaggaagcccagcagattctcaacatctctaagctgagccctgaggaggtgcagaagaattatgaacacctgtttaaggtgaatgataagtccgtgggtggctctttctacctgcagtcaaaggttgtccgtgcaaaggaacgcctagacgaggaactccgaatacaagcccaggaagacagagagaaagggcagacgcccaaaacgtgactgctgggctctccacacccacccattgcctcataatttatagcctagtaataaatgtcttttcgtgtttcaaaaaaaaaaaaaaaaaacctcgtgccg

SEQ ID NO: 525 - DNA, 446 bp, Rattus norvegicus
  Genbank Accession No. AA891041
aaatagattcaataaaaagtcaaacacacacacaaacacatcttaaaatagactttagacacgaagtgcgtgtttcttctccacagtactgtgcagagggggagggcagggggcggaggttcctccctagtatccccacaggctgagtaccaggcggcggggccagctccgccgcgacaacccccttctcccctccctgttaaatacacaaatatattatattcaatatgaattcagtctctttccagaaaaaaaaaacatacaaaatacgctggaagggggccatgtaaacctcgaggtggaaggactgggcgcaggcgggcaggccagagtccagtgtgtgagctgcgccccagacctctgggcgagtgcccatcgcctgcccccctcaccccagtggggggcgggcgcccagccttcaaggctgggggtgtccgtatggagca

SEQ ID NO: 526 - DNA, 455 bp, Rattus norvegicus
  Genbank Accession No. AA891049
gaccaaaacatttaattaacaacaacaaacaaaattacaatagcagaaaaataataataacaataacaaagaaattagaagtgggaatcagggtaaaatagaatgcagaggccttagtccctaagagaccagcacccctgctgagctggacttagccccagctccttctgagttttccttggctgctggcttctcatcttctcccataagacgaatgttgtgcttttcccggaattcattgagttcttttccctttgcctgaagctgctgtgacagtgtctcaatgatcttttgtatctgctccttgttaccctccaaggcaggcagcacctccttgaccgtccgctctaccagcacaccgccaaccatgcggtagcacttgcgggtctcatccacttccttcagcgtatcgatcaccagctatgctcattcagttccatctccagctcagctgc

SEQ ID NO: 527 - DNA, 508 bp, Rattus norvegicus
  Genbank Accession No. AA891054
ctcttgtttcaaagtcttgtcgttcaggtaatctggataatcacctctcctctgtcccaaacactcccaagagagtgattgatgaactcttctttcctagcggtgtggtgtctcttggcggtgcacaccgacaggcacctgtggccacgggcctagatcccaagatgcaggaatcggagcccaaccttgaagggatgtcctctcggagcatgaacttgtcccaggcctacttttgttgctactacgagtctgtgcttttaaggcccgaggggagctcactggactccttctctcaactctgcgtctcttgctgtttgttgttctatgaggaaggggcacgttccggtctcgatccggactttttagactttctgtcaactagcctaacttcccccacattctttaaatccaggtaacttcctaaaaccgcatagatcacatcacgaatggcctcagatcatgaattcatctcaacagcatcgtctcaagaacggtcctcttcctgttg

SEQ ID NO: 528 - DNA, 513 bp, Rattus norvegicus
  Genbank Accession No. AA891108
aacaggacttttattggtagtaaactagagcaaacaatcagaataatacatatgtagtattcagtacacacaataaaagttaaagaaattcaaaacctgtataaaacaaaagagagagagaaatcatacagcttaagagatacaggggtaaaggtcctctccatctttgatcacacttgtctctgtacccaatagaacttactgcacttaataagacatacagacattttagtactgagtgtattaaaagaattaaacacttttctaaaaatctttcaatgacaagttggtaccctttagctaactaaagctaaaaggtgggaggtgggaaaagggaattaactagtattttgtaaccatttttaataatttcttattttccaaacactgcttttataacagaagtgttttacacttgcacagtattaattactttattatacatggaagcctgtggtacgctggttacacaatgagactgcaaactaccagtggtactttcctgacgtcaga

SEQ ID NO: 529 - DNA, 474 bp, Rattus norvegicus
  Genbank Accession No. AA891161
  misc_feature (1)..(474): n = a or c or g or t
gcagaaacatgtgttttaattcatggtttagattctggtgggtacaacagcaaattatttggaattctgctcagaaaactcaaagctgcacctgtagatgttatttcaaataaaggacacgtgaatttatgtacttggtttgtagcaaggaatttccatgatggtgtgtacctggtctgcgcacaccttttggtgactagctatggcttctgcaggaacttcagtctgcacactgctgagaagcctactgtgaactgttctcaggtgtccagctgagggcaatgctgaggaagaccagcacagttgtctttccttatacaccatggcacctangcagggtcaagaaacacggcacagcatttcatacacaaaatacagggagccaacatttgacttgtcaagtttcagatttgatatcatgttgtttggttgatcctccacataattcacaacaggaagagtactgcacattga

SEQ ID NO: 530 - DNA, 647 bp, Rattus norvegicus
  Genbank Accession No. AA891207
cacagtgaaactttatagaaacgttctttaattagtgaaacagttcattgtattatgggtagaaataaaaccaggtcaggaagcacagcaaacgaaccaacgctgtaagctacacgaagaacattctggtcagcctttttaaagccaggcacaagcgattcacaccagtaacaatgaacgctcagagggcctttcgaagaattcacacggcaaacaacaagttaaaaaattatcccccttaagcaaaaaccccaataggggttagttgtgtagtgcttgtcccatttgaccattagtgatctttgtagaacacaaggatgtaaagcttccgagcctagagcctatgtggaaatgcccatcccccaccctgtgctctcccagtcccctgctaccctgtggtgtgaccacagcctttggggcctgtccaggataatgccctcaaaagagtgaacacagagaacagcttttcagccacacgccgaatggatacatttattgttaatcaacctataattctgactgtgccttgtgggttcgctgcagaccttttagaaagaaaatactaaatgaaccactgcaattaagaaccatggcactaataaagggttaatctggttttgttccccttctctatgtgcgattcggtc

SEQ ID NO: 531 - DNA, 529 bp, Rattus norvegicus
  Genbank Accession No. AA891209
cccatccttctgagtggaggtgccctgtgtggggttaggaagtggtgctgggagggctcagaggagaaaccacaccacgtcttgccttaggaaagccaggatgtccttccatcctacccgcacatgtcctgcaccttccctggtgagatgggcgacggggctcagagagttctgaagagtgacacagtgtcacctgtacagggcaatgccagctcccaaaggaaccagtgccctagacaagcagtccaggccagtgtgcctcaggaaagaggacgtgaaggctcatgacaggtgagggtcacagctccgagtgtgccgccttggctactatcaccagcttggagagctcagctttgaaggccccaggcctgtgagacactgctgtcttggtcacttcaaactcctcgcttttcagggggacatcactctctctctcaaatgcagctttggagtaggccatggcgtactcgatctcagcaccctgcaactcagccttgaactgtgtgaagtagaggtaggatttcccctg

SEQ ID NO: 532 - DNA, 635 bp, Rattus norvegicus
  Genbank Accession No. AA891220
aacatttcactaacagaactaaactttatttccatgtttgttacatgtttgtcttggatgctgagtacatattagaattgacataacatacaacctgggagaaagtctgatattctccactgaatgagttaaaaaggaatgtaaaactacaaaatactactttacgtgtgagttctaaggtatgattaatacaacaacaaacatcttgctatttttctctaattttccgaggtggatttcactataaaagcttttttttctcatttcaagaaaggaagggctactcataaaaaatctttaagtatagggtacaaattagtctcaacacaaaattctactgcctacctaaaagttatgaattgaggggactaatgtcaactgcaaatctagtgtctgaaaggttagtctaatctaaggatgacacgcaaatacaactccatttgtcatttatgttaaccacttggtactcagaacggggtggccaaacactgcttagtgacagagatccaacatgaatctgttccaaggggaccagagccaagagggatgactcattctatctccggacccacactgtacacaaacggaaactactagtttacactacatgtttcaagacaaaattggcatgtgta

SEQ ID NO: 533 - DNA, 607 bp, Rattus norvegicus
  Genbank Accession No. AA891226
ggaacgggtactattatttattataaccagggcactccaccttccctcaggggatagatgaagtatacttgtcatgtaagtcagctacattgtcactggagacacggatccagccatcctcccgcacatggtagaggttgactgctcctccggagtaggcatctctgtaggtggcttggtagatggctcggcgggccaggtcataggcctcctccacttgtaggtcataggagtagcctcgatccatgactccaaacgcatacacggagccagatcccactgagaaggcggttccagagatcctgttcccctcactgtctacatagtagaggcccgggcctctcttatcccagccacagatcatggtgcccatggacagccccatgcctttgtactgatacaccatgttggcaagcagtttggaagccgccgcgaccgagatgcgttccttgttgcgaagctcatagattcgacactgtcgagccaacaaccgctcccagaagctgcaatccgctgcacccccagccatggtgcccagaacgtaagggttgatctctatcactttcttcactgtctgggaagcaatgtaggcacctgccgtggcccg

SEQ ID NO: 534 - DNA, 485 bp, Rattus norvegicus
  Genbank Accession No. AA891314
  misc_feature (1)..(485): n = a or c or g or t
ctggtcgctgagaatatttattcaaaaacggggattgaaaaaaactgtacagagtgtctgctgctgagaactgggcccctgccccccaggccacaccccctgctataggcagagccctctctttgggttgccccccggacaagcccatccagtctattccagtcaaaagggtatcagtggaagcagcaggatctgcaggggatgaagagaagcttggccccagccacccctcactctcctccaattcccactggggcagcaggaagaagcccaaagggatggagaggacacgagtagcccctcccacggcagggcactggggaggccccagctactccctgcatccaagcataggtctgaaggggtggagcccctgctctggggctgccaaactcctagaaccctgggccaggaactgtcccctctctgaggaggatctccaaagatggggcaaggtanggggtgcatccatgcgtctggcatta

SEQ ID NO: 535 - DNA, 484 bp, Rattus norvegicus
  Genbank Accession No. AA891423
  misc_feature (1)..(484): n = a or c or g or t
actgtggctaaacagccacaattagcaactttaatataaagtttttaatacaaagttcaccacaaagaaagcagatgccatgcgtggaggcacgtggactgcagctgcctcatcctcaagtcccgggcttctggtgttttgtcctcggatccagcagttcccatgtggaggctgcatggcctctgtccttaacattgatgccgtgggtcatgaggtcctggcggagtgcgtcacatgcctccagcaagggctgcctctcctggagctgctgtttccgggcctccccggtggccccaggcgtggccagtgcatactggcggaccttaagcctgaagcgcactagttcatctaccacacagtgcanggctactgtgctgctgtctcctgaaacacactgtcgcttggccagagaaatccaacagtctcgaaaaactgctcaacgtaggcaacgatggccccaaacacagtgggacttctcgggcca

SEQ ID NO: 536 - DNA, 397 bp, Rattus norvegicus
  Genbank Accession No. AA891438
  misc_feature (1)..(397): n = a or c or g or t
ttccgtggtttggcttggatattggaggaaccctggtcaagctggtttattttgaacctaaagacatcactgctgaagaagaaaaggaggaagtggagagtctgaaaagcattcggaagtacctgacctccaatgtggcttatgggtcgacaggaattcgggacgtgcaccttgagctgaaggacctgactctgtgtggacgcaaaggcaatctgcactttatacgctttcccactcatgacatgcctgcttttattcaaatgggcagagataaaaacttctcaagtctccacactgtcttttgtgccactggaggtggatcatacaaatttgagcaggattttctcacaataggtgaccttcagcttcganaactggatgaactagattgcttaat

SEQ ID NO: 537 - DNA, 436 bp, Rattus norvegicus
  Genbank Accession No. AA891441
caggcaggcctgagcaatctttattctgcaaaggaaatgaccacagatccacataccatgtcaggacaaggggagccagcctttcaggggtggggcaggtcctgtcagggggcaaagcctcaggtggatgaggggcaagatgggtagacaggcaagggcctaaaaaaaagacaaaccccacggggcagggatgctggctggtggcccctacctggggggagggggtgtcacatctctgcctaatccacccggggccgaaatagcttagtttaggaggcaggacctccctggggagaacctgaccagaactcccagccaacccccacccctcctcttgactcagaagccgaaggtttcttgggaggcatagaccatgtagaggaatccgtcttcaaccttcttcggttcatagatgtcaaccatgggtgtggataca

SEQ ID NO: 538 - DNA, 499 bp, Rattus norvegicus
  Genbank Accession No. AA891447
gcatgatatatgtgtgggcacatggaggttagaggccaactccgtggagagaggccccctttacctgttgtggttggttaattcagtggttggtgttcaaagacttaggtttctggggctgcagctcagtgttagatttgcctgacatgcatgcacctcagatccaatccccagcactaaacacaaaggaatagaaagaacggcctcccagcattcatcggcttcggctctgaacaccgtcgtctttgctatgggctgatttcaggctggttagtggggtgtgaaccactcttcagcctcacagcgagattttacatcacagaagcagggcgtctctccttatggtgctaccatagcatggcaaacaaccacagaacagcagtttacattgcttcacgttttgaggtggctgaactagctgtttccagctgtggtgttctataaggagatggtcacactgtcaatggccaggcctaaagtcatctgaaagctggactga

SEQ ID NO: 539 - DNA, 621 bp, Rattus norvegicus
  Genbank Accession No. AA891535
tttacatttgagaccttatttaatcatagtgaatgctccaagtttaaaaagcattaggcagtaaccacacacaagatgaaaacagtgtaaactatacaatactttatgtacatttttacaaagtaacacttttttaaataatataactggacacaaaaatatacactttagagaaattcacatcagtaattgtataaagctctcttctagggtcctgaaaatttaggacaaacattagctctgtaaataaagtgttaccgtgacagtcctgaaaggccactatatatatttatctacatatagatatcacattgacattttcaaggctaccagctttactatagaatttttagattatgtattcaagtgttgaggtccttatgattatgcaaacatcaaaggaatagtggaataagaagcagagcaaatttacacgaattgggccagaacacggatgcacaggctctggctgccccaacttagatcctcagtggctgatatattcatacttcagacagcagtgaaggttttaaataaaattatggcaaacaggcttgaaacatgattctgattttctacaattttcacaagttcttttaaatgcaaacaattctttaccat

SEQ ID NO: 540 - DNA, 549 bp, Rattus norvegicus
  Genbank Accession No. AA891537
ggcaagtaaaattttaattgttctagctagaaacaagcatacattacagatataacacggaaatatattagacgaagaaggctattataaatttctcaataactaaaataacataccagcagctactagcactatcccatacatggttccaactcttcactgtcccctcaggctcaacatgtgggtattaggggatggctgaacttggtgtgggacacgagactgtcaggctggcatgagatgagccttgttcctgaatggacatggactgcatgcactcattcagtagatcctcttcctttgtctcatcgttcatgcatggctgataatccttagaagaaactggtagcaagaacagtctgcctggtcttctaaaaatcttcagggacttgcatcttgttttagatgcatatccaatttttaacccttctttgtgtctcaggggtctccaaagggcatgtatgatcatttcaggtgcttctgctgcaatgcccagagagtcttctctctccagatggtgtctccatgtagtgcagggggaatgctgtt

SEQ ID NO: 541 - DNA, 564 bp, Rattus norvegicus
  Genbank Accession No. AA891546
actgtgctaagcctttattgcaggaggcgagtcaggcctgggtagacacagattcagggcagcagtggaggaaactttcagaggcacagtgcatggcattaaagttcagcaagtcccggaccccatgttctcctgattctccacggctcagttcttcatagagtgctttccattcaaagggtcctaaaggccaaaaggaagggattttttttcagctaccggccaccttcaggtctcccagccgaggcatccagtgagcctatcttccagtttcctctggaggatcagaaagcctgcttcgcatcgcagcgccgtgctccctgctcctgttcctcttctccatgtactcattcttcaagcacttcctcatttcccgatcaagatcgttgcaatgaccaaaaaatttcagaatgttgtgatttttgtgacattccttaagcaagttaatcaagacgttgcattcttcagtgtgcaagtgtggagacaagtcaggatgcatcgtttggaggacgagtaagtgcagaccgccactcagccctcaaaggaagcactgaaagaagccac

SEQ ID NO: 542 - DNA, 614 bp, Rattus norvegicus
  Genbank Accession No. AA891553
aattttatttcttctgctagagaacaggagctggacacacgctgcccaggcacagctaggtgctaacacacgcaggcaccaggccaactcacttaagtttcttcctcttcttcttcttcctcctcttcctcctcatcctcttcgtcctcctcagagctgaaggtgccatcaggcaagctgtagactcggatgacctgcttgttggggtccttgaggatgaggtatttgccctcctccagcttcatgcagatatcaatgacacagcgcaggatgccccaggcattctccacactcaggttgatttggctggcaaactcattgggcttaaactgctgggtgcccaggatgacgtggcgcgaggagtcctttacatggtaccgggacacatacccgagcttcaagtactcagagccagccagcaaagcacagcacgtccatcgcgccaacttgtagctgttgttcttcaactcagtggcgatgacagccccacgctgagagtccagcttctgacgccagtcaacgccattacaatgcctggagtcccattcattgagtgtcttgatgttgatgaaggacacttccccgttggccccagtcatgacgccatcatgttc

SEQ ID NO: 543 - DNA, 574 bp, Rattus norvegicus
  Genbank Accession No. AA891559
cagttggacaaagaccttttattccatcatagggactggaggagagtttatcgttcacccaggacttcatcagggatctgactcttacaatctctaactcttcatcccacgtgtccagggtggctgccacagccccaggcatcctaaggaggtggtgggaaaacgctgtctgcacctccctgaagcattgctcagctttaagcagaggactcagaaaacccaaacaaccttctttctgtgccacatctgtcagaaccaggtcctgtttcacttttctctaaaggacaagcttagtagtaagcagctaatgccagggttggccctgtggtggcagtgttgcctcccacacacctgggcctctgctgtcaacaagtcccttgctgcccagcaggtcacaagcttcctggccatagccctccagctctgcccctgctctctcactccagtgtcagggacaaccactaccacaggcttacgagaaacacaagtttcctgaggttgggtcattctgaaaaagcccttggaatcgcaaacccctcaaggcattggcccccttaacaatctgatacccttt

SEQ ID NO: 544 - DNA, 419 bp, Rattus norvegicus
  Genbank Accession No. AA891571
gaactcagtccatatttatttatttattgagttctaaaaaaatctgatggcatcagtaaaaatagcatgttcttaaaagtctactgatctcaatccaaaaaggtcagcatggtaactcttggatcaatcttcagcctcttttcctttgattctgactgcaaaagccccaaatttctctcctttccaagcaatagaacaggaacttaaagggttctcaggatacctgcttaacttgtgagttctagcaaccgatgcaagatcatcttctgaccatagcggacctgcaaggcttgctgctcccgccagctcagcttggcatagacctccttgttactgagtaaatcctgctcagtttttaagtctgtggcataggtctgtagggtcaacagaacactgtctcgaagaagccgtttccacga

SEQ ID NO: 545 - DNA, 402 bp, Rattus norvegicus
  Genbank Accession No. AA891576
cccacctgaaaaaaaaatagtctcataaaggtctcgataaactgccactggaatggaaccagtcagtgattcccagagaaactctgaggagacagagggctgatgggtcaggaaccagggtggacttcctgaaggaagaggtctgagtgaggatggggaaagcagagggagcgaggcgggcgtccgggtgctggacccagcctgccattctagtcaggaaacagtaggaaaccagagaagacgctgtcagagccctcctcacccggctccccgggaggacccctggggcctggatcccctggcgacccagaggtccccatggggccgtttttcccacgatggccaggcatacccggctcgcccttctgacccttgggtccttgtgtcccaaggatggctggg

SEQ ID NO: 546 - DNA, 486 bp, Rattus norvegicus
  Genbank Accession No. AA891580
  misc_feature (1)..(486): n = a or c or g or t
aaagccatatgctacacatataacaccttctctctctgtaaggttgacattattcagagagacagtcagaccacaaaccacaaaacaacagtcagacaacaagcactttacagcgcccaccacagtctgtacactaagaacagtcctaagacggcatccgccttctccttcttcaatcaggatgaagctgtcactgacattccagtaacatgctgacgtggttgtcattgtttcaagtcacaccaaactgacatcagagagtacaaggttctttaatcaaacaaaaaattagtcttatttaaattaagagaaattcacttaaactaaaaataatttatttgagctgagagttttaaatacctaacacattttttcagggaaatgttggtaccatctctgagccagctttccttcctccagactgtatctgtataagaatatataatttacttatctctcagtcattttcagannacacgtatctct

SEQ ID NO: 547 - DNA, 410 bp, Rattus norvegicus
  Genbank Accession No. AA891589
  misc_feature (1)..(410): n = a or c or g or t
ccggcacagtgtgtggtgtgtgaatctatgaagattcagagcccacccaggacaattgtgcccacatctcccttctgctgacttctttgggtttaagacacccaactccatactgcaatggcctccttctctcctagactacaaggcacataaggctacacggtgatctttgtttggggagctacagcagcccgatttctcagtggtgggcctggcctccctggctaggggctgtagccccaggttgcgagcagatctccctcgaggacaggtggcagctacacggaggacccggctcagtgaagccatggggacttagggctcctgtaccttagtcttcgtcctagattttccagaagctcctgngagattcctagcaaggaaaagtcagcatgatatggacccaatcg

SEQ ID NO: 548 - DNA, 398 bp, Rattus norvegicus
  Genbank Accession No. AA891591
ttaatttgtgatgtgcatttatacagatgaaaatattcacagaggcttgttcgattcctgctcctacataaagaaaaagtatgctgaataaaaaatgttcttttatccacccattccctgtcagggatggaaaagtgcttgtgtattccatgatagggattcaatcttcatgaatgttgaagagtttggctacttcattgaggtcttcatgttgctcaccgtctttaatgatcttccttgcaatcggcattcggttaaagacgttccatagcacaatccccaccacaactttgtccctgaggtagaagatgacacctttgccgtagtcctccccttcaacagggacctgtgggactgcagggtcactgggagggattgtgatttcagaagcttcagac

SEQ ID NO: 549 - DNA, 381 bp, Rattus norvegicus
  Genbank Accession No. AA891666
aaacagaattgtccaggtttattcacaggcaggacgtcttcgggcctgctgctgtatatccctccacactcagtcaaggaaagacttctttggcctcctcagctgatatctcctgggagtagagatctgtgaagagagctggcagccagtagtgggcctcccctggtgcctgcagatccagccaggccagtccttccttcagcaggtgttccagcacttgccgtgctcgctccgtctcccatttaagactggctttgatttcactgacagtcacataaccgtttttctcggccagctgcagcacaacagtgtgatccatattgagctcagctggaacagactgaatgaggtaagttccctccacagggatgatgccaaatc

SEQ ID NO: 550 - DNA, 410 bp, Rattus norvegicus
  Genbank Accession No. AA891669
agtaacgggcaacagtgcaagggctacagggtagaataagagttcgagagctggggtttggcgtaaattttacaaagtgtataaagaatctgtgtttctctacaataacaaaaaaccaaaggctacaagagcagttgtatatacaaaacacggagatattgcttcacttgcagacaggttcctgaccagacaaggagacgagacaagagaagtggggacgggcagaggagagcgctgcgtgcagaggaggaaggaggggggcaagggtgtcttctcccagcataaatctacaggcaggcggagctcacttggagggtgggagcagcctgtcctagagggacaagggatgggccgggaagacactggtgaggggctggccaaggaccgacgacgtgcacgcacgctgggtg

SEQ ID NO: 551 - DNA, 421 bp, Rattus norvegicus
  Genbank Accession No. AA891689
caggaaaaaagcattttattcacatataaccgaagcccctgggtctgctgggggggggggggggctgcagggagtctcagttggcttccgatggtctctcctgagatgtgagcttccagctgtgccctctcaccctctgcgatgaatactcagtagattccataggtgggctcatgactgtccctgtatcggtccagatagcgtaggggctgctggtgggggaagcgcttctgcttggggtggtaagggggtggccgtacaaattcaaacacaggttcccgcatgtctagaagctggtggaaggtgtgggtgaccgagtcatcccagcggcactggaagaaagccagaccagctggagtcatggcttcctggtgtttcttgtacaaatcaacggtgtggaaggtcctctgggccagctggt

SEQ ID NO: 552 - DNA, 502 bp, Rattus norvegicus
  Genbank Accession No. AA891690
cttgtagagtcttttatttgtttgtttgaaacagggtctcaaccactgtaacccctggatggcctggaactcactatttagaccaagttgaccgctaacatagaaataggcctccgagtactgggattaaagcggtgaagcacaatgttcagctcggaagtttgctaggggaatggggagcatgaatggaatggatgtcgaggcacctaaaatacattttttttctagacagtaacaagaatttggacgcaatagtgagatagtgaaaatcgggcttcttgtacattgaagcagggggcttgaagagttgtggccgagggacacgttttccctagcagagaccgtgttctttcctcaaactgcctctagatggtggtgctgttctggatgcagtccagtggataaggcttggcacagtgcacaaaacccctgcactgtagcagctgttgtaggcacggtcaggatcagaagcatacttttgatacaccggaatacagtctcc

SEQ ID NO: 553 - DNA, 418 bp, Rattus norvegicus
  Genbank Accession No. AA891727
ggggaaactgggcagtttattgacaggcatcaggagactgcgcagtcaggtccgtgggcgggacagcacccgagtccaggctctgtgcttctcctcgggccttgtgggcgcaaacttctcctgcagtttcctccacacactcttattcatctcttgaaactcctccaaagtgtctgtggacaggatcagcttgtactcttccacggacaggccactgaagctggtgtctctggggcagggtacttgtgcttgtagtagtttgaatgcagtcgtgctaagctctcgtacatctgatcacaggcctcgggttctgcaacctgggtgttctctccctcccgaaaggcctgtgctacccgctgccgcaggtaagcgcccaagtcccggccccgtttggtctcgtccactggcccctcgtgcc

SEQ ID NO: 554 - DNA, 666 bp, Rattus norvegicus
  Genbank Accession No. AA891732
gcaaacaattaaactttatttgaaccttaaaaatttgcagagtggaacattattgtaagatctaatggcgacggagtacaaattcagtgcggagcaaacgatcaagcaaaatgccatataaaatatgactcacaatcacctttcagaaaaattagctctctaaccgttcataggaaaacaaataaaagctatgcaaacataatgagaacataacaattagcatgttttctaacaagccgcgttgtttaaattcacattaatgatgttattatgatcttgaggagaatgtgatgtactgtcaagggtagagagaaacttcctcacagcacaaagatgagtttaccgactgaacagaaaggcacacttgcagcacggggagcggcagtttttctcatctctcccagatttaaaggcctttggttcccatcttctacctcccgtgtatattcgagttaaaaaaaaagaacaaaggccagaggctgtggacagaagcagcttctgtgctggaaacgttggccatcagttggcaaaggactccctctcctggcttaactggaaaaggagacacaaacctgcttcttggacggctggcgtgggggagggggtcctcaagtgtgtccgtgtgcagatgacagctgccgccatctgctggctccttaacttaaa

SEQ ID NO: 555 - DNA, 664 bp, Rattus norvegicus
  Genbank Accession No. AA891733
aaagcaatctactaaaaaaatacaactgtatttgaaccttccgatctctgtgagctatgatgatcagaagtcgggagtcctttgtgtttaaacaaccacatgctcactctttaacataattcctgcttatatacgggaagcgattcacaaccgccatccacctgcaccttttgcccaggcggcaatgtggtttagacctcaggtctgtaattgcaatactttttgatgggagatgttgcacaagtgctatttgttagctatgaaatcaggttttctgcttgttcttaatgccatggtcaaatcatagcacaaaatcattaaaaataatcagtgataaatgatctgttccctggggttgtttgttcacttctcatagtcaacaaatagaagactgatgtatgtgtatgaccagtcttggaaaatacctgttgtttgtggtgctggagggagagctcttggctacacaccaacccaaaggatactgctgatccgtccctagttactgactttaaaatatttgtcatgtgtcacagctcatgtgtggtgaggacaacctgctcctgtcatgtctctctgactactacgtgagttccaagagcattcttggcagtgaatgcctttagtccctttcttactggtctgtcactgatttttttaaaaaaag

SEQ ID NO: 556 - DNA, 516 bp, Rattus norvegicus
  Genbank Accession No. AA891735
aatacaagtaaaagggggcagggcaactccttccccctccaggtcaggaccaggagaatctgctgggctgtccccgggaccaaagaggaaaagagtgacatagaaactgaagcaaaggaagcttagtcacactcaggtgagggtgacagctcctcctggattttgtttccatttattaaaaaaaaaaagaaaagaaagaaagaaaaagccaccccctcactcccagcccattcctcacagccagggtcagaaagcagcatcagtgaggcgggttcctcacctctggttatctctggcccaggtcagcttgagccacctgccctcaccaggagagggtttcagttggcagttaggcttggggaagtctctacctggaccccccagaggcctgggagcacccccctcctcccaggaaagggaatgcagtgtctactgggctcagaggggtggcctcacccacctgacatgagtcctgattctcccatctcgaggacggcaggaagtttattgcaccag

SEQ ID NO: 557 - DNA, 558 bp, Rattus norvegicus
  Genbank Accession No. AA891737
aaatggttcagaatcactgtgaggcttttagatgttcccattattcaaacaacccaaattaaaaacatacaactcacattttaagtaatataagcaaaataaaaattatctttaacaatgccttatattttgttttagtattctactatagacacataagaataattatttccattttctgcttccctcaaaactataaaatgctgttacatatttttgaaaaatcaaactccttcatatcctttcatcaattttatgttgaaaagagagttattttgaagcactggaattagtgttggaaaaataggtttagagtccaaagctggtgtgtttgcgaataagaacacaagctgacaagtgatttaaattccttagaaaccttcacagttctccatatgtacatgtggcagaaggatgaattgccagccaatatacatcagtgatcagttgcttacatttcaaagatcaaaacacttggtgggaagcctagaaggaaacacttaaagacatataattaagaactcttatctctgaaaagcaaagtccacattttagtta

SEQ ID NO: 558 - DNA, 599 bp, Rattus norvegicus
  Genbank Accession No. AA891739
gagcgtcccggaagttttattgggttctggttgggtcagggtccccccttcatcatctagcgagccgcgctcagcgcccgttactgggcgcgctcagctgccccatcatgtcggccagcatgcgattgcacagcgcggcgtacggattgagcagcaccaactggcgccgtgcgaacgagctgcccagtctcgccgcctgctcgaagtctctgcgggcatcgtcgtcccgaccctgaaatcgtgccagcagcccgcgctgcacgaagctctggcgggcggcgcgaccccggccgccgctcaacgtcaccgcgcgctccaagtcctctagggcgcctgctacatccccctggagccgcctcgcttgggcacggttgttgtacgcagaggctctctcaggtagcaggctaatggctttgccaaacctctccagggctgtgtggaggtccccagcttctgctgccctcactccctgcaactccagggccttggattgctccaactgtgcttgagggaaaactccatcttcatctccctcctctgtttcttccaggtccaatccaacaacatctccaaagggggtattagggttgaggatggcc

SEQ ID NO: 559 - DNA, 608 bp, Rattus norvegicus
  Genbank Accession No. AA891746
cactttccaaggttttgctttgtttgacagcagttatgggttgagggggcacacaggcctgacccccatgttccgtttgaccatgtgaggagacccacggcagtgctggtggtcctgggggaccagccagaagagctcagccggaaccactggcttcgaggctttgtgttcatttcgccttcggccccttctcgataggcttcccgatgtccttcccccggagcttgaggccgatggctctctcaattttgcccaaaacctggttattcggaatggcccgtccactttcatagtctgcgatgacttgcggcttttcattgattttcgtggccaggtccttctgcgtcaggcctttgctctgccggccccgctggatcactttgcccacctccagggtcatcctgtcgtggtgcagctcctctgtctcccggtctagcttggctgtgtttttagtgatggaatgctgcttgttctggccagcagcccattttttggatgtctccacatcttctcctcgtcgctgagctgctaagatggcctgcttagacttggcctgtgcggccgtggggcccttcttgcgcagcaccgtcacggtgtcccagtcactc

SEQ ID NO: 560 - DNA, 488 bp, Rattus norvegicus
  Genbank Accession No. AA891749
atctacacggcggctcacaagcatccattactctagtctcaggggatctggcaccctctcctggcctctgtggatgcatagacatacataagcaaaacacttatgtacatatagtaaaagtaaataaatcttcaaaagacagattgtttcatcactcctttggaacaactccagtgtcctcctctggccttagagcaagtcctggtctccacatcttaaacgagtcagggcagaaatctaacagggagaggttctgctgcagggggtagctgttttcatccaactcaaaaaggctctggatcttcagcacgcaaggttctgcactgactgccaacaaggagtgcagcaggtccgcagcgaccatgccgtaggtgacctctgaggaaggcactatcactctgctgaggcaatctggagaaatgttgagaagaatctgctccatcatcttcgacccaacatggacataagtattatgtcttccatcaact

SEQ ID NO: 561 - DNA, 557 bp, Rattus norvegicus
  Genbank Accession No. AA891759
acacaggcagagctttattatctgagggtacgagccaaaggacaggcccacagttgtcaaagcatcctcatgaagcatcttcagtgatccactgggcgatgaagttaacataactacgacagagtaggatattctgagtatttgcaatatgtcggcaactggactctccatcaggaccctggctcagaaaaggcccagcttcaaggagtccgatttgcataggctgaacactcccatatctagaagctcaaaaacctcctttcttatctcgggaatgtccatcattctcctcagcttctgatctctccagttccagtcaaaaaccagaaactttaaggggttcaaattaaggccatcttgtttgacaagttctttgattctccctggagtccccacgcccaggtgtatcgctcgcttctccagcaacttcacctgctcctggacctttatgtgttttgcaaataatttcataactttggcatctcctttgaatgctgtcagagacctgataagctccagggcccggacagcggagctgcacatgatcagcatcagga

SEQ ID NO: 562 - DNA, 423 bp, Rattus norvegicus
  Genbank Accession No. AA891769
ctgtctctctgaacacgggggagacacatgggaccagaggggagacaagtgtgaccatggggagggctggactggacaacgggatggcacatgtgaggggaaagacaggcgtgatgacgtgtaaccatgaagacgagtgtgaatacagagaaggcaggtggaaaggggagtggatgggtgtgactgcggggaaggcaggtttgaccttggtcgggagagacggtggcttcccccttactttaagaagggaaagctgtgaggtatcaacaacccaggcacttgaagaaggaggaactcggaagagaagtcccttagctgctgtggactaagcagactcttccatctccaacaggtcatccacatactccacaacctctccctcatcgtcgtccatgaggtgttcctgagcgaagtcatacagtt

SEQ ID NO: 563 - DNA, 518 bp, Rattus norvegicus
  Genbank Accession No. AA891785
gaagagctttttagtagctaaatatggcaccacgtgactcagggcaatataaattacagtatgcaaaacacactgactggctgaggtaaagcgcaccgttcctgcctcgtgtccactgtgagggaaattgctcacatgctttaaaaaacatctccatcatatatatatatatgtaaaaaaataatcccctagaaaggccaccagagaggggggctacaacgcccaccctctaccatgtacggagcacccactggagctgggtagtgtagtgtccacccctactgcttgcccagagctctgtgtccaggcaaagatgctggcaatagggttggtactggtgggccggcccttctggtgttctcggtagtggcgggtgactgtcccgtgagcagcctcagcttcaatggtcttcccgtcagggcagaccagcacagatgtcatcaggccaagggagccaaatccttgagccaggatgtcagactgtacatctccgtcatagttcttgcaggcccacacaa

SEQ ID NO: 564 - DNA, 609 bp, Rattus norvegicus
  Genbank Accession No. AA891790
ggagctcttgcaaggatttatttgctacagaattgctttcataccccagcgagctggactaaggacttctgggtctaaaaggatttaggtcacttcatgttttcaagtgctgtgacattcaaaaagcaattttggtagggcagagatggggtagagtagcaccatttgccatgtggtaagaggcgagaaaaataatcagtaatattaaacgtctaagaatagagaaggaaagaatactttaaagttcccatctggacagtccctgagctgaaatcacatttatgtgtgaagagaaatgtttgggctgtgaccgtgaagtgacagatgctgaccttgggcttggctggtgaaagcttccagacactctgaatgacaggatatacgccactcatctggctgattctggcacgtgtcctaaatgtctcctaaatcccaactctcctggttctctgaaaggcctgtggtcatctgatccccaatacttctttttatttttgagacagggtctctctacatagccctggctgtcctggagctccatgtagatcaggctagcctcgaactcacagagatcctcctgctcctgcttcccaagtgctgcccaatact

SEQ ID NO: 565 - DNA, 571 bp, Rattus norvegicus
  Genbank Accession No. AA891796
aagaaccatttctactcttcaggacagggacaaagatcgccctgtgcagaaagttgggaactgcacacaaaactgcagaagcaacatttcagctgaagctggggcctggtgggagggagggtcaggcaaggagagggagtcaactttagctgccactcgggtagtgtcttgtggtggtcacagacagtaggctgtctttgggaagtgtgaatacacaggaggtccattctctgcctacacccctggctgaggtgccatcaaatcaatgtcactcaagttcctggccagccaaactccagcagcaaagagtcccaaattgaggatcaagttcctccggaagtcgttccgatcggtggcgaagcggtagacgccgcgaagccagtctcccacgttgtctggaacctcggagttctcaccggccgagccggcggcgctcaccgtcacaccgctggaagccataacagcaccgagcacgtccgtaccggcagcgcgtcgcaccgagtcggcgcaggccgatcgcgcaacttccgaccccgcacttccgccgatcagagtaataagtgaacgagaa

SEQ ID NO: 566 - DNA, 620 bp, Rattus norvegicus
  Genbank Accession No. AA891800
aaaaagttttaacaatgatgtcggacaggaagttatcagacggtcatccacttgcttcacaagagcactaaaggaaaaggagtccccggggtcctcggaggtttaaagtctcagtgcagaagccccagagtccccatcagttgcggaggaagtgccacacttcttcttctacactgctttctttactcattgaaggtgttgggatcgattcaactagtgaccttgcttcctctgtagtgcagtggaaagggctatcacagatgtgcacgttcacacaactgatagctcccttgtcacacttcttcatcaccatctctttccaatgttcatgtgcagagttaataacttcgagggcaaaagccttgtttttgaattctccattaaaagcaaacttgttttctggttttccatctggtaccttatagagtctaaaccaattgacagtggcttctaggtaacctggtttgaacttcttaacatcatcaatatcatgaaatttttcagcctcaggatcattcacattgatagcaattattttccaatctgtttcactctgatcgataagtgccaaagtccccaggatcttcacatggaccacgtctccacgggaaagaaccttg

SEQ ID NO: 567 - DNA, 551 bp, Rattus norvegicus
  Genbank Accession No. AA891810
aatacaaagctttggcattagcaattttatgaaaaaataaaatgtactaaaaataaacgcttgtgtggcatgattggtaaatgatgcacaaaaataggttcttttttccttcaaggcaatcagtcagaaagcagtgttttccttcttcaaaaccattctaccttgttactgcaatgttgatttcacccgttcgaggagtgagctccccatcttgaggaagaggcgatatcccagaagttctcagtggctcaaggccaagggaactgtcattggcaaggtcaccaagggctgatcttcggttaactgcctgggttctggtgagcctttccatatcaaacgctacattatcagtacatggcagatttggcacaattcctagggctttcaaaatattaagtttacacataggacaggtacagtgttcactgagccagggatccacacaggatttgtggaaaacatgcttgcaggggagaacccgaacaacatcattctgcttatagctctctatgcagactgcacagtgatcgaagtctgggtctgtttcctta

SEQ ID NO: 568 - DNA, 620 bp, Rattus norvegicus
  Genbank Accession No. AA891812
  misc_feature (1)..(620): n = a or c or g or t
agacaaagaaactgcttaaagacttttatttgtgagtaagacctgttacgacgaggaaaggacacacaggacctgtcctccaagtctgtccatatatgcagcgatattccgtgtgtaatacaaagattagactacaaaagtgagaagtcattgcatatgtgggataaaggaagggccagaaggaagacgaggaggagtccagatgaggggactcaggaccaggtgagagctcaggccaccgtggtgactagtgggactagcagtacagcaggctgtggggtcctgcttggtgccccattgggagatcacagggttctgtccacatccgagcacccgctctatgaggcccaacccagcaggggcgtggagggccccagcaggctccctctcctagtcaggctggcagtggcagctcctggaacaaggccccttaggattccacctgacactcggcttccccactcactaaagcagtttcaagcccttttccagggataaaagttaggtaaaaattcataagggatgaccaagaaggtcatgggctccatgaatgatgcaagacattagatggcacctccaaagccagcttcaaccatgagttaccatccctatcaanacca

SEQ ID NO: 569 - DNA, 641 bp, Rattus norvegicus
  Genbank Accession No. AA891814
  misc_feature (1)..(641): n = a or c or g or t
gcataacatcgatttattctgtgacattgtcctcgttggcagtattttaaagtagattaaaacacatcaatatttcatgaaagataaaaatctagaaaaatccggatattatctgtaatatacatgatttgatctttgaacatccatttttttccttgaaaacatcgtttttgagagttgcataagaatgaaaaggctcactgtgctcctcacggaacccaagattcattcggttcagttcaacctgcagttcttttcccaagtgcgtatgtcagtggtatctgctcctgcttctgaatgggcagagcatccggtttctgctttttgacagtgatgtttaggtcctctttctcggagtcttcaagtaaatgtttcacagtaagtctgaacagtaaccgagggtctggtccagagagtggtgggcaattacagacctcccgaagtttgagagcctgtggtatgagtctgtccaagtactcagctcggttcccgtgagaaggatgtgttgatagccactctggcaacttggggtagccatgaaggctctctgagaactccatctgctgccaaaacactgaactagctcttacgtccacacatgcctttgcagccagctgtagtccaattttgtcagcttcggn

SEQ ID NO: 570 - DNA, 669 bp, Rattus norvegicus
  Genbank Accession No. AA891818
ggtacacgaaccttttattcttcataaagtcctcaaaacatgaagaacaagctctttatagacagcagtttcaactaggaagacaaaaggcagggcagagctgtgcctgctcactgcctgtctggctgcactctgcagtgtgtggtaaggagcagacacatgagcaaaaccctggcctcagttcaggactcctctgggagacacccctaccctggccatgtaaggaagccaaacagcaggaatggatgaaagacaaaagacagggctgggaccaattaaagcccagaggaattcctagcagagggactcaattcctcaagagacacctccaacacccatgactgcctccaccccaatattctgggaactggtgatgactttcctcttctctgagttgacctatagttggtaactgtgctgtggtggaccccattgtggagttcatctgctccatgctggcagaagactgacgtcatccacagagactattctgaggtgttctgggttaagagatactggaaagaagttactacctctccactgggccaagagcatcttctgtcagcatttcacctgcttcactcataccacataccacatgcacagccaccaaggacccccagatgtcatggggaaaacggttgtattcacaagcaaactagaaactgg

SEQ ID NO: 571 - DNA, 646 bp, Rattus norvegicus
  Genbank Accession No. AA891821
gcaacagaaactgtttattgaaacctcagttctataaaagcatgaaaaacccagatacaaagcagtggcgcccagagaggcctgtgaagagaacacccaaaaaggcagagtgggaagccttggagcaggatgctatggttggaagacaaagggacaaggttaaaggacccagcaattcttggctatgacaaattcgtccaagggacaggtgtggcaagtttcccgccttggggagccttctgtccctcagcatctctcgtcttggttttcctgactcacacatcagagattcacatcgatgctttcccactctccttactcacttcccacaactcccatttaccttcccatctctggaaacttcaaagcagaaatctaccctcctgggcttgtgaaggcaaagagataggtgattctctgtcatttgtggcatgcctctggtcactgagctgacactgtcccaggcaccactggtgtcctagcctattagccagcctctgaggtctaggagagtgagtgaccttgtgctgcccccataatcccttatgttcctacccagcaggacaggggactagccaagggcccagagaggtagcataattctaaatcaagttttcctcttccaggttctcaaggactcccaaac

SEQ ID NO: 572 - DNA, 546 bp, Rattus norvegicus
  Genbank Accession No. AA891828
cacttcaaaacctttatcagaggtgtttctgtcctggggaaggggtggccttggccttcagaactgatgttaccccttttccaggctggaggccaaggcgagactggggagaaggccttgggcttctaacagccttactccagatgggaagatcggggccactccaatggagataaaggtttagggctccagcttcccctcatggtagaggaaggagggttgtccttggggatgcttcaggggctggggaaacaggcaggcgcctctccatctggctacagggagctgggacagaggccaagaggggcccatctgtcgcttcctggtcttgccaacaactttgggcaggctggagcagagcaggcagcagcgccgggttctgctgaatcacttgccgcatgttctggaactgaggctggtcccgcaggaactctagggggttctcccctgctgcttctgtggccggttgttcgggcgcctggctttcctggacagaaccatgttcaggctcagggcttcctggaattcccgtgagcaagtactcca

SEQ ID NO: 573 - DNA, 537 bp, Rattus norvegicus
  Genbank Accession No. AA891838
aaagagtctctgctgtctacagggagcaccctgcagacaaaattttattctctatagaaacaaagtcactgcccagcacctcccttgtctttatccatagcagaaaaaccagccgctccctctagggggcgacagcagtcctgggggcgaccagtggagatgaagtacttgctggaaggccttggttctggttcccagagacagctgtcgtcctcctcctcctcagactccccctcagactcaggcacgctctcgggaagggcaacggccatctgctggaatctccctgactgggcatcccacatgtatttgatgggcactttgaattcggccatctcatacccaaacagcttcaggacaaggacctgctctggggtcagcacgtcaccctccttgcacacttcatagtcagacagcaggggcaccagacctttcttgagggcagtgggcagtcccagctgcctcagctgtggctccatggaatgagggaactgtttcagcggccctggatccaggctcacagttaaagttgctttg

SEQ ID NO: 574 - DNA, 608 bp, Rattus norvegicus
  Genbank Accession No. AA891864
  misc_feature (1)..(608): n = a or c or g or t
gaaaccaaacaggcccaaggtccttttcgtcttgagtcagctgtctgaatgcttgtccctctcatacttcctgtgcaacgaaaaccaagacatttcatttcttcttggcaattaacaaaggtggaagaaagttcaaatagggtgtgttcttgatacctcagagtcggaaagggcttcgtcttgggcagaaggctcataatcgcctgtattctccgctaattcaacctctaactcgtcattgctttctgcactgtaatcaacttcttcaaggaaccgaggttcatcttcatccaaaacgtaagtagtggggctagttactttacagcttgattcaattaagtcattttcaaagtcaagcaggttggagggtagattgtactccaatggagaagtcagtcttttcaaacgcaataaaccaacacaaaattttgctcccatttcttccagttctcgagtcccaatctgtaaacccttgtatctaccctgatcgcagccacataaagtactctccatggtatagctcctttgaactccaatttcccgccacacaacaacccgagctgtggactctttggatttttccaccacanagctacagctgctcatgc

SEQ ID NO: 575 - DNA, 614 bp, Rattus norvegicus
  Genbank Accession No. AA891872
gagaacatgatgaactcatttattactcaaatggttgcattccattcaagagcacttaatacagaccattcaagagcacttaattgattgaaattaaagagaccaattggcatgggacttttaaaaatacaacttattccttttaagttattacttaaactatctagatcttctacatattaaaatagaagtgagaaaatagatctttggaatctagagtctagagtgaaggctaaaaacctgatatggaattggcatgatcaatccagactacggctaaaatgcaagagaacaggtcaggagttgatcaaagtttcaaaatttgtcacatttggtggaaaaataaaacactaaatgcatgtgcctgtgatgatcaaacggcataatattcttcagaccaaaacatatcctgaaatcttgaacattcaacttctgagctcatttctagctcccgaaagggggttgcaaaatccaatgggattgcatctacagtgaggccgctctctcactgctgacaaaatactctgctttttggcaatggcaatgataaacaagtagatgatgagaactcccgatgctttttgagaatcaagggttgctgatcttgaaaatct

SEQ ID NO: 576 - DNA, 480 bp, Rattus norvegicus
  Genbank Accession No. AA891884
ggtacaagaagcattttccccccagttcccatccaggaagactgaggtctgaaggtggatcctctttctatcccatctcattactggttgagaacagctcctaaaatacaagtcttggaacctttgcgaattggcttgtaaggagtatgtatctgcaacatgtatggcctgcggcttactcaaacatgtctggttacttgtccttctatctagtctccactccttcctgagatgagaggcctgtgttgctggaggaaaagtggctggtagcatttgcctgattcagtgcataaagaaatgtgactgggagccacagccttcaaaaggtgaagctagggttgctgtgtgtggagtcctaggccatcctgggctacatggtttcaggccagttgacacagtgagacccagctttacacaacactttattctgcaagcacaggtatgataaatgggaagattttgaatcctggaactgttgct

SEQ ID NO: 577 - DNA, 497 bp, Rattus norvegicus
  Genbank Accession No. AA891891
aaaaatcaaagaatagaaaaactttacataaaaatatgtcaattttagtgtccacattgttgtccacacagaaaattgaaacatgatatctttttgtcaaactgtagcatatggccacagtggtagccaggccaattcatctggttcaccattacggggatggacacacatacctgtgcctgtggatgacagaactttaaaacgcacatttgcgggtcactcgaacggccccacggtggctccttaatgcagatacagtcaatattgctaatgtgtaaattagtacaggctatggaccagtgttcataaatattctttagcaacaggcttcacaatttaaataattttaactattctgatgattccgatcctcatgagctgcagaccccatgtgctactctggaatatctcccagagtcaacagccccaccacagcagcaggaggcagacccggatagacagcttgtccttggcgaggtgtccgtcaactcagaatc

SEQ ID NO: 578 - DNA, 581 bp, Rattus norvegicus
  Genbank Accession No. AA891902
aaggaattattacagaaaatcaaaatatcaatatttgaaaaatacattccattacacagactccaaagaaacaatgctgctaagcgccatggtcccagctgctgctgccattcccacactgagcaccaccagagcagtctgagagccaaagtgatctatccaaacatgtgcctgcagttttggcccagctgctgctgctgtccttggtaccataaggatgtcatggaacatccagttctacacagctgccaaattggcaagtcagtaagtccagcagtcccagattccctcactgtagaaaaccaatgctgtcagttgtaatagttaatatgttatttattccacagaagaggcaatgatcctccagagaaagtctttaaggcatctacaacatctggggattttatatttagttaactggtcacacactcagtttttcactagattagttctgtagagtgagcatagctcagaggcctttgctgagcggcttcctctgctgggctggcaggggagctctggagcttcaggtggctctagggggctgatcctgaacgaagccagtatctgtgaaggagatt

SEQ ID NO: 579 - DNA, 576 bp, Rattus norvegicus
  Genbank Accession No. AA891914
aaagaacatcccattcaacactggctttattactgggcgggggcaacagatccttggcagtggttgggctgaaagctatgagggttggaaggcctggggctcagctttcaccaggcagagcgggcacactagcaagtgcagcaactaggcgtgtatatatgtcaactccacgtagaaacacagcctcgtgcagtcgttcgttatggtcatgtagtaacacgggtgtgcggttcatgggcgagaagcccagagctgggatccccaccgctcggatataacggctgtcagtggcagcaggaaagatctccggctccagagtgaggttcatttccttgcaggccccgctgaaagctgcccaccaggggtccgtatcatcagtgggtgtcattcgaggctctgtaaacttctgagcaaactcaaaggtgaccccctctcccgcttcctggcaccagctctgcagctgcttctcgaaggccttcatgtctacatctggcgccactcggaagtcaaaacaggcactcatggtaccaggtaccacattataggccacaccaccttcgggcttagtcagattca

SEQ ID NO: 580 - DNA, 561 bp, Rattus norvegicus
  Genbank Accession No. AA891920
aggcagagaagcagcatatttatttgtcaatttccagaaacaggttctctactgagtaagtagaaaaatagaaagtttactacttttaaaaggcaactatgacaaaccagtatataaccaggaaaggggtttctaggagtcgaacatccagtttgcagtgctgctgtgacaacaaaaatgaactagtgttctccacgtcctgagatttgagactggcatttctctgcagagcttggctaaagccaagctgcctttgtcacccccactagctggcccagtcctggaagcggaagcagtcactcgctatcttccacactgtgttactgggtgacgcctgagcagtcaggatgaagttctggttgaagtcccgctgtttgttgccctcaaatttcactgttccacagatgaccacaaggaccgtggtctggcttggcgtagcttcatcatgaacaggctggcagtctaccacgttgatttggaactcactggaaggcaacatctcaaaaaactcactcaaggattcttgtcccgaaacggcatttccattccatactaaagtgg

SEQ ID NO: 581 - DNA, 473 bp, Rattus norvegicus
  Genbank Accession No. AA891928
gacagtatgatcacatgacttacaaggtatcatttataacaaaaatctaacaatttacagctgcacttttgtgcagagtactcaggaaagaaaagtatgtacagtcatttgttttgatgaataccactattcagtcctgcaatactgggaaggcggaatgtatctggcacaaaaagaactcctaagagttacaaactagaaaaacaacacttttaaaaaagatttttacttttctggtagaaatataaaaacttgcttgtgtgggaaaggttaaaataaaaagtccaattgtacaggtggcttgaacacttaaaagttctgtcccttaaaccaacaatcaccagcagcagtgtttacaatctaaatataaataaatgggcagtgccgcccaagtagcagcacagagcaagcaactcacagtgatgctgcagggtgatctcagtgcagaggagggaacctttccagtatcctgc

SEQ ID NO: 582 - DNA, 533 bp, Rattus norvegicus
  Genbank Accession No. AA891933
aatgcaaacaccaaacttctcttcctttggatacagcagagaaattcaaaaaaggaacgaacaagaagcacgtgttggagaaggtgctgtggggagcaccaggggaactgttcacactgagtaacgccttagctgagctgtgctcacagggagaaaggacattataaacacaaagaaatgttacaaaccagacaagcttccctgtggaggagcaagcagtaattcatacttgaacatctgagtaacagtaaaaactggagttaaacagctattgaacttaagggtgtggcagaaaaggcccctcctccattggccccggttggtgaagtgctttgggagtgaggtaaaagatcaagagagaagctgtgtgagggacagtgcagagccaggcccagagaggctgcgagcagagagaaggggccaggcgcagctcgcaaaggctctggtctgactgtcaatggcagaaccggtcagcttctgcagttgggacgtcactgggtggatgtcatgcacctgctttccccacagagtgg

SEQ ID NO: 583 - DNA, 583 bp, Rattus norvegicus
  Genbank Accession No. AA891937
ccggccgccaaacattttttttatttttttttttttttttttgccagtgaacacacacacaggagtttttattttatgcatgtcgtgttttgtctgcaacatatgatgtatcagctgaatgcctggtctcctgggagcccaggaaagggcatcagatcttcacagaccaaagttagagacggttgtgagctgccatgtgggtgctgggactttaacctgggtcctttgccaagaggaagccgtgcttttagccaagtcgtctctgcggtccctcttgggtatctccagcaattcttggccagctctgtccgtctgatccatggtgtgatcccctcattccctccccatgaggagagctgaggacacggaggttcaggcacagtatccctaggctacagccctgccatagtcagtgtcacggggccgggtgacaggtgagggcagtagttctctttattttagaaatgggggtggctgtacatattaaaagtgccacagagtgattcgaacttgaaaacttacagaaagaaatgttccctgtcccccgccccatagtcataccctctgaggtaaggctgcacca

SEQ ID NO: 584 - DNA, 605 bp, Rattus norvegicus
  Genbank Accession No. AA891944
cctataataactgtgatgatttattccatcatagagattaagatcacatgtatgttacatacaatacagaataatgtgtatgatgactatataatacccctgtacatatatttctgtatctgtacatacaaccagcaaagagaaaatctacatctgtgacctaagacacagaattcacaccctgcttctccagccaggctaacagtgagatcacagtcagtttcctgagtgctggggccaggttagagtccctgtaaccaacacatacaaccttagaagagctttaagaaaacacgcttgctttctcacagtcaacctactggagcgggatctgtgctataaacgtgacctcaagaattatttctgaatacccatgtacatcataaggatgggaaacaaagcctctgatttcattgcagacctttcctgtgagtccatggaaccacgttaacaaaagaacgagcaggcagaaggggagtcttagcagaacttggttcacccccaatcccactgccgtgagacttctcagttcaacctatccttacccacaccatataaagtaaacccaccttttacatttaagtgatgctttttcataaagtacc

SEQ ID NO: 585 - DNA, 569 bp, Rattus norvegicus
  Genbank Accession No. AA891949
aagcagaaaaacgtttatttctatcaaattccatacaaatcaatcttcaagcaagataacaaaacaatcaattaatacaatgaatagttaggacagcacatacagaacagactctggattaagcacatacgccaaaatcatcttgaacaccaactgtcactgaaggaaagctgatgtgtcagctcccgggggacttaagccaacattgcattaaagactgccttgaacttggggggatcacagtgaaacgccatcacagctcaacatagtcccccagacatccgttcagctcagaaaacaaaattggcaaattcagtagtacaagttctcataaaactagagaagccttgagccccaccatttcttgcagttcacacaaagcccgggtttcccatttttcttcccttttcccgaatcccagagagaaggtgcagtactcttttcaaaggttttaaacaagagtcttttattgaaagatgttgtgcttcctacaattgtctgtcactagagggagtccatgtggagccgtgggcaatggcttactcacttaacctgtctctcacacccaa

SEQ ID NO: 586 - DNA, 343 bp, Rattus norvegicus
  Genbank Accession No. AA891969
ccatcagcattaatgaatgagaatattttattttaaatggaacatgaagaattaaaatacagcctgaaggtttcaattttgtactgtgaacatcaagacagcaattacccctaagaaaaaaattcacagaaacatgttgaactaactgaacagaaaccagagtgggtatttaagtcattacatttctcatcattgtgaaaacagatgtcctctaacaactccagtctacagacagcacacttcatcataacactacatttaaaacactacaaacgtttacaaagaacatttggatttcacaattgcctatagaatatctttcaatattaaaacaccatgatgc

SEQ ID NO: 587 - DNA, 305 bp, Rattus norvegicus
  Genbank Accession No. AA891978
cagatcctctgaaatggagctatagaccgttgtgagctgctttgtaggtactagaaattgaacccaggtcctctggaagaacagccagccattgctcttaaccaccaagccatctctccaggcccaaattctggtttttgatcatggctgtattactgactccttccaagctaatctcttgtggcagacctgcagcacagcacatatcagccaggtaaggggtctgacttgggttttacagacaagcacaggttagatgagtcatcttacacattacatgtctgtcctgtgagaggttcaagtgt

SEQ ID NO: 588 - DNA, 102 bp, Rattus norvegicus
  Genbank Accession No. AA891998
agcacaacaaaggagcccttatttattatgtgcaaggccctaggttcaacctccatacccccaaagaccaaaaaaattaaacggatgtgtaatgtacaactg

SEQ ID NO: 589 - DNA, 394 bp, Rattus norvegicus
  Genbank Accession No. AA892005
cccagttaaatatcagttttattcagatgcagagcactcagaggcttcccctgcttgttccgtgggacatttaactcctgtcccctcacctctccctagaaccagcttctcagctagacattagaactcgtcctttatgtcaaaatggggctggtcttcaggcttgaagtccaggttggggctgccatcctcgttgaggatcctgcgggccgtgtagccaacaatggggtatttggctttgtacaccttgctgaagatgtcatcgagggcttccagctccttggcagtgagaccagaaatgtcatgagtgaggtctgcaggatccagcgacatcttggccacacctctgctcgagtccttcccggccaaggcgttgtagggggctccacgtcca

SEQ ID NO: 590 - DNA, 443 bp, Rattus norvegicus
  Genbank Accession No. AA892006
caccagttaaatttaagaacctctctcgtctctattaacagataggaagcttcagggaccaggtactttgaggagctttctgagccagtgaaagaaaacaaaatatttcctggaactggtaagcttgctgttttcagagtgtcaacaagcaaacacacacgccacacacgtacctcgtgaaaacaatgccgctctggcccccggccacactgcctgcaggcactgctgcgtgtccttgtcagtgaatgttaatgcagaccactgggagctgaaggcgagggagctccctgagggagtgtaggcagcagccctgccaccagcttctagagatctagatgtgagctgcaatctgcgactccatcttggcctgagcagggctggaaggagcacaacagcacgtaccagtgtatggggaaaagaactgacatggctggctccggctg

SEQ ID NO: 591 - DNA, 476 bp, Rattus norvegicus
  Genbank Accession No. AA892010
gctgggaaatgaatataaattaagggtttattacaaaataaaaagtgttaagtttctccttgtcagtgattcaagaaaacaaagccagaagccttttgtggagccgaagccaggacctctgtgtgcaggctggtggtcaaaagccaggctcatgagcgggcagacagacactgattaacgacctctagcaggtgggtattctccagggcagctgccactcgctccttatctgcaagttgtttgttcactaagtgggaaaagaagggtggaaaaacagggttaaaacaactcggccaggctgctagccccagtatagattatatttctaccgatgaggttctcttctgacgtctcaggactccaagcctggatcaggatatatttactgcctgtgccataactagcttcttcactaggaatacctgtcacggccagggactgctcattccgtctctgtccctgtgtacttgagaact

SEQ ID NO: 592 - DNA, 421 bp, Rattus norvegicus
  Genbank Accession No. AA892014
  misc_feature (1)..(421): n = a or c or g or t
ctctgataaatcaggactaagtttacgagtggtggtgacgcagagaggcatggagagggtgggctgaagtgtcaggggtggggcagtagtgtttcctccctgaccccttcgtcctcttctacaacagactgccacagtccagaataggtgattcctctaccgtgtctgttcaactgaagaaagaaacagtcagttacaacaagacacacaatgggaacacacacacacacacacacacacacacacacacacacacaccaagccggcactcactgtangaggaaatgtcgatctcatcgggcagctcactgatgttgacctcgaaacggtcctgcacgtcattcaagatcttggcatcgttctcgtctgacacaaatgtgatggccaagcccttggtgccaaaccggcccgctctggccac

SEQ ID NO: 593 - DNA, 454 bp, Rattus norvegicus
  Genbank Accession No. AA892036
aacaacttcaactttattaaatatgcaggcctgccaccactgccacttgtctccttcaacatcatccttgtgatctcagctccttcctagggctactaagttgtccctcttcccatctgggtagaacggtcatgcaggcagtgggcaggggcacatctaaaaccaaacattagagtcctctgaaaaggatttgcacttaaataagcaccttgcaaaggatattcaagacgggtcaaagtgaggccaccccttccaaggtacagactgcagtgagctaagctgctctgtgtggggcctcagaaggtaaacaggcagcgtggtctgggatttactgcaagtgcggcatgccctccccagacttgttctggtgggcagcgttcttcacatcttggacatcctcgtggtggacatatgcctgacagaggtaacaccaggtagacaggtcaacacagct

SEQ ID NO: 594 - DNA, 482 bp, Rattus norvegicus
  Genbank Accession No. AA892053
  misc_feature (1)..(482): n = a or c or g or t
gaaaggcctgaacacaaaggcaagctgggacagcagaaagaaggcaggacattcctcagactgctctgattcctagagtaccaggggaggaggaaaaggaaatccagagtgattgccctggcttgccccagactcggggttccatcctaggccaagcaaggcctcagcgggctgcttgctccgcacgcttgggcctcaggcctccaggagcttccctaggaagcggaggtttagaatcttgatctgctggtcttccaggtccattcggatgatgccatcctcaccatcaatactcagaaggaccccggtagcctctcggtcctcacccagaatcactttcaccttgttgttcttggtgggggtgatgggctccagatgctcactggagatactgnacaacttctcactatctttcaggtacacggagcacatgcctcccgtgacactgcggatgacgcctgtctgccccactatttgtgtgt

SEQ ID NO: 595 - DNA, 495 bp, Rattus norvegicus
  Genbank Accession No. AA892066
tgtcaagttacaatagttaggaatgtgaaaatacatcacccattaatgctaccacaatgaaacacacaaacacggaacagacacagctacagaggtgagacgggtgccacacccacaggtgcctaggctaggtccctttgcctgttacctttgagacccatccaggcagaccatctttccttcctcccaccctcacagggattcccctcagcttttccttcaccacacctcctgggctggccccctgaaagggaaggcccccgacacctgctggggccctccagtccctctgtcccttaccagggacagagctatatgccacatcttcaatctgaaacagttggctgtgggcaagcagggttagtgtgcaggaagatgagtctccccagcactggtttgtgaagtgagggcagcatgcacctacttcataaacgttgatgagcttctacatggtgtggtctgtttcagagctgggaggggggggggtgccggttt

SEQ ID NO: 596 - DNA, 489 bp, Rattus norvegicus
  Genbank Accession No. AA892083
gaaaagtatataacagaatttcttctttatttacagtcaagttctgttgggacacataattaaataaataaaagatgtgccctggccagccactctcaactcccaacaccactagctctctggcagcgaatgacaggtgagttgcaagcagggaaggactgctgtccctcttccctagttctagaactcatgtctgttcctactgtccagagagccagcgcggaagcaaaaaataaagtgcaaagtaaatgtgacaaacgtggtgctttggacacccagacaccgtgctcagaccgtgtgcatgggtaagcaggacagagggtgctttcccagccttcagcatgaccagctcccagataggcttctcttaccaacactacactgcatacacaggcagtggctggactccccaacaccagctccagatgagcgctaagctactgctgtgactggcagtgatgctgggtaaagatgtgtttctcatttcag

SEQ ID NO: 597 - DNA, 490 bp, Rattus norvegicus
  Genbank Accession No. AA892086
  misc_feature (1)..(490): n = a or c or g or t
agaacagaagtaagttttaattcattgaaaagtgcagcagtgaacagggtccgttgaagggcactttctaagtgagcggctgagatgacaggtccagggcagaggagcctctacaacaggtgatgctaataaaagaatttacaaagtccattgagcggaaagtgctggtgagctaaagaaccccaggacacccatttgtcccggtggtgatcagctgatactccttgctttttcttgagggttctgggctgccatctttcattagaaaaaaataagataaagacgctcctaggtttgagaacacttcccacagacagaggtgtaacttccatagccactcctactattttgatacaaaaccctggcgctggcaagtcgaaaggtgtntgtgacagtaccgcttgctgaactcagactctaacgtgtaccccaccttgaaactgtgtctgcagggcagttttagaactgggatgcgtaaggtgcgtctgca

SEQ ID NO: 598 - DNA, 404 bp, Rattus norvegicus
  Genbank Accession No. AA892094
actgtaagaatataaacgttttaagaggatctttgttatcatttatacaaattcacaaacagtacaattaattgataaaggtctctgggtttctccatggtctctcatgttgctgtggaggactctaaaaaaataaacaaacaaaatatccaacaaaaatatacatcctactcaaaagccatttgttttaaagccacagtcccaaccccccaccaaaataaagtcatctattcctccatttagaaacaaaagtttttcaaactcacacgttcctcccatttcatgaacagaacacagataagacatgaagttcagtctcctccctttcacatagcctcgggctctctgcagactctgagctcctagacagggctggaagcctcactgtaaccttctggtgggaa

SEQ ID NO: 599 - DNA, 433 bp, Rattus norvegicus
  Genbank Accession No. AA892112
cagggctaaggacctttattgagcacacggcccctgatggtgctgacggagaaaccttaggctttccttcccagcagcctccgccacagttcttggctgagtagtgcctgctccctccgggcgccctgcagcacactcctgttctcctgggctcttcggatcaggtaggatatcacctcttccaggcagccataggggatagacttatataccatgtatccagcttgccctaatgccagggagacgtggtcacacatgcccagaagttgtccgaagcagacaggcccatccagaggaatgcccagctcccacatgctgcagaaagggtcacattgtcaatccagagagtggctacagcgcctcgttgcctggcgaatggattcttcattgtgggaagccacatgaggtggcaccggggaccgtggttggacac

SEQ ID NO: 600 - DNA, 528 bp, Rattus norvegicus
  Genbank Accession No. AA892127
aatgtaaacaaggaatttattcaactgattaccagacaacgaaatgctaaggagtacaacaggcatttataacttaaataatttatcaccgacttcagtgaagtcaaattcttcaactgtatcagagttcaatatcggaaacaaaaaggataattacaaaatatctgggtcaaggaatcttctccgctgtaaacacttgagaagcttgtttcctggcagctctctcctctggggacaggataccctccactgctactatctggtactgcttatgcttcagatttcccacacatttccggagctgcctgagactaccagcctccatgtcttgctttaacagcttctgcatttctcgagaaggacatccaggatcaaatattagcaaacataatgttcgtttttttctctcttcaatcccaacaactgttcgactgtgaccctgatgctggagatagacaggaggtttggatgtacacacgacctttggcgccccttccgtctctgaggaaatatagttcagtatccact

SEQ ID NO: 601 - DNA, 443 bp, Rattus norvegicus
  Genbank Accession No. AA892128
  misc_feature (1)..(443): n = a or c or g or t
agacataattaatgttacagtaaaaataggcatttactcatatttgtcttgttttagccactttaatttctttcatctcccctccccctaaggttttctcaaagcacattatcattttacaaatacagtgccaaggtcctgagtccactttgcaagaatcttcttcacattcacggaaagcagttacttagtgcagagttctcatttccacttaactgtacacggctttatcggtgctgagacactggcccacctgctggccagtgtctcccacttcacacacctaaaccaagctcaagacaggaaggctgagccgtgaagagcatcnccacancctctccactggcccgatagctctttcccgcccctcccagttgtcctgagaaaaatcagatttgtcacagaaaactgacattcctacattcataggcagaagaatttta

SEQ ID NO: 602 - DNA, 439 bp, Rattus norvegicus
  Genbank Accession No. AA892146
acagctattaggtgctgtccacttttctgcacagaccctgaaccatgcatcaacttattttctctgcaacttacaataactctctcagtgacttagcttaacccttcaagtttctgtaactttctcttcatatcttttctttatcttagccagattggtggggcattttccagcccctaggagacccacccttggagcctgggggcagacctggagcactccctaccttcaggggtatgaagagagcaggcagaagtgagggccttctatgcgtgttggaaccctttttttttctggcctctagtaggattccgtctttcctcggtggtaaagaagacctgtaacagttactaacaagcatatcaaatgggatggtgagaaaacaagagaatcttgagaatagagtctaccgaagagggcatacagcatttagtcacac

SEQ ID NO: 603 - DNA, 486 bp, Rattus norvegicus
  Genbank Accession No. AA892149
gaagacatttccagtaagtgtttgaagccttggcttagtacccatccgtcctagtcaccagagttctcgagcacaatcccattgcctgcaatggtatttatcaaaactaaaaatgctagaacactgcctgtgccaacactgcacccagtcgtccatatcaaatactccatcagctggaagaccaaaggcaaatgctgcacacagagtccaaacaacattcttcacagaagaaaacagtgagacaaatttctacaacatgtcacctgccaattcctcaatattattactgcaattatctctaggatagtaaaattaggctccacaacctgtggttgctcgactttttaaaaaaaaacctaagttctaaaaggtataaacaggtatacacagagacttgtttataaacttttgatatttgatatctgtatgtcatgatgacgacatggagacaggacacatggcacgaagtccatagtgggtatgcgc

SEQ ID NO: 604 - DNA, 386 bp, Rattus norvegicus
  Genbank Accession No. AA892154
gaggtataaaaatctgtatttatattacaatgacataatgacacagcacagccccatctgttagacaggtgggatggggtcccattccagtctgcagctcaggtctcataactcacccactgcactggcaccaggccccttgtgtagccccagactctggcacggaacctgccctagaacagcaagctcaaccacctgcaggttagaaatacagaggcagacctagggcccatatggagacaaaacctccgtgtcctctcctgctagacaagctgggtctgcagcaggatggtgggtctggtacatctggaccacctcctacgaaagaggcccaagcctgagcctggagttgcagactctgttatggagcacacgtggctcacatg

SEQ ID NO: 605 - DNA, 632 bp, Rattus norvegicus
  Genbank Accession No. AA892234
cggccgccaaaatttttttttttttttttttttttttttttaggtacgaggctgacgccagataagtttttattatatttaaaaaacagtggagctggaagtaagggcgggtcgttgaaggcgactgagaggtgaaaggcctcccgttcctcagtggcaggatctggacccactgcctaggccgggtttaatccagccgagatgctggaaagcagagcacacagttgtgcccatcagggcaaagagggcaagagagctcacagctcctcgataccgcttgctagggtctcccgtgtagtagccatatgcgtaaagaactcgcccaataatccacgccacgcccaggccagaagctatgcgcgggtggtaaacacctcccacggttaggaagaataggaagggagggtacacctccaacgtgttctggtgggcgcgctgaatgcagttgaacatatgcccattctcaggatctgtgctgtacatgacagggtactctaccttgtacttcttgcgggctttgcccacgttgatggctaagtggagcaccatcacaaagctggcggcaccagtgagaagcacgaatccatattccttagagaggacagccatcttggctctggctcaccttgacg

SEQ ID NO: 606 - DNA, 630 bp, Rattus norvegicus
  Genbank Accession No. AA892240
gccactttctgacccgactttattaagggatctctttcctctcctctcctatctagtgcttgggggtagatgggggcacaaagaagagggatggagaagggtgggaaaaagaaccccagcaccaggtctcatgcctgcacgccaaaagtttagccatggagtcatctgattccagtggactttgaaggttgttaccccaaaatttcggatcctggtgatcaattctgacctcttctgaagaacatggttggtggagtttgttaccttttgttccactttcggaatgtcctcactgcctgttcattacgtctgtccgtttcagtttgtacttcagcaatgggtcaattgcttcttgctcttctttttctccttcccaggccggagaggcacacttgtcctccagcttcagtgtagcaaagggtctgggattcttgaccggaggcagatcccagatcactgtccttcccagagcctccttcatccactgattccaacatggaaaccaatgtcatttatgttgtcgttggagccgtctctgctgtggccattattggagctgtgattattggagctgtggtggctgctaagaatccaggtaggaaagaggacgtctgggtgccctgtcagaag

SEQ ID NO: 607 - DNA, 627 bp, Rattus norvegicus
  Genbank Accession No. AA892246
aagcattcagacactttgaggtgggaaagatgatacgcaggttgtactacaagattcaatggaagatgtcagacaggacatctggtacagacgcagcagcacaacccaacacaggttagatgagagcgcttcatccggaagaaacttaaaagaataatttaaagctctgtgagacaagatatgttccaattgaaaacactaagaaacagtaccattgatggaaaaaggaaaacttctatgtgtaccaaaaggggcgcagggtgaacgagagggaaatttgcgtctgttgaggtacaaatgggagtgttccacgaggggggggataattattattaatgacagaccctgtaaatacaaaataaaatccaaatcactggtcacgaacttcaaatttacacgtaataaaggcaaggcaataagactcgagttctggcctgtcaaatatttactccacagacattatctacagaagcacttggccaacgtgtacacagtgatccttatgcacgccaaaagggtttcggtaaaaatgacgctatatacaatctgtacaccgatccaccagagcgactctccgtctcccgggggaagagctatcaatacaaagagatacctgaggttgcgtct

SEQ ID NO: 608 - DNA, 587 bp, Rattus norvegicus
  Genbank Accession No. AA892248
agggtttgctgaaaatggcggtatataggctgaattatcgagaaggggtaaggtagaacggggtttatcgattatagaacaggctcctctaaatggatataaagtaccgccaagtcctttgagttttaagctgtagctagtagttctctggcaaataattttgtaggtttaattattaaggtttagggctaagcatagtggggtatctaatcccagtttgggtcttagctatcgtgcattatataaatgattagaattactttcgttattgggcttaagtcctaacaatgaattttcacatataacttggattttaattctattatgacatttatagttggcacgttttacgccgaaaataattagtttgggttaatcgtatgaccgcggtggctggcacgaaatttaccaaccctgacaggtatagcttagtcaaactttcgttcagtgcctaatatttatcactgctgagtcccgtgggggtgtggctaagcaaggcgtcttgagctatattatgtgcttgatgccctctccttaagttttacgcaaatgtttaagggattttacaccggtttatggatgtttgc

SEQ ID NO: 609 - DNA, 644 bp, Rattus norvegicus
  Genbank Accession No. AA892250
aaagagagaaatggtttatttggtaacaaggaataaaaagaaattctttaattcttctctcttgtggtggttggactgcagtgtccagtgggcgggcaccacacaggaacccctccctccctcagaccagatctgctgctcaagcgcaaaggccatagttgcatagtcttctagacagaggggctggcctctgtgctttctggggtctcggtggctgttgcagtttccttcttgtcttcaggcttcatggcaggaaagagaagtacttccttgatattgttggagtctgtgagaaacatggtgactcggtcgatacccatgccccagccagctgttgggggcagcccgtactccagggcagtacagaagttctcatctatgaacatggcctcatcgtcaccagcagccttggccttggcctgttcttcaaacagttgtctctgccgcacggggtcgttcagctcagtgtacgcattgcatatttccttcttcatgacaaacagctcgaagcgctcagttagaccctctttgcaacggtgccatttggccagaggactcatgatctgtgggtgatcacagatgaatgtaaggctgatgcatgtcacttcgaggaactctcccacaagcttatcaaggagcctggc

SEQ ID NO: 610 - DNA, 529 bp, Rattus norvegicus
  Genbank Accession No. AA892273
  misc_feature (1)..(529): n = a or c or g or t
caaacattcaagaacagttcatttctatgtgatgtaaactcttccataaagtaagacaagaggcaacagtcccccgctcagaggtacgcagaccaaaaggaccattcaggaccatcttagaaacctctttagaaatcttactaaaaacaaaggcactcatatacaagaatgttcatagcagcattgtgtataagaacagaaacctgcaaacagcccaaatgttattcagcaggtgagtggctacctaagttgttttgtctgcttggtggagtattatacagatggaaatgaacaagttatagcaatcacaacgtacaggagtcttacaaacaatggttaagtgcaaaaaagcaaacctcaaggaacagagtacaacatttttgtaaagctaaaagtacaagcaatacannataatacattcctaaaggatatatacacacatgggcaatattattataacaagtgattaatgagcataaaattaaagacagtggctacctctaggaagaggctgggcaaggggacaaaa

SEQ ID NO: 611 - DNA, 605 bp, Rattus norvegicus
  Genbank Accession No. AA892280
acacttacgctttattggagtgtaaaatctataccatgtgctccttcacaacgaaggccccttgaagaaccacaccagacacatgtaaagacatgaaacaacgcttagtaggctccggtcccacatgagatgtcatcatgatgtcgggactaagagtataatggggcctggtcagtggctcagtttctgattttgttgagaaatgtaggtttggaggttgtgaaagatgaggatgaactcatgtgcctgagccctggggaggtctgactcacctttgggctctactggcaaatatggcgtccttccccacaaagagggcagagagtttgactaggtgtaggactaagcagacaggaagtttgtgtaagaaatatcagggtgaatgggggcgagggactgtgggatgtgatggctggagggatcttgtgggagatctcttcaaatagtaaatgtatgactattaggaaaaaaagtattgcaaagatataactgttttgctggtggtaatgagtacataccccagtgtttcaacccaacactctgtgtgtggctctatccttctgtccttccttaattagcccaggtcatggtgaaacttttttttt

SEQ ID NO: 612 - DNA, 572 bp, Rattus norvegicus
  Genbank Accession No. AA892284
ggaaattttagtcaaaaatcaagcaactaggaaaaatcaaggcaatttattgtaaatgacagttgatttgaataaggcacattcaacatcatcaatatggaaacaaatgcaaaaaagcagttatggtgacttgaaaagtctgacaagccgttaaatttgtgaatacatcaaggcaggattcttggggctaagaaatccttgatagagaatgtaagcgtgttgctggacatcgttttgctgcatttctctcgtgttcacatctgtctgccatacccagcatctgtgctcacagtgctccggccttaaacgagaatgtgaaccaaaggccttgagacaaagctgtcccctccatcagccagcactgttagggtgggccgacaggaagggcactgatcctcactaccctcccccaagcctccgaacttccagataaaatttgttcaaattagttcagggataagaactctctagaacttctctgatgatctctgagaactacctaaaagaaccctaagaaccctaaattttacctgaaagggaaagcgagactcaagtctaaagacagtttctat

SEQ ID NO: 613 - DNA, 601 bp, Rattus norvegicus
  Genbank Accession No. AA892298
cagtcttagtggcacaggctttaatcccagcacttgggaggaggaggcaaaggcaggcagatatatgtgagttcaagcccatcctgatttatgttgtgagttccaggtcagctggggctccatagtgagaccctgttttccgaacactgtatatttcatgtccaagtgtggctgcttgccataggtgatgaagaactgagatccgttggtgtttgggccattattagccatagatacaacacctcgaacattgtgcttcagatattcactgtattcatcctcaaacttcttgccccagatactgctgcctcctcttccagtacctgttggatctcctgtttgaaccatgaagcccttgatatttctatggaacacacagccattgtagtaattactggcacacagagccaagaaattctcacaggttttgggtgttctctcacagaagacttctatcttgatatctcccacatctgtatgcagtgtcacagacattctccttcttgatgcttctagggagcactatttactttttcaaagctcctcgctcagcaccgctgctgcggtaacaaaaatgtctcattcacaggtgccggcatgc

SEQ ID NO: 614 - DNA, 579 bp, Rattus norvegicus
  Genbank Accession No. AA892303
aagtttagtttttggctattttaattgtaaaaaccaagatgtttatataaataagaccgctgtgtaaaatatgattcacccttctactaaaacccttcttcccgcactcaaaaagaatctagaaaagccagcaaggtaagaagtacaaattgcatgcggtccctgatgaagtccctggcaggccaggtttccctgctaacggggcctcacggtgagatcactcctggcccaagggtctcaccggagctcggcaacacttttgagaagtcgctctacaccaagggcctagctctcagccatgcagctgatctggtggaggtggtgtgaaaagttcatgtggcccgggctgggagaaggggacaggaagactgggtgatcctcgtgccaaagccagggctgtgaactgctggtccggtaagatgtggaggactgttcggtcccaggtcaggctgggggaggggaaagggaactccttccgcaatgacaaggagagacttgccctgtgtcgcacgagagaggagcttcgttttcagctcactccacatggtctctaacaacgagggcaagagacacttccca

SEQ ID NO: 615 - DNA, 529 bp, Rattus norvegicus
  Genbank Accession No. AA892308
gggggttgtggacaaaaagtaaaatcaacaattatggaaagtgtattttgtcttaagccgtacaaatcttcacagatgattagaatggaggaaggctaggtggcctttgagaagaggaggctctagctcagtgagcagagagctctgccctccaacagccaccaccttgccactaccctctgtgacaagcagtctgtcactgcctggagaagcttgtccaaggtattaaatcaatggtccctggggactggagctaaagccacataaagatgtggccttaatctcaagccgcaaacaagaatgtgtcccactgctctgatgccaatcagcaccacagcttctgggggcccaacttcctgtattcagtagacggagctaaggcagaccccagtttttctggccataaagagcctgccactgttgagtcctgctgtggtatagtgctccatggctgcccgcagctcagttatctaatggtgactaaaaatggaaccggaggcggggtcagagcacatacgtcagctgtcag

SEQ ID NO: 616 - DNA, 454 bp, Rattus norvegicus
  Genbank Accession No. AA892310
gaaaggacagcctggctttaatcaagtctcagaaagcctggtttcagcagatgcgccaaccaggtgtcaaacagtccagccttctgccttctgcagcagggctaggttacttggtccagctgactttggggatgtcatagtgctcggtgagtgtgtccaggtgtcggttgaagtcctccactctctgtttgtgggtttttgatgccttcttcaggattctttccatttgccgcttctcctgcatcttttcgaaggccgcctgcgccggcgtgcgcttgtccaggcagcgcctcttctcctcctcgttcttcttgctcgtccccatggcctccagcatcttggccttgtctttgtccttcttcttcttcttccgcttcgtcacgccgagctccgccacgcctttcagcttcagggggcccttctggacctgctcgtatgcctccatatccctcac

SEQ ID NO: 617 - DNA, 591 bp, Rattus norvegicus
  Genbank Accession No. AA892313
agtaatcaaagcctttattattctattaataaacaaccgaatggtcttttcccaacaaaacaacatcatttgtgagggcagaggttctgtttctggtgtacacattccagccttaactctcacggttggcctgctaccagcgcaccagtaggcagtctccattctccacagaataaaactgtaatggctgcaggtcattttctagttcgatttctctgcccggcatcttggaactttcgtaggacaacagaagttctgacacaggaaccttgagaagacgtgacagcagtccctttaccttttgaattgtcatggagtctggcaactgcttttctaatatttgttgttcaggttgatttgagcattttatcttcagtgttagtagctgattttttagcatgaatggctgctgtgttttgagctcctcatcttcaggtgcaccatatttacctggacgtactgcagcagagaagctggtatcttggatgggccgagagaaactctgcacttggcctgtttctgtctggatctgggtgtccaccagcctttctccattcttttccaaaggcttttcgataatcaagctcagca

SEQ ID NO: 618 - DNA, 541 bp, Rattus norvegicus
  Genbank Accession No. AA892318
gaacaagatcatttaatagtgaccctctgctgtccacttcggtgcctaggccacccactgcacccaagaggatgctgggccgtaggaaaggccgctggacatcagtctccaaactaccaacagcagttcacagagctgggatggcagtgccctccctcagggaagcaggcctgctcgcatctggaaggccaggccgtcccctcgggtggcttgctgaggaaagaaacaggttggaagcatgagaaactaagtgtagacacaatgagggcagagcataggcagagtggtaccaccaaccttgttgatctctctgtgtcgttctttggttacgatctcctctaaaacctcaccgtctcccttgatgagccttgtacggccggtctctgggtccaccacctttcgaataacgctctgtcgagcgtcccactcctcctttgtcatgggcttcatggcctggatacgagacttctgctcgtctgtcaggactgggccatcattgtcctccccagctgatctgtgccactgatccagagaggggccg

SEQ ID NO: 619 - DNA, 605 bp, Rattus norvegicus
  Genbank Accession No. AA892335
ctctgatatgaaaattcagaaaggatttcatgtccctgcaaagtctggcctccgagaaggagcagacacttctacacttgatcttagccaaaaagccgagaagcgatggagcagacacttctaagccaatgagtcagatttatgactatgatccaagaagggatatggcgaactccaaaggccatctttagaacatgtgtatgataagaaggcccccaacccctcttttggctaatgatgactctaacgactgctgactcaggaattcagttactgctcaactggaatactgtcaacatttttctactcctaaaaggaatgtgcctaaagttcaaattagaaccttttttttgcagagagaagaaaaagctgaggattcctgggggattacaatcacttcaggaaagatgtagcagttgtcccaacattgaacgagttgtgttacatttagagtcagtatgcagtaatgacagggtgagtgtcggaggtcggggggacggtctgaagaaaagagcttctgtttcaacaagacagttacaaataacgtattaccacaagccactctctaaagtccgttccagccatagtgtttgatgactgttggg

SEQ ID NO: 620 - DNA, 466 bp, Rattus norvegicus
  Genbank Accession No. AA892346
gatacacagacaattcagtgtgacccacaccatcttagtccacccactatgtctttttgccacagtaactaacacatgctgtcaaactgggtcaggagtccaactcagggtcaagtttctccactttgatgactacgtctgagtctagggcagcagcatcttggtgagcctctgtctccgactctgacaacacctcttccttgatcttcacaggcttcccggcagcctcctcgtcatcatctgaagactcgtcaagctcccattcatcatcgatgtccatttcaaacaccctcacgtgccggaggtttgaacttaacacacaggacactttccgaaggccattcccagcaacatactgtgccttcatgctttccagcagcctccagtgcttctcagagtgcatggtgcgtgtgggaataatgctgccctgctcgtcaagcctggtggagcaagtcccagtgaactc

SEQ ID NO: 621 - DNA, 662 bp, Rattus norvegicus
  Genbank Accession No. AA892367
gatgagaccccaccagctgcacaaagtactcctggcatcaggcaccttcctccttggcaatgcgatctttcttgagcggtcccatgaatgctttcttttcctccatggtctggaagcgaccatgtccgaatttggaggtggtgtcaatgaacttcaggtcaatcttctcaagagcccgacgcttggtctggaccagcaaggacttccggagagtaagcactcgcttcttggttcccaccacacagcctttgagcatgatgaagtcattggtcacctcaccataatggacaaagccacccagtgggttgatgctcttgtcagacaggtcgtagtcagtagatgcattgttcttgatcagcttaccatccttgatgaggtagccttgaccaatcttgtaaatcttcttgttgatctctgttcggtgatggtagcctttctgcccagctcgagccacagagaaggctacacgggcaggatgccaagctccaatacaagcaactttgcgcagacctctgtgggtctttcggggcagcttctttgtatgccaacgactggtcacccctttgtagcctttgccctttgtcacgccgatgacgtcaatcatctcatcttggccaaacacctggttcacagggacctgctgctccagcctctctcgggcc

SEQ ID NO: 622 - DNA, 624 bp, Rattus norvegicus
  Genbank Accession No. AA892376
  misc_feature (1)..(624): n = a or c or g or t
gttttccttttggtttaatcaaagactggtgaataaacataaataccgcacaatgaccagatcattcttcatactgtgcacacacagaccaatgaacagtaatcgcaaagaaacttgcagtcagcagtgaaatgcactcagcttttctttcccttgtttaaaaaaaaaaggaaccgaaagccacaaatttagaatctcgtcagcacatattctgctgtgacaaatgattcaaacataaatagtggatgtaaagaaactatatgctaacatatgtataacctttgttaatgaaaaaccaaacaaacagaagcagccgtaatgattaagatacattcagttactgataactagttgtacccagaagggccttatcaaaagggaatcgtgctgcagagaaaagctatatatacatacacaatgagaaataaactgcaagatcaacgcatgcatgtttaatactggaaaaaaatcacagccctccagaatttctccacatttgttataaaagccctctgcactcaactaaaattaaaatgatcttaaaagtataatacttcttttcagccacagaaactgcaatggaaataaatgttcagagtcattttcaaaacanaaacaaaaatc

SEQ ID NO: 623 - DNA, 609 bp, Rattus norvegicus
  Genbank Accession No. AA892394
caaacagtttaatagcaaataaacaaaggaaggtaccacacttggcagatacaaaatgactttttgtccgtgtgtctgtgcaattaaaacagatttaggttccccattgggacaaaagggaaaacacacaaaaagggagagtccttttaaacacacactcccttgctccaaacttttaacaacttttccttttttaatccactacacaaactgtgattaggtaagaaaagcgacaagggctcttcttgccctttttttttttttaaaaaccattaaagcaaaatccataattttctacagagtacaacacaagttcacacacaaaagacatcttttataaatcaaacaggaaaaaaggaaagctcaaacaaggtcaagaagaaagcatctctacggctgaatcacgactttgagttgattgaatcccgttgctgctgcagaacagactgtgcgtttggtcatagtggcaattttttctcttcacattgtgaaatcactttacattgttttctagtagaaaaggcaaaaaactgtacaaaacccctagtgttaaatacaacgtttgtaccaataaaaaactcacacaggtttgtctccaaaatgtaaagt

SEQ ID NO: 624 - DNA, 591 bp, Rattus norvegicus
  Genbank Accession No. AA892395
  misc_feature (1)..(591): n = a or c or g or t
gcggctgtgcctcttctctaaccaacccccggtaagtatgtttgttaaaatgcccttctccatccttcccttccgagctgctttgctcagtagtggctgtatgcatggaagactgaccttccatgtaaagcccgttcttctcttggatggatgttctggaacacggggaactggaggtgttcggagactactgggtgacgtgctcatactcgcacttcaacagctgattctgcttttctcctgtgtttatgattcgcatatgtggtgttttcaaaagttcaatcaaatgtgatctaatttccagggctgactgaagcctttcaggtctccaaccaaaatatttaggacaactggagcctggctggtaggtgacggtatctagtaggtgtaggaggctttgaagagtgactgcgtacaatcagcgcctgacgagcccgtgtgaacatactgtccttgggctgcctggcagttggccacagcccgcttcatgaaagcttcctgngttgccttcttgtttgcagccttgccgccccaagcagccaatgcactggcctggagggctctgccgtatgaaaagcttagcctcgtgcc

SEQ ID NO: 625 - DNA, 224 bp, Rattus norvegicus
  Genbank Accession No. AA892396
  misc_feature (1)..(224): n = a or c or g or t
gctatattaagcttaatggaaaaccacatactttttagaaacgaatcgcactaagtacagttataaatctgcagtaccgttgaaaggccacaagcccaaatgtcctgtctcaacgaccctcccatgcagcattcgctacagcctgctcaacggggcttgtccccaggccaggatggtcagtcacatggaaggccctctcctgaatggccctgtanagcgtgatg

SEQ ID NO: 626 - DNA, 371 bp, Rattus norvegicus
  Genbank Accession No. AA892399
gaaagaaaattcaacggcttggtttattttaaaataataactttcatataggagaatactagccaaattcaatactgatataaatataaacttcttaggtcaaaatatggtcaggtgaattttctgaatctcataaaagacagttttcaaaccatacaaaatatttagaaacaatatacagcaaaaacataccacaatttaaactaaataagctatgaaaaatagcccaatctttgttatgatttagaacatctattttcaataacttaaaatattatctatacttcccatctctaaattctcctgggaagaaccactagtctagatttaaataatccaaatatttactcatggtaagagagactctggca

SEQ ID NO: 627 - DNA, 482 bp, Rattus norvegicus
  Genbank Accession No. AA892417
  misc_feature (1)..(482): n = a or c or g or t
ccattaaaaaaccaaaaacatcactttattatgaatccaagaacactgtataaaaaacctccagtcgtagaaatgaacagacagcacgtttatatacagacactgtacatgtgggccctgccctttaagctaaactccacagactatacacatgggcactgcccttacagctatactccaaaaccaggctgctatagtcctcctgctggcacagcttcagggaatgctgccccagggaaggggaggatgcagtcagtgccgggctacaaaactctctggcagcccagcaggtggaaatcttgcagagatgctgggtcagcccaagctgtctctcttgtacctggcttccccgcaggaagctgtctcaagcttttcctttggtcagttcatctgcaaattatggcttccttggggaaggacatttttnacaagttcagtgtccaactgcatggnctcaggctctttcagcgcatctcccagtg

SEQ ID NO: 628 - DNA, 460 bp, Rattus norvegicus
  Genbank Accession No. AA892422
gacaaaggacgtttattcaggctcgatcctgtggcacagcatatgtacagaagtcaggaaactataaatcgggttgccatggagtcctttggctcagcttcctcggtgggcccccttctcagtctctcacttcagagtgtagaaggttggggtcactttttggcagcttctgcctgagctgccaaatccgcctctttctgagcagccaaaaccacggcccgttccttctgaaaagctgccagttcgtctacactgaggtccttcaccacacgaatgcccagggagcgggcagagccaatgatggaacggacaatagaagacaggggtacatcttgcatggcaaaagcctcatccttagctttgacacgggcaatctcgtatacgtgcttcaaactcaacagacctgccacctctttccctgtttgccgggcccccttctcaatcccagcagctgccttca

SEQ ID NO: 629 - DNA, 513 bp, Rattus norvegicus
  Genbank Accession No. AA892446
  misc_feature (1)..(513): n = a or c or g or t
gaaggtgaaagaatgcactttttagtagatatgagtgtgagactcttgtctcgttattgctggtgtgcttctcggtctctggcagcagtgtaattatctgcgcatgcctgacctacagtcaggcggtagaggggccaagcatctccgctccgggcagcagtactggttgtgcgtctttgactccacattagcgtgctccttcagtgttgccttcctcctgccttctgtttattccacgcatctcagcagaggaaacagcagcgctgctcctaaattcactctaagccactgacaggaagaatttgggctgtgctataaagtttccaatacaatgtatgcatgaattataaaccagagacgggagagatggccaagtggttaagagtgcttcttgcagcagatccaagttcaggtcncagggcccacatcagaatcacctgtaattctagttgcaggggatcagnatacctcttctggttccgtgtgtgcaggaatgtgggcaaagtcctcgtg

SEQ ID NO: 630 - DNA, 395 bp, Rattus norvegicus
  Genbank Accession No. AA892462
tgcctgacattagactctcccgacatgcaagtgttgggagctcaaaggattcttgagctgggaaatcctcaagggagatgacgtatagggagccaggcgtccaaggcgtacgaacaaggtttaatgctgcacccgtcaaggcaggagctccccagatcgatgcagacttcttcctccgtgtcctccacaggactaagctgtttctgaggcctcagcgcatgctaccatcgaggcctgtggtgggggagggggctgcctaatcgtccttcttaaacttgccattgatgtacggcacccagtccaggatcagccgccagtccgtgacccacaccagtcccacggcacccacagtgccccacatgccggatgtggggatccagtttttgggcagttct

SEQ ID NO: 631 - DNA, 470 bp, Rattus norvegicus
  Genbank Accession No. AA892470
aaaacacaagggagagacctggccagtcaacacatgactgaccacagggaaaggagtttatcaaacttcgagagtctaaaaacatacaaatgtgtcttctgtctacagcaattgtctatgctttcccacacaccgactggtaccctctgcccagtcacacacagtgaggacagcaggtcagtgactcacgtcctaagcagttttctgctgccccttctttccgatcagagacttgtggatgtgcggaatcacaccgcccccggctatggtagccttgatcagtgaatccaactcttcgtcacctcggattgcaagctgtaagtgacgtggggtgatgcgctttactttgagatctttagaagcattacctgccaactccaacacctcagctgtgaggtactccagaattgcagcactgtacacagcagcagtggcgcccacccgtccatggcttgtggtgcgagtcttca

SEQ ID NO: 632 - DNA, 540 bp, Rattus norvegicus
  Genbank Accession No. AA892485
gtcaaatgacaaccttttatttttctttcaagagaacaaaagagcattagcaaagaatgagtcatttttcaaatatttcacatttgatcagatttggctcatgctaatgatgtgcccctgtgataagcatgttctttctgtggttttcagtactagaatatctccgtgctgaagcggcaggccactgaatgggcctgtctgtacagaaacatggccattggaggtttgcgaactatttggagtgtcacttgtgcaccacatgataacgaacatttagaaacagattcaacaccaatgaaacacttcaaatttcagggagtggcccccccatattacacacaaggtgaaggctatttaaagtcacaaataatcccaaacatttatgaaaacatatcaacaggaagtctgctcccaatttatttttaccatcctgcatgtcagccctacgtccctctaacacaaaggtcaaacatgataaaacgaaagagcgttcaggacaggaatgagacacctatctaaggtttctgtccactgggggtc

SEQ ID NO: 633 - DNA, 555 bp, Rattus norvegicus
  Genbank Accession No. AA892486
aaaattaagtacacttcacagtaagtttctcaagtctcagtggctgtgcagcctgatgttggtgcagacacgacgtccccacgccgagctccacattctctagtgggaggcgagggacagacagctggggtagggcaggcgaggcaagcctcactctcctcctaaccacacagagcttcaggggcgcatgcagcaacacaatgggaaagctcaaaggtgtgtcaggagagcaggacgcaggtcctcacaggagccaccagccagagcgagctcaaactcgcatggcctctaggggggcctctgtaaagtctcctaggaccaatcgatttgaaaccgctctcccatcagcagtgagacagggatggacaggctcttgtcgtccgggctgtaggtgaaattggagacagagatgccattggaaaggacctgggtgggagctgtggtcactcccaagatggtcacctccctcagttgcagttcacctccctccttggtcacgtgcactaacttgtttacaatggtattattcttggctgagaaggtgaccagtgtgta

SEQ ID NO: 634 - DNA, 590 bp, Rattus norvegicus
  Genbank Accession No. AA892500
accctaaaaacactgtcagctttatttaaccttgatatacatttgtacaagcaatttaaaaagactattccacaacgactcagtgggttttacctggtttgaagataatgcagttacaaatgagaggtagaaacaccgtagtaaagacctaaaaatacaaacatcctatacataaacgttcaaattaactgctagaatttcatacagataaataatgtaaaaattacattactttgttcaccaagtaaatgaaaaccattttctctgttaactttaatcagcacactaaagtaagtgtggtgccaaagagcttctgtgcagctatcagagcgcaggtcattatgtcaaagttttgaagtaaaaagattaaaaccggtgaatggtttattcaagtattaaagcaggtaagtaaaagaaaccaaataatatacaacatagaaaccattcttggggagatgttgatctgccatgaccagctatttgtgaactcagggttaacactgagaagtacacattagtctggagagagctgcccatttttctaagggaaaacaaacctcatttcttactattttatgtagaaactccac

SEQ ID NO: 635 - DNA, 443 bp, Rattus norvegicus
  Genbank Accession No. AA892504
gacagtctatacagtttatacacagagctgagagcccatactgggctcacatcccctacaaatagagttctctctacaaaacagagataatttagctccccatagcagccagtagggggagggaggacagatagggaaaagctgagttcctgtcatccctggggcacaggatggaggtgggggtgggggcagagggctggtggggaggacccgaaggtaccgtcagtactaacggtaagggctactgtgggcactagagtgggcttctgaggtcagtgtttgtgagggtacactagtgtctttggtagggctgaaggcaccaccggtggggacaggctgaacaggaggtcttataaatagaaggtggggagggaaggggtaaagtgggtcctaggagcccaggagcccgatgtagaagacatagagcaacagcatggagacca

SEQ ID NO: 636 - DNA, 562 bp, Rattus norvegicus
  Genbank Accession No. AA892505
cgagagcaggagaggatttattaggggctcagtcatcatgtggaagcccaagagcattgagcagaggaagctgtggcgggaacagggcttgtcatggtagggccttgccagagcctgacactgattccgtgacctggtgcacccagtgcagatacgggggattcccctgctccacgggcagtgcgatcacctcggcaacttcataagggtgcacagatcggacaaactctgtcagagcagggaccagggagctttgtgttttaatcatcatcagcacctcactatcttcctcgatctttcctttccattcatagatggatgtgatctgcgggatgaggttgacgcaggctgccaggcgcttctctaccactgccctggcaatctccttggcgactttttcgttcggacaagtgacaaaggctgcagagactgatcctggaacgtagccggagcccgaggccggcgacggctgggacggagggcttccagaagccatggacagcagagctcggggtagcaataaaaggcgggaagccaccggcagtaaggcaggcatgcaaag

SEQ ID NO: 637 - DNA, 541 bp, Rattus norvegicus
  Genbank Accession No. AA892507
cacagtaactcatgaggtggataacagagggagggagctgccctggatgacctgcagccttccctccaaaggaaccttctgacaccactccaaagaatcaaggaaaggttcctgtggtgtgtctgctctctgctgagctgcactgacactctggcctttgtcagcagggtggggtgacttcagtccatagtcatcctcctgcttgtctttatggtcgagtttattcttttctgtcgtagcctttctcggttcatcttctcaatcctgagtctctgaagctgagcatcttctttggatggctccttgggcacctggctggccttggcaatcatgtctcgaattttctgtaggcattctgccagattgcggaactggtatcggctgctctcggaggtaagtaccagctctcctgccttgttgatcgtgagggcaatcttctggcgtacaggctccgcaatccagtctgcactggccaagtgaaaccttacttcggccttggaattcactttgttaacgttctgccctccaggaccgctgctcc

SEQ ID NO: 638 - DNA, 560 bp, Rattus norvegicus
  Genbank Accession No. AA892522
aaatgaaacaaggtttatgccacacagtccaacaatgtataaagagcttgaagtagaaaagcttgtggaaaatgtatactctttacatggtacatacagttttatagctcataaataaacacagagaacaggagccattgttcacattaccgaccagcaacacagagcagcagtaacaacacaaacacaatttccttcgactcagccacaaaaacttgaaatggtctcaccatacttgaggaaaatgacaggtggtgaagtgttacagccacacccacatcaccaagtgctttaagttgtctctgggttagaaatatcaacaaccgtattaactccagagagaagaaggcagggtaagaccctgtcctataaggcacttaataaattgacactacccttgtcttaaaatactgcaaatttgccttgaaatatgctgatgttttacggcgaaatttaggtttcttttatccaggtttagacatagacataatttgaataaattgataatactgtctgatggccactctttacaccagcttcaaaatggacccatttaaact

SEQ ID NO: 639 - DNA, 559 bp, Rattus norvegicus
  Genbank Accession No. AA892531
aaaaggaactttattgggtgttgggttcagatgaggtccatgaggatgtcgtcctccatgacgctgggctgcaggcccggctggggaaccgggccccggggacccccgctcagcagcatctgacctggcagtggcgccctctggggtagctgtgtgggccaagactgggtaggtggagggtgcaggagttgcggccctagctgcggctgccccaggctctgatgtggcggcagcaatgcaggggcccctggaggctggaggtggtgtagggaggcctggggtgggggtaccccagtctggggcggtgctggattaaggagaaggctccgcagctgggggttggctccagggttctggggtcgaaggatgggtccagaaggaggtgggccaggggctgctccaggaggaccttggggtgcccctgttggggcctgggtagtaccttggggctggggctgccctgtagccgcagaagctcccacagcaccctgaggctgaggctgtggtgcacggagctgtaatagattctgcgggggcctcgcttggtcctccagaatgg

SEQ ID NO: 640 - DNA, 572 bp, Rattus norvegicus
  Genbank Accession No. AA892532
aatggaaaaagccattaatattcaaacaaaggaatcacattttaaaaaccctatacatacgaaacagcttccaagaacattcaagcagcagtcaggagggaaaaatgtttcaatagcccaattttcttcaaaatatgccagagaatacaatccaattcactgctacaattcatagaattcttcagtgttttcttgagacgctgaggttcactgttggcagtttccagtggccggcgagtactgctcggaaaggccagcgcagacagctgaccggaagaacttcctgctggaaaactgctcattcccaaggaaagacatttgaaggccgggctgtggccctcacaactcgtccttctctaggtcatcgagctccacatcactgaggtcaatgtcgtcctccacaggaagctcgccatccttgccatcccagggctccctgggagtgatgttagggaaggaaccaccccctacgggtgctgtggagccacgcccgaaagacagttccctgagaaactcattgatgccttgttcactgaaagagcctttgagaagagcaaacttcatcttgcggg

SEQ ID NO: 641 - DNA, 605 bp, Rattus norvegicus
  Genbank Accession No. AA892545
aagaagaagaggttcttaagtttattgcttgactgggccaggtcgttgggttttgtggtcaccgggctttgtctcccttctgggacaatggtttcttccagaggaccaataggacaagcaagttcaccatgagttgcacatggcccaagatggagacaccatagctccggtacagcaggccacccagggtgggtcctacagtacgggtcaatggatgcacagatgcacagaggcccaacatggtccctgtgtctgaagcagatacagccttggtcagcatgctgtctgtgactatgttgagagcacagagactgaatacgagtccaggcaacaaaaggcagaagtggaacacattggacatcagtgccatgcccaggcccacaacagcaaagactagtacactggatctcagcagggcttcctctggaaaacgggtgcttagtctcccaataaccaggccttggatcatcatctggaggatcccaaagaaggacatgaggtagccagcctgtgcagcctccagctggaagaagtccatggagatgatggagaacatcaccatgaagagtcctgaagggaagccagagattaccttgaccaggaat

SEQ ID NO: 642 - DNA, 584 bp, Rattus norvegicus
  Genbank Accession No. AA892547
ggaaaaaataattaaaattttcccaataaaggggagaattaacactaaaagaccatacataccctggttacaagttgatgatctcatttttcataatatggaagtgttcaatgttccagaatatgaactagcatttgcaattttgaaaccccaagtcctgtctctgtaaacccataaatgatgaaataaatacctagaaacaagaatcgtctagaagctgcggtccatgatagagcaatccgttgcggacagacagtgctgcaattgtcacagtgtcacctgctagtccccactgagcttcctcatgatatggctgtctgctgttgcattagtgaagatacttcccacaaccacatgagtaccccagagaccatgacggatcactttacagcagccaaggtcatcaacagagaatcctaaatgccggtaccgttcatctgtttcaaaaagtgtgttgtttgtatatggtccaaaaaatgccaaaccagacgacgggtcaatgaagtcagcccagtatccttcagcccgaagagcatagcaaatttccttagcaccattaatgaacttctccaagagcgcctctc

SEQ ID NO: 643 - DNA, 644 bp, Rattus norvegicus
  Genbank Accession No. AA892549
gagatatattaaaagactttattcacaatagagaaattttacaaatataatttttaaaaattatgtgtcaatctattatgttttccgtaacatcagagatttatataaagttggaaacaacagaatgcacttatgaacaaatcaaaaacaatgtagaagtggatggatacacacgacagagaagtcactgagttctctaaatgagcacacaacttataggtataatattaactgcacaaagtataccaaaacatgttttgtaaacacaaaatcgggtgctaccttaactgctcacctttaagggcgtggatcatacatgtaagtcaaattgcacagctttgttggaaatgaatgactcgtcatctatttggagacttccgttgcttaaaattgacacaagataaaagcctaatcaattacgctactataaaatttgtctcttatcgcgtttaaatttttggtgttctgtgatctggcattaaaaaacagtccaagttttaaaacagaaaacattgctcgccagttggagagtagctcgtggttcggcttcctccctgctcgaaccggaacaaacgctacagtaccgtggagcaggcgcacaggacctgacgttcgcgtcccaaccgctacagaaatactcacca

SEQ ID NO: 644 - DNA, 566 bp, Rattus norvegicus
  Genbank Accession No. AA892550
ggtgtaaaaccaaaatatggtgatatgatttttagaattatgtgataaagactgttcccttgcagtctctttactaggaagaggaaaacactaactctcaaaaaaagtgaacagtcagtaatatttgttacagcttctgtaaaaaacagaaaagcagagaaagacttctcaaaccatttctttaattttctcatgattctgctaaaagtcaccaaccactacttgaacctccaccttccgggtggcctctcaacctcccagggcacttacgcagtggccgcagaatctgttcagccacagcggctgcttgcactaacaacagcctcatttcttgacttgtgtgctcacaatgttaacgctgtccttcatctgcgtattaaaaaatcatcccggagtgacctcagagcatcaatcaaagctacaaaacacacaatagctagttttgtttaaaatatttgtatccgagattccatttttctaaaaaaaagaaagccccaaagttacataatgtgaaatccactcaacaaggcagctcacttggaggcccccaggtgaacgagagccat

SEQ ID NO: 645 - DNA, 112 bp, Rattus norvegicus
  Genbank Accession No. AA892551
ggaaacaaaaagtttttatttaaggcaaaaacatatcagccccattattagaaaaattatccttattggaaaaaatggccaagggccaaatctaggtattaattctttaaaa

SEQ ID NO: 646 - DNA, 549 bp, Rattus norvegicus
  Genbank Accession No. AA892554
caacgtttgcagctgtgtggctttgcagcacagcaattcataaaccacactgtacagaatcaccagcaagactggaatgatgttatagaaggcaccatcatgcttattacattaccagagaacaaaatacaggaaagacagtttctactgtacacagtttaaagaaaggaaaggggaggagtgtgttgagcagccatccatccctgtactcaagagggcaggtagaaaactgacaaaacggagctactaaacctggtctagtatttaagaccacagcttttgaagttctcgtttttgttatttcgttcatagctaaaggacttccttctggaatatttgcagtcttgttaaggtttgtgtgcacacgctggtcacagcaagcagatagaatgccctcatcatttcacaaactattctctactggaaaagaagatcaactttttatttccctgttgcctcctggtgcagatttcaatgttaatgacttcagagtacccgacagtgcattctgatgaatacgtaacaagtttccgtttgtgttgggggttg

SEQ ID NO: 647 - DNA, 647 bp, Rattus norvegicus
  Genbank Accession No. AA892557
ggaattaagaggatttattttaaaagattataaaagttgatattaagagtgataaaaaaagacccacaggctttaaatcaacaaatacaaaagtgatctgatataagcaatgtaaaaatacatttttcctgtcccacataaagcataatttaaagtataattataaaagtcttgtgctgtaagtatatttcccttctaagtcttaaaaaccattctaaacaatttgtataaattacaggaactcaaatctgccacagctactagaaaagacattgtccctactgtgctgacagtctctggttccagtgcttctgcagggtgtttgttgccacagtctttaatatcatctctctccatcgaatccagaagtcaaccagccacaggttcccccaaaagagaaagttctaagagtggccacagacacaagtgaccaaattatcttcctaaaaggaaagcctgaagtggcccggcagagtcccccgctgtgggacactaacacagcaggccagagtgactgtcaatcacgaacaagccacacacgggcagagaggcgcctaccacagagtacaatgtccctaagcacctgcgagttagaagctaggtctcaggatggcactattgcaggcagacacctttaaaggtgggga

SEQ ID NO: 648 - DNA, 443 bp, Rattus norvegicus
  Genbank Accession No. AA892572
acactttaaaaaagatttaatgataaatacatattggtagaaatggttaaattcttgaatgaagaaacatctgaggactttctgcatcatggctcccagcccttccctccaggctgatggggcaactggaggcccaccaaaccagcagactcctccactgagcgctcacccttgccatgaaattcctgatgaagggctacatgttgccggatactacgcaagaggcagagataggtggcagcttggaagtgaagctcgtgttgggctctgcacaacttctcactggtgacccgatgtgctcggaaagccttaaccaggtaccggtaggctgctgtgtcgcggtatggtcgcccggtggccgcgttcaggtagcgcagctcccgcagaaggcctcgcagagtgcgcgccggcgaaccccaagccgccattttcctgtccttggc

SEQ ID NO: 649 - DNA, 512 bp, Rattus norvegicus
  Genbank Accession No. AA892582
  misc_feature (1)..(512): n = a or c or g or t
attagccaaagcacatactttattagctcctgaactctagttctccttctcctgtacagttttggttccacgtagccgtccagtccggcgagcagcaatgagacccactttgcgcccagctggggcatctcttcggatagtggaaggcttgccaatgtgctggtggttaccaccgccaaagggatgctccacaggattcatggcaacaccccgcacacgtggccagcagttcctctttgccttgtacttatggtaggcacggccagcctttaagataggcttgtcaattctgcccccgccagccacgacaccaacaacagctcggttagcagaggaaatgaccttcttggaccctgaaggcagcttcactcgggtcttcttggtctctgggttgtgggagatgactgtagcatagttcccggaggctcgtgccagcttgcccctgtcnccaggcttctcctccagacaacacacgatagtaccctcaggcatggtgcccacgggcaaaacat

SEQ ID NO: 650 - DNA, 658 bp, Rattus norvegicus
  Genbank Accession No. AA892598
acaaacactttttattttgtttttaatttagaacatgatacatattcacaagatttacactttatatcataccaaagcaatctagaaacactgtacagagcacacttgaacatttagaaggctatatataatctgtggtaaagtcataggcatcgtcttcttcactcattttatccaagataaaggatctgtcagatggtttacttgctgttgattgcccaggtgacatctccctggtctcttctacaggagtcacatctgagatctctgcatttttttcaccagtaacatgttcttgatcatcaccatcctgttggtcttctgtctgttttggtgactcttcggggatgtccttttcttctagtattccatttgtcaggcccgaagaccggaaaaggattttattagttaaatgagggcccttgaggacttgtatgctgtgtgcattattcttttctagttcttctagattaaagcccctcttcatgattgctgtaatattctcattaaaatgaggagaatgattccaggatgcagggggatggcagtagtaacctaatgaggcacctgtccactcagaccatagcagcttagcagcactttcgacatttgggcttccacctttttggtgcagacctcttctctgagcaagtttagt

SEQ ID NO: 651 - DNA, 476 bp, Rattus norvegicus
  Genbank Accession No. AA892602
aaagacattttatgtgaaaacaaaaggtgcgaggtcctgtcggccctgtcagctccgcaagtcagtttgtgtgcaaatggggctggccacagtggcagggagggccggcagagtgggtgagtctatggagttgtgcaacaaggaggtggctcaatctccctcacaagggagactggctgtacggggtagggcaaggttcagtacaaggtcaagttcccactacacaaatgctttcatgggtggcctccagccccataaggattcccagcagagagaccactccagcactgcctgactgaaagctacccagggatggaggcatctttgatactgggaagattctcaatgccaaggacacacatctgtgctcctggaaacatggtcttacagcccagaaggatcttagaccagtgcctctggactgcagtctgttcctctatccacagtttgcctcttccctggggtctgaattgagc

SEQ ID NO: 652 - DNA, 393 bp, Rattus norvegicus
  Genbank Accession No. AA892607
ccaaaaataatttatttttacgtgtgtgtgtgtgtgcccatgcatgcaccatggcatgtatggaggagctggctctctccttacaccatgtgggtcccccggatcacacttaagttgcaagatgcccactgagccatctctctggctcctcaaatgcccttttttttcttttttaaacaaaacagcaaaaacaaacaaacaaacaaaccaacagttatcctgaaacagagccagatgctgcccgtccagcagccgtggcaggtcctgtttgctgccatcacaaaggaggaaaggaacagctggaaatgtgcatggtgaaaaatatgtaaaagtctgtgccagccgaagagcataagagagtaaggatgatgaggcttggctggaataatctag

SEQ ID NO: 653 - DNA, 480 bp, Rattus norvegicus
  Genbank Accession No. AA892637
  misc_feature (1)..(480): n = a or c or g or t
tcttcaactttattttagctaagtcattttcagattctggaaaagtgacatttccaggttaaccttgagaatgttaggcaagcaagcaagtttagtaaagttgccttgcaggaatgagaacttctggtggtggagctcattggacttacagtgtacctagatgtaacatgactgaaaaattaaaactgattgcttctgtgtcttttgtgtgatcattagccttaatcatccaaggcagtgctgtctatctgaactacctttgagacagactctctgaaaggctggatccccatgttccagccaagtgttatgaaccagtcatctttattgtactcatacaggctaggtacatgcacactactagacaacactgccttccaccacccacgacagcatcgaatatgatccagatctctattttgttatcaagctttaccanaaatatacttaaatggactatagtaaaaaaagagtcactag

SEQ ID NO: 654 - DNA, 506 bp, Rattus norvegicus
  Genbank Accession No. AA892642
catggccaaacaaaagtatttattagggtttttttcttataaacattttcttctaaagaaaaaaaacctaaaatttaaatacctcacattctgccacatgagactgtatacattatttacatctgtcaaataaaacatattacagattttctgacattcagtatttcctttaaaataataacagagaaacaactttgatcagtaactacaatttgcataatcttggcacaatttacaatatggcgcctacgttgcatttcatagtttagatcgtttttgtcccatctaactatcttactagagaacctgtcccatcacgagaacagacatgtgtctccgtgcatagcttaagcaattgcacaatgcgaatcctccttctgcttccattacctggcactggcagcagttctgatttttgtcttcagaaatgatttctattctgtgttccttatatgctatcttcacaacattatttctaccaataattttaagtaataacttaaatg

SEQ ID NO: 655 - DNA, 421 bp, Rattus norvegicus
  Genbank Accession No. AA892647
catgctcgcccttttaataggaaaaggtgggctggccctgtaaaagggcctttggttttgtgagatcagacgacagacgagagtcccttaaccgccaaagccgtagagggtgcggccctgccgtttgagcgcgtagaccacatccatggcagtgacggtcttgcgcttggcgtgctccgtgtaggtgaccgcgtcgcggatcacgttctccaggaacaccttcagcacaccgcgggtctcctcgtagatgagaccggagatgcgcttcactcctccgcgccgggccaggcggcggatggcgggcttagtgatgccctggatgttgtcgcgcagaactttgcgatgacgcttagcgccgcctttgcccaggcccttaccgcctttaccacgtccagacatctctacaaagctggagagcagc

SEQ ID NO: 656 - DNA, 515 bp, Rattus norvegicus
  Genbank Accession No. AA892649
gatgtgcctcctacctcccccacccaatgtcaaccccttccatctaccccccaaaaagaaggtagtgaaaggaagggtttattggggttctgagcccagtgggcagttagaaagggaatagaaaccaaaacaatcatccgatgtgacagagatcgacaatccagaagtctaaagcagagtgggaatggagggtaaacaaggggaaagagagatgtacagcggctgcatctaccattacccctcctgctcagagggactggagagacagcctcaaacattaagtgcaggtcctgaagaaaggagatggtgtttgagcctgaaggaggaactggatgccaaggaaggagcgccacctctctttgtagaatggaacccccacctccgggacagcaacttcacagaccgtagacgctttcatcactgtaggcaatgtatagaaagaagtcctcttcatggtgttcctggtacagctgacccatcgtggcactggtgggtggaatgacattgttgacaaa

SEQ ID NO: 657 - DNA, 487 bp, Rattus norvegicus
  Genbank Accession No. AA892666
aaggtttgtttttaaccgttgtggatgtgtacgtgtggaggtgtccccggaggctagaagagggtgcttgctcccctcgagcctggcatgggtggactctggtcctctgctcttcactgctcagccatctctgcagctccggagaagaaggctctgacaggacagggcccaaaaccctgcttgtccttcagtggccctaggaatgcttaggcagactgaggtaggggcacagaaggggaacctgaattctcatagctcaagacctggttaaaacttctgcgggggtagtctgaggtaaaagagaaggcaggaaaacagttctgtcaaggaaaggaaggcttgaagaaaacagacacaatggagccaggacggagaggtggagcctatgaagtcaggagagtccagaggaccacttctctaccaggagcagaccttagtgatgacagagaacagagctggtcgttagacacagcctacagccagctct

SEQ ID NO: 658 - DNA, 451 bp, Rattus norvegicus
  Genbank Accession No. AA892680
aaaaacaaggcactgctctctatttaaagtaaacctattgagcgacagccgtggcacagaatatgttcaagatggggcgtgaaccccagggctcccgcatggagcccagtactgtagatgccagcagaaggaccagtctctgatggactcagaactggataaaccacactgggcgtttcccagttaagtgtttgccagtgtgtggccaggcctattacagctactgagcaaacgggttggcatgaatagttatgtccttaatgtgcacatcattaagaggtctgtaagtcttctcatttactggtaacttctccaattcatccaaagtctccagaccatctattacctttccgaacactgtatatttcatgtccaagtgtggctgcttgccatacgtgatgaagaactgagatccgttggtgtttgggccattattagccatagatacaac

SEQ ID NO: 659 - DNA, 382 bp, Rattus norvegicus
  Genbank Accession No. AA892754
aaaggtctcaagataatttattccaaattttaatataaacaagtaattagcctgtattatacatgcagaacaatttcagccccttccttcccttcccctccccccacacaatgaaaaggcatagtctgtacatgatgctactcggctcttgtagggaaaatgtcactgtgctttgtgtgggctttgtgtgtctcttttctgcagtgctgtggcacatttgatccgacaccgttgacacatgggatatagccaccaaggcacaaaaagggggaaggagcagcaactttgatacaaagaataaggaccaaacaagccattcctgtgcttgaggatggacacacacacacttgaggacccttctttccttctcaaataatcacaa

SEQ ID NO: 660 - DNA, 467 bp, Rattus norvegicus
  Genbank Accession No. AA892759
  misc_feature (1)..(467): n = a or c or g or t
gaagaacaataccattaattacaaaatttaattgtaagaatcaagcaatggttactggtcaaaccgatctactttgcgctaattgcgatctacaatcagcaattgtacatgctgatttttaaacaaaggtgacaaataccagttcataacacttcagggtctacacaaacttgattctgtgtgtaaggcagagagaatggcagtgtggtcatcaataattaatcaaaggcataattttccaaacaacttttagtaacagattataactttttaaatgtctaaaactatacaaaactcaaagcaatctatttttctacctgagatcaaaacaagtctttttcatatctaaacataattcttatgaggtanatctgaattcacatgatacaccctgctttagtgaggaagtctccgatttcacatatatatgtacatcttttcaaggctactgacaactccatgaagtt

SEQ ID NO: 661 - DNA, 606 bp, Rattus norvegicus
  Genbank Accession No. AA892773
aatgaccagcaaacaatttattggttaaattatcaatcgtggagttccttgataacattatataacaaatggattaattcaccagaaactggcttgaagatactgattttaattactttaacaaaatttggtttgtgtagcaagctcctactgtcactgctagacagtgaatgcagcggctatccaaagccagtcattccttgaccacgggggtctctcagagcacaggtgaataccagttacggttgtgtttgctgacctagcacctagttccagccttaggactcagaagcagctggacagaagatatggggggaggggagatgctggaaacgaacagctaactcgacttcgggccggtgttagatctgaggcaactcgcaggctctgagaccaaagaggaacacagctttggatgtggctgtgaagaaggcaggccccgggaccgaattggtgggtccagaatacagtgccaggtgggcatcaggaactacggggcttcttcttggcttccaggtcctttttaatctcctcaagttttttagccaggtttggcatgtcgtaattctggggccaaatacattccaaccacgttgcccaaagtaa

SEQ ID NO: 662 - DNA, 635 bp, Rattus norvegicus
  Genbank Accession No. AA892774
ttcaaattgattaataaaatagaaattttattatatcttgcatatccttataatatgaaaaacaaagccaaaagtttaaaaaccagttttacagatgtacatgctaataacaatggtttaatacatttgcaattatataaaatacattatacaaaagatgcctaccttttacataaagtgaattaaataaagcattcatatatttctatgatctaggtgcaatatgcacatacttagataaaaaataccaatttcctgagcaacaatgctgtaattcaaaatcagaagcagttccatggtaattcagtgtttcaataacttaactctgtaatactctaagactagatctccacttctgtttctaactatagccttcgcattgcagtgaggtaatgtcagaaaatgttttttactaaagactaacaattactaaagagtggttcatttaatgaacttttcacaccaccaaaaagcagagtccaaaaataaaaataaaataaaagtcaacaatcaactccatcagaaaagaacacttgagattacatacttcttcctaatctataacatggccagcagatcataacctggttttgcagacaggaatatgtttaaataattaaccattgggtcaaagc

SEQ ID NO: 663 - DNA, 711 bp, Rattus norvegicus
  Genbank Accession No. AA892775
caaactttttttttatttttttttttttttttgcgttgaaaatcatttaatgagaattatactttttctctatcagattagatctgttctagtgattattgtctggtgttacaagctcatctgtctcagagttggttagtgtgcatgaagctacttaagaaagatatggacaagcacagctcactggtccccctgagcacctcacaagactgggaacatcctctcaagggttaaaacagacgggcatacgggctgagaatttattttgaaggcaggataaacaggccagctctaagaagatactgttttgaaagctcacacgtttcataagtttctgagttcaggcagtctcagttctcatccactgagtcctgggccctcaaaagccctccaggtccaccacagaggctgttctaactgggtgctgagcctatacaaagccctggcactcacacaactgccattccccaagatcaactcgtctcctgtaaatatgtgctgtttgtatccggcacagggctgatgaagatggatcccgatggagcctactgtgcattacttcctgatgtgcagagatgtgtgtggtgagactgtgcgggatgctgggagcagtgtgcagtgcgttgggagactgagaagtgaaagccctgttggtttgaggggaaagcaaggaaatgtgacctttcccatagctactcccacagtgagaaa

SEQ ID NO: 664 - DNA, 663 bp, Rattus norvegicus
  Genbank Accession No. AA892789
gcaggtttcaaaaactcactttattccaatgtgaaatgaagatgtgatggtttaaaaacaagaaaacgttcttagtagctgtggggatgccttgctggccgcccattccctttgaaacaaggtccctggacagatactatccatcagcagctccagaaaagccccaagtagaggatctgcctaaaacagctctcttaggctcaaagggtggccatctccttcagggacagcagacaaagaaaaacgacacaggcagggaggggagagagagagggcagccaaggcagtaggagccccaacacccaagagcttctttgtgtaagtgcttatatggcaaaaaccaagaaggagtcaggctccaccgaggtgacaatcactcctaggcatggcactttccctgggatccacaattcagccctgggtcccaccccttacccaactatgcattaggcagctcaggttaaaatggggagaaagatacattcagactgttggcccccaaggttatgctcacctggggtacagggaggcaagtcaaagcctgtggtaggaccacctctcctgcttggccaaagccaggcacatggatgtgtggggtccaccaacgctggccccttcccttcaccctaaagctacaggtaggccaagcccaaacacagtaaa

SEQ ID NO: 665 - DNA, 409 bp, Rattus norvegicus
  Genbank Accession No. AA892799
ccgtgtcagaaactgtttaatgttagaattacaggcttttggcaagtatatggcaagcccatctgtccgttcccatgtccactgagaacacagcagagggggcatgccccaagctctggcctcagtccagacttcagcttgggtttgtccagcgagatgtctccagtccatgaaagcccatctggctacagcttgagttcactgggcattggctcccctcttaggccagctgagcaataggcacaaactctgcctgaaactctgctgcttcctgaggcctgggctggcgccccgtgtagagaaatctctggacaccaaatggtttcagtcgtcgagcaatggcctgggcgagcgcagccctgccctgggccggcaaagggccagtgacgaacaccttcatcctcgtgcc

SEQ ID NO: 666 - DNA, 650 bp, Rattus norvegicus
  Genbank Accession No. AA892817
tgcggccgccaaacattttttttatttttttttttttttccagtccagtcccctacgctttattgggaaaccgtgtgttcaaaaaaacaggaggcgtgagggcctttctggagagatagcttaggggttacaggcacttgttctttctgagaacctgcgttggatttgcagcgccctcctctgtaattctggttccggaggatctgtcgccctcttctggccgtcgggggcactgcttgtgtgtggggcgtggacatacatgcagggaaaacacccatacacataaaataaaaatgttttttttaaaagagggggatgagctcagtggtggtggtggtggcggcggtggcgcacacctttaattcaagcacgtgggagtcggaggcaggtggagttcgaagccagcctggtctacggagctagttccagaccagccaagaagccctgtcttggaaaactaagataaaataaaaataaaaaagaggggggaagggctggagagatggctcagtggttaagagcattgactgctcttccaaatgacctgagttcaattcccagcaaccacatggtgactcacaaccatctataatgggatctgatgccctcttctggtgtgtctgaagacagctacagtatactcacataca

SEQ ID NO: 667 - DNA, 590 bp, Rattus norvegicus
  Genbank Accession No. AA892820
catggagcaaacattttatttaataagttataagatacactttccagtcggcatttgttccagtttggtctccatggctactaagcctgtatccctttcgcatccagcttcagctgctctgggtcctaacgggtggcttttagcacccacacctctctggctgccgtgccttggtgcgggacacctacttcacccctaccatatccacgacaacagccacaacacccgattttgagggggaaggggtatttgacagcctggaaatgcttacaccaaagcctttaaagagaccctaggtgcatgtgttagtgccttggtccttaaggcctctcatgggtcataacaggggtgggtatccaccccttccagcttttgcaaggaggaggtcctacagtaatttatcagtggcctctgccatttagcacaagcaatggactctgggggcagctgacagaggctctgcatttggccatgaccacatgtcttcaagaaagtaggcaagagcagaatccctcctactccagagctggctttgcgatgaagtcaaagtggtcagggcgcagacatggagaacgatctgggtcagactt

SEQ ID NO: 668 - DNA, 626 bp, Rattus norvegicus
  Genbank Accession No. AA892828
actcataggtaggaatcccctttattccttatcaaaacagtttaacagcaaatgtagataatatatgttttatttagacatataagttatcttccatgggggcattctatcttgccccttctaatgaaagagggcaaatttttatattaatcttattcaaagactagaccaacttaacagtaacagacaaagagagcagagcatctagggtagggagtagaaaaattctactcataagcacatttaaacttcttaccagtacagagacacctgctgccacatcagcattactcctgactagtaagtctcccagtacacgtcaggggaagtcccaacacgtattttaaataaatttcactgacttgacattcaacgtctagattagatattcaaagtcttctttattgcaaatatgatgtctttgacctgaggtatggagttgtcttctagaatctttgcgtaaggcatagggacatcagcaccagtgactcgaacagcaggcgcatcaaggaagttgaatgcagggccttccataattctcgcacaaatctcagctcctactccaaattgtggccagcctccttccacagttacgagatgatttgtcttcatgacactggcttcta

SEQ ID NO: 669 - DNA, 635 bp, Rattus norvegicus
  Genbank Accession No. AA892832
ccgggtaatcaaaaaggttttaatgattaatgtttagacattatttgacagtgtgggtatatccagatgagctaagcacactttgacagcacactactgaatgttatagttttgtactaagatatgtaaagaacctgcgagcggtaccctcggatggagacacacatggacgctctagattagagaagatcaatgtaaacagacgctgcaactccgtccaaacagaggctaatgaggaccaactggctccttagaatatgaatgtgcaaaattaaagcatggtaaactggtatttacataaatatcaaacccacaattagtttgtacattgtcaattgtcttctaggatgtgtcacgagtggttcaatcaattttcttcaatgcagaaggtgttcaaaggctaaactttcaacactttaaagatgacacatgtaacaatagtccccacttgtatgaccaacgtctccagcgcactatctgttacttttaaacaagcgctttaaatcaatctttagatgctaagcagaaaaaaattacagatgccaccgagatttacactgaataaagcgattgctccccaaacacccagttcctgcgtgctccagctctttaattttgcctcaaaatgattacgg

SEQ ID NO: 670 - DNA, 570 bp, Rattus norvegicus
  Genbank Accession No. AA892835
gggggaagggatacgatagatataactgttatccaatctgctgtccactgtgtacacacatacccacacacatacatatacatacacaccaaaagtcccccccaaaaaacaaaaaccaccctcaacctgtaccaatacttcatattttgaccaaaagaatcgatcctgggaagaagtgcaaaatgcaaaatccaatgaccaagaaatgctgataaaacagcatcattaatatacaaaatatttatattacggaactaataacaggtgatgttctccatgtctgtaaaactttggaacaacagagctgattgttaaatctagtccatgccagcttccaaaacccagaagattttagttagcttcattttttgatgcttcatcaaaattttctacaagatctggaacgtcatcatcctcttcatcaatgtcttctggtttgggtgctttactatccaatacttgtcgtgggaactgttcagctaactttctaaggctcgttaagctgtcagcaccaagctgacttagtattccaggaagcatttctgtgattggtttggcttctgcatgacc

SEQ ID NO: 671 - DNA, 544 bp, Rattus norvegicus
  Genbank Accession No. AA892842
cacaatgtcatatatttgcaatgctttcaaagcccaacagtgattttaaaaagaaattaaacaacatgccctcattgactttttaaaaatctatacaattcaagctaatgaaatagtttattatacatagtaaacgtggcgtttaaaaaaaaattccaggcccagatgtctgcaggagtatgtgagaaatggattccacgcgagcataagcagaaaaactactgaatgagaccacaagtccaccaactcctttatagtaaatgccgacgttcaccgaggctcgaattcctgtggtgtcaggagatatatttaacgtattacacacatgcttacgatgcataggaaaatggaaaacaaaagatgcagttgcataccatgtggactcccaaattttctaatttacaacttgttaagaatgacaatatacagagaaagtattttaaaatagtgtatgattcactgatgattttttttttactcaaataaataccaaattttgccattttaatgtcacagtatcattcagttttcaatccaaggggag

SEQ ID NO: 672 - DNA, 644 bp, Rattus norvegicus
  Genbank Accession No. AA892851
caaagagaaaaattttattgatataaaatgcacttataaaatgtccacagaagacatgtcatttttcactgctatataaatttattgggaatgttattcacatctattgtcacctaaaacatactgtaaacaatgggttattccctaagacaaatgcatacgtgattctcagcaatcattggtttgattattagtaggttacaaggtcacatctctgtggaatgtcagtgaccgctgtagtgtgacaggcttcagcgcatcattgcacacactgcttcagaacagtccccaccgggtctggacccaggacgcaaagcaccccctctgcttgaaacggcagctctggaaggtctgcgtcacagctccaggtctctcgctgcagcactctatgggcacgtgtgatgacgtgtacacacgcacgactaaaaagtttacctctcgtaaacaagagcaacattaccgtcaactctcctgcatatttaagtagtaaagtctacgtatttgtaaacaaacaaaacacacaaatctatttttaaaaacttccatcagctcgtaattcctctgtgatctaagtgagtccacactgaatttctgaaaggcgcatgtattaccttaggtaataaagctctgcaaggggtgcttca

SEQ ID NO: 673 - DNA, 486 bp, Rattus norvegicus
  Genbank Accession No. AA892859
ttaataatttatcaggcaggggaccctcagaagggtcaatgggaaaatagaagactctagggacctcctgggagggctgttggggccagcacattctgtcccaggcacatagacacactcaggagatgagaatgacaacccaggtggcccaacaaggcacagtggcagagaaggtttggcagactgattgagtgtcaggggtcaacgaaggacaccatgatgtatcgagttcccctggtggtgggcagcccctcgtggtagtgtgtgaggcgaccagggtgcaggagagcccagcccttcctcggggatgagactctgcagtcgtacctcaggaagcggcagccacctccctcataatctacacccttgtgattgagggcaacgttgagcgtgaaggtggacgagtcatggtgtggccgaagtgagggctgctcatctggccggtagcggaccacaaagttcatcactgcccgtgtcttggtgtgg

SEQ ID NO: 674 - DNA, 436 bp, Rattus norvegicus
  Genbank Accession No. AA892860
ccatataataatttaatatatgccagccaaacaaagtagtttatctttattcaattaaataaaaacagacctgtcaggtatattatataacattcactatatacacatgatttaggcgatgcaaggtaattctaggtatgctaactgttcaactattagtgaaacacagaaggtgtcaggagcccagcgtgttcctgctcacattgggtgcctgcgtttctgtggacagttagagggacagccacaagccaggacagatattaccagtaaacgtctgagggacagaggggctggggatgagtctagcagagattaacagtctcctaagtgtggatagcatacttgacagttacgctttaacaagttcctcttcgatcatgttcatgacgtcaaagtttttgtttgaaggcaacaccaccacattttacctcgtgcc

SEQ ID NO: 675 - DNA, 593 bp, Rattus norvegicus
  Genbank Accession No. AA892863
gcattttcctagatcatttttacttgaccttttttttgggacaaaagagtaggtaatgcaaaacatgttttatattaaaacagatgcagatagtattgaatagaatataaaatttacattacttttgagacaaagtacttttgacatcaaagacatttcaaactaagctacttatgagcttctgggtgcatccctccctaaccctgagcagaagaccctgctcgctcacactacctaacatcatggcctctgctgcattgacagaagtctaaaagcagcaaagtcagtgcttactcatttggcaaagtaccagtgaatttacttaaacaattgacaccttagggctttctcatcttacgagcattttaacctgacgttaaaaggcctgagtgaatagaatctcaatgcctgagttgagaattttcattgtaaagtgaattttcctccagtaagtgtttttaacaagcctcactgagggtctgacatgcgagctggacaatatcctaggaacctggtcaccagataaggaggtacagatacacttttcaagggcatcatcacaaatgagaacaaactactcaccttctgcagta

SEQ ID NO: 676 - DNA, 570 bp, Rattus norvegicus
  Genbank Accession No. AA892864
aaacttaatgaagagtagtaataccccatgcctgtccacagctgtccagggttccctgagcaggagggagtgctgactgcctctctttgcacactctgtctttatttcctaaacagaaggagagctaaatggcgctctggacagctcctggacccttccttccctacatgcagtgcttgggccctgctgaggggcacagtgaccttatgacctatagtaagtggccagcctctgactgctatgcatggtcagggccaccagagggggcagagggccctcccaagatctagaataaattccaccaactccgggatacctggatcccaccttcctggagcccccccccccttccagcagccaggcagttctccttggcagcagagcccctccccagggttctatgtgcagtgacatgatcctgaggtaacagcaaggccctctgtaaagatgaaagtgctccaagggagcagtgagccccagttattgctggcgctaagtgaggcctggcgtaagcctttgggcgggcacctgagaggacaggggctcagacttcactgcttcagggtagcc

SEQ ID NO: 677 - DNA, 533 bp, Rattus norvegicus
  Genbank Accession No. AA892888
  misc_feature (1)..(533): n = a or c or g or t
gacaataagaactctggctctttattgagtgctgctctcattctgacgtttgtctgctctctgttcctctgtagttcaggatagagtgtatggtggggagggaggctgaggtggccaagcaagggatacatgccaagggggcaccagggagaacgttacaatgctgtgagacacggggcatggctggaaggacacacaagggcgagagagagagagagagagagagagagagagagagagagaatgaatgaatgaataaatgaatgaataggggtcctaaaagggttgggttgggtaagtccagggccttgcagtctagttttctgcctcaagagagcaggaagaaagcctcactgtggagaaaggctgaagctgattaatgatcaccccggccgtggcagcggtgctgagagtctctgctttacctgacccctccttanaagtactggggtgggttctggctgcacatggggagatcagatggccttcttgggggagagttatttcacagttttccccatgatgtggggccc

SEQ ID NO: 678 - DNA, 541 bp, Rattus norvegicus
  Genbank Accession No. AA892916
caaaattaagaccagtgtataaacatacttgccaagaaataagcaacttggagcttattacattagcacaaacattacatcaacagttcgctaatcacatctgtgggtctaaaggaatcaggccgtaaaagggcatctctaaaacacccctgggcaggtccaaactcgctgggtcacccaattacagtggagaaggcagtcacagaaagaaacccaatgaaatcctcctggccactaaatgggagtcttgaaaaccctctggcatgaagagacttgtagagagtgggagaacacccctttactatggaggaaaaccaggagtccaggtattctcacacatctgacatggcccctgagaacaagtttcagcttgcataatccctgcatcaacacatgcattaccactaaaaggagtcccgttgggtcctacccggatgcccaggggtctcccacaggtaggttcatcatctcgggttttgcaagggcccgaaccaaaccgggcgatggtctctatttctccattctccagttttacaactcg

SEQ ID NO: 679 - DNA, 544 bp, Rattus norvegicus
  Genbank Accession No. AA892921
actattaaacttcaaaggaatttattatcaaaattaaaaatgaagccttggttctagataaaggcataatcccattcaacagttgtcaaggagcgtgtgtcggcagagtctgcacacagcactgaagggcaggaggaagcaataggtgggctccagttggaatgttgaatatattcagacagcggcctcttgagttagacagtcatgacacactggatgaaatcatcgtacgagaaattcacaactccttgttgaccagaatcccgtctgcggaagctatctgtgagagccctcagtttgacacagcaggctatgtagtcatcaaaggtgatcttcccgctggtgctgtaccgctttgctactgaattcacggtttgggggctcaacctgaaccccatagtggttagggccttctgcagctcctggggatccactgtcccactcctatcactgtcgaagctgatgaagtgttgtctccagccactcagcacagtccagagctctctgaactcactgaatcccatcgtgccagacatatctctat

SEQ ID NO: 680 - DNA, 476 bp, Rattus norvegicus
  Genbank Accession No. AA892940
  misc_feature (1)..(476): n = a or c or g or t
acaaactgtggctaaggttgaacttgcaaaaaataaaatcttgaagaaaggccccttagggttaaacattttcatcttgttctcgttcttctctgggcccaagctcctctctgttccttgggaatggggccaggcagaggccacataaggaaccaggaggccttcctcattgggatggaggtttccgggttgttcagatggccccataccagttcccagatgctcagagcatgaaggcccagtcacacaggtccagcttgagtctagagctgcgtgctcacatgggataattgagccatctccactgtcttgactcaggccacaccctggactcaaccttgctttaggaacattatctgagaggtgttgatggaacaaatccctcncctcagcactttctcaggaggaaaacatggcctcctgcaagtcctgngaagtgctcaacaatgggtgtcatggaacttcagaagggccta

SEQ ID NO: 681 - DNA, 511 bp, Rattus norvegicus
  Genbank Accession No. AA892942
acactctaataaagaccctgatttaataaagaagacatttaaaatgtgccaacaatagacaaatgtatttacaacataatctaaagattccaacaaaattttcagtagctacaaaagaattcagctgcctataatagttcacatttggtttagtctatagtatatcactgtcttaggaaataaccttaatacaaatgtaatttataatatcccctttataacaagaaaaaaataaattcatacagtattttataggcatttattatgccaagtacttaagcaattactctcattattacataagaataatattcttattaaaaggtaatctttccagagtgatctatggccacaaaagacacagcaacagcggcctgtccatccaccacagctacaaagatccatttatatcaaacagctcgagtgaaatgacttactactaagaaaaaacaaaattttagaaatcagttaacactagtacccagtttagcttttacgtgcttatacaagt

SEQ ID NO: 682 - DNA, 441 bp, Rattus norvegicus
  Genbank Accession No. AA892950
cgaagaaagaaccaaaagtgtctactgtataaatacaaaaggccaaaaccgtattaacataaggtaatgaactaacagagactgtccattagagtgcggaggcctatgccttcccagctgacgccaggtacttgaccaggaagtctctcagcctggatatgtgcatcatctccttcatcgtggtgtctcggcttcgaagctggatcagcccactttccaaggtggtttcagtgattagaaccgtgaagaggatactcatctcatcgtactttgaatagagttgctctaatgaggactgtgcagtttccaaataaccaggccacacagcaatcccattttctagtaactcattgagtagcccttggcaaacctgtcggagttccacggttgggcctttccccacatctagagccaccttaataggggctaaacaagggtgaa

SEQ ID NO: 683 - DNA, 454 bp, Rattus norvegicus
  Genbank Accession No. AA892959
caaagaatgaacgttgcttttttactcttgtgtcctagaaaggagctgtgataaggagaagtcacgactctccatactgtacactattcacaacagtcatccggctgatcctaatcctgttgaatatgagtcagcaacagcccaaaatgaatatcagtttaaacagactcccactgccagcagggggcaggaaacagtccttcgaggccaaagccaagtggtgaatcccactgacaaatggggcatccacactcaagtctcccgtagccctacatggccaggtcacagggacagtggctacttgagaggcaatggccagctcatctggactggctattgtagctcctgggtgtgacagcgagaggcatcttctaccatttgagattgccctttaagcacctgccgcatcctttgcattcccaggcggagccggttctccttgtccgagaagaca

SEQ ID NO: 684 - DNA, 376 bp, Rattus norvegicus
  Genbank Accession No. AA892960
acaaaaggaaatgtatttgtgcacataattactatggacaaaggcatattctgagggcttcaggctgatcagtatgcgtgtacctcactgaagtacacttacttataaaaacatgttgcctttgccatgtgaaaaccgggtgttcagttctctggatttctttataagggcttttttctgtgcctcatcaaaccggttaaccttgagatctttatcacgatcgaaaggggttctctcctggtgcctgttcttatcttcagcagccttagtctttaacctcttatgatgaatgtccatgagggattctgacctttttgattcattgtatgaggagacttgctcagccagccttttatcccttcctgacaacatgttc

SEQ ID NO: 685 - DNA, 496 bp, Rattus norvegicus
  Genbank Accession No. AA892993
gaatgaaaactcacttgcttttattgacacatatttaaaagtccggattgagtgatgaaaggcgtggggtaaggggctgttggactaccccacccctaccccggcgctgcttggttagcgcctgcccagtgggtccagtggctgtatggtgagtggcctagggtcctgctcttcatcaggggtggcggtggggtatctgagtccggaggccatggttcctctgttcctgacccactgtactgtgaccctccctgtgaggcaggcaggtcttccgggctctgcaacctgggttggggttcgaggttaaagggatgcagttgagatttcatttgaggggggtctggagaccccaaggtgcagcttcttcctgagcgggtgtggaggggcgtctcccggtccaagaggcctgtcacaggtgctcgctgtgggacagagggggtgatgaagacctcgagctgagccatactctctcttcacccgttcctcccctcctgca

SEQ ID NO: 686 - DNA, 482 bp, Rattus norvegicus
  Genbank Accession No. AA893000
aaggaaacaaatatttccctttatttgagtgtgttacatctactcatgggatagtcataaaaactgaaatctttaatttacaggactataaatgatgccacttaactgagaaccagccagcaaacagtagcatctgaagaccaccactcctggagggttccccacaccaagtcagcctagtagtgactacagtagattaggagctaggagtcagaagaacaatgcttgaggttataccaacgggggtttccttactcctttgccagctgcacattggtaggctttgctccaatggggatcccatatttgtgcaaagtgttcatcaaaatctccctcatgtcgttgttgtaggaatcaaagtcaaatacattccgaaccacactggagaggccttcagtagggaatttctctaagtgtttgacaatgttgacaacttctctggtagaataaggatagttgataatcccttggtcagccaattt

SEQ ID NO: 687 - DNA, 367 bp, Rattus norvegicus
  Genbank Accession No. AA893032
acagtgacaagaaggcttacaaaggagaaggaagaagaacacattggacacctgagattgacaagggtcatttttggtccaagtgctgttaacatttttgagggagttttaaggcatttgggtctcagggtttgttagcttgccctattgccttcttagccagcagttctgagcaactctcaagctttgttaccatctgaggtgcatcttctttctgtgtacttctatttctaactcattgttatgctgttactctctggtctcccatgtagagtactcaggaggattttcttgatctttccgctccattgagaacatctttaattgtatgaaacatcgcaggttgtctttatctacagagtaaagg

SEQ ID NO: 688 - DNA, 414 bp, Rattus norvegicus
  Genbank Accession No. AA893040
ccagcgccagcacatgtgactggtttaattacatcatctgtcactaaacactgagtagaatacagtggataagcataggattctccaccatggagagagacttatgttgccacagtttctatccccacctgtgtgggaagacttggagtttcctgttgccaggggctgatgggacagggcatgcatgaggccctgcctcagcataagctctgagcaagaagttgcatgccggttagcacacatggggaaagccagccctagacagtacagagatacgcttgtaacaggtgcagtaaggctacacagattacaaacaaataggcacatggacatcatgggtgttcgtgggcacagccaatgggcagtcacttcctcagagtcttcatggtgccactcggccattgttgcttaagc

SEQ ID NO: 689 - DNA, 410 bp, Rattus norvegicus
  Genbank Accession No. AA893065
  misc_feature (1)..(410): n = a or c or g or t
caatagaatttaattctggagtgtgagcaggaaccagttaactacattcattgtccaacccccactggtctaagactccaaattcttggcatgtgaatcagctgttgggtagctccgcctcatccctgcgaggcggtaagaccgaccgtggtgcaaaggcttcacaccgagggaggggaggctttccgctgcaggaggtattggtgaatgctgtcagcatcccgctttagccaagcagcgttcagcaggatattctcacaacactgctggatggtacgttcggctgaaggagctgggtgactctcaaagaaagccttaacttctccagccattttatcaactgcanacccctcaactgacagctttatgagtctggatattaaaaaccctccctggtatcgattataaag

SEQ ID NO: 690 - DNA, 479 bp, Rattus norvegicus
  Genbank Accession No. AA893088
acgatattgtacagtttctgaagctaataacagagttctcttgcatgtacatttaaagcatgacaaaataaaacgtatttcacaaaagaaattcatattacagtactgtggggatcagaggcaaagagtgtgcacttgtgggtgatgaacaatacattcgattcaaaagaataatctgtgtgaataacagcttcttggctataataaatacaggacaggttaagagcaacacctggagtttacggatacaagacaggtgttttgtaatggacgcacttaggaacggtagagcgctcttgacttggcagcggcatcttgctagctctacaatcattagacctttttgagcactgcagatgaggctaccctacattcaccagcccatacctcagcgtgccaaccgcagttactgcccattttcccctgggtaactagtaccaatgttcaagcaaggtttcaaatcagccgtacctttaatt

SEQ ID NO: 691 - DNA, 373 bp, Rattus norvegicus
  Genbank Accession No. AA893091
  misc_feature (1)..(373): n = a or c or g or t
acagtcacagagatttattcagtatgaattatttggaataaggatacacttttttaagaccttagtaggatttctctctagtatgaacttttatgtgtcgagtaagacgataaacattaagaaaggttttgccacattccacacacgtctgtggattgccttcagagtgaatttcttgatgtcttctaaggtangaatatctggaaaaacatctgccacactcttcacacttgtaaggtttctctccagtatggactatcttatgtttcctaagggatgagtgatgacgaaaggctttgtgacaattttcacacttgtatggtttctctccagtatggattgtttgatgttcctgaagacttgcagaataagt

SEQ ID NO: 692 - DNA, 493 bp, Rattus norvegicus
  Genbank Accession No. AA893160
  misc_feature (1)..(493): n = a or c or g or t
gaggactatcaaagttttatttaaaatttcggagcacttgaaagaatataatgtacttgtgtttttattgtgtaacttaaagaatgctttcaattacaattagccttcaagggtcaccacagaacactgcttggccaggcctactgttgtctaccttcaccctctggtggctggcggggaggtaggctgctgacatccctgtggcaggtggcttgctcctacttggagtggcaatttttcttcttcttgtggcccttgattgcctttctcagggcttcatccagaatgagatccaacactctcatgtctgtgtggctactgccaatttttgggcaacaggccttcttcctcctcttatgcttggattccatcatgcgaacaatggccacacattttatttttcactggattcttcatttgcaactcctgtaagttttggtcttcttgagtccaagagtttanaacatgtgctcacgagtcactcacaatgaaa

SEQ ID NO: 693 - DNA, 606 bp, Rattus norvegicus
  Genbank Accession No. AA893173
aaatggaaggtacacatttattaccagagaagagaaaacacacacaaagcctggatcctttctcctcatgcactagttttctatgcagtccaaaaccaactgggaagctatttacaaggacaaacttcctaacatggtcctggactgtggggtgggctgcttcttatagaagccatatactgcaaactaaatatattcttaagagtttacaagaagctttagagcaactgtatcaacagagaagactttttagtgcaaaatattataaaagtgatacaactgtgtgcctcttaagtgtttaattatctgatttgaacaaggaaatgagcaaaaaataagtggtggagaccggcctggctttatgactttttatactcaattcgttctacttttacgtcatctccaattagctgatagacgtaagtgaccacggtagaagcctggatgtccatcagcacaaatgacggaataatatttgtttccaaggcattataggctccagtggcagaacctgggttaatatagaatttattttcatgctcaaatgcttcgaatttgtgtgtgtgtcctgagataagaatgtccacatcaaactgcctctgcagc

SEQ ID NO: 694 - DNA, 491 bp, Rattus norvegicus
  Genbank Accession No. AA893183
tctcaacctatcagaaagacaaacaaatcaccgacaacaggggtggggccttgaccttttgaggactgggatgcttttctccttttgctatgaggaataaaactaaaaattatgtcactgagtaaaaataaaagtggggagaaaataattctctgggtaaacagcttttctgatattttatatgttgtttttccttaactgtcactttccttttttttttttttttcatttttttcttttttaaaaagacacccgagttgctttcaagaataagcatatcacttaacccttagaaaattaggcaggatgccatgttgatggaatagggattggtttaggggacaggaaaataagctacaacttgtagcctctgtccaaagggaatgtgccttcagcagggcctgtgagatctaatgtgaagagagacacaacatgtgagatgggacttggtgtgtgaggcatggagtcattggagactcttccctcgtgcc

SEQ ID NO: 695 - DNA, 667 bp, Rattus norvegicus
  Genbank Accession No. AA893193
acaatgtaggaaaatttaatacatactatataaacaacattatttacatcagaaatcaccaggacagtggcatttttcacaaatataaattaattactgtttagtcaacaggtttcaaaagtccacaagtttacaagaaaaaccatctgtccccaaatgggtagggcacatggactaaagcagcctggacccttggcatggctctcttcacccaacacagctggcctcggctaggagacacaggtgctgggcctggaccacggctcctgctgacaagtgggttttggtctgtaggattcagtgttgctgtgtgtgaacacttaggtgaatcacctttgccctgcaaagcctgatgtatctgtcagacacaccaggtcagagcatcagcagcacagtgagaaatgtttgcgctccctttgtggggcggaaggaatgactacacagaggataaggagggaacatcaggttgggctcctgcagctggccaagtctgagaggacacagtggtcagcagaggctgcatcttccttttctagggccacagtgcatcataggacttcaggccttgacaacactcacacctaacttccccaagttttgccacctcctcaagaatgagctgcccaaagccaggctccaaagaactccactggtaacaaatgtctgc

SEQ ID NO: 696 - DNA, 597 bp, Rattus norvegicus
  Genbank Accession No. AA893199
catagtcaacaatgtgttttactatacatctcagatttatacatttcatatatgcttttaaagcttcaattaacagatcaatacaaaataaaatatatatatatttatatatgtgcagcagtggttctcaggcacaggatttaggaggaggatggagggagtctttccttggcatgtcaaccatgatagtggaacgtgtccttctgacttagctgccttgattgaactttacatggcaaacagttgaacatgtatgccattgctcattggaaggataagatttgaagtaagttcatagcctgcatgttttgaagtctttaagacttaaatgcttgctttcctcctacgagctccaagatcatcctatgaaaaaaatatgtccacaaactgtctggaacacctgcctaagaaccactgcctatggttattcaatgtcctcaggcctcacaggatgaggtaatgggatgatggatttcttctcagtgtccctggaaagtgctttcctcatatcgtaggcatcctcatcaggctccccattgctggctgagtagtactctatgactgtcctgtagacactataacccaactgcttgtaca

SEQ ID NO: 697 - DNA, 638 bp, Rattus norvegicus
  Genbank Accession No. AA893212
gagctgggaaccgaacccagggccttgtgcttgctaggcaagtgctctaccactgagccaaatccccaacccctgtagtgcgccttctatactagaaagcttgaccactgagccacacctcccactagtgcttcaatgtcaaccgagagtaaaatgtgtttgtatgaaatgcctccatttgactagatagagctttatttggagaaagtcacatataacataattgaactttgaattatacaatcccgtggattttagagtgctcctggagcaggtggcagtcaccactatctacttccagaacagtctcatcctttccagaaacccacactctgtctttcctctattccagatctgttagacgagtggaattacatagtccggtcttttctgagttctgttactaagttttaaaggtttattctcaggtagcatcagtccgtaatgtattactgctgaatagtgttccgtgtatacagacaccgtgtgtgtcttcttccagcgagcagaggaactctgagctgtttctactttggggcttttgactaatgctatgaacatctgtgaaaaagttcgaaatgtttgatttagtacagaccctagtggggagctccggggtcatattatgacagcctcaa

SEQ ID NO: 698 - DNA, 663 bp, Rattus norvegicus
  Genbank Accession No. AA893217
aacataaagatagtgaaatcttaaggataaggaggcaatttatatagcctcttctattcattgttcaggatggagctttccaaagggcataggtatgagatttaacactggaaaaatacatatgaaacttgtttaaccggctgcacttaggaccaggcacagcacaataaatagagaactgcataatcttttaaaaagactgctatattttaacacatccttacgaaagaagcactatcagtgaacaatctgaaactctacagtgtgggcagagggaaagttaccgtgaaaatctgagcgttgtttctgtaacttcttcacactcatacatcaacagtctcagagggaggaagaacgcacatctcaaatccaggacaacaaaacacacttggtcaagtagtttcttgggatcattcattctgatcacaagcctaggttgctggtaggtgtaggcagacaggttttgaaatctttctcatctccactagtcagggcttctggatacgaagccatattggaagcaaactgattaagcagcaccgttaatccacctctcaacaagtcattgcataatccatatctgatttaatagtttttaaattgttatgtggaagaatatccttcttgaatagcagtctatcgtgtagacatgcactagcaagg

SEQ ID NO: 699 - DNA, 591 bp, Rattus norvegicus
  Genbank Accession No. AA893224
gggcctgaatactcactttattaacactttaaatacaggaaatagttccaagcagggccaagccctaggacaagggtcagagaaacaggaggacagacaactggatggacacacaccctaggatactctgcccccacagaggctgtagtcccaacaagtctcccaccagatacatacactgaggctcagagcccagagctgtctcccaccacaaaggcaggcctgtcctggtgagcataggtaggccagctcacagcaggcgcctgcaggggagctcatctccagcgactctgagataccagaggatagaatacgttgagcacaagggccaccaaagccgccacggtacccaggacaaagtatcggaggcagccctcgtctgatgtggtagggccacgtggcgggggccccacccagtcttggggcccccaaggacccagaggcccaggcccctcgggcaccatctcctcctcggcctcgagctcctgccaaatccgggaagcctatggtatgtggaaagggccatcagcacccagaggatggggaggcccagtttccctgagacccctagccaagacagtcacattaagg

SEQ ID NO: 700 - DNA, 590 bp, Rattus norvegicus
  Genbank Accession No. AA893225
gcgagacagggtttctctgtgtagccctggctgtcctggaacttgctctgtagaccaggctggtcttgaactcaagagatctgcctgcctctgcttcatgcagtttaggcctattcggtcttacccactttcattcaccaagtgccctaggtgtccataccaatcccgggagcctcacctgttctgccctgtccccactcacaggggctggggagctatgggcccctgtaaaaggctagggagcacctttgggggtaagcagtaccataagcacatcccagatgcaaagtgggacatgtgtcagtgtgagctgtgagtcccgtgggtactgccctcacccggagaacccactagtgtctgacacaggtcaatcttgccatccagccaagagactactgggccagggctgtcctgcctcctgcttctctgattgtagcaggacaagtaagtgagtagcctgggccgagagctccgagccctgagctgtgaccaggaccccagtcggagctgggaaggagtgctaaggcctcaaggactttcgggatcgagctccttgccaggcctctagtttcacacttgtgtaacccttg

SEQ ID NO: 701 - DNA, 645 bp, Rattus norvegicus
  Genbank Accession No. AA893235
gagacagaatataaaatgtttttatttcaaaatgcaaaatgatattcgttgtaataataataataataataacaacaacaataaaaataacagtataaaaagcatgtctccttccctaatgcaaagtgacagctccttgatcgctcccacagccttggacaaatcacagtgcatgctgcacagcagcaagtcagtcccagatcccttgggtgatctgtgcagggtcagttctggattcggtggcaccttgaaacagcatgtgactctctctcgcccacctcagtcatgatctctctgtgtctcgcttctctgccagtcaccagccttaagaggcatgctgccggagggacagggcccggctgcacaaagtcgcctcctgtgtcttgccttctgctatcagggcctgcttgtggagggactgctgctcacaagcatcccgcagctctgccactgccgcctcctggtcgcgcagacggctggcagctgtgaaagggctgcacacagtctccactagaccgagcaccacaccgaagaacgctagcacactgcccagcacgtacagcttcactagcttccctcgggacttctgcgtcatcatctccttagccagaaggatcagctcctgcacactttccatctgagctc

SEQ ID NO: 702 - DNA, 635 bp, Rattus norvegicus
  Genbank Accession No. AA893237
ccaaagaaacatttattgaaacacagggcccatgttagaggctcctgagccccagggcgaggcccacaaggcagagaccattgctcagcagacaccccaggttgcagagggaagacaggccatggtagtagaagaatttctgccggagagcactgtacttggggtccttctcccgcagctggcggtaggggtcagggccctggaggctgcctggcacctctgtccccaggcctcgctctttctctatactctgcagggcccacatggtagctgtggtgcgagcctcgagccagcgagcattgatggtagccagtgtgagactcagaagcagtagggtaagctgactgatttcccacagcgtgaggttgatccaggcccgctgtggtgccaagatgcagaggttgatgaaggcacaacccaaggagacgtgaaaatagactgggaagagcttgctctgcacaagtccaaacgtgtgcctcgggaggctccggaaaagcaggaagcctgaggcaaaggtcacccacatctgcatgccccagacaccagacaagaccagcaagtggaccactttaatcagacttcctgggtcctcaccttcttccattctgccgcccgttggagcaccggaggtcagc

SEQ ID NO: 703 - DNA, 630 bp, Rattus norvegicus
  Genbank Accession No. AA893239
aacaaataatgacagctttaatcaatttctttactataaaagacaatttaaagtgtatttttaaatacaatgttagcattgtggtaattttgctatgaaaaggtaattctaccttgtaggaaagagaaaatgcctcaaaaaacgccaagtagtttattcatatgttggaacgggtgagccagtgaaaatcctgggccttccgagtactttgtggttcaatcatgatgttgataagacacggtttacttgtgtctttcagagcctgcctcagcgagtcttggagctcttctggcgtttgtacaaaataccctttgcctccaaatgcagtcatgacctgctcgtagtgtgagtttggaagcagacacattggagggattgttgtagcagttccttgaaaatttaatattttcccccaggtgtcagcatcaaaaccttggtaaattccattattgttcactaccaagattatgattggcaagttgtacctgcagatggtttccacttccatgccggaaaatccaaaggcactgtctccttccacacagatgacccgctgcccagggcttctctccttagccaccacagcagctgcaatggcaaatcccaaaccaactcccattgttccaaagg

SEQ ID NO: 704 - DNA, 643 bp, Rattus norvegicus
  Genbank Accession No. AA893242
aatgccgtttatccagtctcagaggtagcccttgaagggaagaaacttttgatttgacccttttttctaagatttttgtttcaggacctgaattaagaaaaatcaaaacaaaacaaaacagaaaaattaagagatgattttttctttctcttgaaagtttaagagagattctcagttcatcttttcatgactggaactttctaagacaaaccacaaagccatataccaagcagaaatcagagaacgaagcccagtccccatcagctgcaggtggaaaccacggagaagccagcacagcaagtggctcatggttaatacctcaggtctgttctgagaaaagatgccgatgaactgctctgagcaaggtttgaaacccttctggatcagcgccgagcctatgcactcagccatttctgcaacctgtttgtaagaaatccactcatatggctggtttggctttctagaacctaaacaagggccatcatttgacacctgaatccccctctggaagccatcgtacatcgttctgacatcgtcgtagtagtacagcaagagcttgtcgtcctcaaggactgctgatcttcggacaccctcagtagtacccgttactttcacagactgcatggacagatcacatgggggc

SEQ ID NO: 705 - DNA, 540 bp, Rattus norvegicus
  Genbank Accession No. AA893246
cataagtcatatttaaatgggcagaaccacttccattacacacagacacatcgtgcaaagaaaagtaggcatagagttgagtccacagtaacacaatggctgcacagcctcagacaacagtgccaaggtttacaagtgggtaggaaggaaggctgctcagcatttgcctgagaccatgaatgtttatagtaagtatttcctaaagttttaaacacatcagtcaaactagtgtaaataggatggtatgactctttcactggggagattctgtaagtgctgggtgggttttacaaatctcaggttgctgaattatgatgcaggaaaaatggtctcacacagcattctgataaatcttacagccagatgaactcttctgccaaaataaatacccgcacataccgaacctgcacactgagttaaatgatgctcagcctgaagggagcagcgggcagctactcgaacagcaggtcctcgtccttctcttccgccaggaggttggcgggctccatcaactctccagctgctctccgccgctccaag

SEQ ID NO: 706 - DNA, 480 bp, Rattus norvegicus
  Genbank Accession No. AA893280
gggtccaaaggtgatatttcttcacatggaaaaaaactaaattcaagccacacaagaacatgccttgagggaaacagtgatgaagcctgctcggaccacacaggagcagatgcccattcagagcagaggccgcatgaacaaatctttattcggaacagacagacgtttacagccaataagaacacaaaggccatggacaagactgtaagcgcacctgagctttaaggttctggtgaggtcctcacaaaactaacacactccacataccagccgggtaagaagaactcatgtgtcagggccagcgggggcacgaccataagtgagctgtgaatgaccataatgaggacctttgttcacactagctgcttttctaatctaatcaggttaatttcaatacagcaaataaccgataaaaaataaaaggtgccacctggtcagcaacatcatacactggtgacaagagaacgttactgagttgtg

SEQ ID NO: 707 - DNA, 296 bp, Rattus norvegicus
  Genbank Accession No. AA893289
ggtggtgcataactttaatcccaacacttgggaggcagaagcaggatgatctctgtatgttcaaggccagcctggtctacatagtgagatgacccactctcccccgtaccccagtgaaagttctgaggctgcagctcagtcggcggagtgctttctgggcatgctcaaagccctgggtttgaaatctagcaccacattaaacctggcacactggcacatacttataatcccaacattcaggaggtagggaaaagagaaaatttaaggtcatgattatatacttattgagttcttta

SEQ ID NO: 708 - DNA, 348 bp, Rattus norvegicus
  Genbank Accession No. AA893353
ggagtgaaaatctactttaataacccagcatcagctaaactgagatcctcccctctcaatcaaaggggtggaagacaagtcttggaaagaggcctcagtccaccaagaggttacggcttacagaagggaacagctcaaagaagcccttgaaaagggtgagggtctggagaactccagtggtacaggctgtctcccggatagagtgcatggccagttgggggctgcctaagtccagcacccgaagccccagtcgagaagccaagataggtccaatggtggtaccacatggagagtcattcctgaccatgaggtcctgcagagggactccaacttggccggccacctctc

SEQ ID NO: 709 - DNA, 434 bp, Rattus norvegicus
  Genbank Accession No. AA893357
aatatgcgcgcccaggctgccaacggccacactgggtcacgtgtaaatctgaaaacatttaatgctctttcccctgggtttcacgtataacgcaaaacagaaatatttcaattacatgtgactaagagtaagaaaaatatacaactctatttaaaacacttaaattaacaagaaagggtttttccattctagcaaaatattgtacatttggttttaaacaagagttaatatccagacatacattttcaaaatacctgatgctagttgaaaaatcagtgaccatgaggccttccaagatatttctaactagcaaaactgtgcacacctgggaaggcctgaaggcttttcccccctagaacacagacatcaaacaggccaataccgcaaactgaccgatgcctctaaatccggttgcttcagcttccggaactacg

SEQ ID NO: 710 - DNA, 502 bp, Rattus norvegicus
  Genbank Accession No. AA893384
  misc_feature (1)..(502): n = a or c or g or t
gatggtggcataaattgctttattggagcagctgagctgggctcaggtttctccagtggcctggaagtccatgtcttccaccaagtcctggaggcaggccttgtactggtcagaggtaagggagatcggctggctgttggagatgtgcaagtccacggttttcagtgatgaggctcccccttcccgggccatctctaacagctccttaagacatgtaggaacaaccttgaccatcacaagcctcttgacccacggctggtcctggggccacgattcccccacacagaaccacagagtgtatcgtggggaatgtctgcttccttccatgaaggcaatgagatctgccacaaagggcctgaggtcgaacacgactccgttcttgtccttggggacctctccatcaggccctctcncactgtctggaagcagctcctcacccagggcccacaaggaatgcgagtggcctaagcgctgggcccaagagcactgccctgcccgccac

SEQ ID NO: 711 - DNA, 489 bp, Rattus norvegicus
  Genbank Accession No. AA893406
aatattctaaaatactttaataattaagattggtgggaagactgatatacaatgtaattatttattttacaagattctgtacactggagaagcatcttaacctacaacatgagaagcttttacccttttacattatgattgtaagcttcaaattacagaaagaaacacgtaatcaacttttatatacataaaaacaaaaccacgggctagatgccgccctaacagatgacgctgcagaagacgaatgagatgaactgtgagtcagggcccttgatggcacacacaagcacacggggagtcaggcttggcactgtgaggcagggaaagcagcagggagacaagacaggcaggcatggtgggtgcctctgtgagccctgtaagcagggggtggaggcagatccttggctacattgtgaggtgacatgagagcctgtctaataaaacacaaagttaccacagcacaggcagcacaggcccataaagtgctct

SEQ ID NO: 712 - DNA, 512 bp, Rattus norvegicus
  Genbank Accession No. AA893436
aacaaatatccagtgtgtttaatgccacctcaaacaaagacaccacccacagagcaatgtgaaaccgaaggcaacacatgacaggctcactacatttcatcaatttatacacagaaataaaaatccagctaccaagaggtcctctcccagagtgccggtcgcctccgcgacattctcccctctccctcagcattcgaaccctcttactaagagaggtagcttgtgcccaggctctattccagtagagctggagaatttatgacacactaaaggaagccaccagaccgggcttccgggcaacccacttctgtcccgttcctccttttctcttgcttagaacacaaaagtgaccagcaggccactttgtggtctcgtaacccaatattcaaagccatcgtgcttctgatctgaagtgttttctgaaggttgtggtgttcagctgataaggcctttcgtaactgattggatcactatgcaatgaaggaagggctcaggcttcctcagcaagttaa

SEQ ID NO: 713 - DNA, 466 bp, Rattus norvegicus
  Genbank Accession No. AA893453
gagctcttaaattcattgaaaaccaataatgggagaagtaaaaccctgaaaaggtgcgtatagtgcacgtggacagtagccatttgtattctgaatgcaaagattcctgtcaatatgaaaagttcgggtcgatgttaaacaaactacaaaaggtttgaacaggtcgctcacaaaaggtatttaggttatcagttaccatgtgaaatattttcattgtcgtaacacaccagagaaatagaataaaaatgggggacagtatcactttacacctacgagaatggctaaagtcaaaagaatcgacatgcggcctcctgccccccgcagatgtacaatgtttacacctgacacacacaggtcaccagagtctggcttcttttcatcgaatataaatacctgctttccccaccaccaacaaccaaccagcaaatcagtgcccgtatctacttaaagaaagttaatgggtgct

SEQ ID NO: 714 - DNA, 410 bp, Rattus norvegicus
  Genbank Accession No. AA893454
gcttctcagattttattttgatttgggttcacagcaatcccaaggtgccagagcccactgtcagtgggcaaagtatactttagacacagggaaggtgggtacaccccaccactgacagacttagaagatgcatttggctacagcatggatgatctctggtgtgacattttctgacgtctccataagacactccccatgagtttctatttaattcgcttctaagaaactttggaaatttcaaaataagtggatggtcaagaataaaaaaatatgatcttttttaagctgtgtgtataatgtgcctggtaagttagagggaaatgagttttggaaagcagggtttatgtggtataaaaatactgttcatttacctaagactgataataaattttatggttgaataaaactta

SEQ ID NO: 715 - DNA, 656 bp, Rattus norvegicus
  Genbank Accession No. AA893495
gcaaaaacatcctttaataactgttacctctttctcagtgctcccttctcaagtgactttgtcttgagagtggcaacaagggctactcattgctagttatctaaaagtagattgggttggggagaccctgagaagactggggaaaggcttccatccctcaaagtcagatggcaccaaggcttctcaggacacgttcttaggctggattgaccacttggctcatcatcaggctgctccatgtgaacttgtcaaagagcaggaggatgaagggcttgttgaacttgatgtcaagtggttcagagcgcaggtgtaggggagccccgttggtagaattaggcaacacattcccttcatccagttgtagcatggccttgtggaccatcgttaatgtcaagggaacatctttggtgttgcctgagaaatctgattggttggtgagcaagtccttaatgttcaggtcttccagcacgtctttaaggtcataggtatcagacatggagaatttcgggatgtataggttcacctgccttggggtcataagcttgccccacctatcaattgtgtcccgactaagtgcagcgatgacagtgtccatctggccctggtccggaagaatgaagaaggcagttccatttcccacatagtccatctgtatc

SEQ ID NO: 716 - DNA, 461 bp, Rattus norvegicus
  Genbank Accession No. AA893569
ccaggggggaaaaatcttaaaggatgagaggaacagctctgctaaaacacagacaaagcgccgttccacacaaacatcaatcctcagaactcaagtcactctgaacacaaggaaaacagccacctcacaacgtggccaaagctgccagcaaacctgggagcggctcaatcagcaaagtgcaggaacctcacttctgttccagcccacccccagccatgaagaacccccaccaaagggccagggagggtgaggaggaaccgtgaagaggaaaggaagcatggggacaggtacacacactacaatggtctcctccttgcccactctttattccagctgagtagttcagacaaccgtcctttgttcttgatctggctggacacacctggatcgtgactactgaccctcatccagcttcctctcaagcttgaggactatctcctatctgtaacttttaagtccac

SEQ ID NO: 717 - DNA, 506 bp, Rattus norvegicus
  Genbank Accession No. AA893584
aataatacattatatcatcagtagaaaacaaaacgaacaaaacagccattttggaaaataacgtgctaattgcccaataccagggaaagcaggtcccctccctggactctactggcaagcccaggtatgccctgaactctagagtctccatcttgtatggatgatgaagcattcaagtaaacggtgaggcattctgggtgtgagtttctgagaggtaccacctcagaggagactccagaacagccgcagccctccagttcatccgtggtatcgcgtggtcttgggattaaccagcagttttcttctgaggaactgtgataattgtcagcctcaggatttagtggttataaaacaacttccatattaaaaaacacttgagacacacgaacatgattctcatcgcttctccaacttcttgtacttggcttctagttgaggaagaacaggaattgtgtctttgaacactagtgctcacaaagatattttttagttagattttcaagcaa

SEQ ID NO: 718 - DNA, 560 bp, Rattus norvegicus
  Genbank Accession No. AA893590
aaagggtgaagcactccaaagccaatttattttagacgggctccgtgttacctatggtttgcctcttttctttataatcgtacaacctttgaaaattacataagttgtaatgatctaatactattaatagccattcagaaaaaaagttccctcccgcccaacaaccatccaggggaaatttaaagtcctcactagaggccagctcaacatggcctctaccctggtagaaacaaaaagcaaaaagatgagaagaaaacaaatggactaagaggtgtgttgccagtgtctttcaggagtggggccctggctgttgcctgggtcgtgaaaggcagagcctgcagcatgcagttcggtagccgggtggcctcacagctacatcttcctcaccccggcacatccacagcccggtttaggtgtcgtgaaaatcctttagcagggttcttctccgctgctctgctatgtgcatctggttttccaagtcctgtccaatcgacacaacaggttttataagttccaatgccaggagcggagagcacgcaaagccacaagcggtgtattgg

SEQ ID NO: 719 - DNA, 443 bp, Rattus norvegicus
  Genbank Accession No. AA893593
ccgtagtcttgtggggaaaacccattggcaaatgtacagttgttccatcagggggtgctgctggctgtgggacccccacatccctgacttgcatgcattgtgctgcaaatgttcacagctgatctcaggagaagaagtgaaagggcagagacccccaagagcacttattttgagctggccataagcccagtgtgtgggttgcaggaatccttgtgggataccagacaagggctcaaactaacatctagtgcaaaggccagcagactcctagtgagcatggtttagagtgcagaagacccaagagtgcctcccggagagaaaagagacagcgagcagggaggggaacctggttttctaccctgctcttcgaggttcacagatgtgtcccccctggcagcagggcagaaaagacctgtttcctggctcaggaaaggggcttcaac

SEQ ID NO: 720 - DNA, 564 bp, Rattus norvegicus
  Genbank Accession No. AA893596
ccacattgtggaaaaactaagcagaacattgaacgttttcgaacaatggcacaaataggtagacaaagctaaacaggcagcagggcttacattgtaagtttatagttaaaactacggatgaacatttcagtgcaccacaattccaaactgcaacgaagacggtaggtactcggggatccagctgaggagagatgggtcactgcagctgtactctgtaagcacctattagcaacttcacctacagaagagaagtgaatgtgtcagtacacacagctcccatctttaaggttattgctgtttttagtaaaaatataatcctgctcatcagtggaaccattagaatggttcagcaatccagcttccttcctagagagcccagtggcagtttagtactgaaggtagggtttgggctgctaaggagggaggcctgcatacctgagccaaagtctacactcaagacacatatttgcccaacatatacatcttagttcttcgacatttcagtgttataaggatgtataatttaaagggaaaaaatgagcagttactgtctataaatatgaa

SEQ ID NO: 721 - DNA, 567 bp, Rattus norvegicus
  Genbank Accession No. AA893602
cacatcgaattccattttaaaaacaaaaataattttaattaaaacaatttcttggcattgttcaaaaacataagactctttttacaaaagaaaacttcccatcttggttttaaaaaaggcaaacgaggaagtaagctgcattagacataagaggatggacagcctctgcagccacaggagaaatgtgtttgctttcttattacagttagctccttctgtgggagcctggagtcttgcatttgttttatgcatattgggccttgttgtattacttggcaggagcctgtactcccttgagtcagccgtgctcattggtcagaacacattccagcatctgacatcaatcccattaatcacgggcgggcgtgagtgagatgactcaacagtgagcagtgccggctatgcatggtattcagtgatgagaggtcggagatcctctgaattcagcatacgtgagatgccaaggacaaagtcctctcacatcaaataggtagtgcatgatcactaatactcttaatgcttcaaccttgaagggatttaaatgaatttccacataaagccatcttc

SEQ ID NO: 722 - DNA, 511 bp, Rattus norvegicus
  Genbank Accession No. AA893603
ggagaccaccatttatttttggttaatgccaaccaggaacactactcccgtagtacagtctgacacaggatcctcaggatgacaacaatggaaagcaagagcatggcaggtttcctgtttcagacctgaggtttgggagcttggggtctggccatgaagagcccactgctcataatcctcccaacacgcagagaaatcaagtctcaagtacttcccttcatctgctgcctctctcaagggagttttgggtttccctagaatagatgacaaagtaatgtgctgggtatggcggctcctccaggcacacaggccaaggctggaggagcatcttctactgtgcccaacctgggctaaataggcagatactatcacaaagaaataaaagccccaagtgctctaataatggacagatattcacaactcgaagcctcagtttccccttctgtaaaatgaaggagctgggtaggtcaggatcagtattttggctaagggtatgtggctaagggataaa

SEQ ID NO: 723 - DNA, 515 bp, Rattus norvegicus
  Genbank Accession No. AA893607
cgggtgaaaatcatggcaaactttattggcataaatcacaggagttgaaatgggaaaagccaggttagaggtttaaggtaaggaaaaaaaaaatcaaatgatcatatatccatgacccagagaatggccctccaggtaccccagtctcttcttggaggggcctggagcaggtaggtcactgtaaacagagcagtaaggcctgtgggtggaagtgtcggtcggtgtcgtctgcagcgcccaagctgaccttgagctgggctgctgctagcccagtcctgactgaggacccttgtctgggaccccatcacactgggcctctgctaggaagctgatgtactgtgtaggtccccagcctatggaaccttccagagtgccttttccaggacacatgaggttcaaaattccaggtccaaagggctgaacattcttggaccagttcttaatgaaaagtgttggcctgggcagtaagggaagggtttgagaatacagcagtttaaaaaacagtcctgggagct

SEQ ID NO: 724 - DNA, 298 bp, Rattus norvegicus
  Genbank Accession No. AA893612
catgagaattgccatttattcccgaagttgccaaaatcatcaccaaggattcaccaggggtgccaagggaacgaggaggctcaaacactgattgggggttgtcagtttagagggagatgggatgggtgggggaaccccagctgtccctcccccatctaatgccacagaaaagggtcctcctctggccggctcccctccccatccccatgtccagtttttctcaaggggaggtgggttggggacttgggaagaggttgtagtgtgagtgggccccaggagatggaagggcactgggggt

SEQ ID NO: 725 - DNA, 561 bp, Rattus norvegicus
  Genbank Accession No. AA893626
acattaaaatatgagttacatttccaataaaacaggaacaatttatattgtatctacaaaatttctacaatatatgctgtactttaagtgtgccaaaaaagctgaggaatgtcctatcaaccctgcgtagtctgaggcactggccctgaagatgctggtgtttaaattgggcagtcatagacatggatctcctggtcatctccaacagacacaatttttgatccatttccattatattttactccccaaacctgatcctggtggtcaaagaaggtgtgaatacaggtccttgttccaacatcccagacctttacacttttgtcggatgaactggaaacaaagtgagtgtcatctggacagaacgcaacattcaatacccaggatgcatggccactcagtgtgccagccaaattggcatgttgcacatcatagatcttgatgtagccatcatctgaagccgtgacgaggagctgggagtcaggggaaaaggtcaaggatcgaatgggcatcgcatggccttccagcgtgtgcagaagctttccagttgcaatatcaaaaata

SEQ ID NO: 726 - DNA, 346 bp, Rattus norvegicus
  Genbank Accession No. AA893658
agtaaaaacacaccaaatgacttttcactcggctgtgcgacaggcattgtcttactacagctccatttccagaacccaataccaggggctgagagtttaagtataagaaaccagaaggacagttgaccactctcgtttgctcgatggctactagggccaaacctacattttaaacacaaggaacacttctaaaacgggcgaaagaaagcctcgcgtccgctctaaacttggcttcgcgtcattggcgtccacacgtctctgcacgcaagatgttacttcctcttggttctgtggcccacaatcgcttcaaactgaatattctgtatacggtttatagcttttaagc

SEQ ID NO: 727 - DNA, 503 bp, Rattus norvegicus
  Genbank Accession No. AA893659
actggaaaacatgcagcagcatggaggacttttattaagtttataaacaccaggaactgtaataaaatataaaatacagagcatctctttttttaaatatcaagtttctgaatgcttcattcgtcctttggtttcaaaccatacaatgcactcatgatacactgttcatgtggcaatgggacagtgctctgcccaactgctggggaggaagggtgctgtaggaataccaaagcacggctttatagaaagggaagcattgaagcaaaaatactttctgaatatatatgtgcatatatatactgtacattgtaaacaaacgttcggagtaagaaccaacacaggccaagaaacggtttccagggaaaccaggatcctcttccttgtccacagcggaggctgaggtggggcctggtcctctatttgctcatgtgcttagatagcgtggagatgactaactgatacattcatttgctaatggtctgtccatctaggttggctggctg

SEQ ID NO: 728 - DNA, 485 bp, Rattus norvegicus
  Genbank Accession No. AA893667
aaagacagacccacaacgcctttcaaaggtgaaaaagaaaatgccctttccctcctgggtcgagggtgaggggaaggatagaggtcaattcattcttctctcagactcgctctcatccactgggtgtcctcggggaggaccgttttctggaagccagtgcagaagggtgccctgttctctctggtgtcccaagctcagctctgtccagtgtccgaggagcctcctcccaggaacaggggctggctgtccctgtgtgggtcggaagaagtcagtcctgctccatctcgatgagcgctgcgctgccgctccatctcaccgtggcagcagcgtgtaccccctgagggcgggctggtcagctggggcatctggttcagtccaggcaggcccatcagaagccaaacatcatgtcggcaatttggacctgcactctggagctggggtccaataactctgcctcactcatccttgcttgtcatcagattttg

SEQ ID NO: 729 - DNA, 461 bp, Rattus norvegicus
  Genbank Accession No. AA893670
ggtagaaaaatcattgtattgaataatcacaatatttctctatagacagatctctacagttccagtgctctagggaaatgcttccagaataccagttgatttcagaatacaagctttgtccagaccactgtccacttaataaatattgaaacctatactactgagactcagactttattaagattttcacatataatagagcatagtttccattgcatccaaggagcaatcagggatggcagcatgtcattttgtaacaactgtcactgtggcttttcgattctggtttgcagaaaccttatcctcagttaaatctagtcatgcttttaagaaatgctttaggtcactccaagcttggcaattaacatttggcatgaacaagggtaaaaccagcacaatagagaacagacacaacctcacaggccataaacacatacagcaaaggatgaaaaaagagaaag

SEQ ID NO: 730 - DNA, 497 bp, Rattus norvegicus
  Genbank Accession No. AA893683
gagaaactaaggtattttatttgaaggaacccaagtgaatgccaagtgtaaaaggtggagtgctgggaggcaaggctgtcagtgcactggcggcgtcagagcctcgtacagtctctgggcggccagttccaccatttctcggagggactcatcatcctcacttccttcttcacattctacagcccgagtctccaaattaatatttgctgtttttccatccaccgtgacactgaggacagagtcatctttcacactgacacagtcttctccaaatatgtcctggagcatgacctcaagcctcttgctgtaaacgtgcatctctagcttcttagagaccttctgcactgcacctttccttatttttggattcgactgaacttccaatatcacggtggtcactgtgtctgcatacatgtcgttagaggggttcgccagccactccaggaccaccatgcccggctcctgcaccacggtgatgcttttgaataccttcaaag

SEQ ID NO: 731 - DNA, 533 bp, Rattus norvegicus
  Genbank Accession No. AA893708
ccatagaaaacaattttaatgcaggtattacctcagatgcagtcagcagtcaaattagtttctcttctgaataaacaaatgaaactagagttgtttttatatttataaataaaaaatatacaaaacaaggaaaccagctaataaacataaggactgaacattagctggtgtcattaaagccgtacagtgagtatgaaatccaaaaggtaacctcacttagactttataaatggaatgtcccaggctgtgctccagataggctacttggtctctgcgggaacagaaggcccatcttgtggggtggcagcttctgccgctgcagagacaggctcggctgcagtagtaatgtcacacagagcagaggtatcttctgtgtgactggaggcagcctccgtctgattggagcagtcaggctgagaagttggggtctcttgactcaggctggcatccgttggactgggtgtgaggttagcttgaacagaccagtttcctcttctgcttccatttctgtttcttggctctgaacctcctca

SEQ ID NO: 732 - DNA, 449 bp, Rattus norvegicus
  Genbank Accession No. AA893741
ggagaggacactgacccgcagggccccgtgggggctttattttgacaccactttgtttcaatacaaacagtgctgaaagaaagtcatgtccctctggggagggatgagggaagagtggtcgttgtttgggagcccaacctgcaagccacaggtagaggttgggcccagactgccagcgtggcagggtgagatggcaccaaggatgacacagtgcatggcccagctgccagtgtttggagcctgcagctgcaggtcctcaagctctcactggttgatggggtgctgtccaggacccctaaacccaggatgatgcagaggataaaagctgagctccaggggcttctttctctcagagtctcagctttctcagctaataggttcacagcatccaggcaggacacaggtgagactcaccatggggccaagcaggacaccctcgtgccgaattc

SEQ ID NO: 733 - DNA, 487 bp, Rattus norvegicus
  Genbank Accession No. AA893793
gacaggatttcctttagcagttatttgaacacagttatttgtacagctgcagacatgacagcaaagccacaggctctaaagggctgtaaggcttgtcacccccaggggacagaggaaagggaaggcaaaggacggagagagggcaaggagagagtcttttaaaaggaatctgagatgtctttcaatttttcaattataagaagaaatgacaatacaggaagtggtgacatctgacaatttaagcattttatccagaaacatatatctattccacagataccaaatccattaccatataattgagtttgaaaatatacaaaatatttgttgttcttacatactgaaattaaatcctaattttaaaaagtgcacagtaaaaacagcgtaaggaaacctacaatccatgggtatgtctattgttctccatttgactgtcaacatgaaattctgcattcgcctcgctgtttacaaatgtctcaaggtcaca

SEQ ID NO: 734 - DNA, 464 bp, Rattus norvegicus
  Genbank Accession No. AA893811
catcagtaagaaaatgtttattcttttgaaccccacaggggaaaaaaaaagaatgcagccaagaccaagtttaacgaaaacagtgtcccaaaggcagcagaatgggggaaacctcatcaacatagtgacaattttccatgttttagcacaaagatggagaaaaaaacctctgacaattctgagtaacactttcatggtgacatttacacaagatgactcaaaagtgcaaacggcagcaacatgcacgcacacctggcacgcacacctggcacgcacacctggctaagctagaagtcgcttactccaaaataagctctgtgattaaagggatgactgtaacacttctaattgtactgactggtttgtcctacctaatttgctttaaatgagatatacatgccaatcaacaggaaattttagagccatgaccttccagaacacacagtatggaagccaagccaatc

SEQ ID NO: 735 - DNA, 419 bp, Rattus norvegicus
  Genbank Accession No. AA893860
gaattcatacaaaataacctgggtacagaaaacatcctccatgattttccattttggagagagacatttaatggcccccatctaacagcattctctaagacttgtccagaccagaaaggctgatccacgaagactcggcagaaccactccttgctcatcatgaagccatgtttcccagtgcacaaggtcacgtgatgggcacccatcttcctctacactgatccagctcgggccatgtgcctgttaaaactcctcctctgcctgcttactgcgcaactgcttgagctgctgcagccgctccactgtttcccccacagtccgctctccgtggaccttgttgtctctcgtgcggatgttcacagtgccactggctttctctttttcaccaacaacaatgatgaagttatactgtgccaact

SEQ ID NO: 736 - DNA, 392 bp, Rattus norvegicus
  Genbank Accession No. AA893885
caggaacttggtactttttaaaaattccaaatctttgcacacagatcagcactctgcttactctggaactgcagatgcttggacttcacgattgtcacttctctccttgtatcacacagcatagaaaacccaagtcctgatgctccccaaccccttctgaactactacagctactctgaccagctgctgtctgaatacattctgcagtgtgggggaatagctataccaagttatgccacacacattctggaatgcaccgtacccaggacacaggtgagtttccctttgtgttctgtgtggttcaagccaacactgctgaggttatctagtccctgagggagctcagaagtttggtaaaggtcaaagagagactccttaagcattcagcagtg

SEQ ID NO: 737 - DNA, 355 bp, Rattus norvegicus
  Genbank Accession No. AA893905
caaacaactcaactttatttatctggaaaatggatgagttcattcagtggtgtttaaagcctgagtctgcacgttctccttagaaaggtcagctatgtttggcaggggctctgacggtttgaaatccgcctgattttccaactgggcttcaggccggtcaccccagaggagatgcttggggtcattgaggaaccgctggcttcgctggcatgtcagacaggtctgtactgtccagcgttgtccctttcggcgtctctggcgctgcgtgcaggtgaggccagggatgaggagagaggagcagtcgcgacagagcgtcctcttcacagaggggtcctgccgtaggaccagccgcttc

SEQ ID NO: 738 - DNA, 451 bp, Rattus norvegicus
  Genbank Accession No. AA893933
aaaaaaggcactttattctagcattctgaaaactgcagagatggacacagtctgtatgacactggctgcctggggtgggacagaggggctgagagtgaaaaggaagatgcctcaagagactcaagaggaacgatggcaacttgatcaggtaggaaccatgaggagatgcaaacccgatggttgtttactgtaaagtcgataaagtttgttggaagatggacagagggtgaagaacagctgcgtttcaaggcacaatcctaggcttagggttaggtcctgacacaggaaactgcctttcccatgtgtgctttgcttgccccgccgagcatggatacaaacacaagaatctcaccagaagctcaaagaagaaccaggcgtacttgaagacggtttctctcactagtccagtgctgaccaccatctgcagggcaagctcctcatggaaatgcta

SEQ ID NO: 739 - DNA, 520 bp, Rattus norvegicus
  Genbank Accession No. AA893970
aacaatgaatccctttgataagattatgcttcaggaggctttaatgcccttaacataaactgtacacattatacaaaaacattacaaccacaataacagtaacaacaacaaaaatcaaagtgagcaaaaccatttggggacaaatcttatttaaattatacacaactcaatgaaatattcttaaggaaaatatataaatactttttctttctatgttacagttatacaatataaatcagatttcaatgtctgttcagtgacctacaaataccagaacctccaaaaatgtagcagcgtattactaaataaaaacacgttatgtggtcggagagcattagctgagatcctctctatgatcccttaccactcttcaaagctaactgaacttacatcatttgtctcacaatgcatccttagggtttctgacaggccagcaatggaacatttttcaacaatcatacattaaaaatttttaccactcccgctctgccccaagactgcattttgtgctacatcaact

SEQ ID NO: 740 - DNA, 407 bp, Rattus norvegicus
  Genbank Accession No. AA894027
caattcaaagcaaggtttaatctgtgcacagaacagccaatctggcggccatctccccgtaaagtttgagttctggaactgaagggggtggggttttgcaagcaggaagaacaaggcagttaaggaaatcttctcagaacatctggtacagaacattctttggttatgggatggggtacagctaaattctgagaagcagacattggaacgtaagttttacagtaaacagagcctcgaaacgactcctggccttcaaatggacttgaactggtttctgactcatctgtcttatgtgttcctgtcacataagcctcttggaagctaacatttctggctattgtaatggctactagtggcaagcattttagcattctttatttgtccgtagacaagccttgtgaagcgct

SEQ ID NO: 741 - DNA, 444 bp, Rattus norvegicus
  Genbank Accession No. AA894030
  misc_feature (1)..(444): n = a or c or g or t
aagaaaataacacctcttctttaataagacaatgaccatcagacacacagccaagattgacttttgcgaggagtcttgtatgggtggaagactttaagggaggtgaatgttcagtacagataaggacatccagtgtcttacactcaaatgtcacagcactgcgtctcaggagggcacccacatgttgccatgtgtgtctggtgctttgacataaggaatgttccaaatccatggccgatctttactcccgtagagctctgggggcaggtcatagggcacaggaaaggaggccatcggctcactgctgctggagaagaattctgtttcactttgaaggtgtccaggcccttgtgacaaggaaccaagccagtttactgaagtctggtgagggcctcatgtacgtcttaatatgtggcatggcattgcttcggncggatgtctctg

SEQ ID NO: 742 - DNA, 621 bp, Rattus norvegicus
  Genbank Accession No. AA894084
  misc_feature (1)..(621): n = a or c or g or t
ggcaagagatctgaatttatttacagctaggcatctatgtcttagacattcgtttaaaaacaacaaaaacaaaaagaagaggcaatacctagtcgataaagaaaaaatggtataatctatagcttaacagagtatgtatgtgctggaaatgactgtttcaatattcagcagataccggcaatacagtattaaaagaaacacttttttttccctttcctttagcagtacctcatgtagctcaggctaactgaatctgctatgtcaccaacgctggtcctgatccaccagcctgcctcccaagggctaggattccaggcataagccaccagacagggctaaacaataattcctgatttagaaatctaaagtctctagtggaagtttgacacttccagaatcccgtaggtctccgggcggggaagtggtgtggttggtggtatttgcctagcacacgtacaatgttctgggtggctcctgagctactgggaagggtagtgcacacccgtcaccaggaatcaggaagacgaacaggttcaatgtcaccttcaggctggcccactgggtaaaggtgcttgatgaggacatacattgacaanagaacataacatggaccccccatgc

SEQ ID NO: 743 - DNA, 613 bp, Rattus norvegicus
  Genbank Accession No. AA894089
cgggtcaaaactctagtctttgcctggcattctgaaaagctttaatcttaacctcagtgttatataaaccaagaggtctcgaagtagcaaaagcaaagggaccagtgaaaaagcatgctttagaattcagtttattttcaatgaaaccaaactgtactactgttgtgatcacagttttcacatctgatgtggaaaggagagcttaattctgatctcttagtggcagcacttcagacaaaacagaaacgtatgccacagagatgactactgacgttacaatggacaccatgttcaactaaagaaaatggatgcactgcttcaacattcagcttgaaaatgtttagtatcttctgcaaacctaaattcagtttagaaaggttaatattctctttctaaactacggcatatactatatagagcattttaaatatatttatatataattatttgcacatcagatttagaaggaatttgcagatttactgtgatagaatttcgatctcatttccccgtgacggcttacggggcttcctcagcattgtcgtttgcaggcgaggcatcaaggtctggttcagaggaagcagctgcagatgcgtcaatcactgcaggtggg

SEQ ID NO: 744 - DNA, 556 bp, Rattus norvegicus
  Genbank Accession No. AA894090
gctgacaatttattgaagcttatctgatcagagcttgcatgaatggacatacaacatcaaggcttttgtaataaaagacaatttgaaataaatatgtgtttaaaaaaacctatgtcaaacactaatgaataatcgacatttacaaattttaagaaaatcatttaggttaataatttttatttcccccacagttaaatagctctctttaagcaggagggagagagacagacagaaatgaagtcatgcccacagcacagtcatgatgttactcttagtgagggactctttaccaagattaagacctagaggagtatctgaggagaatggttaccgagtcgtctggaacctgggagagcattaggagagcgaaaacaagtggcaaagcagagagaatccttagatggaaagtccgttccccttgagaaaaattaatgaatacccacaaacttccatttttagggtttcaatattttcatatcagtttaacctctacccccaaatccaaccaaacaccataaaaactaagttgtcggataggcttagctggctgtactcc

SEQ ID NO: 745 - DNA, 622 bp, Rattus norvegicus
  Genbank Accession No. AA894101
gccaaaatgaggctttatttcgggagacagtaaggatggaggaagtaaaagtgcgcaggtgtgaattccaaaccagcaacggtctcttcaggccaaaaggtgaattcttcggtaacccagatctgatgttagttccctggagagatcttttcccataagccatctttattttttctgtagaggagagctttatttccaggaaacagtatattctctggagatgggaatttttttaaaaacatcaaggtagatctaatatggtcaacaaagtgggggggctcagccagaggagaagtagaaaggtttgggcctcctgctaaagctctcgcagcacgcagttgctcctctgggccacgatcttgaaaggaagctctgtaaatctctgcagttttaatgttgactgcgatgccataaatgattggaaagtgattttcattttcttcccggtcatttaattctgttacacataatgtcactaagtgaatgtcatcatcctgtttgtcaaattcactaagaagctgatgcgtaagtttctgtgacaactgcctatcatcactgaatcctcccacaaggtggacttccagccttccgcactcggcatgttcagagaaggattttaggg

SEQ ID NO: 746 - DNA, 494 bp, Rattus norvegicus
  Genbank Accession No. AA894130
aaaaggcccactttattaaacacattctttctttcagaatcctgatttttaaaaaacctttatctactaaaaaacagacatataaatcaagcaaacagttaagactacaggaatggggctcctagtgacgctgaaggaggcgataggtggggaagggcagagggctgtggggagggaggtcaggaagaggctctacgcagcccacaggctgggaaacaaagaccaaactccctaatgatctcaggcacaagcgttgctctgtcatggtgtcccccaggctctctgagaactggggcctctacaagacacaggtattcttcaccagctgctccttgtcatccgcagtgctccaaacagtgcggagagcacgctcctgctttctgcgaaccattcggatcaggaacaccatggaggatcccaggaggaggatcaggaccatgatgaacagccccaccaggatcaccgcttttgtgcccggagtcaggaaaggatac

SEQ ID NO: 747 - DNA, 455 bp, Rattus norvegicus
  Genbank Accession No. AA894131
aaagatatatactggcatatctgtgagttaggtgcactgcccaagtccagcagtggaaagattacaaaagatacttaagaaatattcacatagaaagcatggtaggagaatgtcctttgtaaagaacaagtgcattccgtacaaatgagagggctgtgatagtgtttccaggctctagagcctcccacggggctgaggtatactgactgacaaggggcttgccggcttctttcttgtccaacactcactgaagtctcattcgcttctcagggggacctttagtgcttacagtctgctgagcgctctttgcgctctccttctcctcggactttacagtttctggcaggggctctgcctctttctttgcctggtccactgggacaggcttctctccagacttttgctgaacaaatctgggtggaagtttctgtctgaggtctatgagtaaagcatcc

SEQ ID NO: 748 - DNA, 426 bp, Rattus norvegicus
  Genbank Accession No. AA894168
tttttaggtgagaaattcttttatcatatttagaatcaaaatatcccttaaaatatttacattttacagtaaaaaggatagcaaaacacaagatcatgtacaagcttaagtattcaagtttctgaagagcagaaaggaaagggatatggcctaccacaaactgcagtacagggtcagaaccgccttcagtgagcacagattaaagcaacaaatggactccctgggctcttgattcacagtcaaaagctgcccctaagtcaggatggtctgactgggaagtctcggctttcttgccgctcctctacattttctttaaaaacagtgcaattgaaaacaaatgtacagagcacaaattacttccaaattagtcattatataaaggacattcactagaggcaggaaatatatttcatagttaaccatatt

SEQ ID NO: 749 - DNA, 589 bp, Rattus norvegicus
  Genbank Accession No. AA894188
cacaaataaaaatactttattatagaaaaagcatcccatacacaggattccgtaaacactggtaggtgaacaagtgcaacttccaaagtaaataaaatgtaagaggcaaaatccacacattgcccttaggggagaatgtaattctccagattagaagtccatcagcagacactggagtggctctgcctcctaaaagggcagcagtatcctcctgagctcgttgcactgacctcagaagtcgctgatggccaacactaaaactctccacttgagttgaagcctgtgctcggaacatttatttccctaaggcacattctctgactccgagaagatgccccttcctggatttcctgaagagcactcgggcctgtacacatcagacattacacagcatctcctgaggcgctggttaaatgactgggttacccacttccctcctatcttcctcaaattttgccatcacccccatccgttacattctaacactgtgccccgttcaccaactcctggtgcaggcgttccctatcagctccacagactgcaacagcaagcaggtccgacctcaggctcagccttaacttttatcttg

SEQ ID NO: 750 - DNA, 560 bp, Rattus norvegicus
  Genbank Accession No. AA894200
cacagagagcaagttttatttggtgaaggcaaacatcatccaaaagaaaccagacaggcaaggtgctgtgattagggagcctctggggccacacaggaatctcacactgggcaaggagcaggctcgagacacgtaaatgtcctcagccattcagcaccatccggacaagctctgtaaagagatggggtggagtcagccaagcacagggctggggaggggtacccatgggccaggagaccacaagaccatgaaggtggcatgagggaacgtgcccatagcagccaaccttggggtcagtatccaaaacagccaccatgagtgaccagttctctctgtccctggttcccctcccactagctgttagcccccaccccactctaaatagcaagaacacagcagaggcagaaaggttctcagctacacctacagtcactgtcagccgccggcaggaggagcggcagtttggggtgaggtacctccaagctctccaagctgtccagcaggggtggaaaaaggactgtggtgtttcagcagcagaatggggcagttagctccccagc

SEQ ID NO: 751 - DNA, 630 bp, Rattus norvegicus
  Genbank Accession No. AA894207
  misc_feature (1)..(630): n = a or c or g or t
aatggagtgtgctggatgtctctacagttttgttcagatgactacagaacctggaaaagctgttgctgctgttgatgcataacacactgctattattggtctttttatataaatataaatatatatatacagataaataatttgaattttttgaaactttacctgtgctgtcaactttggaaaaaagtatccccgtttactgtgttgagttggcactgtaaagaaattaacagccatattggtctagaaatgttgaacttgagttttttccatttgtacaggggtaacacactgtattaaatatgtaaggtcttatctacgtgggtttgattacaaaaactaataaagtattctctaaattaaaaaaaaagatgtatgtgtactaagggctgagtcacaccactagaaatagtttttttgtaaaataaataacttaatcgtggggttcacattgagatcaaatatcctacaacaggtcggtttccaataattcctcaagacgtcaagtagcgactagctcctttccagcaatccagctctgctctgatgccatgtacctagagaccacatcacagattcacagaagcagggtgagggttcagcctanaggagtgcccctctacctctgac

SEQ ID NO: 752 - DNA, 592 bp, Rattus norvegicus
  Genbank Accession No. AA894212
gcatgtgtaacactttattgggaaagatttatacattctgacctgtcagaggccaaggatgacactgggtggtaggttgtatggggagcccagaaatggctcagacagaagctactctaagagcatgttcccccagggcttttcacttgcacatttcagtttcttcttcaggatgtgtgagaccacggtctctgaaacactggtttgatgataaaagcaaagaggaaaacaagaaggacatctctcccctctcccagaacctggccctgaaattcctgccccaatactggggacccactgggagtctgtctaagatgccggatgaccactggtccctgcaagggcattttgggaagtgtggtgtttgaacacctgaggactgttgcagagataatagggccaagaatggacagtaataccctgatgctagcagagggaggcttgaaaaggtcaagatgcagggagaacccgggagaagggtaccccagctttaaataggaggcggaaggattagttgggaagaaggaatcctctccaggctcttagccaaacaagggattcttgctgggtaaaggaaaatacagcctggttc

SEQ ID NO: 753 - DNA, 461 bp, Rattus norvegicus
  Genbank Accession No. AA894234
ggctggtgacagtatggtggctcacacgacatggttccaaatctgtcactaccctccgtgaggcccctcaccggtctccagataccaaggctccagcaggcaaaggccgttcttgcatctgtgaccatggctgctacctgccttcatggcaggacctcactatctctccaccaacaggcttcacatttccagggttcctctcagacttgggccggaccccatctggaggtctgagcagcccgaggtgatggggcacaagtgtcagcagagtgtccgatgggcccaagtctagacattggccttacgggctgagctgagggggatctccttgagctccgtccgcatgcacaggtactccccgatgacggccatgagtgcaatgcacacagcttggaccagccaccaggtcagcgccgaggggaaacgggagctgtacagccagcagcccaggaggtgacaga

SEQ ID NO: 754 - DNA, 672 bp, Rattus norvegicus
  Genbank Accession No. AA894258
ataatctttattgagcttctgttacagaaggggtgtgacatttgcccttatggtgagttagtctggatgcgtgttctcagcccgaatgagaagtaaaatcttaacagagcacagaatagaaaggaccttggggatcacttagcccagcccattattttcatggaggaaatgaaaccaaagaaaggagaacgatctagcgaaggtctcacagcaagggaggctggtccctgtcaatctccattcctaaccacagtactctgtgctaagctgtttccccaagcctttgggtttgctggcttgctttatgtggtcccactggttaaacaaccaaactatcaggtacctaacatgacggtagggacttttacttcagctttaaaatcagcatatcgaaatgattcctgagcctttagctacttcattattgagaatgcagtccacagtaaatcatggctatctacggtagtcatcttcaaatgtttgcacagacaccaaaagcactaatgacacttgtacgaaagcatccatgcgattccaggacgcttctcatggaatacagcggcaccatggtggtgaccagaagaggcttcagtctctcaaagtgcggtcatgagtttgtcccggtatgtgacactgtacgcccctcctaagttcctctggatctggtcgtgg

SEQ ID NO: 755 - DNA, 582 bp, Rattus norvegicus
  Genbank Accession No. AA894259
cacatacaagtgtaataaggttttattaagtaattaaggggacgcatcacaaaatagaagcatgcaacccaacagaaacggatctgggatttcgaggggcgggggtggaggcgcaaatcagtcacaaaaccagccacttcctcacccaaacgacaataaggtcctgtcagaaacggaggcagcaagtctgacagggctgtttgttactcctgggttttgtaatgatttccatggagctttcaagacccagccatacactcaggatcgagacttcatagtggatgccgctaaccccaacaagatggctacgaccgtgaaaccctgggcagcgatccgggtgcgcatcattagttgggatcggtggctctggccgcggtggaagcagtaaaggccataggtgagtgcagccgccgtacccagacagcctataggcaccattgggttctcacgggtcttgcgaataaacttttccttgaagccctctggattggtgtagaccgtggggctgaagccctcgataactggggccttggacggatcaaaaggcgcctctggactcacaggaccgggagccgccatacc

SEQ ID NO: 756 - DNA, 573 bp, Rattus norvegicus
  Genbank Accession No. AA894273
ggcgaggtttattacggcgacctattacagagatctccgggccgacacgtatcccgcgcaggagacagaggtgtcgaccccgaaactcaaaagtcagagggttatatagagaaggctagggggttttggcgtggatacatacaattggctcatttaaacatagcagtgagaacaaagcagaaagagtacgtgttagaagtcaggggctttcagcaggggtcaatcagccagtcgcagaggtctttcctccacccatgtgtttctgtcagtgtttgacactcctgctgtggtggctccaggtccggattgggcagcaaggtgaccagattgtccccaaccggtggagaatctagtccatggcagctgaccagtggtcccatcttttgggacactctatcagccactctatcacagtttaagtcctggattgggtgataattgttagtgcccggctggcaagagtgatgtgttccaagcagaacagcgctaagccattcatctcccagcatcagttactggtgcactgagacaggtcttaagctctacatacacagtctatacatatgtatacac

SEQ ID NO: 757 - DNA, 552 bp, Rattus norvegicus
  Genbank Accession No. AA894282
tgtgttttttttttttttttttttttttactggggagaaagtttatttatcaatttcacttttcaaagtcagatcataatttttttaacttttcccttaggatggatactcaagtgtttgatttggacttctatctgctctgaacttaactgagaagactaatttgctatttggtctaattatataagaaacttttacataaatggaagggttgcacattaatcgggttacctaggattgataaagtcaaaatgagtctttgggtttattaaaatctcatatagcttaaatcttttcagctataaaaaacctaatacaacagattgactttgtgtagttcactagcatatcacttacattgattcactggcactttaagcataagggcaaccttttaaaaactggagacctttaaaattaggccataagatttttcaaaacagttcatggtcatacattcagcagattcatactaaaaatagtcttattttgtagaataaaggccaagagaacattatgttacaagcttattattacatgtatatacatggc

SEQ ID NO: 758 - DNA, 554 bp, Rattus norvegicus
  Genbank Accession No. AA894297
agccatcagaattccctttacatccattctgttgagcagtatccagtcaacctgctcatcctgcttcaggtcatcagttgtatttaggcacaaaggttttagttttgtctcgacaccaagttttaatcacttgaggtaactgctacagcaggaggaccttgttgaaaaatgtgctaaacacttttcatcttctgtcagtacaaattaatgtcctttccttaagtagagttaggcatttttggttttagaattggtacccatcataaagcaagacacctcacctgtggagtcagcattagaacacccagtgtcggcagcccctgcatgggcacggccagcacaggctctgccctgtggcctcggagactgtgctactgagctctttggtttgctgcatgcagccatgcttacctcttctgccaccacagggtcgcttttgtcagcaggtgccaggccgctgtcccatatgccacactaggactctggggctgcttcacatattagacatagtaagctgtaacacagtaatcgtgatggtacaaccacccagtcaa

SEQ ID NO: 759 - DNA, 588 bp, Rattus norvegicus
  Genbank Accession No. AA894312
aaaaccataggaaaatgcctttattgttacattcttgaactttgtaaaaaaaacaaacaaacaaacaggaaaacgacttatagtctaattgtttcaattcttactaaaataaacaaaagaaccgaaatgagatataagcattttaaaaagtcaaagttcattttaataaagccatgaacttgaaaacttactttaagctacaaagctgggtaaggaatagtttgttcttcaaaagcatctcatctgttctcagttaacgacttaactaaaccctaaatctaggccctcagaaagcacagcggaactgcaaactgctccagaccgcagtgccctgcttccatggcagctgaggagaggtgcttggaaagaagcagggctgaagggaaccaagaacagttactgcacagataggtaaggccacagtgagctccgccctgcaccactgacacagcctggaggtgtgaggtggggaggcagcgggctgcagctgatctcaagagaaatggctgtccagcgcagccccagcttggggtgagtaagaaggctgtcaccaccacattttacaggtggccttccccttgaacaaac

SEQ ID NO: 760 - DNA, 479 bp, Rattus norvegicus
  Genbank Accession No. AA894316
gaatctagggcatctcagggatccccgggaacaatcttgcctcaggcccctcccccgcaactccctgcatctgcatcccccttgcctgaaagcccttctaagctcggaaactgtgagctaaggagacatagcacaaaatcataaatgagttgcggggagaggctggaaacagtgtgcaagaaatacaggccaggggttggggatttagctcagcggtagagcgcttgcctagcaaacacaaggccctgggttcggtccccagctccaaaaaaaagaaaaaaaagaaaaaagaaaaaaagaaaaacaggccaatgctacatgtgaggctttgtggctgggctgtgacccagcgatatgggcagtggaggggatcttttgtctttggggactctctggagcccaacgatccaggctgtggtgcaggggatagtaaagttaaaatgctacccaccttttggccggttcctttcccctcaacc

SEQ ID NO: 761 - DNA, 569 bp, Rattus norvegicus
  Genbank Accession No. AA894318
tttttttttcaagtttccaaacaagaatttattctttattttttttcccttaaaaaatgtaccaggtacaatttttcctgttttttgttttgttttgtttttcaagtttcagcaaatgcttgttcccctcagccaagccccaagagttaagggttgaggctgggtcagagtcttaagtggggagtggagtaactgggaaccatatgactgaatgaggggcacccctcatcccagctgaggtaggtgggtcagagtctggtcaggtaagaggaggttccccagtccttaggcctgactctgtccctggacaccttcctcagtcaggacaccaaagcaaggagacaaaggcaggaggagagggacaactgagtctgagccctaggtaagaggtggttaaacccctgtgttacacatacactcaattctctctcgcgcaacacaccctacacaaacccaagtttgggtgcacacacacagttgtacacacacacactacacacacaccacacacacacatacacacactggctttcgaagatgggttgaagggcagggaagggaaaaggaat

SEQ ID NO: 762 - DNA, 261 bp, Rattus norvegicus
  Genbank Accession No. AA894338
gagcaataaaggggtacatacacttgtctgctcctagaaatcgatacatgcacacgactgcttcgaagggaaggatgctcttcatgaatgtcacgatgtacatgagacgaggggtgcagatcatgggctggtcagtgaggatggccttcatggcatgcttcacacagtaatcgggcttcaaagggggcaaaaagggctcgatttcttttctgattcggcagcctctgaacatgcccgtgtctacaaggtaagcctcgtgcc

SEQ ID NO: 763 - DNA, 580 bp, Rattus norvegicus
  Genbank Accession No. AA894340
acaagagcaaaactgtctgatgcagtcaaacttattttgccttatacccagtggtatttgaataattgtaattcaaacatatcaagtcctcactcatttccttcttttaagtcagtcacagtataatcattttggtaaaatgtttgtattctctctcttttattcatactgaaataatacaatatttataaaccaaactatttgctgttcagaaagctaggaagattcttctacataataattttgatatgctaagaaaccacacaaaactggcattttcaaatggataaaaataggagattgctgaaagaaaacataaacaataatttgtatctaaataattttaactgagtgaatatattcatctgataatatagcctctatcttagaatatagaagtgctcagattacctgtaatagagtaacggaagtctcagagaactgaaaataatttaaataaagacggtacactgagagcaactacacagcaaggactgcgcggttttatctgaggcagactgatgatgtctgcatttctataatgtacctttctctaggcctgggaggattttaaatgact

SEQ ID NO: 764 - DNA, 510 bp, Rattus norvegicus
  Genbank Accession No. AA894345
gacatggcagtgcgggtttaatatacatatatgtagaatatatatgtacacacagttagcacggtcaagatggggaagggcatcttgggacagggaggaggctgggttcactcactgtactctaatggcttggctgtgtggcattcacaaacccaaatgagaaaggtgaccagtcccttcctggattgaatggggtggtagtcagtgcaaaggaaacactgtcgttaacttatctcttgcttggagaattccgaactggaaagtggaaaggttgcctacaatacccattttgggactctgcaggttgcggttaaaacctaagggatctcattccccaattcctacgctccgggtcagtatatcccaacagtctgtatctagaaactgaggagcgagagtgggcctgtctctgcctgcatccctggctcaggctcagcagtgcatggtcccagcatagtctctccagagcagaagttggggacatcaaaagctggcttctccactggggtt

SEQ ID NO: 765 - DNA, 450 bp, Rattus norvegicus
  Genbank Accession No. AA899051
  misc_feature (1)..(450): n = a or c or g or t
tttttttttttttttttgagtttaaaaccaagtatttaatattttcattaaattgtttcaatacaattcccaacaaatgccaactgcaagacaatgtccaaaaactctgaagaagcaagctcccagacaaggaacaaggccatcatcttccactctagccacaatacttctctccatactcgtgccagtcagccagcctcatccagattatcgagtatttaccacatcatcaattttcagaggtagggtctgcacagttcagtgggtacttgagctcaataacatctccattcttctctttcagctgcccgtgatgctccatgtaatactggaccagttcagccaaggtggcaaacttttccccgccatagaggtcatantagtccccagtgttctgaatcttgatgtgggtaacggctccatttcttctaacagacagagtgaagtctc

SEQ ID NO: 766 - DNA, 540 bp, Rattus norvegicus
  Genbank Accession No. AA899106
tttttttttttttttttcttcttcttaataagggataaaagatcacctcaccctcttccggttacacagaagctttgttttcaaaattccatctgtggtctccatctgcccccattagatgagttttttttttgtcacggcccatagctaattccctccatcagataacagtgggaaacgtctacaatgaaccatgtttggaagaagacgcccaaattcaccaaacatgagacttaggagccaatcacctgcgtccaactggcaaaagacatatcccttaggtagcagctactgtagtcagcaggagtaggcaacgtagagaccccaccacgctcagtcttgggaacacgtggtgaggcatcaggacgcttcttacatccaaaatggttcagtcgtgtggttgggtggttctgcataacctccccagcgtgtcccttctcatttctgattccttcttgggttcaatgctttgcaaactactcatgccgcaccggcatccatggtttcttgcaattctactaaagggggcatatgcactag

SEQ ID NO: 767 - DNA, 430 bp, Rattus norvegicus
  Genbank Accession No. AA899109
tttttttttttttttttcagtcgactgttttattgtttgtttgtctcccacttgcagtgctggggagagaacccagggctttacatatggtaggcaagtactctatcacccacctctagttccaactcgccaatgcactcctcctccttcactctctgtccagtgttctcagtgagtatttggcagtgactcatggtgggtttacattagatcttgttcatgaggcctcatagtttttatcagcaccttggatttccttgggttagtgtggcaatttccatatatcttgcaaaccaagagatatgtgtacactacttagaaattaaggaattggaagaaagaataaacagattcttttatacataagtaatagaataaaaaattgactatcctgagttttttctctctgtgcagtaaagtggtagccatg

SEQ ID NO: 768 - DNA, 477 bp, Rattus norvegicus
  Genbank Accession No. AA899113
tttttttttttttttttacttgtaatacatttatttttatatattttttaaattgcaattttcagaatatataagtatttctcatacagaaataagcattctgcattctttggtacagaaatcacactatacatgttgtgtgatcttttttcttttttcttttttttggagctggggactgaacccagggccttccgcttgctaggcaagcgctctaccactgagctaaatccccaaccccatgttgtgtgatcttaaagaaataaaatcactttgactatgtcaaaactagtctttgcccatccatttgtcccctaccacagctcccagtgagagttctagtcacagcaatgtatcgacacagacatcacatcaaagatacttcaaactcctatgtatcaaagtagtacatggcttgaagacagatggcactaaatacataaaacacagtacagataaactggaaccttaacacta

SEQ ID NO: 769 - DNA, 128 bp, Rattus norvegicus
  Genbank Accession No. AA899120
ttttttttttattttttccctgttgataccatttattgttctctgctctgtacaagccgcgtctgtcccctccccaacccgcccccatccaggggcacccagacccccacctgtgccctcccaactcg

SEQ ID NO: 770 - DNA, 490 bp, Rattus norvegicus
  Genbank Accession No. AA899152
tttttttttttttttttcagtgggaataaataccagctttattaacactcaaagtaccattcctttatgtccatcccacagttcagaagattactgagtaagcctctgcaccacaatctgtcgaaagatgaataggaatgaagtatgtttcactgcactgaatatcgcaggccttcatgcatgacaaatctaaataaagatgtgtcaataatacacaaattgccatataacaaagtcgtcattactaacaaaatataaacatggtttcttttatattaaaaaatttaaaagctatttaccagcaagaaaaaatacatagaaattataaaactcaagacattttacacatctttacaagcacaattttgaaagaacaacagaccaaatgtgtggaatgtggtacacactacactgtgtctggcttctgggtaggtgctactcacatgggttccttttaacacaatacactagtgatagtcagcttgaactg

SEQ ID NO: 771 - DNA, 472 bp, Rattus norvegicus
  Genbank Accession No. AA899256
tttttttttttttttttcaaaaacttcatcatcatctttgtctttctcaaattctttctgacaccgatttaacaacagttttcgaaaattcacagtcactgttggcttttctgtagtgggcactttcagcgccatgaggcagcggcacatgttggcataagccacagagaagttgggctctgaaatggctttctcgaagatgaggtcaatgactcctttgaggcgttcctccgtgtcaatggccagctgtgtcacctgcttcatcagctgctgaaacatctggggtgtcagcttattcaagatggagcgtacccttcggaacaggtcctgggtcttgcttccgtcagcatcctcctcccctcgatccttatcagcggctgtccgtttgctactgggtttccacgccttctctgctttgttcagttttatgtcttcagtcattatcactgaagaaatgatcttgcgagtttcc

SEQ ID NO: 772 - DNA, 407 bp, Rattus norvegicus
  Genbank Accession No. AA899289
  misc_feature (1)..(407): n = a or c or g or t
catggtcagcatttctactcgggaactggttaactccaaccagaaacgaatcaggaacatgattgcacagctctgggcacagtgtctgaacagttcagtcccagtccccctcgccctcaggattgtcctcccgaggcacctccaggtcgttgaagtggaagttggccatcatgtcacgcacggccaacatcagcctgttcaagccttgattgcggttcggacccccggccactccttcctccagcctctccccctctgtggtgtaatttggcaataatgaccggaagaagagggcgattgtgtttccgtggctgactggactcagcctctccggtctgacgtaggagtagatggtgtccacgggaggcanagggtcaaaccccataacagactgtgtggtcacatcc

SEQ ID NO: 773 - DNA, 447 bp, Rattus norvegicus
  Genbank Accession No. AA899301
tttttttttttttttttaagggttcttaacttttatttaaaggtgagagagagaaacgactttttattaaactcccagggcctcacacaaaaaggaaacaggaatgtttgaggggaacttgctgacaagaattccagtggaagaggggagatgtggaggtggaggtgggcaacggggaaaagcccaggtcacgtgagtaaggaacacggatgctctaagataaatagctatgcagggagaggcagtacggggagatgtggaggaattgacaatgtagtgagaatgagtaaaattcgttttataagtgtatgaaaatgacaaagaaaaaatttaagctcagcaaatactggaaaagcgactgtggctatgcttctttctgtccttcctagagccacctagaaataacagcaagcacaggatatccgacatttacctcgtgccgaattc

SEQ ID NO: 774 - DNA, 461 bp, Rattus norvegicus
  Genbank Accession No. AA899304
tttttttttttttttttaaattttcatttctattcacataactttatttgaaaccaattttgactgtccaaggattaaagttcaaaaccaaacagaacataaacatccagtgtgcgctctggtggcagacagaagtccgtggatgttaggttatttgggggcttgagagagtcaggctttgttgctgctgttgtgatgatctttggtgtatttacacataaaatgctggaacttttactctgccgtcatcaggagagaacctgtttcaaactctctccgaggatggcttcctttacttgcaagtggaggaggaagaaagcatggtatttcacttctccgatttctgttcgtagtacagtgtgcaagtcctccctgctgtacgtcaccctctatgggtcctggaatcaaatgctcttttttttttatttgttttttttttcccccagagtttctactactct

SEQ ID NO: 775 - DNA, 504 bp, Rattus norvegicus
  Genbank Accession No. AA899491
tttttttttttttttttacgggagcacaacagtttattatttcttgcctgaaaatggtgcaaggtcagaacactcagagcgagcggcccttgtgccttcagagaggacagacccttcaaccagggctttccctgagatatggcctctgctttccaagactctgagggcggctcatacatgcagccaccccagagggagagcactggggcctggacagctgctgttcttctgtctgtctagctatggtccaccggcctgaggcatggccagcacacttctggcctgccctccacttcagtcaagtgtcaaagcaaaagcatctgcaaaggtaacagaccgtccttagagtctggtggttgggagaagccaccactgggcttgacaaggtggagtctgggccatctgtgggaaagttaggacactaagggtaacaagcacgattctggagtggacagcacgtgtgatctggagtttagttacttcagcctcaagtctctcccacag

SEQ ID NO: 776 - DNA, 471 bp, Rattus norvegicus
  Genbank Accession No. AA899521
tttttttttttttttttgcacagaatagctttgtgcttaggcctgtgaacaccgactgtggcgtctgtgttgacagtgagctctccaggccattgatgggggagtcagtgtgcagcagtgttgagctgctcagtaccatggacagaaacgggcgagcactgcactcagcctacactgtctacactgccacctacataggacaacatcatttctctttttggtgttgacctggctcaagaaatacccgttaatcaagaaagcttgaccaactttgacaccttttgtagacactttgaaagtactcccaaactgtctgagatggtgccattatttttctttgctaaaatgtactgattaaaccccacagcaatgattggtcgatgtccgttttacttggtacgtttcacagttgtgtcactggtgaatctccatagacctctcttcaggcttgctgcctcgtgccgaattctt

SEQ ID NO: 777 - DNA, 365 bp, Rattus norvegicus
  Genbank Accession No. AA899546
tttttttttttttttttgattgtaccaaaatatttaatgaatatgctgttaaaacaaaagaaatagtaatacaattttactggtttatatttcagttcataaagttgacgcacaaactaccctagcacataaggtccacacacctagttttagatgggcttacagctatttgggttaactgaataggacagatactggaagtggtaagggatggtctggggaagagcaggccacttattatctccccactgtagatgacctcatcaagcattagtaaagccaacaggggaagaggaaataactcgtgtccttatatacaaacccaagctacctccacacagagcagaccatacagcagagaagat

SEQ ID NO: 778 - DNA, 369 bp, Rattus norvegicus
  Genbank Accession No. AA899709
tttttttttttttttttgtaaggagacactttaatcagaaagcagacatcagcagacagaacccttgagcacgctcagagcgtgcctcacccccaggaatacccctcaggaaggaggttcactctctatcttcagggtaggtgtctgaagggttaaacaaatcacagctccagcccacactggacacagaatcatggcagatcgcctagaagacaggcaggtccgtaggtcacacatgactcctaacaactccattccccaatccccccgactacccttcatgtccaacagagaatgtgctcatctctctttctgctcgggacgccacaccttccagatgaccttgcctgccctctctgccccaagcgt

SEQ ID NO: 779 - DNA, 470 bp, Rattus norvegicus
  Genbank Accession No. AA899721
tttttttttttttttgtctataatgatccaatttttattttttgtcttaataagaatgtttatacttaaggttcccctttaattcatgatacaaaagaactctatttttggataggcactatttttaaattacatgttatttgtgtgtgcatgtgcaggtgtgtgcgtgtgttggaggacaacttgtcagagttggttctctcctaccatgtagatcctgggggaaagacaatctcaagctgtcaggctgggcagaaagcaccactatcactgagccatctcaccaggtcaataggcacagttttataaggaagttttaatttctttgttgtcttatagcactggagaatgaattcagggcactatagaagaaagtcaaatgcattgccactaagctatatcctcagtctctcacaggcacttaattcattatattaagaaaaaaaagggggggttggggatttagctca

SEQ ID NO: 780 - DNA, 380 bp, Rattus norvegicus
  Genbank Accession No. AA899814
tttttttttttttttttgttttcaatagtaaagtttacatggctatcaagtcacaaagacagttgtatagcagtttacattacagttgatgtctgcacacctcaaaacgcattttaaataaacaaaactggtttggaaaaacattacaaaatgcagtggcaagcatgtttggtcaactggtcaatccttctaccatccaacagctgactccagcggaggtcttctgttaggattcttccatcctgttcaatgggccctggaggaaatctaaatcctccagtactgatagtttgagatgtgtactatccaaaactgtcacaaagaaaagttagctacagcaacctactttcgactgtggaaaaattcatccacgtactgta

SEQ ID NO: 781 - DNA, 545 bp, Rattus norvegicus
  Genbank Accession No. AA899840
  misc_feature (1)..(545): n = a or c or g or t
tttttttttttttttttcacatttagagcagctttattcattaacagcaaaaatgctgaaaatacatgaaatgtccaccaagtggtaaatgaatacaataacataaccataaaagaaaatactaaacaataaaattactaatatgtacagtaagcatgagttatctcgatgcttatattaagtgaaagaggctggacatatagactgtgtgaatccattaccagaaaacctagaaaaggcaaaactactgacgaacaactgcttcctgggcaccagagggtagaagcaaggaagggcattttacctgaaccagcaccggcagcaaatccatggcagtattatgcatatgtcctggtcatctcacaacttactagggaaataagaccacagttgattaccttagaacaaccaatgggtcttggataggacaaaagcaacatctttatgctanaggtagggactacaactggaaaacaaggaaggagtcaaaagtaggagaaaaacaataactctaataagcctgaaaacagccttgttttgtcaca

SEQ ID NO: 782 - DNA, 501 bp, Rattus norvegicus
  Genbank Accession No. AA899865
tttttttttttttttttggattacaggtatttattatagtcttacaggtgagtttagctttcaaattgctttaatacttgcacttacaagcaacaggtaaacaacgaacagttattactgggcagtgtcacaggggtgggggctggagaggggagtggaggatcaagcaagcttcacacaaaggcgtttatgtgaaggacaggaaacacgggcatgctaaattctgcagagaatacaacacatacacactacaggggctggagacgtggatgacattaagaaacatgtctgaaatatgaagcttggtatacagtttatatgtggagtgtccccggtgatggccattcttggttgtcaacttgactccatcttgaatgaactaaaatctaatgacagagggcacacctgggagggagttttgcttaatttgaagtcagtagatcttctttaatcctgatcttgaggtgggaagacacacctctagtctgggccacgccttct

SEQ ID NO: 783 - DNA, 493 bp, Rattus norvegicus
  Genbank Accession No. AA899898
tttttttttttttttttaaacaaattaggtttattgaacttggagatggaccactttataagggccaaaccaaacgaaaatagaaacagattagactctaacacatgagaacaaaattaaatgtaatgaggattcttgttggctttaaggctgatgaaacgggctattaaatgaacagacttctccaggatggttttcctagcctaaatgggaaaagacctagataacttgaaaacagctgtcccacccagcactgttagaacactgcttcatacgtgagaatcaagcagcagttcataaatttagtgttagactgcctcaaggcgtggttggttgtcatacctaatgagaagtccaaatgcacaataaagatcagcagtgagccaggccccttccagaatgtggggtccctgaacagaggcacccacactaacacaggcaacgggtgacagcgacacccacactaacacaggcaatggggttgttctctctt

SEQ ID NO: 784 - DNA, 351 bp, Rattus norvegicus
  Genbank Accession No. AA899964
tttttttttttttttttggctctccaaaagcacgtggtttattatggtgagctgtagtgcacatcggtttctttagtaattctaagctgatacaggttccccactaggagtacacatggggagtgactgggcgcgcggtgacagtgacaaaccagtgagccactgtgatccatagaaagttacattagcaatcaggagagaaagggaagtgtgaggtggcccataggcaagatgtgagcagagcacctggacccttccttccctacatgcagtgcttgggccctgctgacgggcacagtgaccttatgacctatagtaagtggccagcctctgactgctatgcatggtcag

SEQ ID NO: 785 - DNA, 377 bp, Rattus norvegicus
  Genbank Accession No. AA899991
tttttttttttttttttggagtaaatacatttattgatacccattttacatatagttcaatgaaataatctataaatataaaagcatttttcctttggctatcaccgtggtccaagtaaatactcaacagtcagtcatctgcaggaagtgctccaagtctcactgctgggtaacagacctgagtacatctgctacccaaaccccaggtgtgaaaaatcacttctgtttcaaagttttttcctcaacacatccagggaactgatgcagcccttgccgagcctggctctccccagtgccgcacagaaacttcctcttttcttcaggacaaatagaaacatcctttgctttgtcttctgagtcagcaagctaatgcactt

SEQ ID NO: 786 - DNA, 395 bp, Rattus norvegicus
  Genbank Accession No. AA900018
tttttttttttttttttcacacagggttgcttttatttccacatccaacttgagcagaggccctgccacaacctgaacagctgtgaggtgctgggtgcctccagagtttctggcacagtaagtgttgggtgtgcagacttcctgatggccacatgacactggcccacacaggaacagcaagtccatgaatggaaatcccactgagctggaagtggagactatgtagccagctgtggaggccatgatggcttggacagaggacaccagcctggcggagacaatgactgcgtcggtctcctcccagcgcagctggggcagcctctggagcgtgttcttggataggaggaagagtccggggaacaccacccccccagccaccattggggtaagcatgg

SEQ ID NO: 787 - DNA, 368 bp, Rattus norvegicus
  Genbank Accession No. AA900033
tttttttttttttttttgcagcttaacgtttttatttttagcttgtggttcgggagtgagtctctaatggcagggcagaggcagcaggccgagggcatgagagctggagtaatttgttgggagctggaaccaaactgaaatggtcaccgttcccattctatggctcaatctatctttattggctatatttattttctacacaacaaaactttccttctcttgacttcagggtctcgctatgcagcctcagtctcagatctgcctgtctctgcctccccgtgagacacaaggaacgcgccatctctcccaacccattcgcaaatctccttctcatcgggaacaccccacaagagagctccagccgctcg

SEQ ID NO: 788 - DNA, 369 bp, Rattus norvegicus
  Genbank Accession No. AA900090
tttttttttttttttttcagtgtccaaatctcaggtttttaatttcaataccatagtgctgagtcaggccagcccctgggcctgagctgtccctctggactcctgcagactctggtattggcttgttagtcatggatcttcagctcttcatcatgggattcagttccattttctcttcagtccctgagaatagctccttctgcaggcttctctcatgctgagaggcctccttcacagccaactcatcccttgggtcctctcccagggatgccaatagtttagcctagagcatatgcactatgactcaacccccattaccacagccagcaaagcctcagtgaggggccctgcctcctcacctgctgcttc

SEQ ID NO: 789 - DNA, 511 bp, Rattus norvegicus
  Genbank Accession No. AA900118
tttttttttttttttttaattaaaaaaatttatttctgtgatacagacagaattcctacagtccaaataaggaaaacagaccaaactcaaaacactattaaatcataaaacaaaacagtatgtaagataaagtcaaataatataatccacacttggtaagtttattcccatcaattatcacatttctaataagattaattttttcaagtctcaagtttaaacaattaataacccattctttaaaatagaatgaaaagctatgaccaacagaagacacacaagcacttagcaggttgtcaaaataaaaggtctttgttaaaagctgccaacatctgtcagtagtaaccatatggaggccgctggttgtggccatactgtgggcaatttggttgatagtaaggctctggtctctgctgtgggtagttgttgttaccccatgaccgtccatgccactgatttgaccgattgtcacttggccatcctcgtctgttatccctacctctaaattgtc

SEQ ID NO: 790 - DNA, 587 bp, Rattus norvegicus
  Genbank Accession No. AA900148
  misc_feature (1)..(587): n = a or c or g or t
tttttttttttttttttgtaaaacaccaagtctatatttacatccacatataataacataactttaagctgaaatatatcataaataaagcttgtctactgacaacttaagtatcaacaattaaaataaatcaaactggaatgaaataaatacgttaacaaaaatgcaacgagtgtacctcctcacgcgtactgttgcctcccagggaaagacacacagccagtagtatcccagagttaatactgatgaccagacacacggaagcacaaagggctgtttaaagaaaaaacctggaattcccattaacgcattcagaaaatgtacctagaggaatctgaaagccccgacatttcagcatttcacacagacttgttttctaatagatttggtgattatttctttaaatacaggttttaacttttggccccgactgtataacccctccagattcacatgtacggtctctgaaagcgagcctcctcttacactcactgcattcagacaaagatggagtcatcaccctgcaaatgtgttaatcttcaaaaaataggctatgaaagtgcagacctaaaanaacagtctagatt

SEQ ID NO: 791 - DNA, 575 bp, Rattus norvegicus
  Genbank Accession No. AA900236
tttttttttttttttttacattaagcacaatacagcaatttatttagatgcttaaaatgaatacaaagggaaataaagaccgcagaatcatacagaccacaacagtgtgtcatatattagatggtataaacgatggtggtgctcaactaaagagaaaactaaatatcccaaatgcagcgctcaactgtgcttgctgctctgacacaacactcttacagatctaaaaggtgtcaaaattagtagctgtaaaatcaattcttgcatgttattttagcttaaaaggtctcagaaagagatctgaaataccatttttgacaattgtaatgtcaaggatactcagaacaagaaaaaaattctataatacaggagagtccagatatatatcttatgttgctggcctctgttgcaagattgtacaaggttatgtgcaaaaactaagtctgtccaaaggtccatactatcgcagggtcaagcttctgctaggtaaactagatatagcatttatcacacagcaagggcaacactaaaaaccaatctatgacgggcacacagtaacagtgtcataagcatcactt

SEQ ID NO: 792 - DNA, 483 bp, Rattus norvegicus
  Genbank Accession No. AA900351
tttttttttttttttttagttataaaacctttattatttttagcaagaataatgcgtgttcattttaggaatatggcaaatacaaataagcagaagaaaaatcattcatctttcacaagtttatatgtgcatatatgtaacatacaaagggactcctgtctctcaaaatatgatattcccatattattttgtaatcttttctcattttgtttcccatcagaagctcatgtttgtatttttttttttacaaatcagtaaagctcttcggttaaaagccagagacttatagattggttcaaatacaatcaacagtaagatacagacaacaagagagatcgctaaagccactaacagcaacagattcaacgcaggaagatgggcaaaggtcttagcaggaaaatgctaatcaaaagaaagctagattgcaatggtaacagcagataaaaaggaaaccaagccaagctacattaaataggggtaagg

SEQ ID NO: 793 - DNA, 466 bp, Rattus norvegicus
  Genbank Accession No. AA900380
tttttttttttttttttgttgcctaggcggcccgaggccatcccaggactggccaccagggggcagacgtgtcccttcgcttctccagtccgatgctacagagacctaacaagtctgtcccaagtgtccaatatcttgattccagagggctgagctttttaagtctccatggtaacaactgggctcctctaacaagttcatatcctgtggaatctgtgagcatggcatccaagcacctgaggctcaacttcttctgtcttcagaagtctcctgaactcttcccctccaggcacgctaggggagcaggtcgattagaaaataagcatgaatcctttggcaaaatagctggcttcagctgtttctgcgtgggcccttcaactgacgccattggctgttccaactcacagtgcataacccggacatgcacttgggtcacaacgagtacagtaccaagtggttggggaat

SEQ ID NO: 794 - DNA, 307 bp, Rattus norvegicus
  Genbank Accession No. AA900401
tttttttttttttttttatgcaacatattttatttagcccagtcagtcacagcacagaataggggacttacagagggtacattgtgcaatacaaacagccagtctttacccaaaggaaataaaggatatattatcaattcataatatttaacacgcaaatgacaaactgcattaacctaatcagggttcttcctactgacgataactggatcgagatcatgcgaatgcattacgaacaggccggtctccagctgagatcacacgtcagtacaagtcactaatgcccgcagtcattcctgctttttgc

SEQ ID NO: 795 - DNA, 472 bp, Rattus norvegicus
  Genbank Accession No. AA900461
tttttttttttttttttccaaaagagaaaatccttttaatccttaacaggtccctgtggaaacaggatgcggataacagtgagaagggagcacctaggacacccccagaggctcgccaacaagtcagcatcacggcccctctcctgtgcacgggcgggcggacagacggacggacggccgatgacataagtccatgtgactacagttcagcagcgcttcaccattgctgccagctgaagtcatcattgctcccgaagaccaggaagaagcctataatagtcccgaagatgactgtgtttccggtgagaacaagtgcgcatgctccccattcaatcagatgtgccctggcaaacactacagggagcccaaaggccgagacgacgacacctgtggtgaggaatatggcgagctccttacaaacgttgctcatggcgtctgtgtcgtccaccaatcttctggctatgcattacgg

SEQ ID NO: 796 - DNA, 383 bp, Rattus norvegicus
  Genbank Accession No. AA900465
tttttttttttttttttgtcagtggacaccatttattgagcacctgtagagtgctccatcctgtacaaaggattagggaggaagggaagacatataatggataaggggccatgttgttcagagccttaaagatctgtggctcctcctgggtggtgagaaaaggaaaaaagaactggggacaccctcccccacgccagatgttagctatcagatgaacttgtcccttatcacacttttccctcctggagaggggtcacagaagtggggaaggatcgttggcagcctagtgactagcctggaaccctacactggctagatgtggatctgaaagtctgcctccctgttggtatggattacatgtaagttggtgccctggtatggga

SEQ ID NO: 797 - DNA, 419 bp, Rattus norvegicus
  Genbank Accession No. AA900474
tttttttttttttttttcgtcacatacctgcgttttaatccataaatatcagtgccaagactcacaggttttcctgtttgccctgagctttggcagagtgaagcaatgaggccctgcccgctgagtaaggcctaaagcttgtttatacagagaactgcctagcactgcaatcacacgctgatgtcctcaagggacagcttatggcgcttaaatggctgagggaggggcctggagccaagtccacgggttctgaggagcatgcgtgagctcatgaaggctgtggagtgtgcacagcgcctggcatggtggccggcatggggctagcatgaaacagccagggtaagccgggatggcaccatgtaactcaaggccagggtagcttagaccaggcaagccactgaaggcaggggtaatgccag

SEQ ID NO: 798 - DNA, 470 bp, Rattus norvegicus
  Genbank Accession No. AA900481
tttttttttttttttttattgatagcagctttattcatactcgacaaaaagtagaaacaaccataatgagaaacaagggaatcaaaacacgtactaataagttaaggattgctaccacatgatatcctcaaagttgcaaaactagagagcagagagatcagtggttgccagggaggggctggagcagacagaaggatgaataggtggagcacacaggattattaagacagcagaactattgtgttatagggggataacgatgcatctacggttttgaacatttgttaaatcccatggaatgtaaaaccacaattgtgagactttgtacaaactatgatgtttttgtttgtttttgagacaaggtgatccaggccacatctcacagcacagctcctgcttcaacttctcaagttctggaattacaggggcaaccaccatttctggttaaagatgcacctttgataaggatc

SEQ ID NO: 799 - DNA, 519 bp, Rattus norvegicus
  Genbank Accession No. AA900521
tttttttttttttttttgtgctcaagtacaaatttaataaagccctgacaagtcttagtccaccagctagctacaaaaccaaaccccgacttctttctggagccaccaagagcggctgggacgccatgaacagcagcaatggcacagatgagtgagtgcttggacgcccttgtcacaacgaactgcagggaagcagactcgtgaccgacagacgaccttaggtcaaaaccaaacaggtcaagctggtatcagtgcttacaccccactctctcctgtgtccccgttgtgactctctggctccaggttactcatgcatgctgtgctcagggcacaggaatccatggacaagctgggaacacacatggctggcagacatcttccaaggacgtgccagcctcccatccacgtgaagctggcaccacactccagaaccccaggggctctcctgggcctggccaagctccggccacagctctttgctaaagtgagaacaaggctcggctgctctcccgctgtgca

SEQ ID NO: 800 - DNA, 274 bp, Rattus norvegicus
  Genbank Accession No. AA900548
tttttttttttttttttaagacaacattgaacattgcagacctcacatttattcccttcatataagaatcctgaggaagactgacaagaatatgggctagggattctccagaagtctcaggctcatcatctggggtgagttactgtgacctcccttaaaatcctggttcttcacaacaagtcgggcaatggttttcgaaaccggaccgctaagcttctcatggatcatcaaggtgttccattaaacatgcactgtaaaaatgacgttttctcgg

SEQ ID NO: 801 - DNA, 398 bp, Rattus norvegicus
  Genbank Accession No. AA900613
  misc_feature (1)..(398): n = a or c or g or t
tttttttttttttttttcggtccttcaatatggcttttattttgtaacccaccaactgcagacccgcggccaccccaaggggccaatccatccccatgacccatcgggacagagggaggtggcacatgccctgtgtacttcttcagtggcaggtggcactggcctcagacccgtaaccagctgccaggttaagagtagtgaggggaacgagagtgcccagggccagggcaggaggctgacccccctcgtcctatgacacgagtgccaccagggtggcagccaccactgctgaaccgaggggaactgcanagacaggcttctgggacccagccactggggaggccaacagcagtgtgcggcccttcagtgcatgtggcccgggtcatcattccatccca

SEQ ID NO: 802 - DNA, 410 bp, Rattus norvegicus
  Genbank Accession No. AA900649
tttttttttttttttttcagagaaattaggagatttatttacacagggaacccagggctcgcacccttagcagccacactgcactcaacaccgacgaccacccgggctatgggcacctcagctcgtcctgtgatgaccactagcgcatgcggtgtgtgtccgcatgactgaagtagaaaaagggcttttctggccagccagagtctgttccctgagcatcccagccgaggttacataacggagatggctgtggagacatcaggtgtagagtcaacacctcatctagaagaatctgtcccctctacatcaaacaggaagacatatgcgaacctatttcaattgtagaaaaaatgtccacactagtcacacaccaggaaaaacaacacactattcatttccaactgttctaa

SEQ ID NO: 803 - DNA, 441 bp, Rattus norvegicus
  Genbank Accession No. AA900688
  misc_feature (1)..(441): n = a or c or g or t
tttttttttttttttttcacagttggtaaagagtttattaagcggctgggaagctcttcccactctaacaacagaaaaacactctccacccctcaccctccccagtgttggccactccgactcatggtggagcctcacactgtaaacacctgcctttcagagttcagtacagggacatgtcttcctctggaaataaaactttcagtctcaactcaaaagggaacaaaggcatatatctcggcttctgcaacatttggtacaagtttgcaacaaaaccgtacatagcagcatgctgctaaccggagaggagatggggctagcctgggcaagccttgcaggaatgctttagcatctgttatcactgcagttttcacatatggcaggtggggctgcaccacaacgcaggagtctcattgctccagggtcanacactggactctc

SEQ ID NO: 804 - DNA, 397 bp, Rattus norvegicus
  Genbank Accession No. AA900722
cggccgcgctgcgcgccggggaccgcctggttgaggtcaacggcgtcaacgtagagggcgagacgcatcaccaggtggtccagaggatcaaggctgtggagggacagacccagctgcttctctctctggcctccgggcccaagaccggctcattgaggtgaatgggcagaatgtggaggggctgcgccatgccgaagttgttgccagaatcaaggcacaggaggatgaggcccggttgctggttgtagaccccgagactgatgaacacttcaaacggttgcgggtcgtacccaccgaggatcacgtggaaggtccactgccatcaccagtcacgaacgggaccagccttgcccagctcaatggtggctccgtgtgctcttcccgaagcgacctgcca

SEQ ID NO: 805 - DNA, 558 bp, Rattus norvegicus
  Genbank Accession No. AA900881
tttttttttttttttttatctcccaacttgtccctttatttggcatttcatacataatgtacagtagctgtcatttccacatggttggtacatttcatttttccagggcaatcacttaaactccaagataatcttaaaacagaattcctccatgctgtctggaggagtccagggacaagaaagacagcctaagataaatactgctacatgctgcccgaatcaggcgtggtttccgaaagggtttcagcatggagagacagaaagtacacttctatgttcattctcatggtaaacaagtactgaatacttactatgtgctgggctttgaggatacaaagatctagaaggcacaggacccctagtctcatagcagcgcagtgagcagccaggtatagttacagaaaaagggcagtgagcctcacagacaccttcggtgacattagtgcaggccatgataccaagaaggggcacggtcaccttagcgcggactcagggacttacagaagcgcggagaaacgaaatccagccgaccaaacttttgtttaaaagacagaaaca

SEQ ID NO: 806 - DNA, 466 bp, Rattus norvegicus
  Genbank Accession No. AA900967
tttttttttttttttttcaccattatagtcttcctttattggctgtccttgtataatacaaatctgcaagtttagatacaaaaaaaatctggaaataaaagatagaaaagtacccgccaggcaacgcccttcttcttctcctgggacccctccccagcgggcacggacatgaggtaacagagcgtcttcatcctccccccccccctccggggcccccaatcgggccccaccccgtgagaccttgaccctccggaagactcgcccccgagtgggggagggggcagggcaagcacagcattggcagtgaacacagcttgggcataatggaagcccttagcttgtgctgtgtgtatggggcaaggacagagagaggatgagcccggctcgaactgggcccaggagtgcccctaagtgggcatcactcctccatcctgcccaacactggaaaatggaagggcacaacaga

SEQ ID NO: 807 - DNA, 488 bp, Rattus norvegicus
  Genbank Accession No. AA900974
  misc_feature (1)..(488): n = a or c or g or t
tttttttttttttttttggtatttcccaaagctggttttaatttccaaaaattatgaggtctcttcccacactggggataataggatgggatagcccagactattatcccagtccaacccccagcctagcccaaacaccattgctgtctctgggtcccgtcatttcaccactgggagcttatttctaactccctcactggccaagacaggtggatggatgtgaagtttccaggactcagcactgtctctccaaagtgaccctgggtctcctctgtgaggggaagccatctgtgtcacgtcaaagtggattggtgtaaccaccaggctcaactcagccaagcacatacaccaaatgtctgaacctgcggttcctctcgtactgagcaggattaccatggcaacaacacatcatcagtanggtaaaactaacctgtctcacgacggtctaaacccagctcacgttccctattagtgggtgaacaatccaa

SEQ ID NO: 808 - DNA, 385 bp, Rattus norvegicus
  Genbank Accession No. AA900993
  misc_feature (1)..(385): n = a or c or g or t
tttttttttttttttttacttttgattaccctttaattgttcctgggatgacttatctgtggaaagtagactttagattgcttgtccagactcctaaggccagcatgttctgaggatagcagttttcagttctaacttttgaattccacttgtgtgtacaccttggtgatgtcattgtacctgccttcaagggcctggtagttagggacaagcggtgtgtacaaagggcaaggacttaatcaacgcaagcttatgacccgcacttactgggaattcctcgttcatggggaataattgcaatccccgatccccatcacgaatggggttcaacgggttacccgcgcctgccggcgtanggtaggcacacgctgagccagtcagtgta

SEQ ID NO: 809 - DNA, 526 bp, Rattus norvegicus
  Genbank Accession No. AA901012
tttttttttttttttttgcagaaaatctgccatgattatttttttaatgaataaggattttccacaaaacaggcttgctctacatgctagatttttaaacagttcagtgacacaatatgctaactacatacacaacagataatatagtaagaaaacactcaacctgatgaaaagttaaaatcttcattaatacactgaaaactgacaactcatgcctttaaaatcaaaaatacaaaaattaaatgttttcctaaaaagatttccttattttaaggattcatttgaaaatgaagctgcatgtaatttgtacaataagttgtacaagtaaacaggtaatatacataaaaaattaactgacatactcctcaattatcagttgtccacctttaatttccaatactgtactttcttaacaagcatacaaaatatcaaacttctctttagaaaaagtgccgttctttgacatcctttacacaaaaacagtctgagcctgcggcatgttaatgcagttgcctcgtgccgaatt

SEQ ID NO: 810 - DNA, 499 bp, Rattus norvegicus
  Genbank Accession No. AA901065
  misc_feature (1)..(499): n = a or c or g or t
tttttttttttttttttcctgcaaagtgctataattaaagtgatatttacgagtgtattagacagagggcagataggctctgagctgcgctctgcaggtctatagagaggggacaagacacaaggaacaggggctcagccctggctctagtgaagcagagtcccagaggaggcatcgcagggagcccgggaggaaaaaaaaaaagagcaggaggttctggagagccgctcaaagcagcgactttgaatcgggagctgtgctggtggcaaagagccttcctggtgccgctggtgtctgacgcagacccttcccctgaccaggtgccctgccagatcagggtaccagggtcatctgcattaccgttcatcacagacttccctttgcctgccagagtatttccaaacttgcagctttaaaacagtgggaggaagatggcagggacgtttgtgttacttaaatccacagtgagagactgcanagatgcctcctggggctgcca

SEQ ID NO: 811 - DNA, 406 bp, Rattus norvegicus
  Genbank Accession No. AA901069
cggccgcattggtggtggcgggggtgaagaggaagatagtcagcaggaatctgaaactccagatccaagtggaggtttccgaggaacaatggaagcagaccgtggaatggaaggtttaatcagccccacagaggctgtgggaaacagttgtggggctagcagctcctgtcctggctggcttcggaaggtaattcccttggaacagatacttcagctaagcctgtagcaggagccagtaaggactgccaaggtctcactttcttgtgccctactaatttagacaggagtcaaggcttcaccgtcccacctgcgaagaagatgtctatattttattttaaaactaggtctcagtttgtatccctggctggcttagaactcacagactcccacttcagacctcgtgccg

SEQ ID NO: 812 - DNA, 398 bp, Rattus norvegicus
  Genbank Accession No. AA901179
tttttggttctttttttcggtccccagctccgaaaaaaagaaccaaaaaagaaaaaaaagagtcttggtttaaatagtagttttgcagtttacaagttaaggacgtaaacttactcaagttgaaacctctacttgactttgtatctgtcaactcgactttggggctaaaggttggatgacactgtgactgcttttcagagtcatggttgacacagtttaagcgatgtgcttaatgatatagcctgtggatcttagttagagaagtaacaaggatttaaatatttttctattgtgcaatatctcaagaacacaaacgccttaaggaaagcgtgcccgctgtccctggggctgtttgtataaatatttaaataaagtcatgttcattgttcctcgtgccg

SEQ ID NO: 813 - DNA, 517 bp, Rattus norvegicus
  Genbank Accession No. AA901237
tttttttttttttttttaaagaaaggtattgcatctttattgcacaggtacagcagttttaaaataacaaaattcaagtcaagacagttatcaattctaattgatacaattaccaagcatgacaggattaacaagaagcacaatcgtcagagaaccacaagcagcagtcggccatgactatactattgggtacgcataccaccagtctagagccagccttcggtggagagcctgcactggattggctgaagacggccgctgtccctgcaccaaagcgcttggacagcagaggagaagtcttagtcacttaccctcagaggctacccatgcagtctggaccaggtgctgattacgctcacattctaacacctgaaggtacataacgattatcttgtgaggatgcttcacatggacacaaaagcccaattccttgagaacccgtctctctgcctttataatctggttcttcagattaacatactcttgatccagcaccagaggcacctcgtgccgaatt

SEQ ID NO: 814 - DNA, 507 bp, Rattus norvegicus
  Genbank Accession No. AA901241
tttttttttttttttgtatttccagtaatagtttattgatttccaaatgcacaggggagccaagtccgaacatcctgggatagcagtaaatctctcttacaaaataatttacagtatgaaaatgatatactgaaacattaactcagatatgtaattcccttgaaagactgagtgttcccttgtttagtgtaaacggtggaaggggaagatgaccaaggagggaatgtgactgtgtacaggacaacaggcagaagacaatggactcgttggttcgacccactcacgcatggtggcctgtcactgcaaagactggtcaggtttaacttccataaagtataaacgactggtccccttaaagccacattaagcccagcatggactctggctattttcccaacagtgcactccaagtgtcttcatttatctccatgttcctgctctggtccttgttctagtgtttctgctcagccccagatagtaatggggaaccaagcgatccaaatgatc

SEQ ID NO: 815 - DNA, 580 bp, Rattus norvegicus
  Genbank Accession No. AA901338
ttttttttttttttgttactttgtttttagctaaatttaacgagcagtttattgtagaaaagaaaaccgaaggacagatcaaattgaaagaattactgttataataactttaatttatcttgcattttacagaagtctatgaacgattttaagaagcacctccttactccatcacgtttctctgacagttgttaaagtaggcaacgagtatatcaacagcttgaataccggtatcttgcaaggatttcagaacaatcactcgccaaagaacttggcagtttctatcttgtttttaactcaatggtacatccactctgatggtaacctgtccagccaaatctccaccacattttgaaaaaatcaatggtgattagcaaattagttagctttggcacggagctgtgctcgcttgcctgtgacagcctggaagccagttttgatactggccacagagcatcgagaatgacaagtttcacactgtaagaaatagagtcgggtgtccttctgtaagattgtgtccggtgaccggcatgtgtgacaagtgacgtattccttgatatatcttctcaagacgttttct

SEQ ID NO: 816 - DNA, 464 bp, Rattus norvegicus
  Genbank Accession No. AA901343
tttttttttttttttttgacagtgatagcaaactgatttatttagtactgtttccattccatatcatcaggagggttgatttcaactttccttttacctacgtcagaccagttggtgctcaagactgtaccaccagactccataaatgacttgttcatggcgcgtttcacttcatcggaaccatccgagtagatctgctgaaataacttgtttaaagctgcgtcaccttccagcttctcgttcttttcttcttctttgatttcaccaaccagtttatcccagttcctggtgtagtgagacgaggagggatacatgttctttacatctgctgtgaactgtttcggggcgggcacatctccttgtccctctggctttttcattttaatttcaatctttgttgagagtactttaaatgtactctgttctggtattatagggtgaagcaacctcagtttcaaactgca

SEQ ID NO: 817 - DNA, 388 bp, Rattus norvegicus
  Genbank Accession No. AA901357
tttttttttttttttttccatttaaaaatcatttttttattaacatcatcttcctgtttagccaagtgtctgtcatgtataaggaatgtcggtaaatattccatttgaagtttctttgtacatatttccatcgataaataaactctgaattcacataaaaaagttaaacttaaataactcatatttccttctcttgtaacagccatatattggtaaaatataaatattcttagactcaggctttgttctaaggaggaggacagtaattcaccacatggtacagctgttgacaatgaaaccgagacgctgtcaactggtgtcctggtgtggacgggtactgaggtgggaaacagaaaattcacatttgtgggccaagggaaggggagga

SEQ ID NO: 818 - DNA, 443 bp, Rattus norvegicus
  Genbank Accession No. AA923842
tttttttttttttttatcaaaactagaatgcttgtttattttggggcttagcagagttcaccgtgtctggtgacagagaaagtgctccaactcctactgctggcttgttcctttggagtaaaatggtgggaaatccctgcctgttcctctaacacgatcacccctgtgctgccacctgctgactgcagggaccctggcatttcaaaggctctcagctatgcaccctgtgtcttcaattaataactcctttattctggaaaagcaaatcaagttcatagtcatagaaacactgacattacaaagtacagggatggggaaggaggagacaaaccctctacaaatctactaacactgtctcacccagcacgaccaaaacgctcttcctgcagccactcacttatataataaaccacgggcaaaatcttctccgggatgcactgctt

SEQ ID NO: 819 - DNA, 423 bp, Rattus norvegicus
  Genbank Accession No. AA923865
tttttttttttttttttgaagtcttggaagctcttggtttattgtgggtttttaattggagagaaggagacaaggaaagaaacgtatgcatgtgagtgtgttgggggtgggactgcaggggaggggagcaaagccagctatagtcaggctccagcctagacccttgaagagcacagagcagcaatgtaccataatcttgatttcatggagagacagggagatggactcccaggctaggaggtgtaactcccaggtactcctatctccatatgacccagagcaatcccttgggaacaactgaataggagagaacactcattgctgctgtaggtgggcagatatggctagatgaaaacttggtgccaggacaccagcaggatctgtgacatcagtcaacccttttcacttctttcctgaatagca

SEQ ID NO: 820 - DNA, 442 bp, Rattus norvegicus
  Genbank Accession No. AA923925
tttttttttttttttttccactttctgaaagagtctttatttttcacatcactgaattgcaaaccatcagtaactttaatatggacaatcaaatttctacccacagaatgtctacaagaattacatttttaaaaaatacaaccagtttttatatcttaaaaatatctgaactcaaataaattaatatcttaaaaagtacactcctcatactatttatttggcatttactctaagcttttgtgcatgatgcctgtgggacatgatcacatctgcagtgctctgattccaggactgtgattgcatcaggtttgggacacatttacagacgatgggaacatgcagtaataaaatagcttcttagaaaacaagtttcttacagactgtgttgtttactgcagctacgatgtgctctgaccagcctgcagctccagccgccccgtgt

SEQ ID NO: 821 - DNA, 433 bp, Rattus norvegicus
  Genbank Accession No. AA923941
tttttttttttttttttagcattgctatagctcaaatttatttaattttttcataatcttgaaaaaaaaccacattttaataaattaaaaaatatgtatatatattttatacacacatagcgtctacatttccaggctataaaccccaaaaagcaatcccaccaaaataaaaaaatgagacctgaatggctgcttaatttgctcccagagcagtggcatttccttcctgatgggcctgcggcagcacacaaacattaagctaaaacccactatgcccagggattagagctttctcagcaatttaaacagcagggtcctcttggtatctgacaattgctttcccctcatttcctaagctctaccctgaggagggccccattcctcatcaccgaagatggacttaggagtggtagtgagggaaccggacggacca

SEQ ID NO: 822 - DNA, 519 bp, Rattus norvegicus
  Genbank Accession No. AA923955
  misc_feature (1)..(519): n = a or c or g or t
tttttttttttttttttcgaattgtatagtttttatttttttgagaactctgaaagaaaaagacttcagaagtgaacttttgaggggcacttttttattataaatttaatatgcttgattaatgaaaaaattacaatgaagtaccgtgaaaatgtatgtcaatataaaaatattagcagcgtttccatggtttcaggctcttaacattttagtgacaccgacgccctcccgccgccatcagaagagaacagcggctccacaggagaacctcggatgttctccacagaaaaggcctcaaagatccccaagcccagtgtccccgcccatacttccggctaagccctgagttggcagcatccgagcccatcaagagcctcactggctttaatgtctgcaacgagattcctgcttttcaggccactgggtgcgacggggagggaccctggagttggacttgatatgtatgtantgtttaattctacacccccactgctgtatgtcatccgcgctggtgacagt

SEQ ID NO: 823 - DNA, 474 bp, Rattus norvegicus
  Genbank Accession No. AA923957
tttttttttttttttttccatggggggacccaagaagtcccagcctttcgaaatcaaccagcacacttgtctcagtgtcaagacaatgtctgcaggctagcatttccacttggaacctcacccagagttgcatcgccaccctacagaaccccatggccagagcctgggagcaagcggttagcactcctgtgactgcagcagcctggcttggtcctcatccagaatgaatggagactggagttttcggccttgcaggtacgtttccaacccctctccagagtaagacaccaagggcgatatctcacagatggctggagggtctccattggggagcaggccagactgctccggaagctggaccccgtgtacatccaggaagtgggctccagcctggagagcccagcggtagtgctgaactagtaaggctcgcctggaggtggagggattgtccctgtcggctgtgtcagcattctt

SEQ ID NO: 824 - DNA, 563 bp, Rattus norvegicus
  Genbank Accession No. AA923973
tttttttttttttttttaatttgccagataatcttttaatgagaattataaaagaccaaaaacatttttttgcaaactgcctttttttaaaaacaaatgatttactttaattacaaatactgtgtatgatgatgcactcttttgcaaaaccaataaatacaagaaccaatttaaacatgtgatttgcccaagacatttgaagagaggaaaagcctgattattttataatttatagtgatcagagtttactccctaagctaacctttcagagagtaagcctgacctgacggcgtaggacagcagtcgggaggcgagaccatcctgtacttgcttcagcctcgacgagctgctctgctccctttcctttctggaattcctatttccacagaagggctgaattaaaaatgtctaataaattgattgaaggaaaagaaagtatgtactgaacacaaacttctgacattaagcaattatggatatcaaaaagacgctaacttaaaaggtacaaaagtgagaaaaacctgaattacagaaaagaaagtcaaatttatttaatgaaaaac

SEQ ID NO: 825 - DNA, 438 bp, Rattus norvegicus
  Genbank Accession No. AA924000
tttttttttttttttttgaagtctttagtacgtttattgtataaagaataaacaaagtgcatatagagcgggccacaggtttgaagtaaacagggactacggtaatgtacagcaactaaacaaatttaaaccgcaagagcactgttggtactaacttgatcctgaattctttagggggtggggctcaaaaggtgaaaaaaatatcaaacaagtattaaacagcattattaataagtttgccagactcctggtcatgaataactttgtggttcgcattgaatcctgaactgaacattgttgactacctagctacctccaagtaaactgagaactacctagcaaactctgaacttcagtccggtgggccgagctgggtcttcctttttgtagttttgcagtatagggtggtgatatctcctgtttgcaaaactgttggca

SEQ ID NO: 826 - DNA, 352 bp, Rattus norvegicus
  Genbank Accession No. AA924024
tttttttttttttttttgcattagacacagtttaatcaccttcaaatagattaaaagtcgtggtttgcacccctccctgtccccgtaagtcatccagacaagaccctggcttagaaagagaaaaacacaggtgctctaggaaatatagccacatataatacatagatcttcttccctgaagtagcgcaggtcctgagcagagcagcctggggggctacagtccacccccaggatgaagtggctcttggactctgccggtggaagtgctggaagagtaggggcttggatgaagcccctggtgtggttaccattgccagaggtgggctgaggccttggagtgggatacccggga

SEQ ID NO: 827 - DNA, 576 bp, Rattus norvegicus
  Genbank Accession No. AA924028
  misc_feature (1)..(576): n = a or c or g or t
tttttttttttttttctcacaaaaattcttttatttaagcaagttttaaaagtaaagatagacacataggcttttatataaatgagataacccaatacgagtcacagaagcaaagagcagacgggggctgagaagagaacagaagacagagaacgaaagttttactttagtatgcccaaagctgaatgtggaagtaaaaagtttctacactaagaaagtctatataaattatatgaattgtaatttttttgtaaaagtcaaaatgaaatgttctgcatagaacaaaagatatgcctaagcaacatatcatatttgtacaaggccactgaaagtcatgaatattagtaacaaatgaaaaaacttaactctgtagcaggctgagtatatttcagtttggtattctaataagctcaagattgtaaactattcttataaaaaagcagtaatggcaggcaaatttgtgtaggaattcttgtgcttctggttggcacattatctactttctaatatggtgaaattaatacagacatttgtaaaaggttgtgcaaaactattgtatttacaaaaatggcacan

SEQ ID NO: 828 - DNA, 309 bp, Rattus norvegicus
  Genbank Accession No. AA924053
tttttttttttttttttactttaaatacactatttattcattttcccaaatataataggaaagtaagatatgatgacagcagcagccacagccctccaagctcagtacccagagcagcacactgcagagtctgatcctgggagcagctgggagagcggagttgaacctgagaggctcaggaggccagatgcatggtgccccaggcccctgcctcagcctcccactggctcggctgggctgacagaaggagggaacagctccagctgcacaatggtccctctactctacccagatgctgtgaaatgatgt

SEQ ID NO: 829 - DNA, 416 bp, Rattus norvegicus
  Genbank Accession No. AA924130
tttttttttttttttgtgatacacctcaggaatcccatgtatttatttggagcaaatacaccagctgtcaataagaggcctgaaagacacagaaatgtttcaaaaccgagattcaattgtgatacaatatcatcatctatatacataaataaacagatacaaactttcaagtaaaactcagacttatgacagacctttataaattggatctatcccttcactgactccaaatcttcaaataagtttaatgtgctgaattccgagacccaagtgctacttgcagtttatgatgaaaggcgtttatccgttccttttgaattggccagttcaagatgcaatgagatttaaacattcctcttcgcaagcagagtgcatggtttagtttgtaatctggaatattccggagaaaaatcagt

SEQ ID NO: 830 - DNA, 280 bp, Rattus norvegicus
  Genbank Accession No. AA924140
tttttttttttttttttaaggaaataaaacacatttattaatccactcagaacctagatgagcagggggaagggatggctgattcacccccagcgcgcccaccacagagggcagctggccccagagctgcagaatgcttaagcatagacctggtgctccctctccacaaaggcctggaagaggctgcccagctcctggggggctggggtctgttcaccagtaagcagtcctctgagagcctccaggccctcctgctccagactctgctgctcttgccgca

SEQ ID NO: 831 - DNA, 275 bp, Rattus norvegicus
  Genbank Accession No. AA924144
tttttttttttttttttcagccataaaaataaaggccttttatttggttttctatgccattacaagaacatctggacaacacttcagtgtcagcagagcctgagaccacaccatgtctactaaactggggggctagatgcaggagccaggctcctcaccaggctctaggaggggctccgggttaaggggtcaccttcttgtaggtaatgtgaagatgctgagtcattggctgtgtagtggttgccatagagaccgtctgttcaagtttgccttca

SEQ ID NO: 832 - DNA, 577 bp, Rattus norvegicus
  Genbank Accession No. AA924151
tttttttttttttttttcgctttaagaagattttatttccaaattaagacgtgtaagaaagcaagccaggtgccccctgcttctggttgcaatggaaatatctggcacaacaaaccatactgaacccatttaaaaactgtcacgagaacagagactataaagaccccagagaggaaagagaagaacccgggtccttgacatttctgcttctacacaggcactggctcacctggaattttaaaatgttcagtggcttcttggatgtttccaggggcttcgtctaagctgcttaactccaaatgaatcctagaatgtggctgaggttcaacagcacattcttatgtttaagacagagcatccactaggtctaaattattcttcaattatatggagtcaagctttatcatctgttataaattccccttccatgggaggccattgagttccgtcaccacaagacaagacagtctttggttatatagagacgaataattgtaaactggtagcattaacacatcttttgcaacctgtgtaggtattgccaaatagtatgtgacaggaccagttatcaacactg

SEQ ID NO: 833 - DNA, 458 bp, Rattus norvegicus
  Genbank Accession No. AA924210
tttttttttttttttttagaatacaaaataaggagctctttattattatttatacaaaactggtacattaaaaaaaaattaagattcaacaactctgctgaccccctgaggaagctaagagcttttatgggtccaccaaaggagcccataaatgattcagtcacccaactcctggccacaggaacaaggcacacagctccagggccattcatgtggctccatcactggctctgtaggctgacttcccttcattaggctcggcaagcaagccaggctttcccggaccaatgctcctgagcgaggtcttctctggcccaagctagagcattttatccgtgtaaaagctgagtacttttatttcttaaacacttccaataaactcctagcattagacactttattacaacatatacagatttgatagtttaccaagaaatctagaattcagctaaatcctc

SEQ ID NO: 834 - DNA, 226 bp, Rattus norvegicus
  Genbank Accession No. AA924261
tttttttttttttttatggcaactcctgttttattctcaattacaaacacagcaatgggaagaagaaggtcaccaaccagattcgtgtgacaggcctggtgggtcacctcagagattcgacattgtgaatggcccccatggggtcatttttatacagcatgaagtagccttgcacctgggcaagactaatctgggatgtagctttaaggacatgttcagcaaaatt

SEQ ID NO: 835 - DNA, 309 bp, Rattus norvegicus
  Genbank Accession No. AA924267
tttttttttttttttttggagtttttcagtggtcttgatgatgtcataagaacatttgtaaaagggaaggcttttagaagagggggtatgggaagggtgctggctttaaagcagaggaatattccagtgctgagaagggtgatctgtactgaagagaggaggagaggactctctgaagcactcttctgaagaaggctagtcacaccaccaactcagctttctgccagtgaaactcatttcagatttcggagctccacaacggaattagtggagcttcttgagatacaggtagatcccatttttggactt

SEQ ID NO: 836 - DNA, 295 bp, Rattus norvegicus
  Genbank Accession No. AA924316
tttttttttttttttttgtcacacatctgcctttattgtacacagcaggtgggacatgtagcaatggtaaaaaattaatttacaaaaccacagacttggtgaactgcctgctgggtacccttggacactcatacatatatgccggcccacagcatgaggaaaaggactccaaagcccatgaagagggaggccaccaaggacatgaggagctctttgtaaacatcgcgcgtgtacttggtaaacgtgacctcgtaaacgaagaaccaggcagtgaagaacatgccgatggccaaaa

SEQ ID NO: 837 - DNA, 511 bp, Rattus norvegicus
  Genbank Accession No. AA924335
tttttttttttttttttcagaattcaattctttaatacaaaatgctttttttttcttaagatatatctgtatttctttgttgctgtttaaaaataaatatgtactacggaatatctcggaaaactgctctagagacaaagacgtgatgttaatatcttttcccccacaattattacggataaacagtagcaccaataaataaatgataacaaatattaaaattaaaaaaggagagagatttagtatgtagaattctctattttttctcgttttgtttttacatataaaaaacagaatagcaatgtctattttatcagaatcacatatatacataaacatatatatatatatatatttatatacaaacacaagttgccaaatatatatatagtatgtaaatgtatattgaaaccttatttcaaaggaatgtgtggtggggacaggggagggcagagctgagtgttagcaaaattaaatatcttctcaggacaagctagtgactgtcaccgat

SEQ ID NO: 838 - DNA, 517 bp, Rattus norvegicus
  Genbank Accession No. AA924336
tttttttttttttttttgcctagctaataaatagacattaggcatgtgaggtggttaatttcccttctccctgttccaagtagtgacaggacctgcgacatcattggctgttacataaagctcctgagaccacccactttctcctcccctttccatccctgatgggagccacaacaacccatggcatgtacagtgtgatgtaaccagggctgcctgcttccggacctgctcctcacagctcttgctcagacggagggcattgtttttttagcaacatctgggagtgcgaacggaagcctggagccctaggatagctttatttccccctctgggtggcctggcgtcagctatgtaagcttgttttgctctggctgtgtctcttggcctggaagaacaccgagttgcaaagggacagtatgtgatggtccctggaaaagctgcttcccctgcgaagttctcccactggcttcgaagagatgctgttgtctcccaaattctccttatccaccattcacgt

SEQ ID NO: 839 - DNA, 355 bp, Rattus norvegicus
  Genbank Accession No. AA924405
tttttttttttttttctggttttgcgtttttattggggtttatcatgggcaggaggaactgccaccataaagtatgcccctcccaccaagcaggtccattctaatcctcctcccgggccttctgcgactttttctttttctttgtgctgctctttgtgcagcttgcagcagcctcaggctcctcagaaaatttccttttcttcttaggggtgatggggcttgctgcctcttcaggttcactggccacttcctctttaggtaaggacttctttttcttaggaacacttatgctgctagtagccatctcttcaagatcactggccaactcctccttgggaaaagctttctttttcct

SEQ ID NO: 840 - DNA, 537 bp, Rattus norvegicus
  Genbank Accession No. AA924413
tttttttttttttttttcaagacaaaaagtttattaacaaatatacaaaatacagtttgcaactgtgtctttataaaaattcacctttgtatataagcgatactatacaatacttacaggtatgtacaagatccccacctgtatgcaattctctgggtcatctgtatcctcacatcttcaagagaaacctcacccatgaacacggcaccattaagcctctttctgtaatggatttcaatcacatttactgctgagattactcaggcaggtgagctgatgctggacacgaacccctcagtaaagtgcagttttaggcaaccccttagttttcctttagacaggtatccacagtccataaggactttttttcttatctatttttggtgatcctgatgacgtctcttcaacagcagctttcgttgttttctctagaggctttgctacagaattattagagctgaacgctatgtttctctgtgcagcagcagatttcccactggcatttttagttcccacttcagtctgcttttctgaatg

SEQ ID NO: 841 - DNA, 450 bp, Rattus norvegicus
  Genbank Accession No. AA924426
tttttttttttttttttcactgtacattctttattactgtccatacccagtaaagtgactttgtgtgaacattctctcactttttcttcttgcctttcggagtttcaatgggcttcccctcagccaaagccaactgtttctttagatccaagagtttagccacttctgcagcaacctggttcttgtctgccttctgtgctttcagttcccgaactatgtttccctgtttggttacctcatccaccagcacttgtatgtcctgcgaccctgctgtagtaactgcctcaacaactgctggcttgggggaccctttagcctggagaagagaagagaattattacttgctgccataaataccctctggcctccagtttcacgtaacatctcagaggaaacagttacctgtaactccaaagactcttctagctaagacaggaaagaaacataagt

SEQ ID NO: 842 - DNA, 400 bp, Rattus norvegicus
  Genbank Accession No. AA924455
tttttttttttttttttgcttggttagataatatttattaaacacaggtgggcacagcagcccatcgtctcccaaaagtacagaaactggtttcacatgagcatgtctgcgtacatcacattcttgggggaagagactcaccacccgcgcactgaaaagagaatatgtcggtttagtacctccagacttcgttggagcagtgtttacttctttagttccacaccaaggtctaacaaaatatgatcttcagatatcagtaaggactcaagaaatgatttttaaagtcttaattgtaaagttcataatgtgtcttaataggccaaagataccaaactcaaggatacaaatcataagcgagctgaggcagacccccgttgtcaggccgatatcctcacactgg

SEQ ID NO: 843 - DNA, 384 bp, Rattus norvegicus
  Genbank Accession No. AA924460
tttttttttttttttttcaaagaatgtaattaggtatttatttagtataaaaggcctgtgcacagtgtaacaaatacaatttttacagctgttttacaatcgtggcgtctgttcatttgtgtttcatgctctgaattacttcatccagtagtttgctcacttctttgtgtctcgttactgctcgactcatgcagtcctgaagtttagctccagtcagcccactcccacctggcttgtgaagacagcacagcttgccttcctcgtccattactacggttaaggttcctgtggacaggtgctcctcctccccggtaggatcgactatcagcaaagtgtcatcaaacacagcaaatgaagtagcaactgggtttgctctaacattca

SEQ ID NO: 844 - DNA, 510 bp, Rattus norvegicus
  Genbank Accession No. AA924557
tttttttttttttttctatttagaatatttatttatcttttacatgacaagacacaaaaagttacaacttcttaaaactcttcaaaagaaaaaaatataattctgtaagcagcagcagcagctttcaaggtacagacataataggaggggtggctcccaggagcaaccgtgaactaggggcagcccagacttgagccccaggtagtgtcactgggaagggcctccatggagggggttgggcttgagggacacagcaccagcacttcagtcaatcaccaaacacaatcacatggccagggcaggggaggactgctttgattcagaacagaggatccagggctggaagggtggggctttccaaacatggatagaggcccagagagctgggaggcccaggctccatagtgtccttcatgcctgcccttccccccaagcaatctctgtctgggagtagggctctgtcagaagagttaccaggctggagaactaaattatcggatggggtcagca

SEQ ID NO: 845 - DNA, 426 bp, Rattus norvegicus
  Genbank Accession No. AA924575
  misc_feature (1)..(426): n = a or c or g or t
tttttttttttttttttgggagggaaaaaattaaatttttatttggtgttaaaaatattaacaatgtgattcagtttagaaaatatccgtagcatcaagaggagtcatgtgtggatgccactcaggcacccccacgtaagtaaatattgttcgatgttgaaattttgattattcatcacccctaatatgatttagtgtccataatgcccagttagtaaggtaacctaaaaagagccgagttcaatccctctatatcttttagattaacaagatggtccttatctggaagcctgggttatgtagcatcaatgatgtttgtgttttaccctgacactcatcttcagagaataccctcaggcaggaaaagatctaaaagatgttagtcactgcccggtctgtaaggtancatgaacatctgccgagctt

SEQ ID NO: 846 - DNA, 532 bp, Rattus norvegicus
  Genbank Accession No. AA924591
tttttttttttttttttgattcccatcctctgctgagtgtcccgtcatctcatttttttgccctcatttctgtagcttttcctccagactccatcccagtttgtgcgtggacccatttcccatctgttttcacctctgaccagccactgaacttgccgccagcagcctgtcctccagcctgcttacccctcattatcattggactaacagagaaagatgtattttagagggaaactcttgcactttatctctcttcagttctcagagtcttgggacaatggacatcatgaattaaaatgttcttaaaaatcacatgctgggagaaaattaatcctaaaaattctggcaccagccagaggaaggatgttggctgaaaaaaaaagatttctagatatttatgtttgtctcatggtgaaattaatgtatgcctcatcttttctatgaaataataattctgatacagaacagtagagagaaatgaatagtttttgctactttgggccaaactgttaataaatcccctcgtgccgaa

SEQ ID NO: 847 - DNA, 467 bp, Rattus norvegicus
  Genbank Accession No. AA924598
  misc_feature (1)..(467): n = a or c or g or t
tttttttttttgggggctctccaaaagcacgtggtttattatggtgagctgtagtgcacatcggtttctttagtaattctaagctgatacaggttccccactaggagtacacatggggagtgactgggcgcgcggtgacagtgacaaaccagtgagccactgtgatccatagaaagttacattagcaatcaggagagaaagggaagtgtgaggtggcccagaggcaggatgtgagcagagcacctccactgctctcatggtggtccacaggatacccagaagctgagggggccttggtggagggaggctgtccccctatctctaaggaactgggacttagtggttgagacgctccactgcctgcaggtggcaccttttcctcaaaagctcatcaggcactaagtccatggttgttgcanaaggtgctctgttctttcaggtactcggttctggttcctcccctcctt

SEQ ID NO: 848 - DNA, 446 bp, Rattus norvegicus
  Genbank Accession No. AA924609
ttttttttttttttgttcaatcactttaatgctgttatggcaaatctgtaaaaggctcaggacaaacttcttttatttttgttcctttttaattacaaaactaacagctgttagaattttttctttacttttttttttcttttcccagctacaaaatactctggggagatgcattataatttaaaatatataatattgcacaaacaaccaaaaggttaattaaaataattacaaagagaaaaacccatcccatcaaaaaaaatttagcattctgtccaccctatccccttcactgaaggtttgaagtgcccaccattcatagcgtcctgaccaagctcctttaaatgagtcactggtgggtgtgccagcatacagcatcaccagagcagcatctgtgcaccaggtcttcatgcggccctcactgtctccggatggtaagagcccca

SEQ ID NO: 849 - DNA, 471 bp, Rattus norvegicus
  Genbank Accession No. AA924615
tttttttttttttttgtggttatcattcattcatttattagttgaaaacagctttgactaaggaagcaggaagcccataattcttgggaaaacaggcttggaagtcaagtctcaggagcggtaaaggcccactttccacaggttccctaggcataaaatggcatcctgaattccaagtttgggctggatgcttttcacaggatgacccttaataaatacagcagtgctgagggactcagtgacacagagaccccaccctggcaatctccttgattagggctctttgcctctgaagaagagtcattcgttagacttttctgcagtccacacagcaggaatcagtagtaaacacttccaacattcagacgtccaaggaatgacagcttcctgaagctcacccactgatactggctttcccatctgccactggggcagagatctgggccacaaatgtggaggctggacttcttc

SEQ ID NO: 850 - DNA, 527 bp, Rattus norvegicus
  Genbank Accession No. AA924630
tttttttttttttttttcaccgtgtcagaaactgtttaatgttagaattacaggcttttggcaagtatatggcaagcccatctgtccgttcccatgtccactgagaacacagcagagggggcatgccccaagctctggcctcagtccagacttcagcttgggtttgtccagcgagatgtctccagtccatgaaagcccatctggctacagcttgagttcactgggcattggctcccctcttaggccagccagcaagttgttagccgccagcaaggacatggtgttgcgagttttgtaggtggcactgccgatgtggggcaggatcacgcagttcttgagggtcagcagggggtggcttggaggcagtggttctggggtggtcacatccagtcctgctgctgcaatctgaccactggctaatgcctggtacaggtcttcctggtttaccacatctcctctgctgatgttgatgaagacagcagtgttcttcatcttctggaagaagtccttgttgcagagccccctgg

SEQ ID NO: 851 - DNA, 415 bp, Rattus norvegicus
  Genbank Accession No. AA924658
tttttttttttttttttaaaaaagaatctatttgtttattgaaagttattttatttattgaaagtcacgatctggaacattcaaatcagttctcctaggaaggtggcttgagggagatgtggggcatagagccagcaacctgtgggcagttgaaagatgctgagctgctggggctcgctgcactctgagcaggccagagcgttctgccctgtggtgtgctgagtggctggagaccctgctagccacacgctatctggaaactttcttcttcttcttcactggtgcgctgtccggtgcagtgtctactgccactcctcctggcctctgcagcgtcttctttgctctcctcttcctgggctttgggacatcatcctgggtgtctggtgtctgcacacgatcctctgcagcctccaca

SEQ ID NO: 852 - DNA, 352 bp, Rattus norvegicus
  Genbank Accession No. AA924737
tttttttttttttttttgaccaccaccgagattttattcttaaataaatgctcagtctacggccaggttaggtgacagacaggtgggcagaatggaagtgcaagtccaggtgcccctcactgtgggtgtacagatgccaggagaggcagggacagctgaggaaggcaagcaggtacatgagctgtaggggacaaattgaaccacttggaatctgttctgtgtacgccaggaagggcagaaagaacctttttcctgtattttaagcggtggtgctagagagcctggagtggtcctgagctcctgagcccttcccaggctccctatgcccagcgtatgggctccacctgttgtc

SEQ ID NO: 853 - DNA, 551 bp, Rattus norvegicus
  Genbank Accession No. AA924756
tttttttttttttttttatagccaagtagtccatttattaacaaaatagtcttagcaagggagagctctgttcaccccacaagaggccccgcagccgaggcccgcagccccggcgctgcgtaagaccgggaaggagggaaggtgttggggagaagacttggttaagtctttaatcctagccactgcaggaacccacggaaacccagtgccagctttggcgattgctggctcaggtctgggacatggcgaagggagtcctgtgatcctagggctccctgagtccccagcctgcccccaacagagctactactgctgtctggtttgctgacttgaggactagtatgctttggagggatccatcaaagatcccccaccccgcccctatggccaggggaggaggcaggccacagtcccaactagggagagaaaaaaaaatagtaacgataaagtacttcacaaaatataaagagcaatttcgtgccagcggggccttctaagacatttaattggatgtgtcaggtccctgtcagccggcaatcccactgcacgga

SEQ ID NO: 854 - DNA, 465 bp, Rattus norvegicus
  Genbank Accession No. AA924763
tttttttttttttttttccggtttggttaacacatctgagcttttattttttagaatatagtctacatctggattaaaaaaaagttttaaataaacaagacatataacaacagtggagcccttcatcattctacgtacaacacagatagaatgtcagttggttccactttagataaatccactttctcacaataatgttattattttcgctggccgagtggcaagcttcatcctagctggcacgtcaccagtttacacacacggggtgggggaggggtggcgtgaaagggatggggtgccataggactactgtacagtgtaacagaaaatcattaataaagtagtaccggttaccaacagtgctgcctgtgcgcttatcacaatggaatcgacgaagtttcaaagcaaaaagatctgaaatacttaagacagggtcactgttacaaaaagaaatagtgcaaacag

SEQ ID NO: 855 - DNA, 479 bp, Rattus norvegicus
  Genbank Accession No. AA924768
tttttttttttttttctcaaaactcagctttatttgcctccattttcccacagtctgagctcagctcatctggctttgatgggtctcagaggcccagtgttacagaggccggtcacagcctgctccaccaatccccttgctggccttgggctccccaggcaggaggacaggtggctcatggaggatgaattgatgataagaaagagtgggcagcaaggtcagaggtcaaagaaagccattcaagcaatatgtccgacactccctctgcatgccgatccttgccatacacactccagccaaggcagccttctctcccacattctgccagcccacagccgtccaggaccactccctatctactcagtccactgccccattagcaagggaaaacaacctctctcagatgctacatgaatctgcttgctccaacctgggtctagcaagaagggactaaggttctggtcatctacaattctcac

SEQ ID NO: 856 - DNA, 520 bp, Rattus norvegicus
  Genbank Accession No. AA924794
tttttttttttttttttcgtgggagtgttgttttaatacagtctgtgccaagcaacatcataatctccaagtttctcctatctttaataggcaatattcagaatttaaaaaaaaaacaataacaacactgcagtcataaaacaggccagcgacacttttgaggagacttaaaaatgagaagccatgaattatcttctttgaaaagcagccatttcaaaaggttttctttaatatcataaaatattctcatggacaagtgagcgagcaaacacacatgcaccagtgtgcctctgacaagagtacccacctaccccacccccaagtggacatgaaattagagaaatgaacacagcagatggaacaggtagaaggaaaaaaattcagtaaaaagaatggaatataactttgtgcttggttattttcctatgtcacaacaaaaacatttcggtgcaaataattaatttttcctcttttccatttaagactggtggagaaaaaaatacttttctataataaaata

SEQ ID NO: 857 - DNA, 389 bp, Rattus norvegicus
  Genbank Accession No. AA924803
tttttttttttttttttaggtaagtagattttaggtagtccgggctgcacatccatttcatccatcatttatgtctgatgggactagatacctaaagctactcttagctccaggaaggagtatctcccgtctccattggaatcaaatgctctcaagtgttctggtcttggcatggcagaacctagggaattccagatttcctggtaggtcagcatcccatccacatcttgaccagtcttgtggaataaatcctgaagatctttgatgctagaaatcccaggcagggagataggttttagttgggtctcagtttggtctccaagaaactgtgagaattttggcaatgttgaaggatctgatgtgaagttctgtactgctcctcatctgtg

SEQ ID NO: 858 - DNA, 402 bp, Rattus norvegicus
  Genbank Accession No. AA924813
tttttttttttttttttcattattattatttgtttattttacaatcagtatgccatcttttaccactatggctttaaattttcattctacccaacaggtgtcaaggaatagttaagtccatgccttaataaaacagttaaaatatttacagattcaaaatagatgttttcataactgaaaagttcacctgagagttcactgtaacggtgccgttggcttctctcttttctttccaagttgttagcatggctgagggccctcacgccatctccactatccgtgtcctagatgttgaattcctcacttaaaattggctaagcatcaagctacagtaaattgttctaaagtttgcaggtggacaaccaatgtcatatccatgtttactcttaatataagcaattt

SEQ ID NO: 859 - DNA, 497 bp, Rattus norvegicus
  Genbank Accession No. AA924902
tttttttttttttttttcaagttttaaaaatcactttattaggttgaatagttagagtggtgagaactgaatgtcaacactgcttacactgaagtgcagaattgaacttcactaggggagattgaatacacatagagacaactcaagatcttcctgggtttgtacatgttaacaaattaccaaggtaaggccatatctgagaatctagctggtccctgaatggccccaggttcccctaataattagttatgctatcatttaagtcttacagatattgatcatttagttcctactgtatgtttcaggagaattttaggagatggttaattattcgggtcaatttaattattcaaaatttgtgcttgagtgctgttaaatatacttgttcagccattcgatgagattcctcctcgcttcctcaatgtagggtttgtctgcaggggagcagtcttctctcttccgatgcacaaagccatgagtttgcccagaaaatgtct

SEQ ID NO: 860 - DNA, 459 bp, Rattus norvegicus
  Genbank Accession No. AA924913
tttttttttttttttttcatttccacaaagaaagaccatcttcctaccatgtgaccctggaggcttctagaatcaacagctgggctccctccaacaggccaaggggagtggatgcttctgcttggagaagtaaggcctaagtgggcaccagtggctgggccaggctcagtgtaactggatgaaggcctccagctcctctgggataaagcccttataagggaccttgttcctgtccagggcacgagcagctaggcactggagtgtctcataattgaagggctgcatggtgctcttggctaacagcttcgagtccagcagctcttcaggaactttctggtgtgggggctgcaatcaggacccaacgtgggccaagctgccctggctggcagctctccaccttcccctatcttggtcacaatcccatcccctgaagttattagatactggggactcctcatt

SEQ ID NO: 861 - DNA, 377 bp, Rattus norvegicus
  Genbank Accession No. AA924943
ttttttttttttttgctgttgccaactgtttattcaggcccaaacagttcatgagtgcagcatgcagcacccatggtccactgcaggccactccatcagtagcaagacccgaattatcagagaccggtgcctgtggcctgccacccagggtacactcaagacgccaagggtgtgggtttggctgagtatgaaaggtaccaggcagaggtcagcttggccacaaaatccctgctgacatccagaaagatgaagaagcactcatcattgggtgtgtaggcacggtgtgctcgcagagctcgcttcacctcccgcatggtcttcagatcaaacaccagcaagtcaatctcctctgcaatgggtggtggctgcatggggtc

SEQ ID NO: 862 - DNA, 448 bp, Rattus norvegicus
  Genbank Accession No. AA925019
tttttttttttttttttagtacaaacaccccagcacatggcagcatatggcaagctgtcagtgaggtgctaatttattggatcgggatgaggaagtctcctctgttcaagaggatggggacagtcctggctaccctgacagtgagatatgcagggtctctggccagatgaaggtccaaatgggaagacacctgtcaatcagtcatgggagtgccacacaggcctggctgtaggtacaggaaccatacagacagctggggcaggtcccctgcacattcatcatgaactatacaagatgaggctgtacatgagttaattacaaaagtcattatttacaaaaatctgtacacacatttgaaaaactcacaaaattgtcatctatgtatcacaagttgctacaccaaaatattaaaaatgggataaaattatatgtttctcttctcaattct

SEQ ID NO: 863 - DNA, 118 bp, Rattus norvegicus
  Genbank Accession No. AA925049
tttttttttttttttatcagtcttataaacaaaactttattaaatggtacagaagatcctgtgggagataggaccaccaaccgtgcctgtccagaacaaaagttggctgacccacacc

SEQ ID NO: 864 - DNA, 487 bp, Rattus norvegicus
  Genbank Accession No. AA925061
tttttttttttttttttccaaaccacgaatcgccccaagttttatttgtagtccatacaaaagagggggggaaaattaagatttctaataccacctacttggggagatagggaattgggaccatgccagtcaccgtcagctaaaacatcagtggtaagcagggatttggacacataccaactgactgtcccaacaggatctcagtctcaacaggctacacggacagtcagggtcccctggactgctggcacagcacataggaaatggttaaagtaactctttcctggcctccctcacatctaaaaagaataacgcgccgcctgacctcagctgtaggttgtgtcacctccaaacaaccttaagtatcgcgcacaaaaataaaagggagccaggaaaaaaaaaatataaaagaaattcccattttggggagatggctgggtagagggaaaaccgcagatctaaagccagtagcaagatgtgctgctga

SEQ ID NO: 865 - DNA, 187 bp, Rattus norvegicus
  Genbank Accession No. AA925083
tttttttttttttttttgactatgtttgtacactttatttaaaaacaaataatacacttagagccaccaaaactggatatcagttagcttatccacaccctggatttacaaagacactgcttgcaccacacgaatccgcatttggatttacattaattgatattgtaactaaagttgcctcgtgccg

SEQ ID NO: 866 - DNA, 425 bp, Rattus norvegicus
  Genbank Accession No. AA925123
tttttttttttttttttaatttttatatatttttctttcatttatttatttattttttttgccttttattgaatcttttatggaccccctcactgtttgttttcgtttgtttgcatagggagaaacagaacagcaggcagtcaacggtgctcaggcgggtccacaaaacaaaacaaaaagccagaaaccaaaatgagtttgtaatatatggttatgagtggagtatgctgtgggtgggggctgtggagcaggaagggcctggggtgcctctgctccccatgcagaccccattcgctctgggagcagggggcagaggttgccgcagaccacgcaagcgcagttaggaaaagctgaagaccagaggtgcatggacccaggagtaaaatacaaagtggctgaatgagaggaaaaaaaatccctcgtgc

SEQ ID NO: 867 - DNA, 505 bp, Rattus norvegicus
  Genbank Accession No. AA925145
tttttttttttttttttgacaagcaacacactattttttttaaatcaatgttccaaagaaatcaaaatttagaaaaggaaaattattcgcaatttcactaatggttactcactaatttgttacattgtagcaaaaaacaaaagtagggcgcagcatacaaaccaaacatgaatgtggaaagtgctagaacaagatgaacttgatctctgacttctagaaaggtcttccaaggttcatgcattttacttgaatcagcaagtgtttccctgagcgttggtgattatgtttgtcgtaatgctaactagagaggaaggtaagaagcacgttctatggtccttggccatcagtagtttatgatctagctatgcctggttataaagatgcacttactaattctaagaccttaaagcgataatcgcctttgaaagccaagcatcatgactgttcaataatcctgccgtcactcgcaacagctttggcgtctcctctactgagactgtaactc

SEQ ID NO: 868 - DNA, 452 bp, Rattus norvegicus
  Genbank Accession No. AA925212
tttttttttttttttttcagcagtatctgcatctttatgtacactacagggtgggctgggcagagtgcctggtcccagggacacaccacttttaacactttacaaaacccaaaggaaggaaggggcaagtgcaagtccaggaaatgaggccaaagtcacgcagagaggtcgctgttatcaaaacgctcctggtcatacacttcagccaccaccttgcgaccaccaaaccagcgcccattgagggcctggatggccttgtgagtctctgaagccatggaaaattccacaaaaatcttgacgatgatttctgcatcttcctcctcgccctgtttttcttggtagataatgacccggttcacagcaccaaatttgccacattcctctgtcacctctccctccaggtcatcatcaatgtccttgggatccaccatgtttcggagaaccatcactgt

SEQ ID NO: 869 - DNA, 524 bp, Rattus norvegicus
  Genbank Accession No. AA925243
tttttttttttttttttgaagtaggtacagaactcagattttaatactgctttacatatttcgtttgtgaaataattcctatagttttattaacccaaaatgccaactggtaacaggtttgttgaatgttcactcgtcaagcacagtggataatcttacgggggacatggcgaaggcttatttatatacaaaggtggaagctcttatcctgcacgcggcatggacacgcgtctgactccttcttacatattttcaaagacattcaagtgaagacagacagactcagactggctgataaactcttcagttgattgaggtcctttgttttatctttttgtgataagaaaattcaaaattatccatgttgaatttctcatcatacattcattaaaaatacagtaaaagaaaaaacaaacaacaaacaacaaacgaaccgcacagatgcataagggagggctgtggaccagttagtttggcggccgtaagagcggcttggtttgctgctggggttatctgctaaagaa

SEQ ID NO: 870 - DNA, 483 bp, Rattus norvegicus
  Genbank Accession No. AA925267
tttttttttttttttatagctaaacaattttattggctttctgtgaaataaaaaacaggaaccgtcatggttaaaggcgaatcagtgtcaaccaaatgaaccagccacttggttcgagcagccgtggagaacacgagaggacattattgcttacgccccatgttcgtgcatgtgtctgttgtgttttggcaagaatacaatcggatggagctttggttaaggtcgactaggactactcattgaaaatccctgcatggcacctcctcaccagctcctccactccaacccggggaatcttcacactccattaaaaaaaggtcgtagaatttggaagaagaggtagcgaggtaaatgcggtgcgcaaagatgtgctcctggtcgtggaggataaagaggacgtcggcgcataggggattgtccagtaaacaggctgcgtcgctcgtcccggtggacggacactcggggactttgatgaccggggga

SEQ ID NO: 871 - DNA, 510 bp, Rattus norvegicus
  Genbank Accession No. AA925274
tttttttttttttttttgaaagtcagacatgatttgtcagcctttattagtcaagagtgaagccgagacctagagtttcctttaaaaaacaaacaaaaaaccaacccaaccttgtttacagcaaatgatgactgatttctagtgacttttaattatacgtttaagactacagatcaagaattgtttgttttccaatcatatattcttttgagattaaaatacaagtgtaaaacaggttaaaattagattcaccccaatgatttaaaaaacaattccaattgaaagaatttcaaacaccatgtatagaactcaggaccaaaagacaaccatagaatctttttacctttgaggtagcacaataatgcttaattggtttttttttttaaaattattattacaatgaatttaaaacataacaacaaaaaacgacgaatctaacctttgctcaaggtgggctatatggttttctgcaaatcccccatgaggtgagtgacaattttcactcttttt

SEQ ID NO: 872 - DNA, 454 bp, Rattus norvegicus
  Genbank Accession No. AA925300
tttttttttttttttttgcttcattcatctttggtaagacaggactgacacagcatacctggaagcttagtggggcagcccaaacctctacctcctgttgctgggggacgctgggctttacctcaggcttgtgtgggctcatgcagcccagagattctctggtggtctccaaacattgggagagaaacaaagtaacactctggatgaagtaacactattcatacccttgagtaggtcctgtgcctagtccctcttgacttcagtgctgtctgcagtgttaggacacatctgagggcaggcaggacccatggcagtcttacatactggtcccagcccttcctgccacactgagcttaggatgtcaaagctcttgggtcttacaggctggagctcccagtcttgatgccagatcctggctttgagtcccagcggcagatggggcaccctcgtgccg

SEQ ID NO: 873 - DNA, 543 bp, Rattus norvegicus
  Genbank Accession No. AA925306
  misc_feature (1)..(543): n = a or c or g or t
tttttttttttttttttcaccagcactcttccctttattgatcgcctggcagaatcacattatgcaaccatgactgcagcaagaaccacactgaatggaagcaggaagtctggggctcaagagtcaccagagagtggcagctgggagatggcacctcgaggtgcagggtggaggctaggcctcaggtgtcccttaacccttactatggagaggctgaggcccctcatcgatagatagtcctctgactcctggtccctgggtatttcctcatgaagacagattctggcttggctgtggagatgaaagagactggccagggcggaggaaagggactcttcacagctcctgctgaggaggggtgggctggacgggttcccttccccatgattcacatcgatggatgatatgctggggacccgggccttagtcttgttcagcctctgggctcagccctatacatactacagcaggtgctgaggacaaggcctggaaggcacttggcttggacctccgggccctgctanagaatgcttatctggctca

SEQ ID NO: 874 - DNA, 479 bp, Rattus norvegicus
  Genbank Accession No. AA925318
tttttttttttttttctggttgtcaggtctgaaattttattaaattggaaactatattaatattagatcttaagtcaggcagggttggggtcatcaggaagaggtttggctgctggggaaggaggtggctggttttggctcctgcgactgtgaaccacgatgtcatcatattcatcgccttcatctctgttgtcactgtcgctgtcactgctgctgttgctgcaagggctaagcttatcatcctcatcctcgggctcaggttgggttgggttgggggtccgtggcaacaggggcatggctggtgtctggggtgtggtcctggctctgagtgaggtaggtatctgaggcatctcttgggtggctgggacggggctgaagcagtacatatgcacacgtgtgtgccctcacacggcaggccaagtgcagtgctgtgtggccccctctctcagtcaccaacactcctgcgccagctgcataga

SEQ ID NO: 875 - DNA, 540 bp, Rattus norvegicus
  Genbank Accession No. AA925341
tttttttttttttttttcactgtaattcagactttattgctcatcagtcacgtcatcacacacagttttaagtaaacagactttgagaaaatatactgggagcattatcagaccagcattatttttgatgcaaatgttcaagtgtttataaggtaacaagggatagcattaccaccgtctgccccagagatctatacatttcatagaaaagagtaaaaatagttcattggcatttaactagcattattgtttgcaatctaagaaccacaataactttgaccagagaaccagagaaatgacctttagaacagaacaaagtactttttttctattacaaaatgtttcttgaaaagaaaaaaacaaatcaagatgacaatgaaaatgcacaaacagaagctctcaaagaaaagctgttgtagtctaggcttctccaatatttgtctagaaaacaagacaggcgtgaacaaactctcactgtgactacaggtgtgagcaaactctctcactgtgactacacttacttttcagctcatacaattt

SEQ ID NO: 876 - DNA, 571 bp, Rattus norvegicus
  Genbank Accession No. AA925355
tttttttttttttttttacatataggaaaacaactttattaagaaggctttcaagtccaaaaataaaactctggatacaatgtttttaaacccttaaatcagttcagcaaatatataatcagtgatttaagctgtcaaagattaaaggtccgttgctttatttaaaataaaatatattttagttcttaaaatttattccgtaaagtacatatatctaatataaattccctacatatacacagggagtatgaagtaaaaataacaattaaaaaaaaaactttaaaaacctttttaaaaaacaacaacaacagaagaaaagaaccgcaacactgagtcttaatttaaaaacaaaagaaccacaatcaaacaaaagttataaatctgttgatgggaccccccttggataccctcccattaccctcctcttggccactctgtggctgatgtataaaatggtatatatttgccccaaaaaaagggagtgtgttgggggtggggggagccgcctgccttttgaagtttctacaagaatccacactgtcaaatccagtgagagctgtaaatatcgtgt

SEQ ID NO: 877 - DNA, 483 bp, Rattus norvegicus
  Genbank Accession No. AA925359
tttttttttttttttgtacagactttatttattaaagttaaacatacaaaactgaaattaacacacactctaaaaagtatcttcttccaattaacaggaaggccttttccctacctttgttttgtttaaactcaacttgggatagctgtggtgcttcacttatgccaacaaatgctggcaacttgatctcgttaataaaaattacaaactcagctacatgaacataatatacagggaagttatggtcagattaatgcacaagaaatacaggaaaatgtaatcatgaagacattcagtactcttgttcattaatttagccttggatttgttttttttttttttttggttttgttctgttttttacaaaaatagtatctacactgtatacagggctgtacatcagctttgtcttcccatataaacattacacatcccaaaacgggtagcactaccacaagtgaagtcaacaaaggaaaacaccaa

SEQ ID NO: 878 - DNA, 252 bp, Rattus norvegicus
  Genbank Accession No. AA925393
ttttttttttttttcttcgacaaatgtggaggtttatttcagcagaacgtgaaaagagtgcattggactgaagcccctgctcgttggcgtgtgtgtccagcgaattctcactgacacgagtgaaggctgctttgtgaacaagtggacagataatatggcaatctcagttcaagcaagtctgggtcaacacatcattcatcctcctccctcagtaaccttgcatgtgtaatgggctgtggggccatcaaactg

SEQ ID NO: 879 - DNA, 323 bp, Rattus norvegicus
  Genbank Accession No. AA925439
tttttttttttttttttaaaaggatttatcttttattattattcatgtgtttgagtctttgagcactacgtgtgtgcaagagcctgaaggggcaagaagagagcataggatcccctggaactggattaacaggtagtcatgagccacggtgagggtgctgggaatcgaaccaaggtcctctgccaaagtagagcatgcctttaaccaccgagtcagctctcccgcccccctgagggtgatcctggagaagaaagaggaactgactggaaaggacagtagcttgctctatggattttccaagtctaatgtttggaccaagtgaa

SEQ ID NO: 880 - DNA, 243 bp, Rattus norvegicus
  Genbank Accession No. AA925441
tttttttttttttttttagagtggcagtaatatttattctgagaagataacagagttcctctcccttgaccccagggcatagtagcctggaggagtgaaggccaggtcctgctggtccatgtagtgtacatcatagggctgatgactgcaactgtaacactacaaggcctcctgggtgcaaatggtgaacaaagccactgctgtccctggtctaacctggtcccaactggccaatcctcaagg

SEQ ID NO: 881 - DNA, 493 bp, Rattus norvegicus
  Genbank Accession No. AA925469
ttttttttttttttagtatttatgctttcattttattgtttttaagaattaaactgccacctcagtagtcttaagagcaattaatgaaacatacatacatttagacttatgtccatcatagacagcttcaaaggcttccctgaaaggtgctgggattcacatctttttccttaagaacagaaacacttaataataatcttgttatctgtctacccacccacccctcattcaaacaattaactgatattcgagtctaacatttaaaattctattacaaaacattcatctcacctgcatcccagcataatgtatcaacctaactgaaattgtttttttaaagcctacaagaattctcataatgtggaatttttttcatgatactgagttttttttttttttgggccaaaaacaggcgaaatggtttcttaccacagccaatcccagtcaatctcagtataagagcttctcataaacagctaaaaagaagctaata

SEQ ID NO: 882 - DNA, 486 bp, Rattus norvegicus
  Genbank Accession No. AA925503
tttttttttttttttttgaacttttgccactttgtattttattgtggaactcagtttcttttttctttttttttttcctttacatcaaatatcctcaatagaagaggggatattgcacacaaataccataaaagcactacatattactttcactggaaactaatttttctacattagatatgactggataggatggaagtgatgcaggattataagacataataccatacacagaggcagaccgacacaaacaccattcagaacaagagagagagtgagcttctccacagccgggcttaggactgcacgctgcctgcgggcgcatgcggggaaagcaaggaccgccgcggcgtgggcgggcggctgagcagagccacttctccggggctccagtttcgcgagctccacgcgtgcggagaagccgattattagctgttgttttttttttccttccttttcagtttttgatgctgcctttgaaatgaa

SEQ ID NO: 883 - DNA, 419 bp, Rattus norvegicus
  Genbank Accession No. AA925529
tttttttttttttttttacggaagacacactttatttaaacaggaaaagggaggaatacagcaatatgtgaagttttccagcatttgtattaagaaaataaacaaacaaacaagcaaataaacaagtgcttgtgttgtcttttgtatgagtcacaaaatatttctggaactctataagaacaacttgggtgggggaaaggcagacaggaggtttttactatgtacatcaacaagactcagttataatgtatgtgtgtggtgtgcgtgtgtataacactagacgattagattattttttttaaaattacacatgtgtgcattttgcctgagcacgtgcatgccagcgtggacagaagaggacaccttccagaagtcacttctctcctttcatcctgtgcatacagaagaccacacaggtt

SEQ ID NO: 884 - DNA, 489 bp, Rattus norvegicus
  Genbank Accession No. AA925540
tttttttttttttttttaccgtaggtttatttttattcaaaaagttactgtctcaagacataaatacaaatcagcaaacagtacaattaggacaatagaatgtggaggacaacaggttagagtaatagagaaaacattttagctggttcaaaacaaagctggaagaactgctttcacaaagaaatactcctttcaagagtgagaaaaaaatcaacttaggtttcaaatcatatatacagtcctctcagcagttgtaggaaatgcagtggtgtgtaaaagaacatatgcaatacgtttgcacataacaatgtttgttgatggaaagtatgttagacaggtctggttttatttgttaaccatgaattaataaaataaatgtattttgtggtctttcatttaacctatggttttttggctaccacagcccaatgcttgttgatttcctgacttgataaaccagaaaccttttggaattcacacatctgaaga

SEQ ID NO: 885 - DNA, 598 bp, Rattus norvegicus
  Genbank Accession No. AA925541
  misc_feature (1)..(598): n = a or c or g or t
ttttttttttttattttccaaacaattttattgaaatgtgccaagatacatgggcagcacaaatgtatgaacaggaaaaaaagaatcacacatacagttattttaaaaagtgaaggttaatcttgggagataccagttcccctccccccctccagagttccagcatttgttgtggttaagcctctactgacctagcatttaaatggaaaaaaagaactgcaaaaataaagacaaaacaaagaaaccaacagcataaaggaaagaaacatcttcctgctcggatggagtcttccttcccagcatctaattaggaggcgtgctgtgcggtggagaagcacaacttcagagtgtatggatacgggccatttgggtttttcatctggtaatggttcaggaagcccaaggtctccagggcgtcattcttggagtcncactccagcagcccagaggagctacgctcgcttttgcctgaaaatactttcacagaggttggccgcttcactcccagttcatcgcagatctcaaagaagttctcctcagtcacctccaagggagcattgaagaagtgcagaacattgctaaggtgctggatgcggtt

SEQ ID NO: 886 - DNA, 621 bp, Rattus norvegicus
  Genbank Accession No. AA925554
  misc_feature (1)..(621): n = a or c or g or t
tttttttttttttttttcaagtttcagaaagggtttatttgacttacaattactggttaaagtccttcatttcaaggaagtcagggcaggaacttgaagcaactagttatactcatgaataaatgcatgcatggagagtgctcagcttgttcttatacattccagattcctttgtgtagagaatggtggtgcccacagtgggcggtcttcccttcacaattaacataatcaagccaatccctctaagacatgcccagggaccaagctaactgacacaatcctgcactgagaccctcttcctaggtgatgctagattgtgtcaagttgacaaagctagccagcacatactccatcaaatatacgtagaaatatgcaaatacctctcccctaaacaaggcactggcttgatacttaccatatccaaactttgcttcaaattattaaggacctgccctacttctctattttccatttacattttaacattccttaaagtctagtttagtatatggcacagagaatatacaanacaatacttgaaaaccacaactgcttcagctagacaggggaagaaaattgtatttgatatttcagaccaatagataggactaaactcaaata

SEQ ID NO: 887 - DNA, 325 bp, Rattus norvegicus
  Genbank Accession No. AA925557
tttttttttttttttttggaagctggttgaattgtctttattaacaaaggggatatccaatgccactacattgagaaaggatacaggagggagaagggctacttgctgctcacactatatacagatgcaagcaagggaggatacacggtgggagctctgagccctctccctctagggaagggaagaggaaagatggggtgggggtggcgacatgctgaagtcccccaaagccttcctggacgtttctattttcttccaggcacggcaaccgtgggggtccaagttgattgtataaaggttggcatcttcgggtcggctccatgta

SEQ ID NO: 888 - DNA, 499 bp, Rattus norvegicus
  Genbank Accession No. AA925603
tttttttttttttttttgggttgcttggtttttattaacagtcacgtttgtatatgggaagagtttcacagatcaaacagggagatccaagcacactcagggttttgactaaacggatactattactaacactgctcacggaggcaagcctgattctacctccaccggaaccacctaccctgcattctcctgggtccattttgtaccctagtgtcatgaccccagcctcctttaagactaactatgaatgcctccacccacatctgcccctccaatcttatcatattcctcaataagaaatatatttgatgttttttctttacttgacgaagtagagttattattgcagaaatgaaaactcaatgaccaactttaattttaaaactagaaaagaagaaaaaatgtcatcaataatgaacttgggtagagtacaacaaggagtatgagttattttcaaaggcaacatatccctattttgtacatatttgcatataaaagt

SEQ ID NO: 889 - DNA, 505 bp, Rattus norvegicus
  Genbank Accession No. AA925644
tttttttttttttttttgcactaataaaaatttaatatcataaaacaaatcggaaacagcaatttttaaaccattcacaattaaagtggaaagacacaaaattataaggcagccatccatggaatgagtttatgtatacaaagaatccagaaaaggagacatttaaaatcaccgtttaggccaccaaaccaggggaatcatggtgttaccattagagtcccagttttcgggaagacacggcagacagagcaaagccagtctctgtgcttggctctgtgagggctgagcacatgtaaggaagtcctactgtctgccagtcctttcccaccagcccccaccctcagctctcccgagctgaacttcgatgtctcgagttaaaaaggctgagttgtgtagtatctcagccagtgctcttcaggggtgcgtcccactctgcactgaacacaagtctgcctccaggactcttgcccgatgactgtgtgagccccagtagtctggggctctg

SEQ ID NO: 890 - DNA, 408 bp, Rattus norvegicus
  Genbank Accession No. AA925662
tttttatttttttttttgttcaaaaatagaaatttattaaggtgtgtttgtttttaattcccaaagcttcttaaaaccgtcttttcattgagcccatgaggtacttgaacgtagacattatacagtatgtagcagtgattgtcgtgtgtatgtgtgtgtgtatgtttcactgtgtatctcaggctgacctggaactctctctggcctcaaagttacaatcgcctgcctccacctcccagatactggagattacaggtctatgccccattcctgtctcttttctctgtaaagtgaaaaggctcaaatatctgaagtccacttaacccctgacacgacctagctttggtttgactattattgcacccccagtcagtacccagcccccagcacacccctgttgagtcagta

SEQ ID NO: 891 - DNA, 171 bp, Rattus norvegicus
  Genbank Accession No. AA925693
tttttttttttttttttgtaaggcgtgcacttttaatacaacggtctcacgtcagtgtacatgccaaccctgactgcctcaacacctcacactactcccagggagaccaacgccttcatacatcaggttggcgggacaataccctggggcaggtcacagtggctgaccatt

SEQ ID NO: 892 - DNA, 381 bp, Rattus norvegicus
  Genbank Accession No. AA925710
ttttttttttttttgttacggtattatgtactgtaatttggttaaattggattttgggtgacttcaaattctttcctcctttctcataagactattcacgttctttactggagatgagagcatgagaatttgactaaatttcagacttcctttaatgtccgtattttgttcctttctcagtcttcttacatagaacagagattgggttttcccaacttaacaaggagaagggtgggaaaaagttagggtatacacaagaaccactgatgtacgcgtgaagctcctccatcacatagccagcctgtgctgtgtctcttccgtctgctagtggctgacggaggccgttccttgtggttaaatgtctaataaactcaagaacgt

SEQ ID NO: 893 - DNA, 351 bp, Rattus norvegicus
  Genbank Accession No. AA925741
tttttttttttttttttactcaaatacttctgttttaataaaggaagcatagatgctaggttgcttatgactctaaacagtgaaagtaaaatgttgacttaatagttactgaaatataaataacacaaaagagctacagccaagaagcaccaataggtctcgacagcactccttgggaaccaaaaagcaggtcaggtccagggcctacctaagccctggtaaactgagtcatttgacctactagccagtgaaaatcctgtttaatcctgttttgtttagaacaaaattaatcattcatcccattccagttgctaagaaaaactctcctctcgcatctttacccggttttcc

SEQ ID NO: 894 - DNA, 374 bp, Rattus norvegicus
  Genbank Accession No. AA925774
tttttttttttttttttcctgatgaaatttatttcataaatgtaattattttctaaagcatattaaaatagaaaacatgttcttttgatcaatttatacaaagaagataccaatatagtaataaagatactgaaaatatatgaaaagcaccagaacattagagaaattacactggcaacaattctaggaatatattttttataattgtacaatacagtgctattaaatccagtcaaaattagtggcaagatataagagttatgattttatgaaatttgagactaggtttacgagcatttgcattttcggctagttgcagatcaagctaatgatcattcattaatgttttcatggaaaatgtattaatttccatt

SEQ ID NO: 895 - DNA, 440 bp, Rattus norvegicus
  Genbank Accession No. AA925854
tttttttttttttttttcagacaatgtaccattttattccttataaaatatatttcatatcattgctgtaaaaacattacatttcatttcacatttaaaaaaaatcttaacagtaaaaataatacttggaagacagcggggaggggcgggggagaagcgccaataagacaaattcacagatgggattctccctttttgtgttgttgtttcttgcccccggtaaaatcagaacctggggtgatcagaaagtaacagattttttttccccaccaaatcagtttccgtatccaatttcatagggtcctctaaggtgtcaagttatacactcactcccacaaggcggccactgctcgaagtgctgtctggagcagcaacactgtcttcaaggccaggtgaaaagccttgtacacccaagccttggttcccagggagccctttgg

SEQ ID NO: 896 - DNA, 531 bp, Rattus norvegicus
  Genbank Accession No. AA925876
tttttttttttttttttacaaagatagggtcatttattcatgttatattactgcatttcaaaggcaaaaatacagatgtctgttctgaatatcaaggtcagagacagccacccactcccagccccagtggtaaatacatctatacacatgggatatcaaaatacacacagagcatcacaggtctgtaacagcccagtgggcagccgagaccctgccaggctaaagggcagcacgtttcctttgcctttctgtgcctctgagctttcccaagggccctgccacacaggccaccacaaatatagacagagaaagacacagcatgggacaacagggtgagaattcccaagtgaaggaaatggtccctgccccctcaatcctccagcccccaacggcatctcctgggtcaggcaaatgcccaggcctaacaacagtgccttgggtgtgccttgggcctgaggtgccccaaagcatgctgggaggaaacggaaagaacaggcaagacaatttcccttgggtctgagaatgaacctc

SEQ ID NO: 897 - DNA, 525 bp, Rattus norvegicus
  Genbank Accession No. AA925920
tttttttttttttttttagcctcaaaacagaattcttttattttgtccaaaacagcacagcatcgacatcctcaacaatacataaacctatatataaaatatagaatatcttcaatatttttcttttatatggcagcacaatagtatatatgcaagtgaaagtgctgttgatgggacacgaggacacttatctgagcaatgtcctagttaaccagatgtcagcagtcaatggccagtaaaaaaaacagtctgaagagagttcctgcaaagctgggtatacgtacctcgttctgcgccctgccattccacgcgcgcctgactcttctcaaccacacctagcctttggaggagtactacaaaggtacagaaaatacctgcctgatactaatttttcaccatgaaaatccaaaatggcttaaaaaaaaaaaaaagaatatactggatttcagaagttatttaccgtcatctgaaaaaaaaataccgtaaattcttccaaaactacagggtttctaacaccctgtgtcc

SEQ ID NO: 898 - DNA, 475 bp, Rattus norvegicus
  Genbank Accession No. AA925983
tttttttttttttttttactggaagtaaaaagaaatctttattttcaaataaaattacctacaagagattattcattgatccactatgaatgagtctctcatcacatacagcacccaaaatatattttgaaaattaaaaaaaaaaaaagagaaaacaaacccacagcctcacctttcacacacacacccttcctcccaaaagccacacagcccacaccaaaaggcaaaggcaaagaaccaaaccaaactcagtacccacaccaaagttatctttgaattaagatttacaaatttatttattctttcctatgaaggaacaaaaggaggaagaaaaagaaaaaaaagaaggggtaaggaaaaccatgaaagtctggtgagacctaggaagataagaccctgcctgcctgcctgcctgcctgcacgctagcaggtgtcgaagcattcagcacttcagcacttccctcgtgccgaattc

SEQ ID NO: 899 - DNA, 498 bp, Rattus norvegicus
  Genbank Accession No. AA925994
tttttttttttttttttcacggagaacaatcccactttattaatacatcagtgtcacagatgtgcccagtacagccagagtcctgaacagataaagtgctactgcagggacctggcaacaggaggagggagccagttcatctcctccaagtccccagcctgaacggtatttctactacacaaaagtaagggcagctagtaatccagtctatagatactctgagctaagaacagaaaaccatactagtgggctgtgtgcagagcaagaaaaaagggaagtcagaaggtatccatcccttcctcaaatggaacatagagataccaaacaattgtcttcaacttcctggatgtggtgtctattaaggaatgagccaggtctgctactccttcccagggactcagaaccatgatgtagacactttcttacacctaagaaaaagtaccattttctaactatgaaaaacttactgaccttacttcgccagccccccaaaagcaa

SEQ ID NO: 900 - DNA, 498 bp, Rattus norvegicus
  Genbank Accession No. AA926036
tttttttttttttttttgaatttaaatcaagttttattatggaaacagttaataaaaaacaaaaaaaccttacatggccaacctgaaattgggaagagtttggaagatgcttccctgtaaagggagaagtgatattcaccctgagttgtacatgaggtcagccgtatatgacgtcattcggtctgtgtcgagaagcagctcttcagttctgaccacggtagggcggaattctgggcaattgacagagcagaatgcgtctaacaacaagaatcttgtcctgcaaaatgagctgctcacggactccgatcatggcatcgcccccacagtggaccgaaagtacgaagcagatattgctgctgtgaaagcgccattttatccacagagcagcgtgtcgccctcaggagagcaccagtggccaaggcaaaagcaaacactagagtccagtggtcagtgactgtctgaagccttaacaaggctatgtaagtactctaggaagga

SEQ ID NO: 901 - DNA, 580 bp, Rattus norvegicus
  Genbank Accession No. AA926067
  misc_feature (1)..(580): n = a or c or g or t
tttttttttttttttatatctttaccatttatttcttaaaatcttattcaaaatattaaataatacaatttcagatatgaaaaaaactactgcaataaaacagtccagatgtgtttcaccacagtgcccttcccagggacagccaacgcccctgaagggggaagaccacgctgatgcttccgtgtccacgcagggagcatggctgctggccgccccagctttactgagcacgcagtaaagaccatgttttctggaaagttgtaatgaagcttgatagtcaagcatggttcaaatcacacattttcattctgatcaactctaaaaaaacaggctaccataaaacacagcaaataaccccagctgctgggggctggggaggaggcaggtttgaaggtcattgctacataggcctgtgtgaacttcttcccactactgctttaactgcaggaccaagacacagtatcacttaagtaacaatgggctggagagtctcctccaatgtactgtgatcaaganacaaagtaagagacctctgacctgttttacactccgctcgtcatnctgaacctgggacccatgc

SEQ ID NO: 902 - DNA, 525 bp, Rattus norvegicus
  Genbank Accession No. AA926085
  misc_feature (1)..(525): n = a or c or g or t
tttttttttttttttgtcaacatgtaatgccctgggtttattttgtgagaattctatcacaatgtttccaggtgggattaaaaaccttaaggataacatatgtctgccattggactgggcattcagacttcggtactaacaaagcagtagtagtctggtaagtaccattctcttcacagaagagaggtcaaatatttccaaaggaaggcacccgatatttgtggttctggcctcgcagccttctggagaatcttaaaaggaaaaagctggctggctgttttacaaactggaatgacgatacacggacagcattcttctcccctatatcctttctgtaagaacaagtaaagaatgaagtctttaaacaattccacaatataaaagtacatctttttgtgctaaaaaaagggcaagacaacataaactccagttgtaaggactccgtttgtgtacttgatttaacactttttggtgtggaaggaaatgggacgactgggctgtttgtaaggcancaacataacatta

SEQ ID NO: 903 - DNA, 367 bp, Rattus norvegicus
  Genbank Accession No. AA926088
tttttttttttttttttgattgaagagcgtttattgtcttctaagaggacaactggaaacgtgtctatcagacgcgacaccatcacttcacaagtcactagaacaaggccactccaagacagtctacatacccgtggggacgctggaccctgtggtggcgttagaggggaagagggtttaaaaccacagggcagaaggggagaggccaggttgtggacacgggtgtttgctcgttttaactcttatcagaactgcttgtttgggtttggcgtggtacttcagacacattcccttgtaatgttaagggaggtgcctaaggtgtggtgcatgctgggtagtgttctacctcacctccaggtcctcacag

SEQ ID NO: 904 - DNA, 369 bp, Rattus norvegicus
  Genbank Accession No. AA926089
tttttttttttttttttaccacttaggacattttattggcatatgacaatttacaagggtccctgttgaaatatacaccacactgaggaagaatcgtttagccatctacattcattctcattggatattttcccctcaaattataatttaattcccaacactgattttaactgtgacgaaagggaacaataacaattctttgaaatagagtgcaactgggaaagactttgctttttatattaaaattcctaagatgttgaagcatacaaacctaagaattgagtcatggccttctaaaaactgttttcttattttttttttctggaaaaatcctttggttcctttttatttcctttctccgggtaaagg

SEQ ID NO: 905 - DNA, 188 bp, Rattus norvegicus
  Genbank Accession No. AA926120
tttttttttttttttttcctgagtcttttttgcataaatttatttttttctcaaccgggttatcgggcatttaggccaccctaatatctgggtttatttcaagttactgaacactgttcgactaactgcagaaagtgtcaagagagaaagacgtacatgtacaatttccaaaaccaaagtcattaagg

SEQ ID NO: 906 - DNA, 341 bp, Rattus norvegicus
  Genbank Accession No. AA926137
  misc_feature (1)..(341): n = a or c or g or t
tttttttttttttttttccagaaaatacttgagtgtaataaggatttctgcctgacattagactctcccgacatgcaagtgttgggagctcaaaggattcttgagctgggaaatcctcaagggagatgacgtagagggagccaggcgtccaaggcgtacgaacaaggtttaatgctgcacccgtcaaggcaggagctccccagatcgatgcagacttcttcctccgtgtcctccacaggactaagctgtttctgaggcctcagcgcatgctaccatcgaggcctgtggtggggganggggctgcctaatcgtccttcttaaacttgccattgatgtacggc

SEQ ID NO: 907 - DNA, 407 bp, Rattus norvegicus
  Genbank Accession No. AA926171
tttttttttttttttttaaaactactattttttattcttctcttcttccgttacaaatacaactccctataaaaagttagcaaatatcagaggtcaaatcttacaagttaaccaattacaacagtcaaagacacaggtcaatagattaactctggggtttaaaattagtctgagaaagtgatacgtgtcagcggcagatgccaggcaaacactgatccttcagaccctacagtaactagaggaggcacaaaagggctttagtttggtgatttaaaaccttggcgctatagtaaagtagaaaagtgcagcttcaggctcttctgtttggaagatgatcttatatttaatgtcatattagacaagaactatcatgaagataacaagagatatgggcatcccccttcaca

SEQ ID NO: 908 - DNA, 406 bp, Rattus norvegicus
  Genbank Accession No. AA926193
tttttttttttttttttactattcaagtttgtttatttattagcttattaagccatcttactgatttgtactgaatagtggagaaagtatacactggacataatatgattttgtgaattgtaaagtgatgtcagtaataacagagtcggtgtcacagtccttggcatttacagtttgctttctgatcttcctttggctggattgaggcttgcagacagactcctgtccttgatgtctatcttctcatcttgatcagagttccatgcagaagtttagagaggttccgtccatcttttgctcatagatttcatcaaacctctcattctgggccacagtaaagtggtttttccaatcacccacaattccttttctcatgaaaggggaaatggactggtccatgatagtc

SEQ ID NO: 909 - DNA, 277 bp, Rattus norvegicus
  Genbank Accession No. AA926231
tttttttttttttttttggtttatagagtaaacattcaacatttatttagtctacatagtattgtcagaaacactttgtccaggataatgtatgctgacagtaacttgccctcctaccatatgcacacaatcagcaacagtgcaaagctccgatgcaaaatgagatagtacacacttctatttattaaagtttattattctcataattacaactgtaatttataagtttgaaacacgaggaaaattctatgaagagagctcaaatgaagctgaacta

SEQ ID NO: 910 - DNA, 538 bp, Rattus norvegicus
  Genbank Accession No. AA926303
tttttttttttttttatctatcggaacgactttatttaagtacactgggccccaccaggcaatgtggctttgcgaggctgtgcaggggacaggcttgggctgagagaggtgagctggctaagcgcactgcagtccacgggctgccacatcgattccacacacaccagcttcgctttacatctggcaggggcctttggtcataggatggtggagagagaatactgtctggaatctggaactggggtgagacggcatcactagtgagggtgccgtgcacacagactcaccctagctttgtactgggtacaaaggcccttggaccacttccgaggacaaggctggaatccatcagatcttggcactttggtctggccccttctctcccttcaatctgaccaacctccaaaggggcctccctgccactttgacttactcgcccggtcaattagagtggcaaaggcaacatggttaactgcagcttgctttgttttgaagggtctaaatctccaacacacccccctcacaaagggcctctgcc

SEQ ID NO: 911 - DNA, 273 bp, Rattus norvegicus
  Genbank Accession No. AA926352
tttttttttttttttttggattcaatcacctttattagcctatcaatgttacattttatacataatgtctagtcatcttctcaaagggctctatttttatttagtacatcatgttaatagtaaatagccaagtgtgatggctataccttagcctaactttttaatattctctgggaagctagaaagccaatcattttacacgcaggtaagagtagtgttccaaaataattatgaagcggctacaattttaagcaggggaggaaacaatgttca

SEQ ID NO: 912 - DNA, 400 bp, Rattus norvegicus
  Genbank Accession No. AA933158
tttttttttttttttttgctctgtagtttttgttttttatttttatagttttaagtttttcaaaacatagtttcttcatgtagccctggctgtcccggagctaagctctgtagagcaggctggcctccgtctcaggtctgccggctgttatgcttttatccacacatcctttactgggtatagaggctggctgcgaagacgatgtccctccggagcaaggtggctgccgtctccatcttggcccctaacacaggctctcctaccaaacgggccgcccctcgaagtgagcggcacatctcagccaggcgctggatacagcggacaaccaagccttcgggggtccccgagagccctgccaactcggagaagggcataccccgagcccactcataaacaactt

SEQ ID NO: 913 - DNA, 518 bp, Rattus norvegicus
  Genbank Accession No. AA942681
ggggtgagaatcctttaattatattcatttccagagaacaataaatacaaaaatcataaagaatataagtaacagtaatatttctctagatacacacaggacctacttttatacaacttaacaagcaaacacttttattcccccaggaattaccactgggaagagctatacaacagaagagaagttgccattaaattaaaaactatttgcttttgaccctaaagactgaggttctcactccagtggcccattggaggtgcagaaaggctgaagaagtcagttcagcttcgagcagcagcagtctggggctgctccgactggagctgtttaccaagatactcccagttgtgcaccatgagcttctgcacagccagaagagcattgtagcggacctgctggtcttcatggtgcatgtggttcatcaccagctgcttcccaccgagctgctcaataacccgtttgccccggggataatgccggacatattctccaacatcatgagcagcaacagctaaaac

SEQ ID NO: 914 - DNA, 432 bp, Rattus norvegicus
  Genbank Accession No. AA942693
gcctgatgatatttggcagctgtcctccagcctcaaaaggtttgatgacaaatacaccctgaagttgaccttcatcagtggaaggacaaagcagcagcgggaagccgagttcaccaagtccattgctaagttctttgaccacagcgggacattggtcatggatgcatacgaacctgaaatatccaggctccatgacagtctcgccacagaaagaaaaataaaatagccaattctaaaagttctccttctgctggatcatacgaattactggtgggtaggggaaaagacaggaagcttaagcttggtcaagtaagaaatgttaaagatgcccctgtttagtccaccctggataaatagaatttcctagtacagatatgcaaagttgtatctttgatggctagctgtagcctccttggtctgctgaatggcttt

SEQ ID NO: 915 - DNA, 609 bp, Rattus norvegicus
  Genbank Accession No. AA942697
aacaaatcctaactttatgtatgatatatatttaaaacaaaaaaaaaaggcgagaacgacatcaactatcgaaaagctgactcggaatgcgtcatcactcccaggcagtcttctccctcgcttgccgattctgggatcactccttccgcacagctcccaggagacccgacagtctctcgatgacttgttcggaaccgtccacaggtaagcaggtcaggcgatacacccaacggagaatggtcgagaagcaggagtcaggaggatcggtccacagatggcagatggggaaggctgggaagcgctcgcctcagttctcctccggcttgtccgccggcggcccgctgggctgcagcattttctccatcaggttgaaacgcacgcgcgctttgctctcattctcagcaatggcgaagtagttgaggaggtcgaagtgacccatgtaggagcagtaggaatcccgatgctggttcacaagccattcccacttggtggtgtcggcgtggcccgtgccgatgtacttggactgcagatgctcgagctggctgtggatggtgtaccggtccgtcatctcgccgctctgttcttaggcttcgaggtcaggccacagat

SEQ ID NO: 916 - DNA, 717 bp, Rattus norvegicus
  Genbank Accession No. AA942704
tggtttgacaaaagttttctgaaaatgctttagctttatgtgggaataggtataaacctcatttttatgctgtattttatatcttagttgtgtttgaaatgttttgatcttaggaaacatcaaaataaataatggcatttggtgtacagtgtggtcctatgtggtgaccagccagggctggggacctggccaggctcaggatgctacagtaagctacagcaagggtcactgaacactatgaagaaagccatgcatggagaggaatcttcaaccccgctgatgccatcttctgaacagaacctccaggcccactctggacagcagccagtgtcaggacatcagtggccagttccaaggacacccaaaggctttctttacaggcttcagcgccctagctgcttaaaggaactgaagttcttgggcttgtgatgatggcttttgaacttcttggtcaacggggtgagctccttcttcctgagtttacggcccctcttgtggcccactttggcttctctctgtgcagtgctcttttctgactgtttgggcttctcctgttggtctgtctgaaagtcttcaggcttgagcagttctctctctgtgaacagctcaggtgggtataggtctgtcatgctgtcatcactcaaggcgcctccctcgtcactggaagttggttcccagaattctgttctctggcctgggaggtcatcgacatccatc

SEQ ID NO: 917 - DNA, 580 bp, Rattus norvegicus
  Genbank Accession No. AA942706
  misc_feature (1)..(580): n = a or c or g or t
aatgaatgcctgcttttaatatctctctatgatgtacagtcaacttgtgccttcaaggtcattcaaatttttatagcaaaaaagcagtatcatttagcagcaattaaagcgccttcaagaagacttaaaaaaaatacaatatccaattagaaaagcagtatttttaaacatttgtacaagaataagctgctgaaactcagtaattgtaatcgacatctgtacagtagtttacaatagagccagaaggggattcatcattatcttgcacacgactggcctgcttttggttacacactgtctcctgttttaatgaacgaggcctagaaacaaaagaaaaatgcctgttaattctaaaacactgaaagccctggaaatactatgatttagtaacttcaactgatttgaaataggcagctctttgtgttaaaagtataaagtatccagaaatgacagctcgcctttaacaaaaccagttaagaggggtagggggtagggtggtggaccactgacatgtgatttcgaggtacaacttggtaaaagccagaatcggcaaatgacaaagtccacaactgtccanaga

SEQ ID NO: 918 - DNA, 588 bp, Rattus norvegicus
  Genbank Accession No. AA942716
aatgaaacaaatccaaaagatgtacagtcaggctcacgttgtgcagttcacaagcatggaagaaacaaacagacagaaggacagagttccaacagaagaagctaacccaagaccaggctggacttgccgccaggggggtttctcctggatggcgctggggccggagccactgggctgggcacaggagcagcgggcaccggcttctcttccacctgtgccaggctggcttggaagtctgtgtccacattttcatgcacatcactttctcccttgaggtctaagaaatctccagagcttgcttcagaagagttacttctctgtgttccaggcgactccgaatcctccctgccacctgctgacttggcccaagatggggggttttcttcaggtgtcccaaagatgttagaagccatcttgttcttcctcacgggctgttctgttggctcatcaaaacctaatgaaaaattggacccaccacctggaggccgcaaaacccgggagctgttcctgctgttagggtctacacccttgaaggtggtggcagtggtcatggcgcaaaggggcgaggtagactggccctgaaaacgc

SEQ ID NO: 919 - DNA, 323 bp, Rattus norvegicus
  Genbank Accession No. AA942718
cacagagtcacagacaccatttattactgaactgcactttcaccttcacacaaactatttcaaagagctggaaaaagtgtagggtgaggggaggagagggacaggtgcctctcagaagccacgaccctcagtgggcttccccaggcagggcagggacggagcgtcaggctgtcagtctctgggcaccagctctccacgggcacgcgcacagcaagccagcagctcctcatacataaatacagacacgcttaacaaaaatagtatatcatcttcacaaggaactaatgactagtctcacatatgtacagcagagatcccggggt

SEQ ID NO: 920 - DNA, 467 bp, Rattus norvegicus
  Genbank Accession No. AA942842
aatatgtgcagttcatataattatcagtgaattctttaaaggttgtaaaactagtttccctaacaatctcaggagtgttgaggtagagtctcctggggtcggtggtacgcttgtgcttgttggctgtgtgagtagccaacatgaagcacagcggagctgtaggaggtgggttcacactcccatcactgcactcccatcactgatacaccccacagtatctatgaacagctcttagctcagcaaagcaagttttcatagtgagaaggcataaatattaatttttaaattcttataattatctgaggaatctaagataatccttcatgcttattctttctttaggatgtcttaaattatccatagtaattcctttaaaaatacactaaaatcaaccattaatatatgaggattgactcttcaaatgaacgagacgggctccatacattggctttgaattttaaaaacta

SEQ ID NO: 921 - DNA, 434 bp, Rattus norvegicus
  Genbank Accession No. AA942845
caggaaaagaatattttaatggtgttgttatatagcgtgttggctaattccagtggatcttcttctcttactgctgacattatctccaatatttgaactatgtggcagggctcgttcctgtcttttaaacagcacccggcttcccacttctttttggtaggaaatgcagtttttatatattttgatccagcatgtgtacttttaactccacaccaaggtgcatctgtctcaatcattagtttttcactgggtattgacttcagaacttccaaattagcttcagttttcagacagcttgaagacagtattttaaaatgatatttagtgaatatatccttaccctttacagaacccatattatggtcaacttcaaatcaacctctacttttgtcccttctgtaacatttagaaaatattatttttacttctgtgtg

SEQ ID NO: 922 - DNA, 439 bp, Rattus norvegicus
  Genbank Accession No. AA942874
  misc_feature (1)..(439): n = a or c or g or t
cactataaataagcattttaagactgacaaatgttgaactgtatatacatttatcagcataactgcccaatttttggtgctgaagtactgtaattagaatttatcagtagcgtcctaattttggcaactacacacggggagaagctctgatgctgtagttaataaactcacactagctagtgtgacactgaaagtctcagcaggagcacccctgagacactttgctcctggtggcctctccatttctactgggtgaaagtcactcacccataggtggagctgttggatagcattttactgtacaaatatatttcaaccaccttgtgactgtcctagctaaggaaaaaattaacttctcttgggtcataaacatctttaagaatctgattaaactatgaactctctcaacanaaaaatacacatgccagtacccgtgtta

SEQ ID NO: 923 - DNA, 503 bp, Rattus norvegicus
  Genbank Accession No. AA942889
atcgttgccaaatatctgaagagggctgtcagaaaccctgacgatctggaagcaaggtctagcatgcacttggcaagcgccttcgctggcattggcttcggaaacgccggtgttcatctgtgccatggcatgtcttacccaatttcaggtttagtgaagacatacaaagccaaggaatacaatgtggatcaccctctggtgccccatggcctctctgtggtgctcacctctcccgcagtgttcaccttcacagcccagatgtttccagagcggcacctggagacggcagaaatattaggagccaacattcgcaccgccaagatccaagatgccgggcctgtgttggcagatgccctccgaaaattcctatttgacctaaatgttgatgacggtctcgctgcccttggttattctaaggatgacattccttcactggtgaaaggaacactgccccaggaaagggtcacgaagcttgcgccgcgtgcccagtcagaggaagattg

SEQ ID NO: 924 - DNA, 511 bp, Rattus norvegicus
  Genbank Accession No. AA942904
cactctaccaaatattaatgtttattatacaaaggctattgagatttgctgctggggtagcgtaagacataaaccagaaatgaacagagaactcataaacagaccaacagaaatgcgctcacctgacacttggtagatggcagaaggaagcataaagagatgaatgctggtacttctctcagttcccctttttattctgtctgggaccccagttcataggatgtcacaacatttaaggggaaatttcccttctatggtaaatctgtctagatctgcacttacatacaagcacagagctgtctcctaggtgattctaaatcctattaaattggcaatgaaaattaatcattataattctacttcctgcaagcctgacatcaaacatcaccttagttattctaccctggttcataaagtctcatttggtctctctctttaacagtttcagctctgctcaaaaaatcagtctctgggttcggtcctcagctctgaaaaaaaatcagtgtcttct

SEQ ID NO: 925 - DNA, 601 bp, Rattus norvegicus
  Genbank Accession No. AA943015
aatctagatacaggtactttatttacaaatatttagataatagcattttgttacatcaaataaagagtacagcagtctgaataaatccttctgtcacaaaaacaattgagacccactgtaactaactttgggaactggggtattgcacctaaacaggccgagggtctttactttgtgattgccaccttatatccccatgggtgatttgttctgtaaatatatacacacaccagcaggccatggtccctgggtgaatcccttgtgatgcaacagtatataagcaaatggatcacgctaagtctttaacagaacataccagcctacgccaagattcctgtaagttaaacaaggacaaaaacggtgaatccacccaaaaaaaaaaaaaaaaaaaaaaacccgaatcctattttctgcacattccagttttggcttttatttaacattgactatacaaaactctggaaccacatgtttataatccagaagatgtacttttacattagtgtctggtaaagagggatttaaaatgtgtattttaaccacagcattgagctaggagcattttatataatgtgctcaggcttacctacgtgcatttcca

SEQ ID NO: 926 - DNA, 546 bp, Rattus norvegicus
  Genbank Accession No. AA943020
aagttaaaacaccaaatttattggataatattgaactatatgcagacacatagaaaataaacatttcatatagttgtgtatcttttttaaatgttgcatttataaggacagacaaactaccaatttagcaattggagaaacttttaaaaaaacagaatcaacaacaccaacaaaaaaggaaaagcaacatctacattccttcatcaagacttggtgctgcatcaccatctataagtacttcttcagtttagataaataaatactttatctaccacagatttaaaattagaattacataaactctttgaccacgtagagttttcttacacaatgatgagcagtcaaacatgtcactattgagacacatgtatttgacttaacgtaatccccctgctgaaatatcactgtcaatgcacatttcatatgtgataaacaaaaactctattataaagagaatcttcagattttcacagttagagacagaggtttaaaaaaaaaccttacaacatttcaaacagaaaagacagcatgcatccactagcagaa

SEQ ID NO: 927 - DNA, 446 bp, Rattus norvegicus
  Genbank Accession No. AA943039
gctctaacctgaacatggaatcttttgagactaaaaggactgggctgcagttgcatctgaacagtttaacatattgattcccatatatagaacctagaaagaagtggtaagagatgctgattttgatcgaatcagtgtaaaaacatcaagaaaagcatgttgtacctaaactatgtgctccatccacccccacctgcattttctaaatcacacataaactattaaaatggccattaaaataaaagtttgttgttgctgtttggtccttcttttggtgtacttacttggtagaaagtgtttttcattctcattcagcaaagtcaggagcaccgacttgctgggagatgacacagctgagccctcagactttatgtcgttgataggtgcccagctctcggcagtttaacccgtctctgccacctgaaggtgcagcccttgggggagag

SEQ ID NO: 928 - DNA, 549 bp, Rattus norvegicus
  Genbank Accession No. AA943095
aatgtaaaaccatttaattctaaatcaaatcactttcacaacagtgaaaatcaatggctggtcaaggtatgctgccttctgtgttcccattttctgactgtccttgtccatgggggaggcggaaaggtggagctgaggacacagagagcccagaagggaaagctgcctgggccatgaggtgagtggtgagcctgtggaggaacggcccatggcatccaagctgctctcttgcctcagctgctggcagatgtacagccctgcaatgctcacaaagggcacaggccgccacagctgtgctactgcatgccttgggatgactgctggtgcacgcctgggttggccatttcaccagcttacaaatggtttactccactactcacaacttttctctcttttgtgttcattggcttacgttttccctctactacttagggccacactacacagaaggatcctaccaactctctctagaacagagacactccagggccctctgacaggatttccaagcgacaaagaatatttaaaatctgtcaggcacaccatgaa

SEQ ID NO: 929 - DNA, 489 bp, Rattus norvegicus
  Genbank Accession No. AA943122
tttaatggcttctttgatgtacagacaacagaaagacaaacatttctctccatgcatggtacaatgaaattcagggacaagaggtcatccaaggacaggagtcatggtactcgggtcccctgacagccttgtgtcctatggtccaacttgagggctcagtagctgcagtcactggggagaggtgggaggccccacggcctcctgggatgggggttaggtgacagctgctaagtatgccagcatgcatgggcactgccatgcacgggtggaccaggagccgagagggaagcaggcttccaggtggactctggagatgaccatgggctcagtggcaccataacagttcctgaggctggggccaggccaagctaaagtattggcactggaaaagtgggaatgggggccacggcatcgtagagcacaggctgagggctgggtcacactttcgtcgcacccaccgagctattgacggcacagctccgtctccca

SEQ ID NO: 930 - DNA, 572 bp, Rattus norvegicus
  Genbank Accession No. AA943129
gaatcaagtaactccagtttaatagaatacaatttagtgcatttcaggatctcgttcacagttctgcttctgtccaaacacttttgcaacagaaagaaaccaaaaagctacgggagaaaaaagaaaactccaggtgacctgtcagtacaaagttcacagtttcacaggtcgctgtctgtgaagagaggaggccaccatctctgatggctctgcaaagtgctctcgttgggttgatttctggagtggtctgtgagaatcccaccttttccctggattaaccgatttcaaaagcctgtaataaattcgattcatgtgtccaccctgtcagccaagtagatcgcccaaagcctgaactggcattttaaaatcctggcccctgtatgcagggaatctagggcatgaatgtcagcaccctcctgacagccccatggcaagactctgggacaaggcctgaggcaggtcaggggtgccctcacccaggcccaggtgcctttggtttggggctggcctatgggccagagatgtttctagaaagaaggcaacaggcatcacaggtgcgccattctaaccct

SEQ ID NO: 931 - DNA, 522 bp, Rattus norvegicus
  Genbank Accession No. AA943149
ccagcattaacataaaactttattgaagatgcacaaacaaaatcaatgcaaaggacaaaagggagcctacttcgggtgaattggttcactgtcacttacggggagggaacagtaaaaatgtttcaatgtgggcagcaagataaaatgcaacacgtttcaggacaagtagtgaaatacattcattcaactcaaacctgaaaacaaacttggctaaatatcaatcaacattgatgatacagtatgatattcatcattcaaaattggcagctgaaagggttcctttgccatataaacaaagtggagataaagaatagtttacaaggtgtgttgctgctatgctacaaagccaccaagttattcctggctctttgggaacatccgctcagtcagtttggtcacaaactttccaaccttgactctcacctggaaatcatggtggctttcaattcccaggactttatcagcacacacttgaaattcttttaaaaaaaaaaaaaaaactctagcggcccggcacgaggc

SEQ ID NO: 932 - DNA, 401 bp, Rattus norvegicus
  Genbank Accession No. AA943202
aaaggactttattgtcctgcttctacaccataataaaaagggacctgcaagctccaggcctgtaccatttgttatcactgtgaaacatgactcacttgaacatatttcccaccccgcccccagacttcacaagataaatatgttacaattttttgaaaacagaataaattaataacttaaatgattaggcaccaacaatgacttgaaaaattaaatgtcaatcttaaatggtaacaagacacgatgtaagactaggctgcttctatttcatttttcttcccaacaaatagtaacaatcctgaatgaaatgattctaaatttcaagacacaaataaccaacagattacacaagaacacacaccaccagataccacaacagcacaaattattagcaggcgccc

SEQ ID NO: 933 - DNA, 436 bp, Rattus norvegicus
  Genbank Accession No. AA943244
  misc_feature (1)..(436): n = a or c or g or t
aatatccagaaatccaaaggacacgttgcttcaaacaattaaaaagacaatgaagtattactgcacaggggggcgtcaccaatttggctgcttggatataagattccccctttgttggttggcctgcgatgaggatgcaggggcccgtgagctcagggcttgcacgactgggtgcaaagtgggcacgagagctgcctggaggtccacagaggtctggagagctggaggggatgcgccaatcagtacaggacaaaagggagcagctccagccttggcctgcagacctgggggcaggaatgcagacctgcctgtcccttcctcaagaccccaagggagtgacagatgatgacatttctaccagtttcattgaccagacctctcttcaaacanacagtatcagaagagaatgaagatccaagcagtagaaagttccaga

SEQ ID NO: 934 - DNA, 451 bp, Rattus norvegicus
  Genbank Accession No. AA943421
gggaagaattttactggtataacatctagcaagatagagaaatgttaggtgtttagacggatcaatgatcagaataaagaagaacacttgggctgtcggttggttctgctcttggtttctgtgggtgcacatgttgaaccaggttctcaccaggcagctctagctggcctcacactgacttcctttctcagcctccttcccaagcagccggaattactggtcagtgacaccttgcccagagcagagtgcctaattcttgatattaaaaaataccaaagacaagccactgcgaccgcagctgccagcactcacgtcagtcagcaggctggcaaggagcagcctgcactggccttcccagacacagaccctggtcctcagtcctcgctttgtttatctggtgatgcagggttcctaagcaggcgtagcagctcctcaattctctgagcatctt

SEQ ID NO: 935 - DNA, 621 bp, Rattus norvegicus
  Genbank Accession No. AA943536
  misc_feature (1)..(621): n = a or c or g or t
ccaagaagaaaaagcattgttacaggctccagttcttatcacgagggtggggacggtcaaatgacagtcttaagatctttgtgtgagccacgccttgcccacacctgggccttccctcttctgctctaggatcacgtggacaacacagagcactgggtgagggtgggactcttgtctcctttgggcattcctggggaaccaagatggcgcctttactgcatgtgtgtgaatagagggtcccctgcttgctgtgctggactttggcacctccggtttctcgtttgactttgacttgggagtaggcttgtactgtttgaggaaggctcacttttttttgttgctgtttctgagaaccaaaacttcatctttcttttctaaagtaacagacatctacctttctcatttacagtttaaaaatttcaagtaggaaaagatattatagctttgaaatgtgctagaactcgctctctatgtagttgacttttataaatactgaacaagtttgagtggcaagtttctggagcactggctgaactctgaggatctgataatgatttctggcataagagggtcaacttataacatgtccaattatccttttcccacaatttanatctgcta

SEQ ID NO: 936 - DNA, 642 bp, Rattus norvegicus
  Genbank Accession No. AA943552
  misc_feature (1)..(642): n = a or c or g or t
aaagtgaccacacaggataaatttattagtgcctgcttttaaaagctttcaacaataagtctgctgctcgtcctggggagagggctccactgagaacctctcgctccatcagaggaatctgttctcggatgctgggatgggtcttgaagtgttctaagacgttttcctgaatgagattccacatccagactttgtgctgtgtctgtctcttggcggccagctccccactggccagcattcggtgctgaaactccctcattatgtcccacatctcagtaatgccctctccacttctggcagaaattcgaatcacctttggcctccagacttcagagcgcctgcgaagcaacttgagtgcgctcacatactctgcttggatccttcgggctggcacgaccaagtccccatcagatttagttataacaaccaaatctgccatctcaattatgccccgtttgatgccctgcagttcatcccctcctgccggtggcagcactanaacatacatatcgaccatgtcagcaacagcaaactccgactgccccacacctacagtttcaataagaatgatgtcatagcctcctccttcacacagcacaatggcttcatttgtggtccttgtcacccctcctagagtcccac

SEQ ID NO: 937 - DNA, 555 bp, Rattus norvegicus
  Genbank Accession No. AA943558
  misc_feature (1)..(555): n = a or c or g or t
ggggtaggaggctttattcttttggcagatcttctcagtcattatagatattgctgcactgttaataaaaaatatatgcttctctgtaaagcatttaaaaaaaaatccaaggatgagatggctgaggtctcagctcaagtatctgcaaatacatgtcgtccattcctgactgttccctgtgctatttcttggttgttttccggatcaacgccattctctgtttgtgagcttctgtggtacaagcttttttgtagggccggatctcctcagagccaaatcctgggatccacatgttccattggcgctctagatgcagctggacatctttcacctccagggtgctggacttgcggtgccgagcgagctggcaggcagctgtcaccacactctcgataaaatcatcagcgatctgcagcagcatctcttccacatcttcatccagctgctcgttaggatccacttctcttactaggtcttgtaatttcttcttggncaatacctggntgttttcagggctgagacgaccacctgtgccaggagtgcccggcatctttc

SEQ ID NO: 938 - DNA, 548 bp, Rattus norvegicus
  Genbank Accession No. AA943600
  misc_feature (1)..(548): n = a or c or g or t
agatgggaaaatatgaagtttctaaaggaaagctgggtcaacagcccaccaatgggaagttgggtcccattcacaaccgctatagcaatggggtctaggctaagaattattccaataccttcactgctgtcagagcgaagttcgaggaataaaaacacaggggtgagagtaacatgggacacacagggaatcattagtcaatgtgaattcaagaaagggttagaaagtactcaatctttttttttcctctgaggtacaaatatacacaccctaaatattcaacaactccaaataaatgtccctcgggaaacataggttcaaactttgagttctacacgagcagtcgtgagccctgcaggaacttattcaggggccacacgttgctctcgcccgtgttggaggtgcgcctctggcactgcctgcagcgccgatacttctcgcactggtccaagagaaacagcttgtcggaagcccgctcaaaggccttttcctccaagtcncgctgcttcttcatggncaggctcctgtcccaatcttcttgcaagcac

SEQ ID NO: 939 - DNA, 500 bp, Rattus norvegicus
  Genbank Accession No. AA943610
  misc_feature (1)..(500): n = a or c or g or t
gcgggcaaagctttgtttagatgagccaaggggggagtggagangaaaaggaactagaacattacatagcagagtatggctgtaaaatctcaaacaagacaggcaatgctttatttagagcaacaaaaataatgtttctgagaaagggaactgctacaagcaatgcatagctgcatgttctcgtttgccatcaatatcaattccctcaaaaatactttgagagtgctttgcggcttccaagcaccgactaagatctgttgaacagaaaacagttttcaaaaccatctttgtttaacattaacaaataatcaaaccatgtggctcttgctaacaaccaacggtgcagtctactggaaccatgtttaacctaagtatacagtcgtgaatgtatccctatgaagacagctatggctgtttttatcctgccggcacacacagcttgtgtagcagtgttactttggaatacgttcaggcaaccaagaagtcatcattacagtttt

SEQ ID NO: 940 - DNA, 612 bp, Rattus norvegicus
  Genbank Accession No. AA943687
aataagctcgcggacgctagagatttttttttttttttttttttttttcacatttctaaaaatattttaatgaaaaggtcatctttctgtaacatttcattatgctacaaatgaaacaattgaattacagaccacctctgctgtcataaagatctgaaaacatgttagcttcaaaactgaatacttggacaggctaccgatcctcacagcaccttgcacatctgcatgcttgctaccatgccaatcaccgtaccgttgtcaggcgttttaaatcgtgacagaactcataaaaaccaagttgaactcgctgtagtcccctaccagaactttttctccatgtgttccctaatttcaacatgaatgtgaacacagctttcagacataaactggaagcagtatcccacaagtccaacaaaaccaaagtcagccttcgtttgttttcttgttcaccgttgctaccaacgatttttgcagaaatgacagtggaaccatattaagtaaaataattttatttcagaaaggaaatgaactgtaaatgccttttaagataacgtatttatttttctaaatctattaagtaaccaccactgaaagattgctacctatttctgt

SEQ ID NO: 941 - DNA, 554 bp, Rattus norvegicus
  Genbank Accession No. AA943693
ccctaaaaacactggggaaaaaggtgtttattgttgtcaataatacaaattagtactagtccactccagaaccaagtgtccacaagacccccgaggcggtgcaatttgacatcttctttcattatcaaaggccgcttcagccttaagccggtcgctcactggcctgtactgtttgtcaacgaagtaaagtcttcctggctgcgacgcgaccgggactcgatcgacagggtgctcagtcaggtgagctggaagtcttgtgtgattcatgaagccttggccttccggcgctgggttccccaaagtaaaatggagatggctaacgtggtggatcccagaatcccaaagaacatgagcagtgaaaatgagccctgcctcatacacttgtatccatggaaaccatcggcacaaacgcattgcaaaagacctggaccatcagacgcacaagacccattctcaggacacatttctgggcttccggtgctattacaaaggtccttttgcccttggcaaatctgcttgtccatgaaagaagtaacactgtcccaggcattaat

SEQ ID NO: 942 - DNA, 543 bp, Rattus norvegicus
  Genbank Accession No. AA943752
gaaaattaaatcaagatatttaatagacagtgcaaaccataatttcatctgaatataaatgtatgcacatgtttccaatgagttatgtaccaattatcacaaacagcaatgaggaccttagagctatgttagaaaactggatagctggagcttaattctaacaatctcatctgctcgcaagagagcacatccacttcagatccgtgtcacagactccaaaagactggggggcaggagtgacaagggcagggaggtacacatggggccagtacacaggtgacagacagaaacacagctcttgaggaatcaaaccaggtatgttattacagctaagaacgaggaaaagcctatctatggctttaaaaatgactctcctgccagtaccgtacacgtcctacagagaaatgtgagacaagtcagctgatttaaaggacacgggctatattctccaggttgtttcaactgcaaatggccgaccctctccacagaggcctcagcagtggggttagcgtagtccagaagctcagtgttggatttgcaaat

SEQ ID NO: 943 - DNA, 522 bp, Rattus norvegicus
  Genbank Accession No. AA943866
gcactttgcacaaaatgtatttctgtgacatcctgaagtacagacatttccccagacccaggtggtaaagcagtggatgacagctctgctcagggcctggcagtgccagagggcgtgggatggaaagggcaggctgaggttgcccaagtgctgcatgggggaagccacctgccagggaaagtttcctctgggaaggtcagttgcctctccccgagtcctgtgaacagctgggccccttctgactgtaggcaggtaagcccggaaacaaacaggcacagagaagaaagagggcagaaaaagccacaccagaggctgcctccggggccagctttgctccctacgcctgctgtgcacaggtctcctgagtacctgtaccaatgaaaggcaatgcagagacacaatgatgggtgcacggatgccccgagagcctacaccacagtgcagcttctcagggcagcctgactgggctggagggacagaggactgtccacatgctggtctgaaggtggtttcctgctgcca

SEQ ID NO: 944 - DNA, 446 bp, Rattus norvegicus
  Genbank Accession No. AA943997
cagggggaacaggggtgagggtagaggcctcagtgctccagctgcttcaggctgcccagggcctcagcacaagccctgataagcccacaaagttggatactagtctccaaggaagcgctagagcccagctcgactgacgcccaggttagcttctgtaggagggctgtctgtgtggaagccaccacgtctgcatttggaggtgcagcaggaagaggaggcccctgggctgccttgagccctgctgcagctccctcacagtgctctggacggggtactggtggctgggatgggggccgagagctggaggcaggctctgtagtagaggccagctggtgttcccgagcttgagagagggctgcctgtgcattcagagccgtgttgcacatccattctacacgtggggatggctaatttggctcggattcttgccacggtgtcagcctcgt

SEQ ID NO: 945 - DNA, 604 bp, Rattus norvegicus
  Genbank Accession No. AA944157
aaccaatgaatattatccaaaattagagatgtaattgtaatttacttgtacaacatgaaattatgctaatgggaaattaccaaatactcattagtgtgttttcacattgctatatgaacatgtgctctcaactgctaatgataaacgttataactgattcgatcactatgaaaacccattttgcaaatggctgttcctgtttagaaaaattcatatagctataaaaatggactaaacccactttaatcctaacctacaaatagactattaacagcaaatataactggtagcctctcaacactgtaacaactggtgcagcgataatgtacacaatgcaaatagaaaagaaaacagtaaaacccgagggaagtcgattcttttagcaataaggactattactctgatgctttggaaaagtgaacactcatacttcaaagtctgagtggtaaggctgaccgtctctccctctcacatgtggaaggcaattccctcgctgattttgaagcatgtgcacaaccactgtacaacagtcacttcaaggttaaccagttgtcttttgtcctacagagtccaaaaaatatattaaccctttcctttttagaat

SEQ ID NO: 946 - DNA, 587 bp, Rattus norvegicus
  Genbank Accession No. AA944165
agccacaagcacatttattatcctctggaacacaagggcctccttcatagcagcggcacacagaaaagaatcaatctcaggagggagccacactgcttccggaagcaggcccgtggggtggtagtgtcatgggtggcaggaacaaggcctttagcttgcctgacaggctggcaatctcaggatcctgggcttcgtaagacttgaccaggcgggcaaacttaaggagaccttccccgtcgcagctgaagccataggctttaataacctcctgctggatctgtgtggctacaggcagcacgaattgcagcatcttgcccatatcgttgcacgcattgtctctagcctcgtccatacgcacggcgttctctggggccgagaacgcttggatcacctccgccaagaccaccttggcctgctctgcgctcagagccgcaggctgagccgaggcggacgccataggacgccactcggtgcttgaatagtgtgaacactgagatccggaggagcctgcagccagccgcctcccccacggctgcggactagtggaggcagaaaggaagctgtattgcacgaggcggaagttcccg

SEQ ID NO: 947 - DNA, 670 bp, Rattus norvegicus
  Genbank Accession No. AA944176
caaagttgaaaactgctagtttattagattagaaatgaaagaattggggtaattatgattacatacagaacccagcagttagaaatgaagtttgtttagatctagcttgagagtctcagagcagaagcatcctataaccatcctgacttttccgtttgcatggtctcagtgaaccagatagactattgtgtcaccgatgtctgcgcgcagcccgttctcagtaaggtgaactttcttgctcactaggtccacgtggaaaatggcattctcagaaatgagtgtcttctcgttctgctctctccccaggactggaactcgtcgaggccccaacagaggatcatcaaagcgcatgagtttcactttggagagatctttgattcctcggtccattttcgtcaggcgtctgattatggactcacagctatctccttgtctgatgtcgattttggtagagaagtgcccgctggatggctgaggatttactagggaaactgggacaccaggttctgttctgaaaacattaagtggcttcccaggacagcactcttccctgactttatcttcagcttcagaggcaaacttgacgtctatatgttccagctcaagagaattggttaggtagactatattctccataaggactgcctgctcatcaaattccaactcgaaa

SEQ ID NO: 948 - DNA, 622 bp, Rattus norvegicus
  Genbank Accession No. AA944180
aaatgcaatatacaaactttatttaacaaaacaggtaaagtaaaacaggcatttatattaagaaaaaaactacaagaaaatttatctttaacaacttaaaataaccctacttgcagttgcatttaaccgagctctgttgctgtgaagaatacagctcatgcacaggtatggatgaaagatttgtacatttttcaagtattcactgaatactaccttatatacacatatacattaaatttgaaaaagattattagatgatcccagctgtacttcatttttgttgttcttttggaagaggccgtctaaagagaagaatatgcggttctggctcatggatcatgtaatgaacccatcctagactctgttgaacaccaagtctcctccactcctcttcggacatcagatgagttttgggtacttgtttagaaagttctctgggtaacatgacatgccggtactcgtagtgctcgtcgaagtacttgtctgagtagtagatctgcttgtgggccatcctgctggcgtgcgaaggaaaaaaaccgggacaaggaaacggggcacaaggagctccacgtccgcctaaggccggggcaacatcagaatggtacctcgtgccgaattcctg

SEQ ID NO: 949 - DNA, 372 bp, Rattus norvegicus
  Genbank Accession No. AA944209
tttttttgaaagatggcgccttcgagcctggaagtccgatgttttaatgtatttatttatttatttatttggttaccttcctgttccaagcttccactgactgttgtccccccccccagggttttattatcatgttctgtctttttttttctcttccctcctcctgacttggggacctttttggggagggctgcaaggcttgcttggggtgttggggctccggtgggacagctgctatagctaccttctgtggggagccccttgcctacttgctggagtggctctaggctctgctgactgtgtacctaagacagaaaggcagttccggtgtggtgtgccttccggattctctctggggttgtgctttgagca

SEQ ID NO: 950 - DNA, 502 bp, Rattus norvegicus
  Genbank Accession No. AA944230
tcactaaatagaataagcttgcggccgcaattgattttttttttttttttttttttttgttttgtattttttaataaagtttgtaatccaatggacacacagaacaaaactgcgctgaggaaaacagtttcataaattaataagtgttaggagtcagggagaggtccggtcacaggagagggagtggagtggccaggtctttgtacaggtgctgtgactcttctatgttgcaggacaggacccgtgcagtgacgacgcacttatacaaatgagtgacggtacaaagtctgagtatgaaaataagattttctttgaaaacacatttttggcacagattaaaaaaaatgtatgtcagggaaatttgatttaagtcagtattatatatatttatatatattatatatttatatatacacaccccaagttctgcacatccgaccaagaaagaaaatccttctgttcgcttttactcaactgtaaactgtacatccggtgagttgaa

SEQ ID NO: 951 - DNA, 457 bp, Rattus norvegicus
  Genbank Accession No. AA944233
ttcttaatcactcaaatatatgtgtaaacatttatattaaggaaacacaaatgtaaaggagggtaccagtcgggcagcattagtgggacacagatctccaagagcatctctggctgctcattttcatccctaagaaacctgaaagacactcgcttaaggaccccctgagggaccattctcattcttgtatgcagtggtggccattagtgtctccctctgagccctgtctgacaaactgccctgtaaccttgtatttatttgccggacagaagacagggaagagagaacgaagaggagccgtgtttcctaatacagtgtagggtggccacgttgacacggttacagcaacacacgactgtcacaggatggtggatttcaattgacctttgtgtttttccacacttttaatttctcaacaatgaacatgcattatctatagtctgaagagatataaagc

SEQ ID NO: 952 - DNA, 508 bp, Rattus norvegicus
  Genbank Accession No. AA944244
acaaacatacaatttcttaaatatagactgtaaaactccatttgcaaaagtctgctattggaaggagtgcacaccagcaggaaggattcttaaactttttatttctatgagtttttctgtcagttttgctagttagtggtaaatacgggacccgccattttacagacctgtctgaagcttctggctgtattcacattgctctttgaagcagccctgcttgtctcacaattcatcagaatctgagcttcaacctacaggcagtgagatcaccagcccgtctggactctgctttgaacggttttcaggaagtgtggtttctggatgggtactgcacttcatggatttgtttgaattgcccatgcagctgtgtttgttaaagtgcatacttcttttaaaaaataagaggaataatctttactctttaaccaaggtacttaaaaaaatgaactttttggtctctcagcagatatttcccaaattgattctatcgctacaaattttagtgttc

SEQ ID NO: 953 - DNA, 593 bp, Rattus norvegicus
  Genbank Accession No. AA944251
taagctctgcggccgcaatgtttttttttttttttttttttttttttttttgtgtttaaactgtttattgaaaaaggagttgcccacaacccacacaataatctcagacagggatagtttgttgagtgcacaccctaagattagggccttagcccagaattcagggctaaggctacaaccccaacatctttcctgtcagcttataaaagctaaaaccgcaaaaactacagtgaactcagacacaggtacaggaagtgctgcccagtggtcagctctgactcaagctgttttagacattacagctcacgtcgatgtttagtttgatgggtcctaagtgaagtgtggaatttcttaagattaacaaacctcattcatatctggatatgtggtcagcatgactctgttctgggtcaagttattcttccgtgtcaatgactggcaggcatgttacagcaacaagatgaaatagttggcaggagggaacacaccggctacagctatgctgggggagttgtgtgtctgggggcagggacagggggcgcaggcctcaacaacctccttggactgtaaacttaccttcaaagcatgaacct

SEQ ID NO: 954 - DNA, 486 bp, Rattus norvegicus
  Genbank Accession No. AA944289
aaaaccaaatctttattctctagtttgtaaaggaaggtaaatggttgttacgtttcgatccaaggaacaaaacaagacccagtaggcagaagtcataggaaagcagaacccaatccttgtaagaatttctaacaattagacagtagaagcaatgccttctggaggtaacggtgacccagcacccaggtgcatgggtagaggctggcatctataccctggaaaccttaaaaaggaaatctacccaggactttccctgcagccaaccccccagctagtctttcacataacccctgaagctctgaaaagagttggggagggtcaggggtttaaacaaaatcaccaggaaggcgtatatttggggaagagcgggcagataaaaagccaggcaggtaaaggagtaaataaatgccctgggaggataatatgcacaaaagagatggaattgctaactgtggatgggtcgctacacatccggggtacctccgc

SEQ ID NO: 955 - DNA, 487 bp, Rattus norvegicus
  Genbank Accession No. AA944301
gatactagagttcatactttaaattcaaaattgaaaaaatacaaattgaaaaatagaaatatttagttattaaaatttctctcttgtaattctcttgtgccttttgagtggaaggttgacacctgcccttctacacccaggtgtcagtgctggcattggttgggacagagagatgggcaagtgaaatttcaaccttaatccttaaaacggagttttttgatttagtaacggaaaacagtgactgtcacaagtgtgggcagccaaacactcaggatactgctggacagaggtaaaggatcctcgccatcttgcagaactgcatgcaccctgttgcactgcaactcggactggggtctgcattcacatcatcgtaaggcgagctagccagtgttagctcaagttcaagtagaatatggccctcggggaacttggtcttgggtctcacagtgtgggtaactggtcctggccgcctctcatttccagaaac

SEQ ID NO: 956 - DNA, 592 bp, Rattus norvegicus
  Genbank Accession No. AA944348
agaaaaaatactcaagcaaagtctacaatcatcggtcaattaggaatgatgtacaagaacatgagacagtaaaataaaaatgcaggtacaaactatgtctcaaacactctatttggcaatattttaacaaaccaaaattttaaaggaacaaaggagttgcagagtccttcgcagatacagaataaaacaaatgatgaagtgcttaagcaaaaggaaatagtaaagcacactgcttttcctctgaaaacagacccccattttctacatcttagcatcttagatggctgtcccagagtgcctcacctgcagtgctgtccctcgtccctcaggctccctcaggctctgggactgctccttatctacctcttcaacccccaccatttcagcctcccattcttttaagaccctgtgggtggtctttcattttttaagcaaatgagaaatgatctatgcatcatggaacgtttcccattttggaactaaaggattaattttatattgtctattctttaaaaacttagagtaaaaactgctggtattcctgacactgtaggaagcgagaactccaagtgaggagcggtttctgcagtcc

SEQ ID NO: 957 - DNA, 583 bp, Rattus norvegicus
  Genbank Accession No. AA944355
cagaacattttactggcaacactgactgtatcaaacagacattcctgggaatggtggattctcttcctatccccagagaagcataacaggaaacagacacagaacagaggggggtactgtcttaccacgggatcagcacagcctcatgggggtgaatgcctgcgccgggggagaggtgcaaggtgcccttgactgtactccccaggggttggtctgttacgcaataggtatttacaggagggttagacaaaatagttacctactaaaggtatccaaaagcggcctgagaaagtctggttaaaatgcataaccttgtattgctactaatgggagtagtcagttttatatcttttaaaaataataaaaagattctgttaaaaaatatattttttccagaaagatgttgatttgaactctaaaaagcagtgtggagtcgtcatttttcccttttggatgaagagcctcttctccatgttcgctccctttctggcttcaggtctatcctgtcccctctgtgaagccaggccgtgcagctggctctccccactggaagtccggcctggagcaggcacagaacacacta

SEQ ID NO: 958 - DNA, 579 bp, Rattus norvegicus
  Genbank Accession No. AA944361
catgattggtgccaaggaaattgtggtaaatgtgaacactggattcacagtaaaagcacccccagccacagactgacagggcaggggcaagagaaagacaaaagaggtccggatggccctcagtaagtggagtgtagcgacactcgacaccagagtggacagaagcaaaggcccaggctgggcaggtataaggctggggactgacagcagcacttgaagcacctgacacaacagtggtgcagcaaagagcctcctctgcaaggtcatcagtgcagatcctacagtacccagtaccgcctctccagctggtgtgcctggccacacctgtagggcagggccactgcagctagctccctgtcattaggggacagacttcaggaagagggtcacaaggcttcactaggaatagagtgaaagttaccaatcactggggttcaggctttctgaaagtcaagagggcctatggccaccacactcccctaagggaattgctagaacctatctagcaagggtgatctattagtaaaacatctgacaatcttaagggcttctgagctcctgactctccaagagtcccca

SEQ ID NO: 959 - DNA, 539 bp, Rattus norvegicus
  Genbank Accession No. AA944380
ttaagtgcctactatgtgacagacacccataaaacaactaaaaatagcgacattttaatgggtaaaattagactaccctgctcgtgctttttttttccagttctgaaagacttatagtgttcaaggtgaaaaattggctactggaaaccaggtaaggccctcacaatcacggtgtacgaaatatattcacacctgtcagataccactcgctaatgctgctgttctgagcataagctcatgcaaaaacctcgtgtatgttcttttgggtttcggtgacttcacaatttgctggaagaacatctatgaagaaaggtcttctcacaagatggtatcaggtcatggagatcaaattcggtctcgaaggaaggacttttttcaaaaataattaaggcagccagcacagccaattttgaggtcattcccttgatgaggtacttcgagccagtctcaaggtctgtgtattcaaagcaatgcaaaacaaaatggtaaccagaatgtgtgaagtgactctggtagtagacttggggacagaggaaata

SEQ ID NO: 960 - DNA, 580 bp, Rattus norvegicus
  Genbank Accession No. AA944384
gttctgtacacaatcgtggacacagcacacctgtttacagtaaggccaaggtcaaggctgtcttttcagtctgcagaggacaaaatatcaaatgaagaagtttcaacactggccacttctgtctgcatcaggggagaaacaaattccattacgttttaacaatttggagaatttacaatgactaattttagcagcaatactgacttttagaaaaggaaaaagtagagtggtttttctgctactctgggtcaaacctggtgctcccaatattaaataatgttattgataacttattaataatattcattaaaattgatccaaagggtaatttcatggcaacacaaagtacacaatgagaaagactcctgactgtatacaaattcatcattttggaagaaatctttcttataacatgacaaacaggatcatttttgtgtctccccctaccccctttgggtttatgtctgtcttgtcataagcagagagcgacattaatgtttcttgtgatggccagacacacccaccatgggataaggacccttgtctgggtggggaagggaagagtaagagtaaggggtaa

SEQ ID NO: 961 - DNA, 636 bp, Rattus norvegicus
  Genbank Accession No. AA944413
  misc_feature (1)..(636): n = a or c or g or t
ggaataagcttgaggccgcaatgttttttttttttttttttttttttgctgataagaattctttttatgttattcgaataaaaaatacattcatacagaaatataacaatctcgcaaaaaacaatttcaaataaaatcttgtaaaacaaaattttacaaaaatcttacaaagattctttagataacagggtgcttcaaaaaaaaaagaaataaagaaatttcactaatagaaattttttttttaaatttcaagcaaaagtttctgcttgattgaggctcagctgtcacctgaacagaatgtactcgcttattattaaaattacaggcattgacacatacggcacccagccccacccagtccaacaacatctatgtgtttcataagtgagacaagccagcacaagtcctccttctcttctgtttaccttcttacttaatggaattgttgtggataagcacacagcagggccaaaaaaaggagttttccaaaacccagcaaatcaagtgctaggattttgaattgccaaacaaaagtgcattttccccttaagcaaaacgaaaccagttccgtagagaaatgtattcgtcaggccagatacgacaaaacaacacaacaacaacaacaaganaaaaaca

SEQ ID NO: 962 - DNA, 611 bp, Rattus norvegicus
  Genbank Accession No. AA944442
gaatcagccttcattgtgcaagtatgtcaccacttttgggtctgagacggccagggcaatgtgctcctgggaaatgggacccaagctgggtgggcagctgggaagctttctatgaggtcttctgagtggcaaaggcaatgggggtcccagccctctagctgggtttgctgacacagtgtaagcacaagctacctactgtggttgaataactgaagggtactcccctgaagcctctgtctgcgtggtgctggccctggggctgggtcagcttctcagccaagccccagggtcacactgggcctgagagtctcctgggagagtagagaggagaggtatcgggctgggatcagcgggccaagcaagtggcaaatcatcctgccccagtttgtcccagtccctggaggttgtgggtctggaaggaaatgcttgtgacgtgggccaggcctcagcacagaagagaggactacatagcccgaagtggactggaaacagaatgcccccggaggaggggctgcattggagcagaagtgggaggtggctagcaggacttggggcagagggtggtagggatcattcttgaacatgaggggctgctcatcaatggcgaagtg

SEQ ID NO: 963 - DNA, 583 bp, Rattus norvegicus
  Genbank Accession No. AA944469
aaaggtttttttatttttttttttaaaattagaatagaacttgggttgtgggagtgagattttgaaaatgattttatagtttatgcaataaatttcgatacattattctggatatacatttaccatataagaaaaaatttaaaaacaatgtcaaatagcttctcattaaaaccaattgtgtttaacttgatacttataaggaataacttgaaaggtataaataaaattgaaaacaaataccatttgggtttgcttttataatgcaattttgtgtttcatttgttgggggtaaggattagagaaaaaggctaaaatacttttttttccctagagaagtacaaagcctttgtgtttcgtgtaagtgacttcacaatgccccagtggcagaatgtcaacaaggtgttttcatgcactggcatgaggggctgtggtgttccacccagggtccctccagactgtcactacacactggggtaggggtgcaacacacctggtctccttaacaccaggttctagtgaagtcacagaatcatccaacgggaaatgggtgtgaggaagaggaagctcgtgttttctaagctct

SEQ ID NO: 964 - DNA, 570 bp, Rattus norvegicus
  Genbank Accession No. AA944481
aagggatataagcttgcggccgcaatgttttttttttttttttttttttgttctgaggttgtttttattgtaagaatgttgtgagctgtgccttggaaccacagttggcacctgttcatccacagcacccacaagagcaccattgagtgtatccagggctcctgggaaccctatctccagtcggtcaatatgaccgagtccgccattaagggcccagctagttggactgaaatggtccctctgcatctccaacttctctggtaggcgagaagtgagagtcaatgccccttgagcccacgttttctgggtctgggccatttgtttcctgttgctctgactgtttcagacaacagtgcttgcagaccccaacacggaaaaggggtcctccagtcactccagttatgggcttcttctctgtccacgagactccagatagccctacttagagctcctgctctcagcagaaaacagccatatcttaaggtcacaaccaaagtcactgtcttcttaggcctggaaccaggctccagtgaggaggctaggaagctgctgtaacctccatgggctgga

SEQ ID NO: 965 - DNA, 515 bp, Rattus norvegicus
  Genbank Accession No. AA944528
aacaggacaatggcattttatttacaattggaccagaaaaaggcatacaggcatttttttttaattaaaaataatgatgatgatttaaaaagtcagaaaaattgacaatgtttgaacctttcccccacccatccctgacaatgagaaccttgggggttgaggtgcacgatttgaatgaacaagtaactcccaatcactctctactctcgggctcccatttctctagcctgattcttggtggatgccactcaatgctgcgaagtcactgtgaggcaagatgagaggtgcactgatttgactgctgatggcagcagggccccaggagtgggggcagtgagggtagggtgtgttcccagcataagcagcatcctgagctttgtctcctggcaggttcccaaagtactggaacaagggccagtggctgttaatgacccctacacccaaagtgggtttggtctcttgctacttaagagcaaagtctatgatctgcacaggctttgcacgggctcaggtaa

SEQ ID NO: 966 - DNA, 441 bp, Rattus norvegicus
  Genbank Accession No. AA944530
caaagaaccgctttattgatactgtgaagctgggcttgctgcccgcttgggtggtcctgtagaaaatacctgggaactgtggcagccccggctaggcacggtcgtcactgccacagcagaagggcacaagaaaccctgatatgaatgcagtctgggggtgggtagggatgtgcagacccacactggctgggtccccagaatgtttttggcaaatacaaatccttgccttgtaggtgaggaggtaggcgaaggcccccagaagccccactgacacattcaccaccgagaagaagatgagcagctccaaggctccccagaggggctccagtaatcgtccggccacaactactgtggccagactaatggccacgtcccacacgtgctgttccatgagcccatgggtggccagggtccagatccagaagttgggtggaaaaaggt

SEQ ID NO: 967 - DNA, 538 bp, Rattus norvegicus
  Genbank Accession No. AA944561
  misc_feature (1)..(538): n = a or c or g or t
gaaattaaaagtatgcaaaataaagatgatgcagttttatacagtcctgctctccttgtaaagtaacactcaggattctgggctccctgagttggaagatgatgagaggcacttgtgcttctgaactcagaaccaaaacacaggtccaaaaatcactgctgcagtttaatcaaatagagcaaaaggtgacatttccaagtaaccaaaacttgctcaaggaacactgggggccccaactgggctggggggagtcctttgtcccttctggcacagcaccattctcactaacccctaggggtaactgcatggcctgtaaacaatttacttcccagctggtgcctggcagcctcaaggggtgggtgttagaaggggatgagcctgctgctggtttgcctggccaccagctaagtcaagatctcaggtatcggggaggaacgctgcattacccacagctgtcacttggtgaagtggggctcttaaggcaaggcaaatnagctgcctccaggactccaaccctctgccgtgtgctgagacactg

SEQ ID NO: 968 - DNA, 639 bp, Rattus norvegicus
  Genbank Accession No. AA944581
attttctagtatttattttgttcacctgcaaactgtagcaaaacatgatcagctttagccgcagacaggtgtcctccacatccttaaagaacttagccatgtacgaatagaagagctcttcagaaggaaaaattcaagaacgaatagaaccttccaatctgaattttccagaagcaatgtttcaaatgattttaatcattcatttcaagctagatgacagcaccttaaaagtggctgatctatttccccagtaacatttctcacataacaatgtgttaaagttacaaatactgatatgcacaaatagctaatttctaagaaaaatatgtacagtgctgcagcataatgaatgtgggatctgcaataacttaacgttagccaatttttaacttacatgatgccgctaccttttcctgccaattcacaagtgaaaagttgttgctgagccctctgttttgcacatattacctggtgtttaatacacaatgcaggcattttaaagacttctctcatgtttaaagctaaggtcagtgaaacaagacaacagtgcaagaggcgaggagatgtaatatgatgacataaaagttcgttccagtacagtgtctatataaggctataagaaaggattggttgatgagc

SEQ ID NO: 969 - DNA, 494 bp, Rattus norvegicus
  Genbank Accession No. AA944617
ggtagaaacagtttattaagagagaaagtattcccatgtttggaagggggccagtggtggagccgagccaagggcccagctgccctgacccttcagcattaagacccttacaggtcacctacacagccagctactgtttgcagcaggcttcttcacacgctgctctacctgtcccttggcccttcctcaggtcgttttacatatgttaaccttgataccttccttgtggctggtggtgggggtcagggattggagactcagcagagctggtaccttccttgtggcaggtcaccccagagtggccctaaggtggccctgcctgggtaagctacggggcctccccaaattgctctaacaaacacagctttgttgatggtatctggcacctcagaatgatgagcgaccctggatgtccccaacagtccctctacctaggtgacatcactctcctgaagaaagaaacaggacagtgtcctgcccagccttgtcctgaa

SEQ ID NO: 970 - DNA, 488 bp, Rattus norvegicus
  Genbank Accession No. AA944628
gcaggggggccactgccctagttatcaagtttagtgtgctgttctcatgttccaaacccagctccctcccaccggggacagcagaaggactttcacagtacctgtgtgtctccttaccaaatttcccctctaacacccttagtccaaccatggtccatttaagtgcagctaggaacaaaggctgaggagaagcaggaaatcttccgagaagaggaggaagggcctagagaatttgacattcccccttcccatgccctaggaggacagagtcagcaaacagtccatgccatccagcacagcaggctgggagaggaagctgatggaattccagcacagctgggcttgctcaagtgccagaggtgtcagggaggagacgtggggtagcaacttaggaaaagcgctctttacagatccaagaaaaggagaaactttttggagttaggaaagaccttgggataatttcctcttcttccaggtcctcaggagca

SEQ ID NO: 971 - DNA, 423 bp, Rattus norvegicus
  Genbank Accession No. AA944740
aaaataaattgcatacagaatttaaaaaagaaacattccattgatataattaagccaattttcacggacagaaatagttatagtggatacaaaataagcaaagccttcacttcaccaggatctgccttccctcccccctctctctcctctcttttttttcttacacaaaatgttaactattaaacaaatatgtatctcaagtggtcagcactcctgtcttcagctcgctgctggcgctcatcgttcctctctctcccgagaggcacctccaaagagcacagagtctgaggacagggagtggtcggaacagggagagaccacccatcccctggcttcaggtctactagagtagagggcactctgggcacagaatggtcacagtggttctggccacgaggtcccacccagccttgaggaacaacg

SEQ ID NO: 972 - DNA, 431 bp, Rattus norvegicus
  Genbank Accession No. AA944741
gtttgaaagtctttcatttcttttgaactttctctgagaggcaacaaacaagttttctccctgactacatggaaatgcacaaagaacccacaattctgcacaggacacataggcaggcacctcttgtgagactgaggagggaccagggaggagcgggaggagcgggatacactatcgcccctacctgggcgacaggccagactttaaagctgtttcgatgacatgcaggttaggtgtggtggtacactcttttaatcctaacatttgggagacagaggcaggctgatctgaggccagcctggtctacagagcaagggcagcctggactacagagcaagctccaggccactacgggctacacagtgagaccctgtctcaaaaagttacttttcccgatgatgatccacagatggtgtgagggactggtttta

SEQ ID NO: 973 - DNA, 428 bp, Rattus norvegicus
  Genbank Accession No. AA944752
gcactataaatattgtttattatgagtttctgtgttcagtacacaaaataacatttaaatatttaagtatttctgggatatatacaattcattctgattattgctaaaatggtcacattcaagccttgaagtgtgaggaaccagtgttctatgcatggacgctgtctaacgtgtaccacaggcctgtccctgcagggtcagtgactctggagtggacaaagtactgctcccatatccagcctacccaccagtggatggtgtgtgacagtcagcactcctcactgtcctcccagtgttaaaggcttcccagggaagcctcgctgacccaggcagggttctgggcctgcctgcatctgtcagcctaaaagcctagcggtcccactcgacagggctctgttcatcattgtcctcctctgagtcagcagaca

SEQ ID NO: 974 - DNA, 400 bp, Rattus norvegicus
  Genbank Accession No. AA944803
ggcaggacatggtactcttttattgtgacgctcagtggaaacatctgtaaaccagcttactgtagtggtgacagctgcaacacatgctaaggcacttgtattatataaaaaaggggtgcgggtcccactcactcctgtgacagcaactgggacctgaattcagagcttttctagcatatgtagcttcatgatttgactgtttctcctttaaaaaaaaaaaaaaaaagccttcttgccatagggactctaatcacagcatttataacacagtgaggaggagcacagggaaactcagcgaccagtgtagaccattgtagggcaggctactctcttctaagcgtggctccaggggcaaggctgtgaggatccacaactagagcgcttactacaagaagggaaa

SEQ ID NO: 975 - DNA, 491 bp, Rattus norvegicus
  Genbank Accession No. AA944823
gaaagtatacaagcagtttcaatttattggaacaaaagtaacatttctgtttttgcaggagtgaaatcattgtacatttcaaagaagacataaaaatgttcaaaacaatcacagttgaaatgaaacgctgtgactgttaaatacctgctctacaggaacacttttataacagtgttcagctgcttgactgaaaggatgcatatatttccacactgtttaacacttataaattaattcacaggattcatagtattactttatagctccaaatgggtattagcaaaaaataatacaaaatgactcctctttcaagcaacaccatctgcctcaagtaaaacatattaaactacaacttgttagtacacaagatttcctgttttattatcctgggacatctcgtgctgtgggctactgctgttgcttcattcatgtacttaactcttacctccaaagactggaatgtcttttgcaaggaatatgtacacaggcaa

SEQ ID NO: 976 - DNA, 300 bp, Rattus norvegicus
  Genbank Accession No. AA944828
  misc_feature (1)..(300): n = a or c or g or t
ggggcagtcaaatcatgtgtttattgagtgcctgttatgtgctaaatattgttcaggggacgtgggacccagcagaggacacggggagtcctgccctcgtggagcgtacagtctattgcactgctgtgaccttgggcaagtcactgcacccctcgaccggcccagcagatagacctggacgtggtgcagatgctgaccaggacagcgctctgacccaccaccccagacagcagagagggctgcaggttcatctttaataatcaagtacacgggggattannattgtttggntatcacatg

SEQ ID NO: 977 - DNA, 522 bp, Rattus norvegicus
  Genbank Accession No. AA944833
aacttttcaaataagtttatttgaagcaaaataaactactgccaagaaactttatgaaagttccatctcaaaagggtcaaaaaggggaattaactgctatgaattctttgcattcagggcgtcaaagacgcagcctgtgcagcgtgatgacgaattcttggatgagaaagcatgtagacagaagtattcctatggcagaatatttacagcactactttcaatgaagtgcttcttccataaacatttgaaatgagatgaactgcagagattaaatgaaggcttcatattgtactttcgtatatgaaggaagacaagtgttaaaaacaaaaccaaaagaaccaaacaccatgacatcatgatctcccaaatggagattttcctaaggaagaaattcatagggtgggattcaaattaaaataaggagaaaagaatgtagttctaaccaatggtttctactctgaacatgcaaagaattcattaacattccaatgatagaatattacagagaaacttctgagatca

SEQ ID NO: 978 - DNA, 476 bp, Rattus norvegicus
  Genbank Accession No. AA944898
caaaatgatttactaaataaatcataactttacaaaaggcacgaggcagtacgtttgcgaccgttcttcgatatgtcagtctaaaaggtatatagcggaatcaatttgaaaaatacaaaaatataactacacgaagtgggaaaaaatagtacaactgcatttgctgatgatatgtcctcaggaaaaaggaagtgtaataaattaacaaactatgatcatcatcacctttacatacacacaaaaaggacacaggagacttattaaaggtttctatgatgtctggaatcttctactctaaaagctttagagatttgagtttcgaaaacaccattgcatgaacttccagaaaacatatcattcttcacatcagcttcagtatatcagcaagcacgtttgtcatatacaaggtaacagctgtgatgcctaagaaaatacatccccatttatagcttgattgtgctctgtgtattaaacac

SEQ ID NO: 979 - DNA, 516 bp, Rattus norvegicus
  Genbank Accession No. AA944906
acaacacttgagacggattttattggggtttctcacagtggttggagccactctgtcttccggacaatcacagcacagggtatcgtcgcgcagactgcccagggcagcctgaatcttattgcttaagatacacatagtcacgatgactgacagacggtggtgggcctcacgcaggaatgtgttagcggctgcaaatctgaccgtagcaccaagccttctgcctaacccctccaacctggaaacccaactcagtcaagtctccctggcccctgactcactatttcctgtgctctctctgagcatcaaggtggctgaaacagcagggccagactggctccgtcatcatggtgggtgcttcagtaaagcttcagcactcgggccagctcctcactctgccaaggggaagagactcgagagggtcccacctcaccaccagttaactaaagaggggttggttttgggaaaactcactcctccgacacacatcagtgaggtgtctggcattttaacaagaaa

SEQ ID NO: 980 - DNA, 457 bp, Rattus norvegicus
  Genbank Accession No. AA944912
gaattaaaaaagttaagatcccacattttttaagaggctcttttacatacagtatagcatctaagtgacagatgtggaaatcagtcagatgagacttcctcatacactgccatgacgtggatctgatgccctctctcaaaagaatcctataaaaaattgctcccaagcccctctgaaatcgcaatagtgcagcaaaacccaagtaaacagcgcctgctgacccggtactcaaatatagactgaaagccaacaggcagttttttgtgtgtgtgtgcaacttttaaaaacagatcattaagttgaaatatccaatctgcacagtgctgtcccttcacagaaggcaagaaactgccggagcatcatgtcggaggccggcctcggtgctgtaggctgtgaaagtgagcctccttcagggtctgattgatgtggaagtaagggccttggcacagtgcagact

SEQ ID NO: 981 - DNA, 561 bp, Rattus norvegicus
  Genbank Accession No. AA944922
cctcactaacataggaataagcttgcggccgcaattgttttttttttttttttttttttgttaaaaaaagttggcactgtttatttgggatgaaaatatggtataaaaaatattaacacggaatggtgggttgaaagcaggtaaccaatataaatacggtccaataagttaatgcacccgcacagcggggcaaggctcagcaagcacgggaatatcttcggtgaagaacagcggcggcgtcacccggggcatcctctgggctcctgggcccctggactccggtctgatgcggcagcgtaggctggttcccggctcgactactcccgtgggtctctgaagcggcgaaactcctccagcgcccgacggttctggtagtcgatcagcgccatggtgatggccgcgttccagcagctctcgactgtgcagcggaagtcgatctccttgtaaaagttgggggacgccgaccgctcgggggtcgcgtaactagttagcatgccagagtctcgttcgttatcggaattaaccagacaaatcgctccaccaactaagaacggccatgca

SEQ ID NO: 982 - DNA, 467 bp, Rattus norvegicus
  Genbank Accession No. AA944935
agaatatagtctacatctggattaaaaaaaagttttaaataaacaagacatataacaacagtggagcccttcatcattctacgtacaacacagatagaatgtcagttggttccactttagataaatccactttctcacaataatgttattattttcgctggccgagtggcaagcttcatcctagctggcacgtcaccagtttacacacacggggtcgtgcgctcctccaggcagctgccactgccgcctacctccacgctgacctcgttgtctagatccggctcggacaggggtacatcgcgcagcagactgggcaccatcaccgtctggtccatgttgttcaccgcgccaatgaagcgattcatggcgttaaagagcgagtgcttctggttgtatgtgtcgcagatttgcatcatggtggccgagcgggcgcggaaacacaaggacactggtacaccgagatggac

SEQ ID NO: 983 - DNA, 344 bp, Rattus norvegicus
  Genbank Accession No. AA944956
gaacggcttgctttattagaaacaagggagatgtctggagtggaacagtgcatttggtatctctgcccccaccccagcaagaaagcccccagcacagcccaaagaaaagccaaccagaaaaagtgaagctctcacgcccccagatgcagcacctgatggccacagtgaacactgtagtttaattcagtgaaaaccgtcctagatctcctcagatacagtctgtaggcccacccgccgtcactctgcaacgagacgcaacgggtctctggttcaacaccaggcagacaaggggcttccacattccaggcccacccaagaaggaaaggctcgagtactttgttctt

SEQ ID NO: 984 - DNA, 605 bp, Rattus norvegicus
  Genbank Accession No. AA945069
cccaaagctggttttaatttccaaaaattatgaggtctcttcccacactggggataataggatgggatagcccagactattatcccagtccaacccccagcctagcccaaacaccattgctgtctctgggtcccgtcatttcaccactgggagcttatttctaactccctcactggccaagacaggtggatggatgtgaagtttccaggactcagcactgtctctccaaagtgaccctgggtctcctctgtgaggggaagccatctgtgtcacgtcaaagtggattggtgtaaccaccaggctcaactcagatccaagtcaatcatccctgggtctaagggtcagcgcccaggtcctggtggccgttccagtgcctgtgtgcctactagtacatccatgaggtagtccagctcagcctcatccaactctggagtttcctccttggctgggccattctcagggacaggtttgagaccctcagaggctggtaaccaaagttcactgtcatacatggaggtatcaatgtcctcaaacaaaccctccagtccatcgtccaacagacagcccgtggctgggcctagcaagtccaaggcacccaggttggg

SEQ ID NO: 985 - DNA, 664 bp, Rattus norvegicus
  Genbank Accession No. AA945076
aaaagctacttaattttaatactccacaagaaaattttaaaaagacttgacgctcttgacgttgggcatggtggcatatgtctttaattccagcagttggaagaaacagaggcaggcagaactctatgaattcaaggccagcttggtatacatagtgagttgcaggacaggcaggactacatagcaagaccctgcttcaaaaaaacaagaataccagtgaagaagcattaatgcactatttgttttatggatcaattggagaacaaaatgtggagatgttggcatcaccatgaaagagcaatagtgttagcagtcgtgttcagacctccttgactaactcaggtagacagaggtgaggcgaaagatgaagcctacagatatgttggtctcagctagagagactctactgataatggccttgggcctcgacaatggattttctgaaaatgctgaggtagaaactgtttagtctgttctatctgaatggttaaaggtgtttatcattccagaaaccacttctgctgctaattatctcctcggtgcatgtgaacaagtgttaaaaggtgacttgtgtctgctgaaacatctctgtttactgaactttcatctggaaatgagaaatgcgaataagaaataagaggtaaatttaatttaagtaaattta

SEQ ID NO: 986 - DNA, 687 bp, Rattus norvegicus
  Genbank Accession No. AA945099
aagttacactacactttcttagatatataaaccaagtaatgaaaaattatggacaatgttgagtaaaaaaataatttattatatatgcaataggccagtacaatacatttccaagcactaatttgaagatatgtaatattttaatgtttccaaagttgttacgcacagttccattgtccagacggccaatttcttctctcaatgctccacagtacttgaaagatacagaattcagaaggaacctaaaacaccataaagatccattaaaaataattataataaattagttaattaagcccaaatatttatatgtagaaaattagtgaatcatgtcagcataagatatatgtaagaaaggctacttttaatactaaaaactaaaatatttcaattgtgaatatgaagagactgcaatatcaattttagaaagcttctactcttaggatgacaacagaattgtgagtagttttaaagcacttataatagcatagcaacacttgccacaaaattttgaggatttttattttcctaaaaaaaaaaatccaaatttgtcagtggtcctttctattactaaggaaaactttcaagtacaagacattattgaagtgattctgatttattagctctgagatagaaacatttgtacatacactatcttcctgctggttctctctatattaatatagt

SEQ ID NO: 987 - DNA, 705 bp, Rattus norvegicus
  Genbank Accession No. AA945123
ctggacaagaattttaaagctttattcaccatggaccccacaaaatatatacttgacactgaatgtgactataaatgagaagtgagaaaataaaaatgattcaaggggaattaggaagtcaacacttactttaaaatgggaatgaagagacagagttcaaaaataaaataactttgcatggtcccaagtggactagacacattcctttcaaacacagtgagtgccacaaaacagccagacatattcagacatgcgatatatagctagaaatccaccttcaaagaaatagggtgttaaaaaatgaaaagtctctagaaaaatcacaaattaccaccatccgtttcaattctatcgggtgctattttctcaacacggcaaatccaaaccccatgtttctctgggcatttccggcatttcaaagcccagcgcacactgtaagagccactgtcttaaggaaatctaaacagaagacaggttaataaacagtgaggtcagtgtcttttacttcggcatgctacctccaatctcaccagaggatatcttttgttccccctcactttagcctgccaggggatgacgttgcccaaacacattttcaatgttttctttttaacagttaatataattccaggatgcaagtccatttctttctagaaggttcctaggacacccattgaaaagtcaaaagcaatgaaaggaaaaggg

SEQ ID NO: 988 - DNA, 620 bp, Rattus norvegicus
  Genbank Accession No. AA945149
  misc_feature (1)..(620): n = a or c or g or t
acaacaacacatactaaaggagccagaggcaaacggtctgaaagactcagctatcactatgctgttaatgatgtctttattaggtaaggcgcataagagatgtccaatggcaccagacatcctgtgacagtttggagctggagacaggcagaaggcaacagtcagagttagaaggcttagagcaagaatttggaaagtcagaacatcaggaaacttccactcctgcaagggcagtcacgaaccagccctgcaccccacctataccagggagcgaagaccctgaggacaaaggcctttcactagtcagtcaatccccatctctgatatgtattcaactcaaaaatcatagagtctccctgtcaaactaaggaagggaggcgctggggttgaggagcacagaggtccacgtggtgccagatatcaaattgagtgtgtgtgtgtgtgtgtgggtgtgggtgtgtatgtatgtgtggcacatacatatacgaagggcacggnggtcactgtgaggtcagaaaaggaaccagggaaccagaaaggtatgacttggaggttggggaaaggttgctttgtaaagtttcaaagaaaaggaatatggccaggtaagtttctcccaagta

SEQ ID NO: 989 - DNA, 720 bp, Rattus norvegicus
  Genbank Accession No. AA945152
aggatcctcatcaatagatagaaacgtataggaatagtcaaactacatctacgaagtgtcagtatcatgctgcggcttcaaatccgaaatgatgttttgatgtgaagtggaattttagttgtcgtagtagacagacaattaggaaagttgagccaataattacgtggaggccatgaaatcccgttgctatgaagaatgttgagccgtaaattccgtctgagatagaaaatgatgtttcgaaatactctgaggcttgtaagatcgtgaaatataatcctaagagaatggtgattagtagggcttggtttatatggtttcggttgccttctattaggctgtgatgggctcatgtaattgagactcctgatgctaagaggactgatgtatttagaaggggtacttctaggggatttaaaggggtaattcctgttgggggtcagcaaccgcctaggtcgtgggtaggaactaggctggaatgataaaatgctcagaaaaatccggcaaagaagaatacttcggagacaataaacaggattattccgtatcggaggcctttttgtacaataggggtgtggtggccttggtatgttccttcacggatgatatctcgtcatcattgatatatagttaggatgtttgtcaggaggcctaatgataggagaattgtggagttgtaatggaatcatattactaagccggatgtgagtagaagagctgata

SEQ ID NO: 990 - DNA, 461 bp, Rattus norvegicus
  Genbank Accession No. AA945171
caagaacaaacacctttattgtgggttccaggggagggaggtacgtggtggcactttaaccctgagtccagtccctgcagagcagtctgggacacaggctgtgggtcttgtttaggaggtggtctctggagctctgcagccaggcctgagttcggggacccaggtctttcaggtgatcttcatagtaggtctgcacgaagccctggatagctctggggccccagaaccaccgccatctgtccctggttctggtcaccagtggttccaccatctccatcaccctggctcttaccaggctccagcggctgttctcagggccaggagtgggggtcaagctttctgtaggcatggatgctacaaagcaggccaggaacagcacagagaggcagagtgatggcagggtctgctgcctgcatctcagcagggacatttctggggacttgggcctctgtgtctctgtc

SEQ ID NO: 991 - DNA, 643 bp, Rattus norvegicus
  Genbank Accession No. AA945172
atcagaaggaaatactgtaatttatttactgcattggatctggattttgaaagttttatgaacacttaaacaatctaccttaagaatcaaaaattagaaaatgtaacaaagtcattaattatattttcctttgtatattttggtggtggtggtgtttgtttttgttttttccgagacagggttcctgtgtagccatggctatcctggactcactctatagaccatgctggtctcaaagtcagaaatccagctgcctctgcctcccaagtgctgggatcaaagttgtgcgccgccatgtctggctccctttgtacgtttttatggacttaagattttccctgtcttgtaaaaatagtaaatatggcttgaaaaatacatactattacaagatgttttaataaaggacctatattaattcatatatcatttagatttccatgattcaagcatactaaaatattccaagaattaagattaaaaaaagaacaacatccgtttttgtctttaaaagattttcattcattcaaaaattttgaaggctaactatccaattcaagacagaaggaagaatttctgagtgtatgaactaagaactgtctttgctgaagcgaagtaagaactcaatcagagtccttgtgggtct

SEQ ID NO: 992 - DNA, 646 bp, Rattus norvegicus
  Genbank Accession No. AA945181
gtgttcagcttctcatttttaatatttggttaaacaaaatacatctttgtaaacaaacccagcacaaggccaacaaagaaagggaataaagcaagaaaaacaaagcctagggttgcccttgctgggcatcagggtcaggatgccccttaataggaatggggctttttgcccttgggcatcaacatgggtccctgttcctaagcaccagaattggatatgaacagaaccagccctgaaatgcttaggcatctttatacatcccaccagctcatgggctccacgtgcgtgggactgtttgcagtgccatttgcaaaggcccaagcagatctgtagggaggagtctcctcttcccaagaaatggcttactctcaccgacagtgccaatggaccaaggtcctgcttgtgacaatcagcaaggtcggctgtaacttctggctggtagtgattggaatgtcattgtgcaggggcagagttagctccccgtggtgccaagcagatctggtgtagaaaatggtgcagatgaccatggctgagcgcaatgcagtagccacttgaggcctctgctacttgaataaaaaacggccttgttggattgaagatacatgtgcagaaaaagtgctggggtaaacatgcactccagtcacaa

SEQ ID NO: 993 - DNA, 592 bp, Rattus norvegicus
  Genbank Accession No. AA945193
aaaagagtatctggtgccaggtaagctttaaagaacacagacttattttagcccacgattctggaagctggggttgaaagaagcccacactggacaggagagccatgtggcttcaatgctggatggaaacacagaactgcaggcaagcatttatgaagagttagttcttaaggcaggcagccctccaagagagtgctgtctcctgagaactgctcttctcagtccgtacatctgtgaggaaagtgtcccgagtgatcgagaagaagtaaatactatgaaagtcaagactgttgttctggtgacaggctctaggtcatcatccactgagtagacggcaaccttcacaggctgttctggagtgtacacaggcttgtcagtgtgaacaaagagagagctgttgtcatagacgattggcattatttctaattttgaaaaatgctttgacacgacttccgaatacacatttgagaaccagttttgttcttcagacaactcttgggcctgaattgttaagatagcagagttttggaatttattttctggtgataattcaacagtgcccgaagagtaattaacatttttattaggatag

SEQ ID NO: 994 - DNA, 405 bp, Rattus norvegicus
  Genbank Accession No. AA945268
caccctcgagtttatttgtgtaatgaaccttgaagaacattatagtaaatacgtgtgttttccaggatgccacagaatttcattggaaaacaatgaaactagattaacctgagaccccccccttccccttagaaaataaggactataggattagaccacaagcagactagtaaaggggatggggttgtggtacacctgattttagccagactttcccaagctaaatccagataaaactgcttctgtattagtaagttgggtgagtgtgtataatctatcattcaaaaagtttttttttaaagtcttatgcgtttgtttgcgtgctcgcatgggcgcacctgccgttgtgcgagctgcgtagacacatcgatgtggtcagaggacaatcttgggtgtcagttcttg

SEQ ID NO: 995 - DNA, 330 bp, Rattus norvegicus
  Genbank Accession No. AA945284
agatgtttctatagttgaattacaacgatgatttttcatgtcattagtcacagttaaatgctgtgtagaaataatgacaaattatatgtttattttaagtttactgtttttgactggttgtctagggttggcgttgaagccttcacctatttatggtgggtttggattgattgttagtggatgtattgggtgcttaatagttttagggtttgggggttcgtttttaggtttaatagtatttttaatttatttgggtgggatgttggttgtatttgggtatacaactgctatggctactgaggagtacccggagacttgagggtctaattg

SEQ ID NO: 996 - DNA, 664 bp, Rattus norvegicus
  Genbank Accession No. AA945320
agcttgcggacgccacactttttttttttttttttttttttttcatatttgatagcagcttttttattggttacaaaacctaagcccatatacaaaattaggaacacgtttagatgcctcttttgaaagaacattttagtctttttttaaactgagtttaaaaaaaaatagaaacaatgcaattttaaaacactgttttgaaaacctaaaagtgcagcaatacactcagtttccttatctacgaagtggtgcgattccaattcaaaccggtaaggtcacagcaaaccggatcaagcagatgcagggtctgcactactcgatgctaacgttactcaaaggttagtgtgcacttaggacgcaagaggaaataggaatcatcacagtagaggcccaattttaatctcaatgtgtgcaaatttgaaaaggtaactgtcagttaagtagggagagtcgagaagaaaataaactggaaaggggacaattcacaatatcaagaagatattttgactttaagggtttcaccaaagtgtgtgaccttaattcattctgactttgttactcctacttttagtgaacaactacacagtttcaaaatttagacaagtgtttgaacaggatgcagttaccacatgaagctttaactcaaaatctgggtaaagaaaaa

SEQ ID NO: 997 - DNA, 354 bp, Rattus norvegicus
  Genbank Accession No. AA945432
cagggacagagaactttaatgttcaggtatcaagggttacatcaaggcacagacatcctcaccaaaaccaaataaataataatctgtataggaagataagtttatggctgggctggcagcaatgcagccagtccctagggtctggacaagtcatggcttttagtcctggagttctgactcccttactcactctctgagtcagagtactcagccaccagggaggcgttgggggtgttggggtgcagcaggtcctcctgggaggaacctaggggtaaggcttgatcactacagtttctcttagattctaatgtcatgctggttctgggtgcctctgctgtcccttgaagtgtcttg

SEQ ID NO: 998 - DNA, 523 bp, Rattus norvegicus
  Genbank Accession No. AA945579
gatagtaacaaggggtcaccaccatggcggcatcagcacccacctgagccatgctgacagtcatctctactgtggcttgcgtggactcgcagccagagccggctatcaggagcttgtccttgggtatggcctggcgcactcggctcaccacctctaggcgctcaaggctggtcaggaatggaaactctccagtagagccctggaccacgaagcctcgaaaggggaaggcggccagtttgttcaggttctcttccagtttcccatagtctacttctgcggtggcggtgaatggggtggtcacgggtgggtagatgccggcaatgtctatcttcttccccttcacgttcctagacaagcccctgctcagcccctgcctcatggaggcccagatttgggggcccagcatttctgcacgaggtctgaggcccagtcgtctgtggccacaggagaactgaatttggacttttttctccccccactgttaatgatctacatacccagttaaaattttgtgttcccacca

SEQ ID NO: 999 - DNA, 557 bp, Rattus norvegicus
  Genbank Accession No. AA945580
aaaattaaataaatgttttaatgttaggaaggaaagagacacgagctgttcgagctgttcggggtaatgctctgaattgcccttgtttgtggtgacacctcacaggaggggttctttgatcctagccacagttcgttcacagggccttgaggcttcatcatgacccagtctgtttcaacttcaggaacactgactcagacagttgtcaccttggggagagcacacagcatctcaaacagtaggttagccgcgaggagggctgtgtttccagagagatcatacggcggggaaacttccacaaggtcacagcccaccacattcaggccttgacagccccggatgatctccagagcctgactaggggtgagcccagcaatttctggtgtccctgtccctggggcataggcaggatccaaggcatctatggcaaagctgatgtaaagaggcacaccccccatctgctgcctgatctctgccatcagggggaccaatgacttcatccaacagtcttcagccaggaccacacggaagccctggctccgactgtatctgtaggg

SEQ ID NO: 1000 - DNA, 584 bp, Rattus norvegicus
  Genbank Accession No. AA945587
cacaaaaaatcaaaacatttattttgttttcttgcacacaacacttaaaacattcccattacagcaatcctgctctctgggagcttacagtctctgaaacagtcaacgtgaatgtagacccagggattaaggcattacatcaaatgcagacctgtcgtctaatgcatcttctcaagtggctggaaagggcaggctcaagattacatgacatgatgtacccttgcctcgctctcctgactcctgcaagggagtgtgggacaaccccaccacagaccgtgaagaaattggatggatgttgaggacggtgcacatgtcggcaatggtgctggctgttcttccatcctgactcaggcagcacctacgacctgtaactctggggacgctaatcctacccagctctatagaaagaaatcccagtggagcaaacttaggacctctactgctgtgtaaataccacattctaattattaggtaattctaaccaccacaagcagtgctactgcatcaggaaggtgagagatgttaaacactaaactacctgcggaaaaagacacaatgggaaaagggaaaagaaactcaggtaa

SEQ ID NO: 1001 - DNA, 619 bp, Rattus norvegicus
  Genbank Accession No. AA945604
caccgaacaactcaaattttattctgtcttgattggtgtacattaggagcgggcagctggaaactagtgttggggcagaactcctctggactaacgggtcgtgggagacatggctggctttggcacacagactggataaaccatacactggctggaagatggcaggcaagacgataaaaaaagcacagacctaccaccacacagaaactatgtctgaattctgtagcgtgttagggagtaacatgcaaccccacctaggccacactgtgagactaaagcctatcttatttccccttcttagagacgtagagatgtggccttagtattcgggtcctaatagcgttccagagcaattaacacacggcagagagagaactgccaccgattcttacagcagcccaccggttaaagacataacgctaaatgacacattgcatctagctcatctcttcactagaccaacccacacggacccgttcattctaacccaacctatatacttagttcaacggaactcatgtctttacgatgttaagaagccttcttgttagtcttcccgtctccgtgagacaagggaacttgggtaaagacatctttccctttcatcacgctgatgagg

SEQ ID NO: 1002 - DNA, 530 bp, Rattus norvegicus
  Genbank Accession No. AA945613
caacatacagttctttattataataaaatattgaaaatctttcggagaagggtaaaccaatcttagtgatgttctacatttttcatatagttaaaaaaatcttagtagccacaaaccaaaataatgccaagtagctctcattttgccgatgttttacttccaaactccttattttaattttatgtgcattggtgttctgccgacatgtctatctgtgtggggtgtcaaaccacctagagctggatacagaccgttgtgagctgctgtgagggtactgggaattgaacctgggtcctctagtggagcagccagtgctcttgaccacagaggtatctctccagtccctatttccaaactccgagtggcttccctaacgatgacatttagggataacagaagtaggtgagtaacctttgtgagtagcccgttcagttgatttttgtctgagatcctccaccgtttgtatggtcgtcaaatcctttaactctgagcttctaagtaaagtggcagtattggcatcaaggtgtgtt

SEQ ID NO: 1003 - DNA, 625 bp, Rattus norvegicus
  Genbank Accession No. AA945615
aatcaaacatgattaattttaatgtaattactaaagaaagatataccattttattatgacactctagccatacatttttcaaaatatgcttactaaacagtaaatgtaagataatgattcagttagtaacactttcacgagtcattaggactgatattgctctgccataaatgaattgaataaccacttcgaatacaatcaggattaatttgatagatttcctttgtgtctgtgtgtgggtgggtatataagacacatacaatgaatgaccaaatactactttaaggtttcagtagagaaatgaattcgatgtctgtaagttaatcatcacccttggcctttaagtgtgataaaaataaatgaagcaaaatgcatgttataatccaaattctcatagctccctaaatcttcaccaaaaacagatcaggtctgatgtaccatttggagctttcaaatagactgaatacacacggcacgatgtttggaaggactaatgatacagagacacagataggagataagaatggacagattgaggtttcctgagcctcctgcagagtgtttagcagtaggtacaatgtaaatatccaaatgaaatgagattaggggatagatcaacaggagc

SEQ ID NO: 1004 - DNA, 450 bp, Rattus norvegicus
  Genbank Accession No. AA945679
ctccggggtcccccgggaggcgacagcctggggctctccgggcgggggatccaaatctgctgcggggtggcggcgggcctcgctggcccgagccggcactgctggagagggatagcgggcgggcgggcccgtcggcgtgagtgtgaaccggtatgcgctgggggtggggtatgcacagtggagcggtgtgcagaatcggagttgcgagccaaaggcctttgcagcggcgaccccgggcgagccgactcagcgcgggccgcctcccgcgcacgctcaccgcagagttcgtactgggaaagagttaaaaaataaacatttacaacggcaaagaaagcggcttcccctccctggcgtccccggacgcgctccggggtcacggctgatccgcagccgggctacagtcccagagagtgaggggagctgatcccggtagtctgggcgcctgggggc

SEQ ID NO: 1005 - DNA, 676 bp, Rattus norvegicus
  Genbank Accession No. AA945699
ggccgcctccaatttttttttatttttttttttttttagtttataaaacaggatttattaattcccatttacagatatagaaattaaggcaagaaataagcatgcattcacaccagccagcaagagcaaagggttgctttagtgcatattctagccaaatataccttggatactaccttttggtactgttcctttggacaaatcagcatgttgtttttaaatgactaagggaagcacttttgggcacagcacagtccagtgttttacactcagccatacttcatacattaggtatctgtacccaataagctcttcactctggcatggaacactgctttgttttgcacactgtcctcttcaccctctgaatgttgctatgctagatgcatcttcttcaatacatgacttgaattctcactcagaaatactcagtagtgtatttaagttcaaacgactaagacaagtaatgtctagaatgaactcaaagcaaaccgtaggaagtcctgtacacacttctggtgaaaattagagaagagctaatgcaactttctattggagtgcatgacgtatggacatttgctttatccaatgttaacaaaagctggtaaaatgattgcccccacgaataagtcatagaaacatcacccatttgaagaacaataccattaattacaaa

SEQ ID NO: 1006 - DNA, 520 bp, Rattus norvegicus
  Genbank Accession No. AA945704
caggtttagcatcagtctttaatgctgtcacactgcataatgacaagtcacacactttggtcttgtgttggtagtggcaacttacaatgagtcgaatggtcagagcaccaggctagctccaaagaacagatccattccctccccaggtctgactcatcacagccctggacaggcagtagttgacagggactgctttcatccaagtgcacaccagctttgcatggaattataaaaacatatttacatacgttccacggtgctcctttcatcagaagcaaaggcccttttatcaaaagggattatatctagggctgtgcaaaattcaaaaggactgtatccttttgagaaagttgagtccattacacacacacatacacacacacaaaaaaagtcacctgcacctctgagaagtgccaggtgtggccaagggctacctctggaccagcaagtactgtgactgtaaggcagccatctgatttcaagagagccacaggtccaggggatctcctggctgtccagg

SEQ ID NO: 1007 - DNA, 626 bp, Rattus norvegicus
  Genbank Accession No. AA945724
aggcagcaacactggccttggcaaaacaaaaacaacaaaatctttttcttttgtgtgttttatcctttcagagtgcataacatttacaaaaatacacacacaccagcagcagtcgttgctaagggctattaattctgtacctaggcaaacattctgccaccaaataaatgctaacgaatatgatgcgaaagacccaatcaatattatactgcttaacacaaatcggcttatccttcaaatgaagaagttacatacctgtttcaaaatatagaaacataccgacgaaaataatgtctatacataagactaactttttgcagttttattcacaattctatatcttggtggatagggaaggtggaggcaggtgggggaagggccctccagactgaagaggaggtggtctagggcaaaggaggtcgctgccctgcgcggttcaagggtctctctcttttttcactttaacatccccagctaagatagttgcgatttcgccctgcatgaaggcccaaggtacattagacccgactagggggcatttctctccgctggggcaatacacctcacctgtggccccctgggctttgatactctctctaaaacaagggaaacaaaatttgtggcta

SEQ ID NO: 1008 - DNA, 592 bp, Rattus norvegicus
  Genbank Accession No. AA945727
ggagaactggagacattttaatgcaagaaaaagaactgcgagtagtaggagtcctgtctccctagacccagcctgcctggggcgtgtgctttgcgcttcctctagggctaggagccactatggctgttggaggcctgtaggtcgtcaccagtccctgtcccgtggggtttacattcaaatgctgctcggagagccttgggccccaggctctgtgactgctcctctcggttcacatcagcagagtctgaccttccaccaggtggcttctggcaactttgttgccagaggctcaggagccctgcgtgcctgtgtcctgctggtcagactcagacatgctcacagctggtcctcgtccacccagatggtcttgcgctgttcctccacaatcttgtctttgaggacgcgcagcagctcctccacgctgctccacatttcagcttccaccgtggcgtagaggcagggcagagcctccagctccttctctttgagcctgcacacacgcaggaattcctcttctgtctctggccttggtagcagcttcctgaaccgtttgatgttcttctcgctcaaccggatgagcagcactatgggg

SEQ ID NO: 1009 - DNA, 557 bp, Rattus norvegicus
  Genbank Accession No. AA945739
actaaaatccttttatttccagaacacaggtcatgccaggaagccaggccagtacgactcagcagggggcaggggtctttctctggaggcacagccatttggtgggcacttcacaggaggatctcggcaccaggtcttcatcataaggaatgtgccaggtgtctccagtcgtctgcaccacagtgtcatagctgagaatatgctggaaggttagttttgatttcagaaaccctttcgtgattgccagctgatggccctgctgccacttaaagaacaggcgctgagcccgggcatcaggcaggcaggccttgtggtccgcaacaggtctttggtgataaacttgcagtgactgcctgagttcagtgtggcatacagaaggaaaggatcgtcctccgagatgttatcagcaaaaaaacagtgggcttgcttccgcacctgctccatctcgtcctttctccactgggaactgggcctcagcatgtgcttccggcccaggaccagcagctgtagattctgctgggccagttgagaaactatacccaggagattttgagatt

SEQ ID NO: 1010 - DNA, 591 bp, Rattus norvegicus
  Genbank Accession No. AA945746
aagtactccaaaggtttgttttattggcatttgaaccaaagtcctgcccatggacaaaggcaaaaccctgaacagaggtgggaaatcagcatcttactctcctgatacagcctctgagaatccactcagacactcccacttcaccagtggtcagagaaagggaggtgacttaaggccggatgtgctgccttcacggggtctgctgatcctgagctggagggcaaggagtctttgggtcccaccttttagttccacaagaaaacaaggacagaagtagagaacaagacgctatggcctgcatctagctaggtctttattgctgtgtctctcgatttgtaggccactcctcgacttttcagctcccgcacaattccttggggcagacgaccagtgactgacacagcatatacacctggcttaaagttactgacgcgctgccacttggagacccagctgtcctctggactcatcatcgcgatgattccatcaaatgaagagctggtgcagtcgtacaccatctctctgttgcccttcatttgtaggtatgcatcgcaattgtcacacccatcatattcaaactggcctcgtgcc

SEQ ID NO: 1011 - DNA, 636 bp, Rattus norvegicus
  Genbank Accession No. AA945753
aaaaaatatttattgagcatgtactatgccccacatataatttacccataagacgttacacgcggctacccatgcagagcccactgcgcacgctgccacctccagtccttgccccgagacacgggtgctcggccatctctcataccggagcacggctcggcaagccacagtccacaggtgcagcagctggtcgagggcatcaaggacaccactgacacaaggtgtggacatcacagtcacaggtacacaggctgaaatgtgtgtctgagggatctacaactactcccggctgggaacacggctggcagcgacgggcaccacaggatgaacacctatatatatacacagcctacgggagaaatgacactgggggttggggggtgagctgtgaggggcccgatgtcacctgctgggtgggaaggggtcagcatgggacgggtgagtgtgtacgtcacagaaggtggccagacgcatcttcttccaccaagatgcacaccacggccgtgactcccacgcggtgcttaaccgtcacctccagatcggaaagactttctctccagccctttgagacgtgggatcaactgcggaagtgacgacccagctcagacagacggacatgtgccttctccacaccgg

SEQ ID NO: 1012 - DNA, 568 bp, Rattus norvegicus
  Genbank Accession No. AA945762
attttgaagaggcccagaacacgtttattcagatggtgtgcacgccctggggatcggaacacctgctgaaatggaacacactcgtaaagacacatcttgtggggactgtataggtaggtgttctactcccccccgtgcaagtgtgcagaggattgattccctcctcctcaagagactttcataggaccaaaaaggccagattttagcaagagaagatgttattaacacacgcccaagggctttgaaggaacaaaattataatcacatatatcaaagtgacacaaaatgaactgattgcacaaaaacacaaatggaagagcatcctgggacctcctataaggcagaaagaccttaggagcactacttgaattggggtaaataaatactttggtacaagtttcgccctaaaagacaacatgttgctttggggttctacagaaggaaaggggccatacgcatccctctgcgccaacacaaggctttggcacgacctgcagaagcctggcaggcaggctctcctgtgtgccccctgcttcatctcgactgcacgctgccgttcaaaggcgtt

SEQ ID NO: 1013 - DNA, 427 bp, Rattus norvegicus
  Genbank Accession No. AA945765
aaaattttaaattatttattaaaataagcacaagttatgagagaatttgggtggtcgtggttgactaacgtatgtcacatgtgcaaatctgttttatgtgaccccacagcttatctgacagtggctgtgccttcatgtctgggggcagtgggcacagcatttctcagagcagggcagcagggcttcatctcggacacagcagtctgactgccctgggtttgtgcctctctccacaaaagacctgggagaaggcagtggcagacaaagatgcgaaggcaccggtctttaaagttggagacagtggggaggaggattaaaacccaagtgcatgggcatctgcctggggaagtccatgggctcacagtgcgagtttgaagttctatggttgctggaagaacatggttaaaaataaagcaaacgcattttt

SEQ ID NO: 1014 - DNA, 438 bp, Rattus norvegicus
  Genbank Accession No. AA945784
ccagtttcaaagcaatttaatcttatttacacagttaaggaacgggtgatacattttcatgagttagaaactgatctttctgtaataaaatagattttaactcagtgtcattatcactgctgaggaaatcgtagcccttgtctgccttcaacagcattcactggagttattgctatgtactctcccttctgttaactcactgtcacttagatggtcctgttttccactcagtagtctacagagctttgaggttactatgacctatggaagagaaattagaaacatttttgttctgattctgataactgggggctggagcacaagtttgggtaagttatttaagatgtaattcaatttattcgtataacaataacctaagcaacaggctccatcactactaataaatagtcctaggtacttaattgggtcttagcatct

SEQ ID NO: 1015 - DNA, 323 bp, Rattus norvegicus
  Genbank Accession No. AA945818
aaaagaactcaaattcaaattttaattacaaaaaatatttctgggaagctattaatactacaaaagcaagggattagaggcctaactggagcaagaccctggtgtctgcagagacacatggcggggctgtgaccttaaggtctgaaatccagagtggattgggcagtggtcacccagccccataacctctgcattgctcattccagtaggaaagggagggcagggaagcagggagaactgtagcaaagtcgggttcagctgtggctcccgcacctgcctgccaattaaagaataaaggcaagaagttgaaacaggcggcaccc

SEQ ID NO: 1016 - DNA, 567 bp, Rattus norvegicus
  Genbank Accession No. AA945866
tatttatgaacttttattcaaatagattttcacacatcttatctacgacagaaacctgggtgattcagactttgtggatcgggagtggctgaggcctgacacatccgttgtggccaaagtacggaaaaaaaaaaatctctcaggataaaaaaaaatatccttttacgtatttacttagttttggaacacatttgaaagccgttgtcagctgaattcattatttcttttagaatttccaagttgctctttatttactttttttttttttttccattttgtttttgcaccaagaaaggggaatggagtcaaataatacccggcaactgatttcctctctttggactgaaaaattaaacagatactaaattatgacagtgaatttgggaaggagggctccgagggctggagagacacgtctagggtaatatgatgctgctaggcgcacggcaatcatatcgtggcaatcaccggagcgtgccgtgtaactacctcctcggctaatatgccttcttcccggtgatgactaatcacgttctattaaacagcggtaatgctggaggaactcga

SEQ ID NO: 1017 - DNA, 518 bp, Rattus norvegicus
  Genbank Accession No. AA945883
cacggtgccagggtttattgccgcttagggatgagtgagctcagaccccctcttccacctcagaccccagagcccctccagcaggcagccaccttgtctgatacagctccctggtagctggtcttgcgtgggcagttccatctgcccttgtgaacatgaggtgactgacacagagctcactttatgtgacagagggcgcacaggcttgctgtggggagccctacagccacaggctctcacggaggatgagaccaaaggagccaacaggctcctcaggaccaaaccctcgcctggcaccctcctcaggtgaatcttaattgccctgtccccctctttgatgctggtctcaccaagtggcaggcagaggggaggaccagaggcattgagagccacaaagggttcttgtgggcctcatggagcatacctgcctaaggttttcatggtcagttgtgcagattctgctccaggtggagggacataaggggttggggatgcaattgccttccagcaagaggctc

SEQ ID NO: 1018 - DNA, 585 bp, Rattus norvegicus
  Genbank Accession No. AA945887
ggagtaaatacatttattgatacccattttacatatagttcaatgaaataatctataaatataaaagcatttttcctttggctatcaccgtggtccaagtaaatactcaacagtcagtcatctgcaggaagtgctccaagtctcactgctgggtaacagacctgagtacatccctcaccagcggcactgacgcactcaaggggcccagtggctttggaatgtgactactgggcatgtgtagtaaagaaaatgtgaaagcctaaatcaacggggaaagggtatcagccatgaacaacaggaacagttatgaattcatacctcagcaaagcaaagtaccacagctgacacttggtgtcagaagactgcagagcacgctgtaccaccacaggcctcctccaacccccagaggacagacagtctgccagagcctcagggtcatctgtggtcaaaaacaattcttaaagagcctacacagcatagagtgacagccatggcaccaggactaaagaaaagtgagcgaagtacttcagtgacataatgagtttgccccctcactgtggggactctggggaaagcccttctgtc

SEQ ID NO: 1019 - DNA, 598 bp, Rattus norvegicus
  Genbank Accession No. AA945898
ggggattaaaaagagttttaaatacaatagtatgaaaatataacttaaaaatataaaagtcagacagcatagggaagacttaaaaatctgtttgcccgttagacccataggtactttgtaggaaactaacacgtactcaaaaaacagtaacactgtcgcagcctgtgagacaggcttcagaaggaaagagttacaaaagccggtttttgagttaagaaaccattcctgttccaacctgggtcaaccagcgactgttaaccccaagcacgtcgcgtgtccacaaggcctgcagcctcggcaggagaacccaccacagttctgtgtgtgctctgttttcttccaccatgccacccggtcagacataggacagggggtctcacgaccccccaaagggacgacaacgaacgaacaaagctcttcgcttgcatatttggtcagtgtttgtagtgcaactgagcgggaactccagctgcccacagcccctcaggcaccggtcctcttccctcttctcagtcacagtagtctggggcgggcggagagcatgcagagacagcaggaggagtggaggtagaagaggaaggcagaggggaggggaagc

SEQ ID NO: 1020 - DNA, 441 bp, Rattus norvegicus
  Genbank Accession No. AA945932
agaaatgagagacagaatagccagagccttttggaacttccaagatgttcaaaatggctacatctctggggcagagaggagaggggcaggctgtcaagagccagggctactgctcttgggagcagagagaagagcaggagtaggaaaaccttatgggtcatacaggaaaacagtagttgtaggagggaaagggaatcctctgagctggagcagcctggaatgaactggggaagtctggaggttagcatgcaccagagatacttgttaacaggcagcctgatgcctcatctaccagaggaaggagagatagggaagtggctttcctgtcagacagacagaaatctgttccacaggttcctgaggaatagtggatgtatctgccagcagtccttctgtttttcctccagaatccacccctgctgaagtcaaatatagacagca

SEQ ID NO: 1021 - DNA, 484 bp, Rattus norvegicus
  Genbank Accession No. AA945962
  misc_feature (1)..(484): n = a or c or g or t
caagggagactttaattagcatttaacagaattcatttccgttcaatcaacagagtttctaatggccccatttgacatcagttgtttcagcaagttaatagcacagacatgtaggaaatctgactggaaacaagcaaccctttccatatgttgaaatctgaattaacataataaattaaacataaatgactaagttctcagcaacaattcattatttctgcatcaatagtaaaatagaaaatacttcccaacttaaaaccacaggtctaaaaattgattaggcatttgactcttaaggccaacgttacatagtgaaatatgtcattatgttaaaacacttcacacagcaagtaagtttcaatgaatataaaaacaagccctgtgtggtggtacacacctttaactcccagcacctggaaggctcanaggcaggtggatctctgttagttcgaagccagcctggtctacatagtgagttccagga

SEQ ID NO: 1022 - DNA, 537 bp, Rattus norvegicus
  Genbank Accession No. AA946017
agacaagctggaacttttatttacactaaaagcaaagaagggatacagaggaagggtttggaagccataatggggaagccaagctcttaaactcagttgcagtggggtgtgggccctgctgccggacgcaagagaataaccagaaaaagcgataaggaacagtctgcagcaggaaccgagttttcgtgctggaagaaccaggctcacagaaccaagagtcccacacaggggatgtgaccagagcatgctccaggggctgaagtccacctcaaacctgggaaagtcccagggcagcccctgagagcttttgactttggacattttgcattaattcttagccagactttgagagacaccaggccagacgaactttgctttgttgcctttatgatttgggacgaagagacttggacggaaggaagcatcattgactgtccatcccttccctgggtgcaacacctctccctgactgacagaatgttattgggctccttggggctccgctgtgggctccctggggttcactggcattgggtg

SEQ ID NO: 1023 - DNA, 423 bp, Rattus norvegicus
  Genbank Accession No. AA946022
aatgcaaagacactagtcctttaatatatactgtactcctgaaaacatttgagttacttacctttgggggcagaagtccttccaataaattatcacactgttagtagtagattttgtgtaccctagaagtcatgtcattggtataggctggtcccatcaaataaagagacttccactctgcaacgtggtgccagggtaggaagaaacgggaaggaatagaccagccattgtcttcagacttacgaggcagtctgtgaggaagtataatccacagtaatggtcagtagtgaccttgaggaaggaatagaccagccattgtcttcagacttacgatgcaatctatgacgaagtataatccacagtgatggtcagtagtgaccttgaggcttgggttgctttctccaaatattgggttagggcttg

SEQ ID NO: 1024 - DNA, 629 bp, Rattus norvegicus
  Genbank Accession No. AA946046
gagaaagtagtaaagatttttatttgtcaatacaagataacacaaataaattaatttttacaacaatcttagactccagggtttctctatgaggttagctcattatgtaaacagactactatctaaaatgatcgagcaattatatgagtgttcaaaaccaacagaccatatccttccccctttcctcggtaatgtgtgttacagaacagatgaggttaacttggtggaaaatggtctcagtgttatcagactacagtggcaccaagttcatgtgaacctgtacctgtcatcttcttctctaacagagctgaagtggttgtcacacctgcaatcccagcactgggaggcagagatgggtacatcttctgactgagtttcaggctagccacggctacaaagtgagacatctcaaacaaaacacacaattaaaacagcataatatccaggaactaggggtgacacgcagtggtagagcacttgcctagcatgagccctgtctgggttaatcttcagtgatggaattggagtgggaaccatttgccagtatgaaaccaacatactgaattagaggttaaagtgcgaaagagaagaggctgcactcaaagcaagcagacctgtggatctctgta

SEQ ID NO: 1025 - DNA, 281 bp, Rattus norvegicus
  Genbank Accession No. AA946092
cacggcttcctggaatagttttatttggagaacaaaagctgtattttagaaaacagttcacccctaggccgaatgaaacagttcatttcattagggtactgtgtacaaagtagttaattatacacataaataagataaaaacagctgtcataaattaaaacgtccacgaattcccagcgtgtcatctgccaagaggtgggactggcctgtgtgggtgtggagagggtgtggccaggtgaccgtagacctgcagacctgtcctccagtgtcaccctcgtgcc

SEQ ID NO: 1026 - DNA, 456 bp, Rattus norvegicus
  Genbank Accession No. AA946166
atgaagaatatgtgtttatgagtagccttctaagaacaaccttcccaaagctccaacccttggagtttaaggcttgaaaatatatatacatcgaggtcatataaacgtgtctttttttatctgacttctgtaaggttcaaaacagtgacttgtataaatatatacttagctatgtgcaatatttacaaccgaaaaaaacacattgagcctgtaacaatgagaaaacttggcaatctgtggttagagtttcaaaaatgtcagaaacagttttacctcaaacattttataataaatagcaccgcacgcagtaccatccccaaagtattactgctcactggcttactttatcccaacaagggtatccgacgacagaggaaccaagaacttggacacagcacttcttagggggcagcggagacctatggaatgcttgggtcttcaaaaccttacagcaaa

SEQ ID NO: 1027 - DNA, 416 bp, Rattus norvegicus
  Genbank Accession No. AA946167
  misc_feature (1)..(416): n = a or c or g or t
gatcaataaacaaaagtatttattcagcacccatgtgccaagcacagtgctaggcactgtggtggatacaaaaattaagacatagtccctgcccttaaggagcttacattctcatgagggaaacaaaactaacatacatgtagcagctaagaacagtacaagacaatatatgatttggtataagaattttagtacagatttgaagcttcgtaaggatttaaagaagacagtgaagtagaccttagttttaagattttagtgtcagggtcttgaaagactgaagaaacttaaattgacgtccctgctanggagaagtangagaagggctcagagaaagacacaaaatatgcatttgataagggctaagaaatgactgcagacttcggagcaaagtggctcaacgatacaagcaaggt

SEQ ID NO: 1028 - DNA, 465 bp, Rattus norvegicus
  Genbank Accession No. AA946189
  misc_feature (1)..(465): n = a or c or g or t
accacaagtgacttttatttgtgacgctcccaggcgcagcccagacacagacacaacaggaagcaggaggtggccaagcagccactttggaagtcacagggcatctcccacccagctcaatccctgctacacactctgtctcagaaaacgctcaaagagtaggcccagcatgtggttcaggcatgaggggacctgcccttccctccccaggatgaagaacagggctgggccagccaaggtgcttcttccactgggtccaagagccagggtaccccaggctattccactcctgggctctttggggttggcccccggctgctcctccaagccacacagttaaggccagagtttcactttctaatgcagcccatctctgacagtctctgttccctangcacggtggacacagcaagacacagcacacagactaattccccagtgtttggtgggacacgaaggcaggac

SEQ ID NO: 1029 - DNA, 490 bp, Rattus norvegicus
  Genbank Accession No. AA946264
gtaaattttactattttatttgtgaaaaaactacaagcagaattcataaatagacatttctatttaaagcaggaaaatgataaagtggcttctaataacatagtcgtgcacatgccaataacaggaatatattaacagcttttatttgctagacaaagagcagtgtccaatataaatttcccccaaaacatttaagacctgtgaatttctgaccagttcacaagaccaccgacactttagcatgaagagaaaacaaacctaacagactgtcagctctaagacggacggagcagaaacttccaaagcgttatacaagccatctttctgggcaaatggaagatacagctcgtataagagattaacaaaagttcacaagggaagattatgttctgacatacttaacaggcattcgctatctgtctccaacatacagagctaagggaataatgtaaccatctttacacagtaaattaggttacaagtcatacac

SEQ ID NO: 1030 - DNA, 491 bp, Rattus norvegicus
  Genbank Accession No. AA946300
cctgttaaaaattatttattaaaaggaagtttctaaaagtcattgcatgaagaatagtagcattatatcaccaaataaaagcaaggagtggaattcaattgccagcttgatggggatgttccacgggactgagttaattaaatgtcttctgctgaaccaagtgtgatagtacagtgtaactaaatatagaagaaaagattctttcttctaaaagtagaggaattacaagaaacacatgcccacatcgagggcagaaatcctgagtcctgattcatccaatcacagttctgagttccataatgccaaagtgtgtagtaggagagagtatttcagaaaggaagtggagaggccttggtgtagacattttaactacttctagccatgacagaacgtgggcagaaatttgctgtcccctttattccacacccctactcttaattaaatggcacataagcagaaagtttctgttgtcacttgaacttcaaaagcca

SEQ ID NO: 1031 - DNA, 476 bp, Rattus norvegicus
  Genbank Accession No. AA946323
gtggaggcaaagcaatactttattacatcctatatggcacagcttgaatccacagctggatctaaagaacttgtctagcaaactgcagtatttataacaaatttaactacttattttactgtataaataaaaatatcctcagtgaaaactacaataattggagtagaaacaataatcagtactacagagctgtgtgggtgaagcgcatttcaacttgaattgtgtcagtgcaggttcagtggcaggcgttcgcagcagcttcctgatttgtagtgtggagtaagagctttttaaagtcttgccagagccacaagtacatgctctatgtactgctcttgacaaatagtaggcttcctgtgaagttttagttaaatagaattatttaccagaagaaaccatggttgatgaacaatgagctattacgagatatttaagagttatctagacattaaatgcattttcacagttttacatgt

SEQ ID NO: 1032 - DNA, 532 bp, Rattus norvegicus
  Genbank Accession No. AA946361
acaagttagaatcaagaaagaaaagacagtctgggggccaaccggagaggtgactaaaatccccaggccccaaatggagtggaagtaaagggaagagtagaaaaaaaagtcaatgtaaaaaaacaaaaagagctccctcttcttccctccccatggaggctggagggcggaccacggcgctacacccccagccttaccacctagcttaaataaattaaaacctcaaaacagggcccttagaagtgaacaggacagctgcagctcagggggcttggtgccaggcatatgcccacacccacccatacccttgccccacccccatcatcctcaacagggacatcacacccaacagggctaggaattcaatcttattttgtctgtgtccctgcattcctccccactgcagagccagctctcctatggaggggtgagatgaagaagcgtcacagcaagggaaaagtggggaagggtggtacaggggtccggtcctgcggagccttcctgccccatctggcctggcccttagcccgag

SEQ ID NO: 1033 - DNA, 615 bp, Rattus norvegicus
  Genbank Accession No. AA946391
agcttgcggttgcttccagtgtttttttttttttttttttttttttttcctctgtacactgcttttattatttacataatacaatatagcatcaatgctgaataccatgattatgtgcaatacataaatatgaactatctgtacacatctgcaaatctaacttagaactaaagtacataaaattgaagcaaaactgaatgttttaataaagaaaaactaggactgaacactgcaataaatcataagtagtgccttgtgtacatacttaactatttacagatgaaaacaggcattaccacaacactaatctaactatactcatttatatataaaaaacacaagtttcatacatcacaaaaaaccttccattataacacagaagtgatattaccagacaagcatcagtgaagtatactgccttttctagttgttattgtacaatgctgtacataatgcagcccatgcaatacacccaagaacactagagtcctacacccaaatacaatatgataaagcagccctctgcaagtggtgctggataccactaaagaagtctactgcagccatgttggttatgattttccatgcacaagggtacagttacattaagaactg

SEQ ID NO: 1034 - DNA, 625 bp, Rattus norvegicus
  Genbank Accession No. AA946408
cttgcggccgcatccagtttttttttttgtttttttttttttaaaaggaacaaacacatttaattccctaacagtggggggctcagtaaacactgactacaggaaagataacacaaggtgatttttaagaccacatttacaagctcacataaatattttgagcaacaaatatatctatcctccctttctgattgctcaacataatttgtcgtaggttctagtagataaactacactaaatacctaagagaaaaatgaattttaaaaacatgaaaaagtgaacagccagatgtgacaccaacagcaatgtttttttaaagttgagccattgatttgcaactgttattagaatcaacttcgctcataaaaagcgaaatttgtaatttgatcgtgatttgcttgaataacagctgaacttttacattaaagaattacaaaccctcaactaagggacaagtagaacactcagacttgagcttacactttcacaagggacaatgacgtcatatcagttcacattagtaccatggtccagaacacactttccccttcagttccagcctgccgctgggggctcctagtgggagttggcataaagtccgttcttgatgaagacaacactagac

SEQ ID NO: 1035 - DNA, 612 bp, Rattus norvegicus
  Genbank Accession No. AA946411
cgcttccagtttttttctttttttttttttttttcattttccttttctttcctctgacaaggttggacatctaatctatatgtccctccagtctacgtatatacacacagctagaataaaataaatttaaatattatgaagaaaacacagagatacttggaataaatgtatacttcaaaccctgactagaataacaatgaggagatagtaatcataattacagtggcaataatacaagtaatcatacaacactaactttatgagcagcaagggacactcattcctgacctggaagagaaggggaaggacctgtggaagaatgagaagcttcaacgtgagcagacaagagatgacagacaaggacggccctcccagctctagagagtgctgcagcacagcagggcaagtctaggcccaccctcagttgagagagagccagtcctgtgggaaatgctgccatctagccgctggaagcttctgtgacagccaaatttccatgctgctggggctctagcagcctctggctcacaggctccaaaagctccttatcccgctcccaactgtcttggacagttttccagctatctcacttccagccagagctggttctga

SEQ ID NO: 1036 - DNA, 329 bp, Rattus norvegicus
  Genbank Accession No. AA946413
gttttttttttttttttttttttttttttttaatatttgaaactcacttttattctcattttctcttgagggaggtggaacaggaaaagttcaacataaattctcttcccctgaaatgaagaaaggaggtgatatacaggagagcgatggagtgggaaagtgagaagtgggagcagatagcttagcttcagaaaggaaagagcaccatgttatttaactgcgaactccaaagcccaacaaagcatgccaaggctctgcatttacaaagcccaactcataccgacttcaaaactgctataaatgtggagcattgtggaaatcaaacacag

SEQ ID NO: 1037 - DNA, 570 bp, Rattus norvegicus
  Genbank Accession No. AA946417
gtttgcagaacatttattaccattaattggtgatgtgataagacagtgttcaggtggcttgaaagttgttcacaatcacagcaaagcttactccagcctagcatattacaagggaacatagaaatcagggacatgtgttcaggtatgtgtcaggatgtataaaagtgatgccaggaatttatacagcttcaaaacatatagggccaaccaatgccactttgcttcagtcaactctcactttgctatacgaaaggtatcttttaagctgtcataagacttccgacgactaggcagtgcaatggaaggataaggagctgctgtcaagtctgcagcacttctaactggaaggaagcaatacggaagcaaaataaatttggctttaacaagcaccctagaaggaacatcatgctttagataatgactttatgtaatactctgtgaggaaagcaacacactattatgaagaatacctggtaattaaccatcctattttacttggggcatcagaatcaactacatgattatgaccacgaaaacttcacctcagggaatcaaatgttacttggcctt

SEQ ID NO: 1038 - DNA, 532 bp, Rattus norvegicus
  Genbank Accession No. AA946421
tgcggtcgcttccagttttttttttttttttttttttttaaatgatttcatctttttattctgtgacctaccatggaacagtgtgtaacaaaagaacagcgattagattagcacagagtgtatcagactagtgtccaggaaacagcaactgtccctttggccagctccactttctcagcagatctcctaaattcacccacccatccagggacaccggtgcctagagtccacaaggacacagtatgccaaccatgacttctgactgatttaaattgcacaaagatagagctttaaacgtggtaatttttaaatttagacttatcttgaaaactctaagtaaaactacaaaagggagtgcatagcgagctagcattgcgtgggacacttagaaagcggggcgtgtatctccctccgtacagaccaaggggatccacacacatgaaatgcattttacggcgtgctacatcattcacttaagtacattgttttggcatttaaacaaatatcaaattaagctttaagccctcgtgcc

SEQ ID NO: 1039 - DNA, 594 bp, Rattus norvegicus
  Genbank Accession No. AA946428
  misc_feature (1)..(594): n = a or c or g or t
agatgtctggacagcaaagtctttattggtaggtagtttatgaacagcttacgcttatttcatttacaaatgaaatttgggaataattaaaaaaataagttaaagactccaatctacatacacacatccattaactattttctcctaggtcttagactagaacacaaagcaataagagctgtaaccttactttgaatagtgaggaggatcataatcataacttggcctttatctgggtttaccacgaaagcagttagcaaacagtgccgcacagttatgttttagtcaaaaatgaggttcagacacaatatggtcccatacggtcctatctctttgtgacatcataagcaccttatattttttaatatttgttcaatggaactccccggggtcatacttctcaaaatccatcccaacaagtggtgcatggctgcaaatgatgatgcttggagaggaatttagctgtctactcagtctgcaaatcacaatgtggtggccttagtagttctaatgacttacgtgccaggaaagggtcccccttccccatttgcttaaaaagatctagctgtgccagtgccanaagttacttacttt

SEQ ID NO: 1040 - DNA, 652 bp, Rattus norvegicus
  Genbank Accession No. AA946434
gcaatgaagtgtttattaaatggttaaatagagtgcaaataaactttcaagttgtcaatgcaatttacataaccttatggttttttcatataatttaaaatatatagaaaagtataaaagttgtacccaaaagcccacaaaccagtacccaaaatagctagttattaacatttttttttgccacttccccagcagagccaatgaatttaaatgtagctcgttacctttggattagagagttcattagaatcagtgttaagcctaaagctcacgagaacactcagaaccaagagaggtgaaaaattctacagtgtagtcagggccaactttgaacttgtgatcctcctgcctctgcccccagagtgccggaactataggaaggtaccagcacaatcaacctagactgctttttaaagaaagatcactttcttggtctttaaataaaaagagttattgacaaaccatatgaaaaagggaatccttcatggagatggtaatcaaatacaacattcaggcccctcctctgtctacccataatcaatatggctgccatcaagcaatatctattgtagtatctgagttcccatctcctctggcaatcgtaggcacgcacttcaccttcagtgggtagaattcgtggtgctatgaaagg

SEQ ID NO: 1041 - DNA, 616 bp, Rattus norvegicus
  Genbank Accession No. AA946439
atgttgcatggtgactttattgtgggtttccaaacctgaacaccagtcctcattcaggtccgctttgtcctataggaacacgaagcttcaactttaacttgaagagcatccgaggctgtaccctacaacgcctaatgggacccttgcagcctggcacgcaacattaaacgcctccgttaacataatcagcttggcatacaagaaaattcattcgcacagaccgaccagacacagcattcagagcgcttaccagttggtgggtggagccaccacacctagccctccaatgagaaagtgcacagaagagacttagtttgcatacgagacaatgcaacgctaataattgtagaccgtaacctagccagcataataagagttcacagctcatttttgatggtttgggggccctgaaaagggcctttgtgagtgggggagggggccaaggagaaggcctatacacacgaggacgccgatcaaccgccggagccatagagcgtgcggccctggcgcttgagcgcatacaccacgtccatagccgtgaccgtattgcgcttggcgtgctcggtgtaggtgacagcatcgcgaatcacattttcaaggaaaacctttatgacgc

SEQ ID NO: 1042 - DNA, 486 bp, Rattus norvegicus
  Genbank Accession No. AA946440
ataatactcttttatttgattaaagaatttgccttcgttgtgtacattggaatgttatattccctatgtattttacagggttacaaaatgtctctcattttaaatattaccccaaaagtaatttcagaaaaaaagtctttgtgaaattaaacttgactttaaaaatcatagggacaaacagctctgaaatacaactggattaataagatttcttgtctactttactacatgacagacttcttatcccagtccccttcctcagaaaacctcatgtgaaaaccaagctagcgataaggattcttccctgatgcagtttaggggaaagggaaaggctaggaacttctttggccagcgtccgagccacagccctctgcggctgctctgcttcatggatagaaaactcttgccagggaaggccaggtgtttagagtgagcgctctctgctctgcagccacctgagagagtggaggccatctactgtcattt

SEQ ID NO: 1043 - DNA, 414 bp, Rattus norvegicus
  Genbank Accession No. AA946451
gagagaaaatttattcccatggcctacctaagagcagccttaagtaggcagggccagcagtgagctgggtgggagcacaagttctgcctggtgtcaagtccagtgcttacaggacaccatcacaccaccttgttgatgatgacaccaagctcttcaatctcacactggacttcatcacccttcttgagaaagacaggaggcttcctaaacatgccgacacctggaggagtcccagtcaggagaatgtcccctgggtacagagtgacaaactgggagacccaggctatcagatcttcagtcttgaacaccatctggttggtgaagtgggtccacaaatcctatcctgaacttcagagactactggtagtggtgtgtaggaaatttcctttggcaagcactcgacttcaatgagcc

SEQ ID NO: 1044 - DNA, 654 bp, Rattus norvegicus
  Genbank Accession No. AA946474
atgtaaaatattttcctttaattacattttaatcttgattaaggaaacacaaatactgatttttgttttggtcaccatcacttttggaaagcccattttctaaacagataaaatattacatatgcagcaacttttagtaatgaaaaccacctgttctttacttctaaggcaatatctgcagttgttttcacctgactagaattttaaaagtaaacagtagaaaagaataaaaaggattcctttagatcctaatggcttatgcaagtcactgtgagttaccagcaaacactaaagtcttgagaatattcttaattaaaaaaatatttttggtaccttaagtatgtatgcaattttataggcactcttaaacttatgtattttgtaacatcattgaaacatattcctatgtgtgcatggaagtgtgcatattacagtcatagacttggaagcatatctgccaacgtcaaagttttcagcgtgcttttagacacaaaaagagcaaacagatacctacactgccaagatacaaggattagacactgagttcaaaatacaggtagtatgattgtttgaatatgcttggcacatgcagtagatttgttgaaataggagtggctttgttagagaagtgtgtcatcagtgcgggcatgtgct

SEQ ID NO: 1045 - DNA, 589 bp, Rattus norvegicus
  Genbank Accession No. AA946502
acgatttaagaatacagctttaatttcttggtcacttttgatcatataaatatataaatcttaacaaggtaacactgttcactgtaataaaggccataaaataacagctctgccatattgcacagataaattaattcaattggcttccccaggccccgaccaaagagctttcgaatcagcactggaagacataaggatctacactcttgacatcgatgtcaagtcgcttgcagaaaataaactttaacatttcacaaggcggtatcatgtatgccaattaacagtctggacaagagtctcactggagtcctcctgtggtagagcttcacgctcagagttgcggtctgtcaccgctgccagggaagtgatcctctgtccgaaacaggactggcggctcgtacactgcgcgctggggcgcggtgggcgccgacttaaagagagcgggaacgctgatggtatgcagcagcctccgaaaggctcggggaaaggtccccagttcggcttcggccttggtgacttgctcctccattctggccacgctactaccgatcatcctcacgaaggcctctagtttgtcgattctgccgta

SEQ ID NO: 1046 - DNA, 511 bp, Rattus norvegicus
  Genbank Accession No. AA946505
gcttctaaaaagtgatcctttatttcctgaaagtcctaaagcagacccatttatcaaacgaggacagacactccagttcacaaacaatgtgtttcccctttctggcgagtcctggagctccgtgagggctgcagcctgtgtaatgcatgatatcaaaaacggccttccacacccagtagctgcacagcggcctcctgcacagcctggtggacactgctgacttctctctgggacagtgtccgttccatgtgccggtaggtaatgcggtagcaatggctggttctgtgtgtctttggatgttcaaacttgtctataagatcaaccttttccaccaggtctcctccgactgttcggacaatgtcatagaaatcattctccgtgtagttctcggagggcagccagaatgaaatgtcattgaacacagcggggtacttgctaaaaggctgaaacttgacgctttgattgatgtctgataggcggaactgcttcaggaagcgctaatcctcactcc

SEQ ID NO: 1047 - DNA, 591 bp, Rattus norvegicus
  Genbank Accession No. AA946530
cgataaactccacagttttagtgtttgtgaaaaacaagctgctccttattttgttctcagtcagactcttatttttcccaatagtcatcatgtatttctgacaacagctggcccagtcttcaatggctgattctgaagtacacagggaagaactgcacttctaagtttcaaaaaatgagctgaattacggttttagtcttctgagaggtataagcatgtaaaaacacgatccatgtctcccacggacagtaaaaaacaatctacaaggcattggattaaaatctctacttggaggaaaataggtaattctggggaaaaccaaaaaacattattgtacagattttcattttgtttttgactattgaagctttatctcttctaaaggggagataagacagaacagtttactcttaaccaaatctctagcacttttagatttttgttccttcatgaatgacagggtctggtcttccactaactgagagctggaatgaccaataacaaaacaaaatccaaaatcaaaacaaggggccagcaaggatatatatgcaaagaaatggtggagagaagatagattcacaggagaaaatc

SEQ ID NO: 1048 - DNA, 437 bp, Rattus norvegicus
  Genbank Accession No. AA955071
  misc_feature (1)..(437): n = a or c or g or t
tttttttttttttttttagcagtgccagtatcgtatttattattttcttttccatttgtttgctttccatggcaagtgaaaaaataatttaaaccaattatatgtacagaggcttggctactcttcccaagaactgccagaaagatctcagccccttaagtagcaaagaagggtcacctttaacaaccatacaaaactccacctagaaaagtctcatgtgtagaaaggttgtagttattacaagcatcacattttggggacaggaagggaagtcagagtgggagacgggggacagtgtgcagggtanggcgacacacacaccagcccaggggtcactctgggtgaggaagctacagccgaggagtttcaggtgatctgcagaggggtctccaacatctccatgangaaggtgtcaatgggggtatccccaatgagct

SEQ ID NO: 1049 - DNA, 556 bp, Rattus norvegicus
  Genbank Accession No. AA955162
  misc_feature (1)..(556): n = a or c or g or t
tttttttttttttttttcatattttaacaaactttcctttattaggttactgactgatatgagtcatcataaaacagaacagaacggggatttcagaactatacatgccacaaggctttacggtgatggtgccgggacggcagggaggtgtggtgagtcctggggcggcggagtatgggggacacaggagagccttgctgttcgccagcatccgtgagggtacggccgggtggagatcaagctgggatctatgcggctgaatgtgatccgctccaaaaccagaacgagtaagatttctgtctgacaaaaggcccccctcccaaaaaaggagaatgacctcaaaacgcanagggaatgacttagattctttatctagtctcggcaccacctctgtgccttaaaaattatactctactggaagatgtttatttattttttaaaaaaggtaccctacagcagctgcttaaaatgattcttacaaatatatctatgtaaatatattaaacattttcaacaaataaagtcatctactgtacctgtgcagaaatgaacagaa

SEQ ID NO: 1050 - DNA, 498 bp, Rattus norvegicus
  Genbank Accession No. AA955164
tttttttttttttttttgaacatctggtttattggggaagctggtcatgaaaactgcaattgtcttggctgcaacttacaaaatagtgttctgatatttaaaataagctagtttccattcagtgagtataaatggtaagaaaaaataataacagcccttccaatatgtattcagagaaactcattcccaaatttcccccttgtatgtattatacagatatgttaagtctgtttaccgaggaagaccaggtttgtaattacatttaggtttctgttacagttcaaatctattctagctgtctgtcagtagagctcagttaaggctgagaggggcattgatatgtcttctcccgggatgtctgaatggtaaccctcataggccttcctacccgacctcatcacatccatcggtcgggaggaataaggcctagtccaccctcccatctagtctacgctggttctaaacatacacgcaacactgtacagatttgttaatatg

SEQ ID NO: 1051 - DNA, 298 bp, Rattus norvegicus
  Genbank Accession No. AA955249
tttttttttttttttttacaagagacagcattcatattttatttaaacaaagcatgtattagaaaactgtcatcacagagatgtatgtcttctgcttcactggccttgactaagcctttttcttgcaaacacctgctggggctgtatgtatagctggatggagcccttcactggttctagaccacgcaccacaagcatcacagggaaaataattcgtgtacctctgaggtaaattctacaaaaccaagagcattcagacacatgctttggatcacaaggagactgccctgagaatatt

SEQ ID NO: 1052 - DNA, 508 bp, Rattus norvegicus
  Genbank Accession No. AA955298
tttttttttttttttttaaagatgagcatttattcactttacaaagagaatggtattaaattgccataaacagctccatttatagacaaagaacaactgtacatcaatcgcaccagcagcttgcccaggatgcccttcccgcttcggctgtgcagcctgctctgtccctgatggaagtcctcccagggagcacttttcttagtcacaggtgggaaagcctcgcatctgctcagtccttctgcagacgacagctctccatctgcacccctgactgaacgagttagtactggcccactctttagaaacaagacaaattactggtaatttgaaaaagctgtgtagcacaccaaaatacttatttatacatacataaaaaatcttgagtaagatttatcattttgaaagataaacagataccctagccctgctaagagcgggtaatgaaaaggaaccaaaatgttaaattactgaattataaaaatagtctctttggaaaaaaattccagca

SEQ ID NO: 1053 - DNA, 220 bp, Rattus norvegicus
  Genbank Accession No. AA955350
tttttttttttttttttcaaattaacttttatttgaaattactcttccccacatgtattatttaggatcctatacaataacccatgtaaccaatgtcccaataccaaaatttctaacagcaagttatacaattgttctaggtaataaataaaggttgtccttcagtgattaagggaataaagtttccgtaaacttaacataaaaatcacactttaagttt

SEQ ID NO: 1054 - DNA, 524 bp, Rattus norvegicus
  Genbank Accession No. AA955382
tttttttttttttttttgcatttaaaacattttaatagttttatttggcaaagagaagcctaagaattttttaaaaaacatttccagagggaacactttttttttttttttttttttaccataaaataaactgtgttgtctggaagggcaaatctccagtgtatatattttgactctgccaatcttagaattagtacaaaaaagataatttgttgaaattctttaaaaatgtaaaaaccagtccaggcaacataactatacaatcttgctgtaaaagtacttatatgaaattctgccaaaatatttttcgcaatatactaaattcagtttctcaagttactcttcattggcggctggctttcccattttctgttgtctccatcccattttcctccttaaggtgttgatatagctctgctctgttattgacagagttcaaacgcccagcaaactcctggtgctttctggaattggcagtgtttattctgttactccacaaggataataaggacactggcccttta

SEQ ID NO: 1055 - DNA, 324 bp, Rattus norvegicus
  Genbank Accession No. AA955389
tttttttttttttttttaatgtcttattttctgtttattattgctatttagtcacagaaaagattaacactttacaagaaatgtcctttatcatatgccatatagatataattttatatgaagagggactgtggggaaacaggatagctttacgaggaaataaagaaacagcaataaaaggattcttccatataaagattttgaaccaaattatttgttttcagaatacaaaaccttaattgctgtttttctctttccttccaacaattaaggttttgtattctgaaaacaaaaccttaattgttggaaggaaacctcgtgccg

SEQ ID NO: 1056 - DNA, 428 bp, Rattus norvegicus
  Genbank Accession No. AA955392
  misc_feature (1)..(428): n = a or c or g or t
tttttttttttttttttagcataaaaagcatttattgccaggaacaaaaagaacagcacaaataactgcggaaggatcagattaacaatgtggtaagcggggctggggatttagctcagtgatagagcgcttacctaggaagcgcaaggccctgggtttggtccccagctcggaaaaaaaagtggtaagcaaggaagataaatttggagttgcaaatatttcaatcttaagtagtctaaggagaagaggaanggggtatgggggggcagagaaatataacctctggcacttaaataaacattaatctgctccagccgtactgaagagatcaggcatttcacgttgagtgccactgaaactgctcagatgctacaaatccacaaggaatcaacaggctgtattccatgaggtctgaagtttgccgtgcc

SEQ ID NO: 1057 - DNA, 380 bp, Rattus norvegicus
  Genbank Accession No. AA955427
ttaatttttttttttttagacactttagaccatttaatataggtatccgttatccatctggctttacttcaacattaatacagcattttcctctggaaatgcaacctgagctggaatgggaatgaaggacgcttgacttcacagactgttctcctcaaggcactggcgataattccaagggaaaagtctggcggcagatcacggctcaagccccgggcaggagttagggaaaactccctcgaggtcaaatgctctgatcaagtccaaggattgcacctgtgagcctctgctcaggtcgagattcctcacacagcccctgaacaaagaccggctgctcaggcacttctgtttgacctgggccgggtagccacccacataaa

SEQ ID NO: 1058 - DNA, 452 bp, Rattus norvegicus
  Genbank Accession No. AA955447
tttttttttttttttttactttgaaatagttttattggctcataagacctttgcatataaaaaaaatacccaaatcactatgcagtattaaatcacaattacattttctcttaccaattgtaactacccagaatatacattttttaaaagaaaaaaaagcctactgaacagaattttgaaatgacattatacttaaatactatgacaaaatagataattccttataacattaattgcacaaagctgccaggtattttcataagcataatcattgcacagagtgcaaatgaacacaatttcaatggtacacatttagctgaagtaaccacctccatctatggaacccttagtttctggcacaaaatgttggtctattttaactttccccaggcaaccaactccaagatccagtgacttttggccttcctcaagatacaagcatcctactcatg

SEQ ID NO: 1059 - DNA, 378 bp, Rattus norvegicus
  Genbank Accession No. AA955523
tttttttttttttttttcttgtttgcagctttattaagtccctttactttctaaaacatgattacaagaaaagaatacttcatttacgtgtaacactgtcttcatggacgtaccgtggtcacggagtagaaatacaacatgagtatacaggaaaggagaggagagaccggtgtttggccctggtggccccctcacagagacacagaaagcagcagtggcagaaacagacaggggcttttctgaggagtgtgtgctttggggtcatagctgatgcttccagaaccttaaataaactcccttgctggctacaaggctggaactcggggctcagctcagagcacagccttatgaatgtaccctaggctgtgcctcgtgccg

SEQ ID NO: 1060 - DNA, 429 bp, Rattus norvegicus
  Genbank Accession No. AA955536
tttttttttttttttttgtctattccatgtttattctctgggattctcaacaggacttgctttcccgggaagaactggtgtggttccccgtgggaagaggagccgaccaccatgtctaagacactcagaagtacacggagttctcactgttgctgtccctttggtcatcaaatttgcggatctgggccttgaggtgcctcagtttacccttcaggtagtcacagcgagcttgcttatccaggaaaccaggatccacccgcttcttctcaaactctcttctgacatgagctgccatgcgaacctccttctggcttcgcggcgggggcagtgacagcagcagagcctccagttgctggagcttagcctgcatggcccccacctgccgctggagctccaagaactcttcgtactggtcctgaaacactgcgg

SEQ ID NO: 1061 - DNA, 445 bp, Rattus norvegicus
  Genbank Accession No. AA955552
tttttttttttttttttaccactctacttacaacttttatttaaacctttcgatttccatccatgcctaaaaatatagaagcaaagaagaaatcctgaaatgagaactaaattgcattttctcctgtctaaagaggaaagaaaggagaaacgaaaacactgagagcgccacagtaacaacactgcctgacagcggccggcacagaactcgtcctatcagacaagacagcggaatgaagatggtctgtggacacagctgtctgatgaagccgcctttaatcgagttttccattctgaaggctgtccttggctttctcttgtctgatgagagagatgactttcatgcatccttttgtgattttgatcatccacatgatgttcatcacatctaaaacaatacaagaagagatccagacaaaatggactacagatccaagccttatgta

SEQ ID NO: 1062 - DNA, 499 bp, Rattus norvegicus
  Genbank Accession No. AA955553
tttttttttttttttgtgatgccacagatttattatagcacagagaacaagttcaaattctcacaacttccacagtcactaaaaagtaaacagaaataagagatagccaagggatacaatctcataatttcccaaactatgaaacaatgtagcatactcaaattataattctcgttaagtatgaagacacaaagtcctgataccccataggtaattaaaattttgtatttataacatatatattgggcctcaaggactcacagaacttttatagtaaatgatacttaatagctgggtgttttgcttattaggcaagcaaatttaaaggcagtaaagtccttctagcttcctttgggtcattgccctgtttgagtctttgggaattgcttgtgtatgtgacagtgtctaccattccgtcccatcttaacccaggctgggcacacagagtcaaagtaagaaaacacgaatccctgagaccttcgaagtaagatataagctt

SEQ ID NO: 1063 - DNA, 485 bp, Rattus norvegicus
  Genbank Accession No. AA955573
tttttttttttttttttgggcctgctctctttattggcatcactctttgagggagaagtgcatcttgtccccaatcatcttgcgctcagggttgaggcgcttgagaatctgcgccagcacattcactgtctgctcgctgctcagccccgtcttcttggtctggaacttcttcagcaggtcctttgtggtcatgggcttccgggtcaggtagcaaagttgactttatcagctgcattaaaagccattatgttgtatcttttggctgtgttcttggggactcggacgacgtactcagtgacattctggctgctggagcctatagccgccatggccgttgctcaagctgctccgggtcggccagacctggatggtcttggctgtgtccctcggacccatggaaagcacctttcctggttgtcacgttagtgtgatcctgtgctttggatttccagacccttaagtctcctagaatgctaatctgtgtc

SEQ ID NO: 1064 - DNA, 451 bp, Rattus norvegicus
  Genbank Accession No. AA955587
tttttttttttttttttgaggttgtgcatctgagctttattaccaggacgatgatgtcacctcaggaagggactgggatccctgcaaggtggttccacatgggacccaggtcctcagagatgtggccctccttgtgtgccaaaatgcatctggaaagaaaatacagaaggggagggacagcatacgaggagacaagtgtgacccgaggcccatgaagtacttccatattctgtccttctccaggcacgagagttgaaggccgtgccaagccctgcactcgctaagctggtgaagaccacaccaaaatcactgtgacaggacagctgcacagatctgtttccgacttttcccaccacgattctacaccaaggtaaaaaagagcttccaccacaaatccaaggcacgagctgggcggccacacacccgccacagatggtgcaagttgctcact

SEQ ID NO: 1065 - DNA, 619 bp, Rattus norvegicus
  Genbank Accession No. AA955630
  misc_feature (1)..(619): n = a or c or g or t
tttttttttttttttttccttgttcacaaaagactttattatctagtgatgcatactgagaacatacagaaatctgcatggtccacttcccatgcagtagaacaatcttctcattacagtaagtgagtgtcaactgtttatgcaatagacaacactttaaagtcacattttaaaagaaaagcttcatttacaaaagaaataaaaggtaaagaagcaattaccgcttttaaaaagcagctgctttgttcaagagtggaaggtttatgcctgtattgaaagacaacatgatcacaaataatgcaaacaatgaacaaatgaaaaacacgtttaccataaagcagtacacttccaaaatgacatacaaatagttaaaaatctcattatgttgtctatcttttaaatatgaggactttgggaagtaggcctcaacattttaattagtaaatgaaaactatgcagtttctatgtcactaagaactgtatttaacanaatgtataaagtctatagcaagttgatttaaaaaaaagtaaagttaataggaaacagtacactgaaggcgctctacccatcaagcgcatacgcttcgaattttaaatgtgatgaacagaacagaaactg

SEQ ID NO: 1066 - DNA, 361 bp, Rattus norvegicus
  Genbank Accession No. AA955640
tttttttttttttttttactttcaataagtaaaaacaaggcttttattctatatgttatttggacaaaattacttagaagtactttggtgctagatgtttgctctaatatttgaggaagatgtataatatacagaaaactaatgctagctttgccaaagacatctacaaaaatatgtccctcacacttttacacataatatatagaactataaaatctgccaatatggaaattccctagaatttctcaatgcactgtgaaatccacaaggcaaaagaaagcatcatatgtaaatgatgttcaaacatcctgtcatggatgatgtttttataactagaatacaacctatctatctatacaca

SEQ ID NO: 1067 - DNA, 286 bp, Rattus norvegicus
  Genbank Accession No. AA955831
tttttttttttttttttatcgtgtcaagccaggagaggaagagagaggaagagagatagagatagagagagagacagagacagaggaagagtggaagagcgagagtgaggaagaagagtgagaatctcctgtagctttattcaccacttatatacccaagtctccaggtagaaaataactgggaagcacagtgggaaaccctggctcgtgactacctggctcgtgacttcggtaacaaaagaccgactaggagacctgaattaattagggagaaatccaagaagat

SEQ ID NO: 1068 - DNA, 273 bp, Rattus norvegicus
  Genbank Accession No. AA955835
tttttttttttttttataattacatttactttatttatttgcatgtgtggaagtcagaggacaacttttgggagttagttttctccttctgtcacatgggttccagggatcagagtggcacgctgagcagagccattaccagctgagccatttacctttccccactgactcatgagcacgaggctcagacagcagtgcggccatactgcatgctgcaggaagctgatcaaatatacttcctccactagtcatgcctcagacttcctgctctga

SEQ ID NO: 1069 - DNA, 457 bp, Rattus norvegicus
  Genbank Accession No. AA955871
tttttctttttttttttaagtcaagtactttcttaaagaaacaatagcaccacattggcgtagctggccaaacagtaaaggggaaagcaaaacacgctgcgtcctgtcttctgcgcatcctcccaagtgcacaaactgtaacagaaaccctggagccgtggcgtctgagacggtttcatctacagacataaccacgttttacattgacattcaaagaaggagaaggagtctcaagcggcatgggtcgatttttttttttttttaaagataggatttttcaaggaaatgatttcttctaactcttagggtgaataggtgtgtgtgtgtgtgtgtgtgtgtgggtatttaaaaaaggatttttttttaaccgcaggaaaatagattataatggagagatgcattaactttttcagtggagtagactcattttacaatgttttcgagcacttgatagtct

SEQ ID NO: 1070 - DNA, 336 bp, Rattus norvegicus
  Genbank Accession No. AA955887
  misc_feature (1)..(336): n = a or c or g or t
tttttttttttttttttcatgattccatttattaaagaaaaacatttccttacagtatgtcttttcaactgcataattcactttaaatttctgaaaagagtaaaactaacttttaaaaaatgctgggcagttaaaatgccctggttcaaagttgagctgttttgttttgtgtttttaaataggcaagaatatattcaagagaaaggaagcattagaaaggggagtcacctgtgacaacctgtcatgttagccttgacacaattcaacctctgtacctacacagccacagaagagagagagaaaannnaaaaaaaaaaacctttgcgcctcgtgccg

SEQ ID NO: 1071 - DNA, 424 bp, Rattus norvegicus
  Genbank Accession No. AA955909
tttttttttttttttttcgttgttatttcaatttattataaaaggatgccaaaccaaggcatcaaaaactaaaaagcttttaacacgcctctctatacctcagggcttcagatacttcttgatgttacagatccttctgtaagcattgcttctgggtgaatacaaggtattgaatgactcctcagaggaggtcagtttgccctgccatctgaacaaggcacttcctgcacaaggaaaccaacccgaggagactccacagaggaaaaggaggacacataaacattacataaacaagctcacggatgcaataaaagataccttctatggagagagaaccggcacctccttctgactgactcaccgagagggtgaatcttccatgaaaagcacccaaacctttctcccttaactccaaaccccatgt

SEQ ID NO: 1072 - DNA, 208 bp, Rattus norvegicus
  Genbank Accession No. AA955914
tttttttttttttttttggcagattagtcctttaatagaaaaatcccctggaaaaagtcaaaagccacatgtgcaacagtagcaacaacacacatttcctcaatccagacagtccagtttcaattcctcgccttgggaagtggcctgtacacacctacaaccacagcgtgggctcgttcaaaagggtccaatgtcaactggtcctgaa

SEQ ID NO: 1073 - DNA, 427 bp, Rattus norvegicus
  Genbank Accession No. AA955970
tttttttttttttttttacatgaagaacactctgcttttaatgaccggatactcagatgtgacaggtttaggggcagggaaaagtaccatgcccctgttatagctaaccgggaaccttaaaattcccaggcaagggtcagggcagggccatggctcccaaggcacatttggtgggatctgcttgttgctgcagcaggagcatgacgtgtctaacctctgtgaagaaatagtgggactgtatctttgcgggttcagctgttgatctcggttttttctggagaattctgaagtctggagagtcttggatctcgctgccttgccggaaccactggacctgcagcgggggagcccctctgactcggcattccagcaccaccacctgaccctccgatgctgctgtgttctgtagctccttagtaaaaacagg

SEQ ID NO: 1074 - DNA, 479 bp, Rattus norvegicus
  Genbank Accession No. AA955980
tttttttttttttttttgcaaagattcaaccatttaataacaaaagcttcccacccttactcctcgacagcatcctgagcacaggaagggcacagctatgtaggaggctgtagaaagctaaggaaaatgaggatgtcagatggattcctgggttaagactgggtcgggcacagtcccctttggccagacaatggcatgaaccacacaggaggctggggctggccacacaccaccaaaagcatgacagtgctggctgatgtgtctgtgtttcactagctgcttctgccaagtccaaatttcagtgagggacgactagagctcacacaggtcttgtcctcttggcctttttctcagacctcacagcgtcgtcatgggctttcctcttctctgcaagcttgttggcctctcggattttgcgccgcttgccaaacatgatcttttgataaaggtacttctctcgcttcttcatcatcatgatg

SEQ ID NO: 1075 - DNA, 559 bp, Rattus norvegicus
  Genbank Accession No. AA955983
tttttttttttttttttgcaagacaaataaaagtttttatttcacacatgacatcatattgttttcagagtggtgccgaggcctctacaagcatgaaagggaagaaaaacttagaagggccgcttcagtttcttggcaacatgaaagtccaggtattcgtccaggaatctgcttgctacccccatgacagcgaggacagtcagcaaggccaaaatgcccaggctcagccggaaaccaatgatccttttttcagcggcttctgcatagccccagaaatacttgtgacgggcgtatatgtacaggagacccagacaggttgcaaaaacttgattgaaataccatccagccatccacagcgatatgatgaatacggaataaaactccaaagagttttgctgtgcgcgaaatattctctcaaactccagagagcccgtgactgctggaggtgcgatcttgtactttaatcttactcgtccgacttgcaaagcaaaataactttgctgacaggcagagagaacggagactgcaaccagcaggcttgaatcccccgccatctttc

SEQ ID NO: 1076 - DNA, 306 bp, Rattus norvegicus
  Genbank Accession No. AA955986
tttttttttttttttttaccagcgtaagaggtacgcgtttattaagcacccagatatgggaggaggatgcctgaagcagagccggtacgcaccggctgcctctctgccttacgcctgtgcgtacgtcactcgcaaggacacctcagaagctcagcacctgggctccatcggcagcttgagtgaggtagaacgtggctgtcccgctgtactgctcctgtatgtgatgcatgacaaggggggcaacagaggcctccagcaacgtgacagtgcagccgccgaagccaccgcctgtcatgcgactgccgt

SEQ ID NO: 1077 - DNA, 350 bp, Rattus norvegicus
  Genbank Accession No. AA956035
tttttttttttttttttgcaatctggataccttttatttaatttcaagaattccctttgcacggcaaaaaagggtctgaggaaagcagagcagcgcagatgagcgggacagaagcagagtgctcacaaaagtggtaccatgaaatgctggctacccaccacactccctagctgggagagaaacaggatccacaaaaggagcaggaaagccatttttgacacaaacaagggtcctggggcatgccaccccaccccagtgcctggccatgcaagatgctgaaatggagactggcccaccaggctgcagtgctgggagccgtggagtgatgcaccaaaatgaaagggagtcct

SEQ ID NO: 1078 - DNA, 541 bp, Rattus norvegicus
  Genbank Accession No. AA956140
  misc_feature (1)..(541): n = a or c or g or t
tttttttttttttttttgcagtttgaattgtggtttatttagaagcattcaagagttagactgtaaataaacatattatgaataattaaaatcgccatttattataaataccaactaagttaaataatactatttcacctatctttcccctttgagctggagtccagattccttctctcaaattcttaccaggagtaaaatctttagtgttgtgacctctgtacccatctgtacccaaagtgcccttttataaactaaatgagacctagaactctgaaaggaagcttcttcccacttactgtagtggtaaactgacctttctgtgggttagcccccaagcactacttcttgctcttggctggacacctcagaaggggattacacacattcgagacgtcaccagcatgtgtgtcncctccttcgcaccgtaaccttactgatgtgaatatttacacacacctgtcctccttaccatctgctgtgacagaaaaaaagatgatgttaacgttccctttctccaacaggtgggtttccccctctt

SEQ ID NO: 1079 - DNA, 473 bp, Rattus norvegicus
  Genbank Accession No. AA956164
tttttttttttttttttatctgtagagttgttctgctttattacagctctgcagatgaaggatgcttaaagacatctaatgaatgcagaaactgaagtcatatccttctccaagctctgagtaagtggaaccagttaccaaacagctgcttttattccagcatctacaggctgtgagaggacgagcagtaactgcagacgcagtactacacaccctttatttaatcacagtggtaatggtacagtttattcttcagattctccaggcttacggatgtcatcaatcttcagaatcatcctaaccatctgtgtggcaagagagatctgctgctttttaccaatcaaggtttctatgacatgctgatactgcatatcattactgcccttgtgcagacagtcaatccccagggcaaggttagactccttcacttgtctagctcggacttcagtcatggtctggatgggattcatgcc

SEQ ID NO: 1080 - DNA, 456 bp, Rattus norvegicus
  Genbank Accession No. AA956185
tttttttttttttttttcagcattaaagtactttatttagaatggattgttaccgagtgaaatgagggacagcatctcggtgactcctctgtgtagtaataaaaacctttgattaaatagttttcctttgggttcttccttagctgtcactgttttggctccacagatgcattaatcagaagaggaagagacacaagttccagtgtaagtttattagtccatactggtaaggcctgtgatgtcccagggctaggtgttctttgtcatcaccatggtccccagaagaggggccctcatctactcgcaaaggccataatctgttctttgagaggagacactgcattagtggcctgcaggccccaggtcctgagcaacactagcggagtggtactggtagagtagagccttttcagcaggtcagtagcagccagaagagcagtattatgacgctgtcgg

SEQ ID NO: 1081 - DNA, 501 bp, Rattus norvegicus
  Genbank Accession No. AA956278
tttttttttttttttttgcatttataaaaactgcagatttattcagcgagggcccgtgtccaagaagctatggtgtagaagtcggaggacctatttttcctcttctcctccccctcacttcgtcttcctggagggcaaaaatggtctggaccctgaaatcctaacccaaataaaaaaaaccacaaaactgaggttccaaaaaagttaaagaatcttaattccttatagaaaagagagaggagccaaggcaaatggggaggtatcccaggggtgggggaaatgccccctacttggtgggatacccctcctcttacatagctgcctctgatgggacaaagcttggggtatagcatttaaaaactcccacaccccattttatcaaaaccaaagagaacaaaaaatttcccttccccccacaaaacccaaatatatatatatactttttcttaaaaaaaaaaattccaaggcattaaagcgttaaagtgaatccagaacaagaga

SEQ ID NO: 1082 - DNA, 549 bp, Rattus norvegicus
  Genbank Accession No. AA956329
tttttttttttttttttgctgagagccttcctagggcttcttttttatttctcgtcactttgggtttaagaacttgaattcctcccttgaggtcaggcagccttaagtcctagcagatacatgacttatccccatccacctaaacccagggaaagggaggtggaagctaagtggagtggatcaaggtaaggacccagcacacgatggaccttagctcccctaggaggcttctactggtactcccctggacaaggaggtcacagggagtgcatcgagagtggggtcgtccctacagctggtggtgaggcctcagctcctacaggagaccccagtttggcatttctgcatttgctacagcctaaagctgctgaaacctctttaaagaagctctgcagcccagcttggagccatggggtgtcggtgctggagctgaaaggacccactgtccctccccttcctcactgagcttgggtttaggtcagtagtggagtacttgcttagtatgcctacagcactgagtttgattttttttcttttctttttagcact

SEQ ID NO: 1083 - DNA, 397 bp, Rattus norvegicus
  Genbank Accession No. AA956382
tttttttttttttttttgagacagcacacatttactacacccatccgtcagaggtacagatggctttgcaacctgggtgtcccatgctcactttagcatggcttggggtacttgacagggcagttccacctcctgttccaacatcgactacatcttctgaattgaagtgctgtgacaaatccctccactgctgagtgtcccacgaagatggctcctgtaccatccctctccagacactactataggactctctgggtagtgcctggctcaagtacgttacccacagagatgtctcccaaacactcaggctttagcttcacgtcctggagaaccgcggtcaacacggccgacagaagctcgtcgggggtggtgtccttgaagccgccgcggcccgcgc

SEQ ID NO: 1084 - DNA, 439 bp, Rattus norvegicus
  Genbank Accession No. AA956437
ttttttttttgatgagtttgaatccattgctcctcgaagaggtcatgacaacacaggggttacagaccgagtagttaaccagttgctgacacagttagatggagtagaaggcttacagggtaaatcactgtttgtacaaaaacacagtataaaagaagttactaaatcatcgtgctaaaagtgttttccccctcaggagtttatgtgttggctgctactagtcgccctgatttgattgaccccgccttgttacggcccggccgactggataaatgtgtatactgccctcctccagatcaggtgtctcgtcttgagattttaactgtcctcagcaagtctctacctctggcggatgacgtggaccttcagcacgtggcctctgtcactgagtccttcactggagcggatctgaaagctctgctgtacaatgcacagctgg

SEQ ID NO: 1085 - DNA, 443 bp, Rattus norvegicus
  Genbank Accession No. AA956453
tttttttttttttttttcagtgttaaaagtcaaatttattacaacagcaagtgccatgattaaaaatgccagttaaatgatcatgtatctaaataatttttctaatgtaaatactagaaatgacagctctaacaattttatatgtacacaaaatattgaaaacataatgtactgcataggccaaaaagtaacactgcccttcgcttgctcttgacttaagaccttcaggaggcccactacctaccaaaggggaatgtgagtcggggatgggggcaccacagaggggcggggggagcaccagctcttgaagggacattttcaagaattgtctaacctgccctccacttaaagtacggaccaattccagccccatttccctctctgcacctcagacaggatttttggttatttttgtaacttattctgagcagtcagccattgcc

SEQ ID NO: 1086 - DNA, 402 bp, Rattus norvegicus
  Genbank Accession No. AA956530
tttttttttttttttttggtagcggacataaacgtttattgtcacagatggagtgcattctgacaggcttttcaaaggaaggaatacagattccaactcaccgccacatttccacaagtctgaaaggcggtgaacataaacataaaggcaactcctaaaattacgatgttgaaaagctttttagattccggagacattttggctccgcttgctcggaggtcaggagcggcccaagataatcacctccagtcgaacccccttacagtcctgagggaagaaacgagatgagagaaccacgcagccagactgccgatttccagtcctgagatgggaatcgcaggcttatgggaaaactctccccaccggcacagtccggacactccagggacgcgaccgagtgca

SEQ ID NO: 1087 - DNA, 524 bp, Rattus norvegicus
  Genbank Accession No. AA956534
tttttttttttttttttgctccataatctggtactttaatagagaaaagcatcaaatacacataaaggaacagtaaaatacagaaaaaaagaactctcaaatgtacagaggaatacatatattttcaccaacttaaacttttctttcttcagtgaaatctgtaaatgaaccatgttctcaaagaactttgttcaactcttccccaatgaccagaaattctaaacttacagtgaaaacacatgacaaaaacaaaacattgcatgacaatggacaccaagttcataaagaacttccttttaaatgagatattatgtaagaaaataccatgaaaataataatcctatgagaattgttttaagcacagtaaatttgagccttggtcttcatgaagatactacagtttgtatagaaaactataaatatacaagactccaagggaaaaaagtcagaatacatattgtctaacattctttaagctaaaaccttttgaaagggggaagatggctgatggccaactgaactgt

SEQ ID NO: 1088 - DNA, 439 bp, Rattus norvegicus
  Genbank Accession No. AA956558
  misc_feature (1)..(439): n = a or c or g or t
tttttttttttttttttccttaataccaaaaaagcaggaaaaaacaaacagaagttggatagaacagtacacactttcccatatcaacactcagcctggctcataaaaatatgacaataaaacaaaacaggaagcagtcagacctgaagctgcaactcagcaggaagatcagaagttgaagactgtgtctgttaacaaagtatgtattccagtccagcctgngactcaaaaaataaaataaaatttagttgggcctggaggcatgctcagtggttagatagtgcagactactcttgggaaggatcacaattcagtttcctgcacccacatccagcagctcacaactgcctgcaattccagttctggggccccgatacttatgatctcctctatggcacacataaatgtaaaaatacaaaataaaaatatttttaaattt

SEQ ID NO: 1089 - DNA, 446 bp, Rattus norvegicus
  Genbank Accession No. AA956746
tttttttttttttttttacaaggaaacttttattttcagttctcatcaagaaatttgctgtggttttttatgcttttggttctttttcttttttttttttttccaactttattttagctgctcagtggctggagccgctgggttcctggtattaaaaaggtgccaacagaggtagctgtgtctcacccaggggcccggcccactctgaataccccccaaaaggagaaaacacaaagtaaaccaacaaaataaaaccaaaaagaggaagaaattcagatcattttcttcaagcctggcagaacccacaacagtttgtaacaggcgcacggtggggagaagccagggtccagaaggcagccagcccgccagctccttgctcggcgctgggctagctactgctgcgtgtctctccagcaggaagggcaccgttgcctctccctccctcc

SEQ ID NO: 1090 - DNA, 365 bp, Rattus norvegicus
  Genbank Accession No. AA956943
tttttttttttttttttaacatttcctcagagggctttatttttctattttatatagaccacttattaaattagaaggctgaaagtaaaaatatatcatataatcaaagaaaaatctggacatggacccccatccccaaataaccacagacagggttctgagaactattcccaccaacctctagacagtgtgtcggatgatgccagtgtctgtaaagagtggcctcatcatggcagctggaagggacgtataggacatgaccaggttaatcatgccctccttgtcgtcgccctgcctcccactcagggttcttggcgccattgtgtgctgtgggagtttcataaacagcatatcccaaacgcaag

SEQ ID NO: 1091 - DNA, 480 bp, Rattus norvegicus
  Genbank Accession No. AA957063
tttttttttttttttttaaatgtaaggatggactttattttaaaaaaaatctttttaggactacaaattacaaaggaagcagatcactacacagaatctaatgaatacatttgcctgtgcataaaactttatcaaagtcattcattttacaaattcaccccacccgccaatgttttcactataatgctcttaaggttactatacctttatttcaaattatattacatgttattctcaagatagactttaaataccaaattcttggcttctaagaatggcaccttcaaaatgggcaatttccactcaagtctctggtggcattattcttactattttcttttaccaattaaaaaaaagttcaaaatgttcactttcagcctttgccaaaaggtggctacatcttcccctaccaactataaatggatagcaaaaagaaaagcaacgaaggcagccattaaaatagattaatcaattgaagta

SEQ ID NO: 1092 - DNA, 453 bp, Rattus norvegicus
  Genbank Accession No. AA957139
tttttttttttttttttcctttgcctaatggaacgataactgctcattttctatcctggcaagattagagaaacaaaaaacaaaagagggatagtaaggctgcttgttgattgccactttcgaagatacccttggtgaacacgcagcattacagtctcaacaccgctacgctggtggtggtaggtctcatgtcaactctgcagatttcaagagctctagaaataaccacgtaagctgctcagggtcttttcaggacctcccagagatgagttatacactcacttgtaaatcaacagttagaagaccgtgttaagataaacaagtacacataaccccagacggaatgtactcagtttccttttcaacagtcctgattcatggcaattattgagaactgtatttatccatatgtaaaataataaacgatgctgagaatcttgtttgtcccaagca

SEQ ID NO: 1093 - DNA, 497 bp, Rattus norvegicus
  Genbank Accession No. AA957143
tttttttttttttttttaaagatgctttaacagtttattttgaaggtctttttaaaaacaaagtaaaagacaatctgagaaaaaaattgcacagatgacactcattaaataagtatggtgattaaatcagacagggatatgctgtcttctgcaactccagaagtgagttccgtggtcctgaaggttcttagacttccagagtgaggaggggaatcatggcaacaaaagctgcctcgtaatcatgtaaatctacagtagcaaccaaatgtttcttttcttcccaagaatcaatttcgatcttcaaactgtgccttattttttaaaagataagatgctagaaactcgatgggatttggtggtctcaacgctgtctgtgagcccgtactcagagtgagggttttctgcaacctgtgtctgtccctccagcatctgctctgactccatggcggaccctgcaaaccgcaatcaaccggataccagtccgcgccaatgctgtc

SEQ ID NO: 1094 - DNA, 515 bp, Rattus norvegicus
  Genbank Accession No. AA957218
cggccacgccatggaacaccagctcctgtgctgcgaagtggagaccatccgccgcgcgtaccctgacaccaatctcctcaacgaccgggtgctgcgagccatgcttaagactgaggagacctgcgcgccctccgtttcttacttcaagtgcgtgcagagggagattgtgccatccatgcggaaaatcgtggccacctggatgctagaggtctgcgaggagcagaagtgcgaagaggaggtcttcccgctggccatgaactacctggaccgtttcttgtctctggagcccctgaagaagagccgcctgcagcttctgggggccacctgcatgttcgtggcctctaagatgaaggagaccattcccctgactgccgagaagttgtgcatctacactgacaactctatccgccccgaggagttgctgcaaatggaactgcttctggtgaacaagctcaaatggaacctggccgccatgactccccacgatttcatcgaacacttcctctccaaaatgc

SEQ ID NO: 1095 - DNA, 484 bp, Rattus norvegicus
  Genbank Accession No. AA957264
tttttttttttttttttggtacacactgttcacacctatattttcaagtttggaaatgcatatttgcaagcagcaatacaaaagtattcatgaagaatgcataatctctgaaaattatgaaaacatccctgctaccaatacatttctaaatacaaaactgactaacatatttgttacttctgtgtagctagagaagttcgttttcaaaacagataaaattcagtctttaggtgtgaatggtatgaatgacagtcttttttttttttttaattcttagttgtttgggatccttaagcatgcaaaagctttgaacaggagggtccacaaaggaaccagtgttgtattatggcatccagttaggccagagcggggaatgcctctgggtcatctacatcaggagcagaagcacttgacttatcagtcctgctgccacgattaggacgaccaccacgcccacgtccaccacgtcctcctctgccaccac

SEQ ID NO: 1096 - DNA, 441 bp, Rattus norvegicus
  Genbank Accession No. AA957307
tttttttttttttttttcaagcctggggaggagactggggaagtcttgtgccctccccagagatgctttattgcgtggcttcaccagtcatcagtgaggagaccctgggcccattcgagatgatgggaacacccgcgcagtacccggcagatggacccagatgctgtgcagtcagatgggacagggtgaggagtggtactcggcctctctgttccagggcagacctgggatcccagcaggcagcaagtaagtctggcaaactgggaggaggcagtgttcaggcctcagtgacctccatgttctgcagctggttctccagggtgacctcttttgctttctttttgctgccttcatgttgcttcttctgcttcttagatggctcctggtcaataggtgctggcttcacaaatgggatcagttcttgcctcgtgccgaattctt

SEQ ID NO: 1097 - DNA, 340 bp, Rattus norvegicus
  Genbank Accession No. AA957311
tttttttttttttttttgttttctactgaaacttattatttactgttaaggattgcaaactacactacgaagaatgaacaacctcaggaggcctttcttgagccctgagaggtccttcaggttgtcgggttccagacatccacccttgctaccaacagcaggagttacaacaagaccctagtcgacaacagcacaatggctcctggaccaggaagcaagctccagaggaatgggaattgccctagtcttcctgtcccaccccatctgaagtcaagggacaagatacgggagagaggaataagatgaaataaatatgtcatcaacatatctgatgttgata

SEQ ID NO: 1098 - DNA, 463 bp, Rattus norvegicus
  Genbank Accession No. AA957319
tttttttttttttttttgaaaaagttttctctgtgtaactctggccatctggaacttacttgtggtccaggctggcttgaacttagagatctgcctgactcttgagtgctgggattaaaggcaaacaccacaacacgcagtgcaaacaatattttcaaaagatattaaggaaatctcctttgataagcatcataaatattacataccatagctgcaccaacagcaattccagcaaagcccatctccgatatgggagtatctatgatcctcttgtcaccatatttcttccacaggcctctgctaaccttgtatgcaccatcatactgggcaacttcttccccaagcagaaaaaccttttcatctctttctagttcttcatccataccttgattaatggcttcacgaactgtcaactgcaccgccgcgggcgccgagcggtggaaacgcctcttcagcagcccgg

SEQ ID NO: 1099 - DNA, 341 bp, Rattus norvegicus
  Genbank Accession No. AA957449
tttttttttttttttttctgaaaaacggtttattatccctggaggaggcccccctggggctcacatcccaataaataaatgtctgttaataaataaaagtggtccataaataatgccccctagctgggagctaaggctcaggtttatctccgagagaagggtgaggttcagggagggcagaccgtccccaactttcataaagctggtccctgattccctggggggattcagccaggagcccccagtgaggcaccaaagggacacgaagggccacaaaggtgaggcccagagcctctcgggcccaggcccagggtctggattccagcctgctctctgcaagt

SEQ ID NO: 1100 - DNA, 503 bp, Rattus norvegicus
  Genbank Accession No. AA957501
tttttttttttttttttcattcaacaaatgtttattgagcacctactgtgtgccaggtagttctagagacctgggaaagaaggggctggggcagactggaattgtctcccagctgaagttctattttcaaaacaagtcctgcaagaggcagggctggggacctctgccctgcaaagtggaaggccttgagaaggcagctaggaatgtggggggtctctgagactagcgccttctcccagccgagccgccacgggatgaaacagccatgtatcacctcctctttagcacagatatgcacgatttcttgaggggtccaatctgcaggtgggcatccacactctccaggaagaaggcaggcttgagcctgtagttgaagagccctgaaaaatggctgtccaggcgactctggaaagggtcagtgggggaggccagggcaccgctgcggcgaggccgggaggctttgagcctccgaagaaggctcagcttcccctctcgaacagcgt

SEQ ID NO: 1101 - DNA, 400 bp, Rattus norvegicus
  Genbank Accession No. AA957557
ttttttttttcttttttgcaaatatttatttttttctcagccgggttagcgggcatttaggccaccctaatatctgggtttatttcaagttactgaaactgaggactaactgcagaaagtgtcaagagagaaaaacgtacatgtacagtttccaaaaccaaagccattaaggccgtttgagaaagccgtagagctgaggcacgaaataatccttgtaatgtccgtcgatgaaacccttcccactgttgtgtacgaaccagcagggaacgtctgttccaaacactatattggtcctgtagtctttctgcatgcctctggtgacagtcaacttatgtcctttcacttccatgctcgcttctggttttcccggctcttttcccggccgccctcgtgccgaatt

SEQ ID NO: 1102 - DNA, 265 bp, Rattus norvegicus
  Genbank Accession No. AA957683
tttttttttttttttttacactttgaccttttattaaggcgagtttgtgaagataaatttactacaaccaaaccccttcatgaaccttccgcttatattttttcaagacacacacaagagaacatgtcctgtaaagagccactcagtaccagaactaaaggaaggagagatgctgagccgggctgcgctcgccctggtgcaggggcttgctactcgtcatctttagagccagatttgcttaaatgcttcacgacgtcaacccagt

SEQ ID NO: 1103 - DNA, 456 bp, Rattus norvegicus
  Genbank Accession No. AA957723
tttttttttttttttttgtgtaagaaaaattttattgaggactgtctcgatagatataaggaccttgacagtgttttttcgtcttcatcttcttaaattacattaggttatttattttgcaggaagggggatgtgcacttgtggagatcaaaagacaacttgcaggagtcagccctctccttcccgtgacggaaagaatgcccagtatcagggaccaaattcaagtcatcatgcttggccaccatcacccttacccagctgagccatgtcaccagccttgggttttcctatgaagattaaggggtgaagatacagtctaattccaaacacagtgtgggcaagctgttgtctatcggcaagaatcaggatcaggtccatgggaaggaaaggttcccatggaaacataaggatgagctgaattctctccactctgacccagcagtcttgctggacaca

SEQ ID NO: 1104 - DNA, 463 bp, Rattus norvegicus
  Genbank Accession No. AA957763
tttttttttttttttttcggtttatttattatttatttttaaaatatatttaaacagcagcagtcacttccaaaatgcaaaaaattacaatttttagaataaaattatgtttataatgcaggtcagaaagaatcgaaggtacaaccgagaaccaaacgcgcagcactgaaggcagctggaaaagccaaggcctgctaatgtggggaccaagttgacacgaggtcacaatttgtgaggttcccacccccaaatcatgcctccccaaattcccattggtagagccagtgtcctctgagtgacagaagaaaaaaatgtcagagatggccctctgtaggggatcttgtcacgccaaatgaagctacgaaaggagaaacgcttgagctgcacgatgagcacatttggtaggcgccacagcagcagctgcttggaggcctctcgatgctgtttgcactgtgggcagtac

SEQ ID NO: 1105 - DNA, 474 bp, Rattus norvegicus
  Genbank Accession No. AA957766
tttttttttttttttttccagcccaccagtttttattctgaatatatgagcagattgaaagaaccagacagaagtccacactaagcactccaggacaccactgtcacttggagctgtcaccaccaccttccctctcctctaggtatcaggaagggtcaagtgaggactgtatctgacagatggacagacagacttaggagaaatgcattagtctgccggcagtcatctgactgttgccgccgaaggtagtccccacaggcatctggccacactttgggcagagtgggtggccctggggcatctttgcaagctgggaacacagtggttccagcagtcttgaactactaagccttgccatttatttcccaacagtggcgagaggagcgcttcagacaaaccagcgaaagcaccaaccagcgagtgctgtggtggtccatcctacagactctcatcctcgtggccatcctcgtgccg

SEQ ID NO: 1106 - DNA, 380 bp, Rattus norvegicus
  Genbank Accession No. AA957803
  misc_feature (1)..(380): n = a or c or g or t
tttttttttttttttttaatggacagaattttatttggttctaagtcgggaaagtctaagggtgaagggacatgctctggtgagagccaacttgcttcatttgtctgtgtctggagaggggtctgggaacaggacacgggacaggaacgaatgtttggttggatggaagtcctaacaagaattatttctctcagggaaagaatgatcgagaggggaggcaggtgttgccatgatgggagactacggacatctcactggtttggcctacgtgaagccctacacggaatcatcaaagtggactgggacgatggggttcccctcacaagcaatgatgatgtgcttctgactgttaatggttgtgtantcacaattgggatact

SEQ ID NO: 1107 - DNA, 279 bp, Rattus norvegicus
  Genbank Accession No. AA957826
tttttttttttttttttggcagcttgaacctttatttttagtacttttctttgtaaaaagcagaattagaaactttcaatacagaaataatcctggtgaactgtttaaaagtctgttgtttgacaggagtttcacatcaggcccaccaggacatcagttcagccctgagtccccccagccccatccttaatcccatcccagcccatcccaatcatgcatctaacactgcgggacatgcacactgttgtcacccaaaaccaccacctgggccttaacacg

SEQ ID NO: 1108 - DNA, 333 bp, Rattus norvegicus
  Genbank Accession No. AA957835
tttttttttttttttttgatgtttaacgtctgtgttttattttgttggcaccagaaaaagctcatgtaatgttatgccactgtccatactgtaaacaagacggcattaatatgttttcttatgggtttcttgttccaatgaatctagattttaaaaaatacattcacaaactaccttatgtttaaacacaatgattcccttttatttcttaactgtacccaaagtcccacaataaaaaaatcatttaaagctgtgtgtttcagatgtacgcttagaagtaagaacaaagtggcacgaaacataaagacaaaagatcagtttgcaacgtaattt

SEQ ID NO: 1109 - DNA, 503 bp, Rattus norvegicus
  Genbank Accession No. AA957992
cggccgctgcggcgggaggagccccccaggaggaggacggggatccatgtgtctttcctggtgactaggatgtcgtcggaggaggaccggagcgcggagcagcagcagccgccgccagcaccccccgaggagcccggagccccggccccgagccccgcagccgcagacaaaagacctcggggccggcctcgcaaagatggcgcttcccctttccagagagccagaaagaagcctcgaagtagaggaaaatctacagtggaagatgaggacagcacggatggactggagacgacggagacagaaaatattgtggagacagaagtcaaagaacaatctgtggaggaggacgctgagacagaagtggagagcagcaagcagccagcctcagctcttcagcggtctgtgtctgaggactctgcacactccctggtctctgtcggtgtagaagccaaaatcagtgaacagctctgcgccttttgttactgtggggagaaaagttcctt

SEQ ID NO: 1110 - DNA, 491 bp, Rattus norvegicus
  Genbank Accession No. AA957999
tttttttttttttttttaaattaaatagcatgatttaatttacttgctgcttaatcctcaatcctcttaagttaaaaaagaaagttataattaactattaacgttaatgaatttaaaccttccagaaacatgaatccaaaaggaaatgtccaacaggtgacacgagccgggtattctatggccttgctgtttcagttttgaacactaaacattaacggaaaagaaaatctctagggttttcagttttattcttctagagcacaactgtgtggccctgtcactaagcgcgctctcccagcaggtacacgatgaactcgtaggtggacaggacaatggcagtattggggatctgccggatgagctgagcaaaaagtcctcggtagaaggcgagatagccttcctcccggaataccaggcgtgctgtctgcatgaatgacgtgtacttgctgccttcttcccggagccgtgtcctgatgacctcgtgcgggtaa

SEQ ID NO: 1111 - DNA, 397 bp, Rattus norvegicus
  Genbank Accession No. AA963036
tttttttttttttttttaactgaccagaacagtttattgacaagatagcatataaagacactacagagcatcaagcagggagccttttctagagatggttaatcaggggctgtattcccagggaggcgatgtacggtaacccaaaatgcactgctttcttcacagaatgctccagcagaacatagctatcggctctcttctgccccagcacataaagccagctcaaacagtgctgcagacacacgtgatcgttggactcctgggcaatcctaattgcctcctgcagggcgagctctgcctgttgatagtggccgaagcggcagtgcagggcagccaagttgaaagcggcgtatcttaggctccggccataaccttcttccccattacttttgccctc

SEQ ID NO: 1112 - DNA, 459 bp, Rattus norvegicus
  Genbank Accession No. AA963102
tttttttttttttttttaaatatcaatgaaattgttttacggagtttattgacaactggttctggataaagttcaaaaaatgcaatttcttcaaagtaaaatagtgcttctgaggtcttttaaagtatttttttggtacaaaaaataagtgtttttctcaatgcttatttcaatactttgctgtaaattaagaagtgtttctcacatcgaatggttccgttaggcacattcaagtaaaatcataaaatatccaagttaaacaatgagacagccagacatgtggctttgataaaagtccgtccattctctggaatggaataaactgtcacttcccttaacccaaggctcgtggtttttggtgttaatatccattccctaacacacagataagcttcttttaaaaaaaaaaccaaagagaaagaaaagttcacttattctgcatccagaagaaccagcgag

SEQ ID NO: 1113 - DNA, 514 bp, Rattus norvegicus
  Genbank Accession No. AA963211
tttttttttttttttttgtgttaagaaatattagttttatttaaccagttttcacagctgaatatttattctataaaaactttacagagtgtacagtttatatatagttcaaactactgaacaaaagagtaggtcccacagatgcaaaaatactgtaccaatccatccaaggtaaagacagatttacacactgcacagcgctccacgtggccggggaggcgtcagttctgagtataaacttcaaaactgtacaaaaataaggttttgattttatttcagtcttcatacattcaatgattgcaagcctagaagccttagtagtaacaggcctctgtagttagtccccataccacggggtactcgtgtacacgaaaccgtgcgcagtatacggcagacatagaagcagagaccgtggataataaatgtcaaatataaggtagttcttttctgttttgaaaggagtttatgtatttaatagtgtgccaagagaattttaaattaaataaaatatatt

SEQ ID NO: 1114 - DNA, 474 bp, Rattus norvegicus
  Genbank Accession No. AA963243
tttttttttttttttttcaaggtataaatgaaattgtaattatataaatatatttataaatatttatacaattatatacttatacataagcacttacacagacttagaaaaaaagtaagaacattaattcaaaaggactcactgaaaaataacagaattttccatgatttcctttggagatacataacccattctttagggaggtccctcaaaatccaaccattaataaccacattctataattgcatactagcaacacaccacatcttttagcttatctttttaatccctagttgccaagagagaggtgtgcaggtacacaggaatctaaagattcctgagtaatcacaatttggattgtgtacaggttcaagaatcctccggatcttcaactgatgagacaggtcattctacagacatggttctgattttcccaccaaatcactctgcccgccctgctagagaactctactt

SEQ ID NO: 1115 - DNA, 525 bp, Rattus norvegicus
  Genbank Accession No. AA963369
  misc_feature (1)..(525): n = a or c or g or t
tttttttttttttttttattttatcattaacgtttattgatgggatggataaatacagattgagaaacatccttgacagcaagatatcaaactgatagccagactataaaatgtatacaatatccttctttaaatttttttgcgtttttaaagttttttttacaaagagcccttatgataatggtcacttccattgtactgtcattcacctaacagcagtagagatcccaggagtagcacccaaaactcaggtgccccacagaggacagaagcaacagcagaataatatgctgagcagtacaaaanaaaaaatcagacaaaaaaacaaaacctcaccacacaattgtacctgagtgacataaaccggtaaaagtgtgactttgctttttcatttttctcttctttttgttctttggtctgataagaaaatgaacagttttgcgtgtggcaagtcaggtaataaagatcagtctccagttcagaaccctaaatcacacctacaaggctgctgcagcactgtttcct

SEQ ID NO: 1116 - DNA, 474 bp, Rattus norvegicus
  Genbank Accession No. AA963449
tttttttttttttttttctcatagagaattttaatctgaaacctttaacagcagagatttgggccttcatttgaagagtcttcaaaagcctcttacagctgtaacagttagggtttctattgccacaaaacaccatgagcaaaaagcaagttgggagggtgggggtgggttatttggcttacacttccatactactgttcattatcaaagaaagtcaggacgggaactcaactgaggttcccttttctctgatgaccctagcgtgtgtcaggttgtcacctaagaccagccagtacacatactttagagaaaaaaggttttattttggggagggtgttaagtcttgctatgtagcctgctttcttaggacccaggatgaccagcctaggggtggaaccagccacagtgggctgggccctctctcattgaccactaagcatccttacagcatttcctcaactgaggttccccctc

SEQ ID NO: 1117 - DNA, 465 bp, Rattus norvegicus
  Genbank Accession No. AA963716
tttttttttttttttttcaagttttatttcatgaagactttattttttttttaatattacaaactaactctccctttctgagaaggcagtcttacactcagacaatcttcaagcaatgttttaagaaattgagaggaaaaccagagttcatcaacaagaaggttcacaacttctttttacagtaataggaaaaatgatacatttcactacctaaagtgggtcacactgagtgtccctagagcagagtagaatgacatcagctggacaggtatgaagacggtaatgaatttgtctctaatgatacagaacacaagcttgctttacacggaacccaagactccttcatcacactgcagtaggccacaagaagcttccgctctcaggcttctgtgaaaatcattaaggcaagtcaataaaggaccaggaagggcacagctacagcattgatcacaggacacccatgta

SEQ ID NO: 1118 - DNA, 510 bp, Rattus norvegicus
  Genbank Accession No. AA963780
  misc_feature (1)..(510): n = a or c or g or t
tttttttttttttttttgatataaatgatcccttttattgttaagtaatgcactggcctggctttgcactgcaagccctcagtcacgatatagtcaataactatgcctgcaggttcttctgcacaatccacaattcagacgcacacagagctgggtgagtgggaggggcaggagggtggcgggcggcatgcacctgacccaggcctggcccttccatatggggttggcaaaggcagataaaccccatggaatgaagaacaaatggtggcacagaatctttgcacagcaagccaagggctgctaggaaactgtccttcataacctttgggtccaggccatcctggaggcccacaattctcttttaaatttgttaataagagaaaataaattaatagctttggtcctgaggatgctgaaccagcatgtccacagtttttggcacaanaaaaaagggtcttttttttttcctttggagtgcaggatttgttgacttacttttaagttcacttt

SEQ ID NO: 1119 - DNA, 470 bp, Rattus norvegicus
  Genbank Accession No. AA963794
tttttttttttttttttaactggaagaagcactttatatttacagttcaactgataatgccaacatttgttactgtacaggtatcacaggttttgtggttgcaaagttatgtattgaagtttactggtattactacccacctaaatctaaactaaatctattgctcccatctgcaatttagcttgtaaattaaagtgttctaaacatgagtcaattatgaatattaaaagggaaagtgagacaaaagtattcccaactagattatctacattaatatgttggaattctatattttgctgtcatttttgtctttaaaaaatgaaataacaacgctctatcagtcacacagaggacatgcagatttagcagtattgatattatactctgtttggaaatagacaccctgtacccacatgtacaccaacagcaggccacacattaacagttgtaactaagcactgtgacaaatt

SEQ ID NO: 1120 - DNA, 444 bp, Rattus norvegicus
  Genbank Accession No. AA963808
  misc_feature (1)..(444): n = a or c or g or t
tttttttttttttttctatgaatttaagtctttatttctgtatctcactgtagtgctgtgacaacaaaacgacatctgtgcaccagagcacacatacatcgcagtaggctgtaactcattacaccactgctaggggttagcactctgtataagacgtaagcatggaggatggccacaccaaataattttctgttttttttttccttagatactcttatttttcttaaatcagtaatactttatcaatctcacagttaatagacctataaatgatctgagtgataggatgtatggggatcattcaactgtgttatactgtanaagctgctagagtaattgcacacatatcaataaggaactgtcacataattagggctagttattgttagttgcacaatgatgaagttcttctgaaaacaatagcccacttatatgtgagaaatt

SEQ ID NO: 1121 - DNA, 402 bp, Rattus norvegicus
  Genbank Accession No. AA963815
  misc_feature (1)..(402): n = a or c or g or t
tttttttttttttttttggatagatgtttattgatactttttgcaagacaaaagaggcagtaagtagtggaacattaatagagtcagcagtaataaagtaggatattgtatggtggggacaggtgacagtgacaaggggttcaaacgatttatacatcattaagtgtgaggtgactgggtcaattccaaacaagttcatacaaagatccagaaaagtattaaaatgccagttcatcaaatcacagatgaaaaatgggtcaggtggtcagcacccctctagaaaattcagcataacaatgttaattatgataacacagttcactggggagcagaagaccagaactgggcaattcagttcgccatttactcttgcatcctgnggcctgctgtgagagacgactt

SEQ ID NO: 1122 - DNA, 534 bp, Rattus norvegicus
  Genbank Accession No. AA964033
  misc_feature (1)..(534): n = a or c or g or t
tttttttttttttttttaacagtaagcaatctacactttattattatcatcaagtcagaaagtctcttgttctaatgaaaggaaattcaatgaagttgacaatcaactgacatcatggaaacatccccaagcttatggtggaggaaagagtatttttactatgcagcctgagcaactctctccgggtttggtactacactataagactgatgtaaacagttcagctccatagtgagaagatttggcagtcctacttggtaacagtcaccactagttctccaagagaaccaacactttcagactacagattttgctcactagaagcaacacaaggaggcatacataaggctaaactttatagttaactactaacccttaactcttcaagttaaaactcccaactaaatcccgtcttttaaatcacttgaagtaatacatgaaaaggcttcatgtttaacaatctttaattcaaatgcaaaagttcagtacaagccatttgtanggcttgggttgttttcattttaaaaaaacctc

SEQ ID NO: 1123 - DNA, 479 bp, Rattus norvegicus
  Genbank Accession No. AA964059
tttttttttttttttttcagagtctgatacagttttatttaacttgataaatgtagaatgggatggattcgaggcaaattttgggttagttcagccaccatacacagttcacatgcttctgaagagcagttagcttgagtatctccccacctccacacaaacacattcggagaaatccatgtagagaacgattttcactccatataatttagatttttactcggacacactgagtttgtctgcttgatgcaggtgccacaggagataaaattcatgcaatgatacttctatcatctgataattcaatgttatataaagtacattgaatatctaaaataaaacaaatgccaataatatcaattaataatatatttattgtcttgaaaccaaacaggcccaaggtccttttcgtcttgagtcagctgtctgaatgcttgtccctctcatacttcctgtgcaacgaaaaccaagacatttca

SEQ ID NO: 1124 - DNA, 293 bp, Rattus norvegicus
  Genbank Accession No. AA964114
tttttttttttttttttccggtagatggtacggcatataaacttttaattttaaaaaatgtacaataaaaatacattatcacacacgacacggaactaaacacatgagaagtgccacaaagaggccaggcagaagcagcaggagtcagacgtgtcctgtccgtgggcctcccaggaaggggccagggccaggtcaccagcctcactgagagttgctctccaagaccctactagtggtgcagttgttagtatatgcccacagcttgggggcacgggaactaagttagcactgca

SEQ ID NO: 1125 - DNA, 399 bp, Rattus norvegicus
  Genbank Accession No. AA964116
tttttttttttttttttagtggcataataaagtcatttattatactctagtttcttttggtcaggatttcagaccggtacagcaagtccccatttctgttccatggattggaagcctcaggctgaagactggtgctgtctgaagccctgtgacttacacgtcaggcagctgatggtggctgttagctggggccagaggtctcagctcatacccgtgtgaccctgtacatgcagtctccccaggctggctggtttggacttcctcacagtatggctgctgggttccaagaacaagcagtcttccactgccttcatcggtgttgaagtggagattttcagggtctatttgttcaccatcaggaaaactggaatgcgaatctaagaaaaaaatcctcgtgcc

SEQ ID NO: 1126 - DNA, 508 bp, Rattus norvegicus
  Genbank Accession No. AA964227
tttttttttttttttttccacaccagacagatgtgctttatttaaaaacaaagcaaaaacaaaacaaaacaaaaaaacaaaacccaacaacagcaacaaaaccctttaataagaaaatctgactcattaactcaagctccttgagaactttcaggaaagccagggtccgtgaaagacatgcaggcagctgtcgacagttctttggtggcacaagctgccctcctgattactgtaccagagttttattattaaaaaaaaaaaggcctcaaagcatacaccaaagaaaacacacacacacactctctctaatgtgctgcaaaagccaacatgataatacatacatcatttataaaatgagccttttgattctagaaaattaaaacacggcaagctcacagaagggtaacagcgagtggggagactcaaccttccctgatgacccgccatggggacacagctagtaacagtgggctttcgtttaccagcccagccagctgagctgtcctca

SEQ ID NO: 1127 - DNA, 376 bp, Rattus norvegicus
  Genbank Accession No. AA964265
tttttttttttttttttgagtctgcggatacatttatttcatcattcgtgcgcgagcgtgtacatgagtgtggtacccgtggaggcaaggagaggaggaggttcctacaccgtggagctggagtaactggaggctgtgggttgcctgccatgggctgtgggaactgcactgaggtcctgtggaagagcacccttggctgagccctctctccagacacctgagctcacatacgcaatccagactccgttagaaagaaagttaatctttaaaaggttaactctggcctccacattccgagctatgtctctgtatccattcagttttattttagcaaataaaatcggaccttaagaactttcctactggcctcgtgccg

SEQ ID NO: 1128 - DNA, 469 bp, Rattus norvegicus
  Genbank Accession No. AA964366
tttttttttttttttttggcctttgcacagcttttattattaagctatgagcatcctgtttgaggctagttttactagcggctatgtgcacatttgtccgcaatcaatgaatctacttgtccccctcccttcatagtagcaggctttgcttgtttctcttgcacatccttggctttacagtacatctgaccatagtgcacaacatgattccaagtcaagacagtggcccactgggcactgagcttctgattggtgaagggcggtccaatcagtgctggtgtcatggggttaccaaaccatgtccggccaaaatggcactacccagcagtagtgaaccatctacttaaagagccctcaggggaaaggctgcactggcggtcagtcttgagctacgtctttatttggcgccccatccaggtagatcttgagtgctttctctttgcgaggggagtatgtcacacgatgtccc

SEQ ID NO: 1129 - DNA, 440 bp, Rattus norvegicus
  Genbank Accession No. AA964426
tttttttttttttttttagacaacatatgtgctttatccaaagtttccttctgtaacaaccagggctaggaaatggggaaggtaaaacatatgaaatttctatagcctactgccaatcggtcccaagtcttcaagagcctcaggttatgacatatcgggtaagtcctccgcctcggacctccgacagtctctggcaatggcgcagtatgttcatgatcacatgaaacttcttgtcaactttcaaagtcgtgaactcctttatgtcagcttccacgatgaaatgacgacctttcgtgtccttcgtttcttcattaatgaatctttggtagagatttctcttcacagagctcatagatgcttttggttgatgtataatcttatatttactaactactgccttgttaatttccttgataacatcattaatttgacaataagtt

SEQ ID NO: 1130 - DNA, 276 bp, Rattus norvegicus
  Genbank Accession No. AA964500
tttttttttttttttttgcatttaaacaacgtggtcgggacatttattggcattatgaaaagatttctttaaatggtataaataatcatgaactcaatctctccatctgttctatttcacgatgataaagcaaatacgggaataagtaacattcctgcttctacaccacagtttaacgcacaataagctaacattccccaaaggattatcaactgcgtcacactgtctctcaacagacagtcaattgtcagtccaaattctaagaaaatttcccgg

SEQ ID NO: 1131 - DNA, 443 bp, Rattus norvegicus
  Genbank Accession No. AA964513
tttttttttttttttttaagagtgtaggcagcatttattacaaagccaagagatacaaatgacccaggacaggagggtatagtcacaggaccttagactcaggacatggtacaaacagacccatgggtttagaacctcacacactaagccaataccctgtcctccccccgccccccagatctatgtacacttgaggaaaaccaggtgggcaaggtttgcccataataggtggtccaccaggtagagttggggtgggcccattctttatcttcttgtgcttctagatgcctctgtcctatccctgcctggcctccgctgggggtgaggaagtggactggagggccgttagcttttggcagaactggagtctgtgcttgtcaggggttacccaccccaaccctcggctctgggccccccagtgactgtcacctccagtcttgcta

SEQ ID NO: 1132 - DNA, 367 bp, Rattus norvegicus
  Genbank Accession No. AA964514
tttttttttttttttttcaagatacaaattcattttattaatattaacttgtaagttatccagtcctgacagtgtgttaaaaatcaccttttaaaaagaccatgtagacattctgtattgccagaggccagggagtccacttggtgaggggagtcccggcacggccacctcattcattagtcaaagcagtcctgaggtgtatacctggggtcctcttcaggggtcttggctttcacaagcacttagttccatttgatctcggcattgccttatacacaggagctctatcacgtgttacttcagagtgagtacagggcctcgggtagcctcgagcgctttctggaatctggaattggccctcgtgccg

SEQ ID NO: 1133 - DNA, 530 bp, Rattus norvegicus
  Genbank Accession No. AA964533
tttttttttttttttttgaggagtctacagctttactgtaggatatatatacacacatatgtacatatgtatatatttctgaaaggcctctcctctgttggccatgtcaactctcaggtcacagtcagaaacatgacttctgagtcacttcttcacctctccaaggtcttcaatgctgtcatcatctacctctggccacttttcctgaatgacatcgatgatgtcatctgtgaagtctccctgaatgatgatctcatcctcccctgttactgaggcaccgcaggagaatttttgagcaaaaaatctttgtgcttctttgagatcaatttcaaaagttgcaaggccacacactctcgtcacgtatttcttctttgctctggggattttggctatcgtgaccttctgtggtactgtcttcttcttctgttttatttgacctcttccacctctttttgttttttcttctcctcctcttcccctactggtccttggccttcactaattccagtttcttgtttgggtgaattttc

SEQ ID NO: 1134 - DNA, 480 bp, Rattus norvegicus
  Genbank Accession No. AA964535
tttttttttttttttttacgttcattcagagtttatttgcacagggtatttctggaatcatgcagaagaaatggatcaagacagtcatctccatggagagtggagaccaatggggaagaggtgaggtggatacttagggtttttaatcagatatccttttagctttttgagttctgtttttcttatgtattgactattaagaataacgatgattaattgaggggggaaagatcctaactgtggtggtaccatttcataggctggggtcccagactaagtaaaaaatcagtaggttgagcaccagcattcacctctctgcttcctgcctgccaacacaagagcggctgccccacactcctgtggccatacttctccacccttccctgtagcctcaaactgtaagccagaatgatcttgtctcagtttcttctttcctctcttttgtcaggagttgaaggctatttggttactcattatggc

SEQ ID NO: 1135 - DNA, 474 bp, Rattus norvegicus
  Genbank Accession No. AA964611
ttttttttttttttcttcccaaaaatattttatttattaaacaatatatccataatccatgatccaaaaatacagatatacatctttacattatttaataaaaagatttacaatagtatctctcctttacaaaggggaaataggtaataattccttgaagataaaatgtggcattcacgttaaagctggatcatccaatggatggagtgtggccaagagcgaacgccaccgcacattctgagggaaaagacacttcttagacctcccctactttaaagctcctctgggcacaggtagtggagaccaatctctgtccaaggaaacaaggtttcaaaacctcaaatgctcctgtttgatttcaaatgctgaagacctacctaacctcctggcataacagggccaaccttggcaccgtgatcacgtggacgagttgctctctgggtggtggtattgcttgaagcatccctgccaagg

SEQ ID NO: 1136 - DNA, 394 bp, Rattus norvegicus
  Genbank Accession No. AA964630
tttttttttttttttttcatttctcatttttatttgacagaaaagttgctttttgctgtacagattttaaaaaaccaaaatgccttaagaaacaaagttgggggggggagggtcttacaaccttgttaagggggtgcaacagggccaaccaacttcagctccttcttcaaagtcgtgttgacttaccaagtccccaaaccatcagtcaccctagaattcggaggactagttccctggatcatcacaatcctagatgtcctgagctgtgcccttccctccctaaactaacattccctcccactccaccccccaaaacacatgaaccaggaaaaactcacagagatcaacatttcacaggaacaaaaaaaaggggatggggggagctctcccctca

SEQ ID NO: 1137 - DNA, 439 bp, Rattus norvegicus
  Genbank Accession No. AA964653
tttttttttttttttttcatctattacaacaccaccactttatttgattgcgtgggagggctgatgggggagtaggatgtactgagtgactgtgatcactcatctactggagaaaatactatgtaacaaaagtaaattaggggcactactcctctgtcacagatgatttcctgggcttcagaacaaggtccttaatggataaagacagttcctgaagctccttccgagtagtattggtgacgtcatgttgttccttgtctaagtcatcgcttgacggatcctctccctgtccactcttcttattttgactgactaactgtttcacaaccaatccttgatattttaccaagagagtatgttgatcctctgggattttgttgtgaagaaaggcgatgatctgtgggacacatcttccaggtgcatggagcatgctgtgggt

SEQ ID NO: 1138 - DNA, 539 bp, Rattus norvegicus
  Genbank Accession No. AA964687
  misc_feature (1)..(539): n = a or c or g or t
tttttttttttttttttcaggtttaaaatgtgttcaattgagacagttcccaaaaggatgccacagatgtggacaggatgccacagacgtatgggagagaggagtactgcaactcagtaggagggtgagacatagtgcactgtgaggagggaaaagcacaggacttaagcaaacacaggaagtaggtggggcaatcagaggaaggattaatactgaccagtttccagttcttaggaatcctggcatctgtttttcccaccaggaggctactaaatttagaactgtttgggtgggcagggctcgttactgatgaacaaataaactcactggaccgttctagtacttgcgaagattaatcacaataggtgtgcttgagatacattaactttcanacaaattctgcaatacaccaggtactgacatagccttaatcacgtctgggacaagtgagaatgacctggtccctgaaacagtctcacaaaaacattcttaccagggacacctccagggtggcctacgacggctggggaaaatggagg

SEQ ID NO: 1139 - DNA, 503 bp, Rattus norvegicus
  Genbank Accession No. AA964740
  misc_feature (1)..(503): n = a or c or g or t
tttttttttttttttttcatcagtgaatttattttatttcactgagacaggaacaagatcttggtttctttatctgcaaagggcaaacatagaacacactggagctaagtgagaacagagcctggtgtgcagggctgcggtcccaggcagtgccgtctcagacaggagaaccggtacatgctggaggccatacagggtaacacagtgagattctgactcaaatactaaccgacaagtaacaagcaaaacaacggagagtaaggggagacaccgggttagggctgcagctcagtaactagggtacatgcatagcacacagcacgagcttcagtccccagcactactggtagagtacccgttaacccttgatttgggagggcaaaggaggactaagggacctggggatatagttcagtggtagaacacttgcctggctttgggaagccctggaccacagatagctttttgtcagatctacaanacagaaataactcacganacca

SEQ ID NO: 1140 - DNA, 571 bp, Rattus norvegicus
  Genbank Accession No. AA964755
tttttttttttttttttaaatataaacttccatatgatttattgttgttccttgtacacaagaaacagtaatatacaagttacactgctttagaatgtaaaatggataaaatgtgtacaaaaaagcacgttcctagaacacagggcattggcaaatagtcaaacctgggaagtaaaaagcaaaaccaaaaacaaaaccaaagaaacaaactaaaacaaaacaagaaaaaccaacatttcttcaattcagtgtgcaacatataaaaaacagaaatactaactctacaggcagtatttcctgataaattatttaaatagcatatctacatagtctgagatctctattccaatggcaatgagaaaataatttataaaaataaaagcaatggtgtacaagatgatagaacaaaaccagaactttgaggagttgtatttaacatttcaaagctatttctgtattgggatcattctctgcaaaggatttttatgctatgtacaacactgactttttagacacgacagtagttttaagtttattgacacttaaactctttcttcttgattcaaaatcc

SEQ ID NO: 1141 - DNA, 461 bp, Rattus norvegicus
  Genbank Accession No. AA964777
tttttttttttttttttcaaaataaatgcaaaatttaatgaaaacaaatgagtacaaagtggatggaaaggaacagaaacaagtccgtggatggaggcgtaaacggatcgacagctggagtggttttagacatgcatgggaacgtaacagacaagcaagctggctttcctgggcctcttacccaggggagtccacacaaacgtacaaacacacaaacatatgcagggtcagtctgcacagtcacagggtgccataattcacgccacccagcacaagggagaatacacatcctggttggcctgggatatatctgcttgatggctgttgacttgttttcttagtgctggggagagaacctggtccccaatcacgctaaatacatttgctagccatgagtcacatgtccggcatttttttttttttttaaattttgacatggggttttgttaagtgacttacta

SEQ ID NO: 1142 - DNA, 310 bp, Rattus norvegicus
  Genbank Accession No. AA964832
tttttttttccttttttagtttacaaaatgaattacggtcacttttaaacatcatgaaagaagaaatggatgtacacaccttgacacttttctagcattcttgaactaattcacaaatgcgagaaaataaaaaagaaaaacgggagaaatgaggaacataggtagttcggtgttaaaaaacatttgcaggaatgatgtgtattgttacagagagaagggacgcttccccttcctgttttgcgtgctatgagggtcatttttaaaacttttttttattataaacactattaaattcagaccgcttttttgg

SEQ ID NO: 1143 - DNA, 397 bp, Rattus norvegicus
  Genbank Accession No. AA964868
tttttttttttttttttgaattaacctatgaggttcattgcacagccgttgggaaagtaacaggaagttggcaacaagttctagccattagtcattccagacactagcagatggtcacagggacagaagaggtggtgtatgctggagtctcccatgcttgaggcaatgactaagcacagtaaaaagctgtttcatgatgctgaagaggcagggtctagtgtcactttgtggttttgttgtccactcctggccctctggtgtccacaatcatcttcaagggccctgttccagcctcttctggaaagtcaacgactgttgagcacacgactgttgagcacacgtggcagagatcaactgacagtcctgctatggcctcctgagcagccagtctgttctg

SEQ ID NO: 1144 - DNA, 443 bp, Rattus norvegicus
  Genbank Accession No. AA964871
  misc_feature (1)..(443): n = a or c or g or t
tttttttttttttttttacgatttgggacatttattattcaattgcttctgaagagttattgccgcagttaggaaaggacttggagacgatggggacattagaggagacaaaacagatttcaaagaggcaagtaccattttccaagtataaaactggtaatattaaaaggaacacgtcagtatatccacatgactagctacctctaatacagaaacaagacagtacaatgtttgcagaagttactgtggcacctactaagccacatgatatcatgatactagacaccctacccaccctgtcaccggctaggtatggcatgcacacataaacacacaatgaaagtcttaagttgcactaaggttcctaatcatgaattaaaatggctgcagcaggtcnctctgaaaaacaccagcaccccatgccagcctcgtgccgaattctt

SEQ ID NO: 1145 - DNA, 404 bp, Rattus norvegicus
  Genbank Accession No. AA964892
tttttttttttttttttgcaaaaggcaattcatcttttattggatcaggagcgccatttggagtgtgccattatgggaggctcgtagctgtctgtccttctccttcagcaaacagaggccaacgaagcggggtgtgtttacgcaaatccctgtaaggcactttacggttttcatagtggacagtgaggtacataggatataattctagggttcgttgctgttaacaatacaaaaggaggggagaggaggacaaggagggagtagcaccatgttgtgacggcggcagaggggggcatcactatgttcttctcatgcacacttggcagcggctgacatgcgtgcgcagctcccctgccttcaaggtggacggcgtgggcttcttgaacatctcgcttctctctatg

SEQ ID NO: 1146 - DNA, 547 bp, Rattus norvegicus
  Genbank Accession No. AA964988
tttttttttttttttctaagagcgctgaacacacctttattcaagtagaaatacaaaagcacgttcctaacccaaatgcatacatgtgatttttacagattctgctacttagggatgaatcaaatcctctgcctcagtcaccagaagtgactattggtcgctataaagtaagagtatacatgtttgacagggacagaaaaacatgcatttttcatttgcttttacatttagatcaatttgatatatgttaattttcttgccctgatgagacactatgcttgctgatggcaaagaagtaaaatacagtggtaggactatccctatcctaggttagccacaaggtttacagagtgagcagcatattttatatattggttgaggatccctagtgaacattatgacatctgaactatgaaagcctcaactgcttgattgacaactagaattttaaataacacttttcttattcacaagatgttattttaagatgaaaacaaatgctttgacatcatgtaaagaatcatgaactctatgtagtatatagggc

SEQ ID NO: 1147 - DNA, 408 bp, Rattus norvegicus
  Genbank Accession No. AA964990
tttttttttttttttttaagccagtatcttttaatcttacagatctacccatctggagctctcaaaaggttcaaaaagtttacccttcctagacctttcctacacacggggagaccaagtcgctgcagaaagcctgatgtggcccctgtccctccctgaatctgcaagtggcctgggacaacccagagaagttccataaacattgggtaccacatgtgtcattgcagttctgtggtcctgtctgggcttcagggcactggcaggcaggcaccaacaggcaggcaccggcaggcaagcaaacaggtagatatatccactggtattagggtgtgtggggcgcccgatgcccaccagcagccttggcattgcattggagttcagacagctaatgcaggaacggactccatt

SEQ ID NO: 1148 - DNA, 201 bp, Rattus norvegicus
  Genbank Accession No. AA965075
tttttttttttttttttgctgctgcagcctagacctttattaaaggtgacaggtcaagctatgctgaggaagagcagcttaggggtgggcatcgaggattggcactcacaggaggatgaatggctttctcctgttttctctggcctcacccctgctgccagtctcctttgatcctgttgctctggctgctccggctgtgac

SEQ ID NO: 1149 - DNA, 415 bp, Rattus norvegicus
  Genbank Accession No. AA965077
tttttttttttttttttgactgatcaagagtttactgtgagtggctcgaccgaaaaactgctgaagggatgggactcaggcaggggcaccaagcctgggtccagactggaactgggctcactgggtccagctcccgaaactgggagctttcagggcctgggcaggggtagaaagggcaatcccagtttcctaggaaaggcagacaatcctggcaggcagggcctgggaaatagataacccgtatgctgctgttgtgtacactgctgggttgtgacttggggccaatactgactggcctagagctctgccaggcacacctatggttatgcagccttgggggataaagttctctctcttttttttcctgaatagagtgaagcaactggtgaacacagaattcgtgggcctcgtgccg

SEQ ID NO: 1150 - DNA, 375 bp, Rattus norvegicus
  Genbank Accession No. AA965113
tttttttttttttttttaaaataaaccaaaaggaatttatttacaaaatgtcttatttcaacaacagttacagccaagaaacaaggtatcaagcaataatgaacgaagagactccactaatcgtgtttaagctattatgcccagagtagcttctcttgctagctagaaagatgtccctctgagtcctccacttgcacaatggcatcatttaaccaatgggggctgtgtgagcagcacagacatgtgtgggttcagctgagtcacaggtttcttgactttttctcctcccttgtttagttttttacttttctccttctctgttgactccttcctctttttctcctccactatcagctcctttctcagcttcctctt

SEQ ID NO: 1151 - DNA, 494 bp, Rattus norvegicus
  Genbank Accession No. AA965120
tttttttttttttttttgaaacactgaccctaataagagtcagcaagaaatacaggatcccttccctcccccggcctgcctccgctgaagccaccaccaccatctctgtggctggatgctggaagagtcctccatgtttgtggactcaggatgacagggcagcctccttctgtggttgttgggcttgtgaacgctgcagtatcttttggctttccacgtctctaaaatgtttttcaactattttgcgtacatggctcagtgcgctcccctctttgcctttacaattttccacttgatatgggggtgtgataacaacttcttccatgactacaatgtttttttcttgccatttacagtctttaatggtcttgtgaatggtctggaagagctgctggccctccagggagacgccagcgctgattgcataggcctggctcagcttctcctccttctccgtccgtgctttgctggcaagcttactaacattgagtgaa

SEQ ID NO: 1152 - DNA, 264 bp, Rattus norvegicus
  Genbank Accession No. AA965128
tttttttttttttttttgaagatatttgttgttgtttatttttttaaacaaaaatcacaattgttcaattttaccagtgaagacttgggagccagatactaaggcaaaagcctactagctcagagaggcagagaaagcgcacagctgaccttcttcctcggctgacatcctagaagtaatgcccctctcatgaagtctcaagctttcaaactgcatgtccctcaccttctactttctatgtgtctctctatccataataatcct

SEQ ID NO: 1153 - DNA, 524 bp, Rattus norvegicus
  Genbank Accession No. AA965166
tttttttttttttttttcagtaaaataactttatttcctaacatgataaacatatacatccaataggtgcccaccttacacatctatccacaaatgacttccatgtcccctcagctttgagagctaacatttagtaaaagttgtcttggttgggatgtgaggtgtctagatggctaaccttctgaacatattggaccagtcacagcggaatctaccccattaggtgagcatagaaattcagagcatggagaagttactacacttctgtgtctaatgcttccagatgaacaggatacagccgtatcagcctgcactcccaaggaatcgcatcagtttttctgatgatggaaccatttatccacgtccattggtagtgcgcaggcagactcacatggtggtggtaaagcatccacaatggctttggctgcatcaggatcacacttgaaggggctctcagacactgtggtgttcatgcaactgatccctttcccatctgtcttcttagtcactaatgccttccaata

SEQ ID NO: 1154 - DNA, 495 bp, Rattus norvegicus
  Genbank Accession No. AA965176
attttttatttttttttaagcacgggatcctgtcttcacatgatcctcagagtctatcaaaactagaattattacctctttcggaaaaaaagaatgatgtcagaggtaaaagtgggaaggtagagttggcacagattattagtatattctacaagaaagggatgacactggtgtaaagacagcttgtgtcaatacaagctgcaatacacagggcagacacgtgactccattgctctagagtccctctgtggtaaaactgtactatcctgcagcgtgagttcagggagctgtgtggtgtccagtaagggttagaaagtctctttgcacactaaacacacctagaaaatgctttctaataaagattgacatttggggaaaagtcacagttttaccaggcttcttgctgcttttaacaaatgagaaaaaaaataagactttaactgcagttccaaagcttctctaatccaaaaattacagtaccaaatgattgactca

SEQ ID NO: 1155 - DNA, 525 bp, Rattus norvegicus
  Genbank Accession No. AA965186
tttttttttttttttttaacccaaccaattctttattgtaaagatgagtgctacaaaggaggcctagtgtgtagggagtggggggtcaccttctttcaagggactccacaaggtccactagagatgacatatagccaaggaataagcctgagccagggcagcagtggttctgaactctattggaagttggggttctgaatcaagcccactgacccaggtccatgaggaagtgttcaatgtcatcgtagagactattggtgctagacaagcacaggccaagactgctgctgtccagagaggacacaccctcacgctgcacgccttccagatgtgtcttgcacagccatggctccagcttcaccaggatcaggccacctccctcgggccacagcccaggccttgaagatctgtgcatcagcttcatccagatccctacggctgaaatgcttccagggcacacggaagactgtgtgagcctcattcagccactgcagcccctcgtaccggccactactgacctcaccc

SEQ ID NO: 1156 - DNA, 519 bp, Rattus norvegicus
  Genbank Accession No. AA965190
  misc_feature (1)..(519): n = a or c or g or t
tttttttttttttttttgccaaggtatatacacattttatttaaaaaagtttacagttttcattatacacaactattaaggaggttatagtcagaggaggcatttgtccaggtgacagacatgcccactagatcatcacaatgcaaggaaggcggaagggaggagatagggccagggggggaaagcagtaaaaagcttagatttcaattaagggctggtaagtcccttttctcttcaagtatcacgcatgtgtaccaaatacaatcagtaattaaaggccatttcttcccacacccacagccgagtaattgctaaaccaagagccctggccactcctcaggtgagcaaaatgctgcacaccatggctccccaagggccatcacaccatccaattcctaaagagctggccaaggtgttcagtggccanaggaagatgaacatggattcagaagtccaaagaatgcagttctttgtgcccaatcagaaatgagttggtttccctcgtgccgaattcttggc

SEQ ID NO: 1157 - DNA, 352 bp, Rattus norvegicus
  Genbank Accession No. AA965213
cggccgcaaaggttttttttatttatttaaaaagttaaaaagctacatatcattatttaacaattattttcccagacatttctgtcctttaagtatgtgcataaataaaatttaaatcatcaatatcaatcttaatacatcaaaataatatatttacagattttaaaatttaggtttgtttatactcaaataatttaatgtaaaattcagaaccaaaattactacgtaatgatgacctaccggagactcagtctacctacggcactaagcaggacccatgtctggattcacagacattcttccaacaacattcccaaatggaacaggcctgtcctgtctatgcctcgtgccg

SEQ ID NO: 1158 - DNA, 566 bp, Rattus norvegicus
  Genbank Accession No. AA965219
tttttttttttttttttggggagaaaaatcacatttattagttaagacgaccacaggctggacacaacacatgctaaaaagtggactgtcttttaaaacttcaaaggtatttttttccaagccccacaatcatttccataattatttacaaaataaaaggtccacattaagacattgaacagtaaaatatgtaataaatgctccaatctacacctatacttaaaaatcatgaatttgactagccatgccattgaaaaccactcgagtactagaagatgaaccagttttcaatgttatcagccctggaaaacacgcccagctcccacccccagcacattctaatttgttttaacattttataaataaggcattaacaataaagcccatttaaaaaaaaaattaaaagaacttcctttaagacttttgttctgggcaaaaccacagttttctgggaagacatttagacctccttctagctattctgaaataaagctgttagttggtgaacttacgtaaatctaaagctttcccatccttctagctgtagcccatgttgaacctcgtgc

SEQ ID NO: 1159 - DNA, 392 bp, Rattus norvegicus
  Genbank Accession No. AA965251
tttttttttttttttttaaaactaattcacagccactggtttattattgatcacgggggcatttcacatcaacactaaaattctttattgcaagttttacaataatcaagtaaattcagtccaaaaacacaataaccacgatgggggtaggggagcatctacctatagactgcctctctgaactgaaagttcatttttatttatttatttattttttggctcctcaaactgaacagctcccagaggctctccagatgcatttagctttgtttgctgtcctcccccctcctaccacccccccacaagaatacaaaagaacttcatagctttgttctccttaaaatgactcccccccctcactaacctcccctggtgcattttcaatgcaaaag

SEQ ID NO: 1160 - DNA, 408 bp, Rattus norvegicus
  Genbank Accession No. AA996422
tttttttttttttttttggacagcaaagcccacactatatttggcccagatataaattagatcacattcaggtagtgataaattacagacaaagataggaccagtagacaggacacactccacaagaggacagtctcacttaaatacagaggacatgctacactgaccataatttacacacagttctacagattgaaataaaaaggaaaaactacatcacaacgaatttcctttgaacattgaaaatggtgtaaacatgatcatccacactgagatcacaaatggctatctgatgcacttgtatgcagttttggcagaagcaggtgagcgggtggcacaatggtcctatgaagctgccaggcaggtagacaccctggtccacaccaccccagtgtcacacttctgaag

SEQ ID NO: 1161 - DNA, 541 bp, Rattus norvegicus
  Genbank Accession No. AA996471
  misc_feature (1)..(541): n = a or c or g or t
tttttttttttttttttcagtttatacatttattatagaaatccccgtccagtgtgagtagtgtcttgggcccagatccattggtacaaaaagaaaaatttaaacaccaggtaaagggggtaggggaacccccagctccagaaagtcacagacaatatagaaaacacaccttatgtggatttgtttaaaaagtgataaatagaaggaatgccaaggaggacatgatgtggcctgtggcccatggccagatgtcacctgagggttttactggcatgtactagttgccaggtttaaccactgcagcatcccaggatgcaacatactcaaatggctctgtttcttgacaacctcttgtacggccttctcattggggaaggtcatcctanaggctatgggcagagacagagatataactccttcaggtaccctacttagactcccatccttccaaatgtagacagaagcccacctgctcgagaactctagtgggaggaggcagggagctctgttcacagcagtcctagtcccgagactctatgtg

SEQ ID NO: 1162 - DNA, 533 bp, Rattus norvegicus
  Genbank Accession No. AA996523
tttttttttttttttttagatgaaatgctttatttactttaaaacattacaaccaaatgcactttgtttgtccgacataggaaaataatcatgagtgacagtgatataaacatttgcgttttgacgtcacagacaaggcacaaaaacgacggggcaggtgactctcgtgaagtaagcaactttatccttcttgtcttctttatccccctctagatctggatccccagttttacctaaaaaaaaataagaatgtatctcaaaatgtagtgaggacgacagcccctgccctcaactgtggaattccgagcctggctgcatttgtagcttggcttagaaattcctctttgagaagaatgcagagagtgtctaacatctttattaataaacatggcaagagagaagctatgggtgtctcccaaccttctagatagaaggagtcagaccacatttactcctgtccactcagccccacagaaaactcaaacatggctttttagctcaactgccacaactttatcccctcgtgccgaatt

SEQ ID NO: 1163 - DNA, 330 bp, Rattus norvegicus
  Genbank Accession No. AA996581
tttttttttttttttttccttctcaaagctactatttattctgtacaaggctccactgtaactagacattctactcttgcttacatagtaaacaagtgtacaccagcccttgggctcacgtcacaggtcttccctagagaaggggatcaggccaggcaaactcggggtgtcttttctagggtgccttgacctgggacactcaagcactccaggttctgagggcataagccaggcccaccagtgggtgtgcaaaatgcactgtgcaaaatgccgtagtgctgagtagcctgactcttgggacagcatggagtttttttttttttttttttg

SEQ ID NO: 1164 - DNA, 354 bp, Rattus norvegicus
  Genbank Accession No. AA996688
tttttttttttttttttaaggcttttttttttttatttcagccacggaatgatgcatgctacagagtaacctttactttcccccacttggtttttaaaaagtcaccactattttcaatcccgaaagaacatggcacttgtttgtttttccccgcctcaatcattccagactttcaagtgttttcttcaatactgaggctttctcctgcagctctggcctgttgtctgtctccatagtagctaaagactcaatcaaaagtcttctgcattctgctgtcaaacattcccactgtttaccttcttcaagttttttaagcagtaattcgatcacagataaagcttctgttctcacaca

SEQ ID NO: 1165 - DNA, 203 bp, Rattus norvegicus
  Genbank Accession No. AA996782
tttttttttttttttttgcagttaaaatcagtgtttatttgaatgtacaaaagttcccagtagtaaaatgtatattacaaatcataggcagaaaagaaaaagtggaacacgtttggcatgcatcttataaaagaaaggatctgtagaagctgagcaatgtgtgcagtgcaggcggctcccagtagaagtgccactccggtaac

SEQ ID NO: 1166 - DNA, 212 bp, Rattus norvegicus
  Genbank Accession No. AA996814
tttttttttttttttttgcaagagctggactctggtccctttattgagacaggagccagtgggtccatcaaaacaaaaataaatttctctcccaaagcctgccagcaggctgacacacccagcatgtcctggctggagcccttggctgccccccaagagcacaggtctggctcctttggagtcaagggacactaactgtccacctcgtgccg

SEQ ID NO: 1167 - DNA, 505 bp, Rattus norvegicus
  Genbank Accession No. AA996829
tttttttttttttttttccggagctggggaccttggctaagctactgctctcccccaaccccccaggttctgtcaggcaggactttccttttcattagtatctaggtggctttcactccagcttccatcacatacttccaacatggggtccccatccctccgcagcagccagccctagttctgctgtggatgcgctggggaggcattgtgtatactgggggagctcctgcagattagagattctgactttgtgtttttattctccccactcaggatcgctacggttcctactgatccaggctccatggctcaggcctgtggtggtgacagcaagaaccctgattcccaggccagagatgcctatcttgtggatctggggattttgactttgtgtgtgtggtgtgtgagttggatgagttgggggatcttggcaacgggaatggtcagcatcagcccttgtcctcagcctgtgccttgagtccttgtccccatccctcacactttc

SEQ ID NO: 1168 - DNA, 130 bp, Rattus norvegicus
  Genbank Accession No. AA996846
tttttttttttttttgtggactcaaccagtttaatgaaagatgcccggaaccaagacgctgactttgaggaatgtgggttccctagtgacaactgcctctgtccatgccttgcttcctctcgcccaaagg

SEQ ID NO: 1169 - DNA, 495 bp, Rattus norvegicus
  Genbank Accession No. AA996885
  misc_feature (1)..(495): n = a or c or g or t
tttttttttttttttttcacagtaccaagctttattggaagcactgcagtctggccgtggagaggcgatgttctagccacacaaactgtcatgctcacactcacgttcacaccgactctctaggcacagactgggctaggtcaggtctcgggcagatcgggaggcttggtcctctcttctggtccttggtttcctgggccagagtgagtcacatctcttcactcaagacacagggccccttttggtgctgccgcctttgctcttggaggaagacttcttcagtcttcggatgatgcgttctacccagggctggtctagaggtgcacagagctggtagccccttagtgtggtgaacacaacagcaggcaccctgcagccatcttggataagaaggtancggaaggctttcacgatgttaccaaggatggggcgctgggtcacagacaggcagcagtcttccgcatcgttagcaccccccagagctggggctgagaa

SEQ ID NO: 1170 - DNA, 489 bp, Rattus norvegicus
  Genbank Accession No. AA996899
  misc_feature (1)..(489): n = a or c or g or t
tttttttttttttttttaacaatggaagacactttattattatttttttaaagtctctcaacatttcaactctgtagaaatcaaatgcaaaatatgtgcatttttaaattagcatatactcaactatctggatcacagcactctcctatagtgagacacacctcggagggaagaggccttgccagtctgtacacagtatttcctggtggaaagcacactggacttcctgaggcaacctgtcccccatcttaagagagtccctgcattgctggagtaactggaatggaaaaccagagctctcaggaaagggccaggcattgccagttctgaggtgtggaacatcaaagagctgcccaggaaggccagtctcagtaataaaattgcccaaattcagctgtatatacacctatctacatgtggtctatcagttagagattaananaagagtcatataagatttggaaaaccttaaaatcgctcctgtaagtt

SEQ ID NO: 1171 - DNA, 261 bp, Rattus norvegicus
  Genbank Accession No. AA996927
tttttttttttttttgtaatatattatttatttgtcctttttcctgtcatcagaaaccatgaaaaaaaaaaaaaacaaacgtgggtttcaggacagtggaacctagctggccttattcacagctgtatcctcccagatactggcccgtggcatatgtggatatcaaaccgatactggggatgaaataaatttcgagagaaaatactgcaaatgaagaggaagacttcaactctgacaaccccccggggggggggggggggg

SEQ ID NO: 1172 - DNA, 261 bp, Rattus norvegicus
  Genbank Accession No. AA996933
tttttttttttttttttcagtacatcagaaggacaacctttatttaaggctactattaaattgagagagtcttgtatattttgaattttgtgcaggagaaaggaaagccattcttctagaaggcactaattggtttaaatatggaaaactgcagagtccagtccaggaggctccctggttcttgggttgtacgtcttactcttcctgtggcttgggtcttgtccgagaacggcatcaggtacaggtgctcccctcgtgccg

SEQ ID NO: 1173 - DNA, 419 bp, Rattus norvegicus
  Genbank Accession No. AA996944
tttttttttttttttttgagcaactggcgggttttatatatttatttccaagaaatgacatcttgttttcataaaaaggtaaaccagactctcaaaatgcaggccaccttccatgcagccatagggcgcacccaagtgtccaaggcgatgtcaacagggtgcatgaggtatcaaaaacaatcaacaaatgaagaaacacagaactcaactcatttaacacctagtgaggcagtcactccgagtgggtgtcccagcagcactgtagagggtgatgtcagcagcagggccagcagacagaaggccagtgacacagacttcctaagtctctgcagcacacggcttccgatgatgtccagagcagccaaagggaatcctctagaacgcgccaagctgccatcttcctagtctctcacatgtcc

SEQ ID NO: 1174 - DNA, 516 bp, Rattus norvegicus
  Genbank Accession No. AA996954
tttttttttttttgtttgttaatactttattagtattttctaacagacagaacataacacaaaccaaataaaaattttaattctgtagttaataaaaataactgacattctgattctttccccttggttaaagaaggagagcattgatagagcggttaggcacaattgacacttatgtacaatgatatgcacaaggtaattttttaacaattaaaatcctaaaatgtgctctttagttttcccttataatacaggagccaggctcccataagcgaaactttctactaagaaaagaattttacaaggagtgacaaaaagacttttaaacaagtccttaattaaggtgcggcaacaacggaatgaagttgttgggctaagaagacagttaaattagatctcaaacattaaaaatgtagttattttacagttactcaaataaacatgcattaaatgaaaatattgcacaaaattaaaactgcagattgtgaaatttatgttgttcttaatttatttttt

SEQ ID NO: 1175 - DNA, 529 bp, Rattus norvegicus
  Genbank Accession No. AA996955
tttttttttttttttttaagttagaaattgaccaaattgtccaaataatgatggtgattttctccccatctactctggcaccgccacctagtggcagattcacagcagccacatagaaggtttggcccagctctgggaacttgatggtggtgcatcaaattattttactaggtaaatgcactagtacacaaagtttccaggcaatactgattaaaataaaagaaacaacaaaacagcctacctcttatgtgttaccaaaatgtactttgctttgactcatttccctactcattcctcattacctgggaatggcactcagataacgaggttatcacaggaaaagaactgaccacttggagataaatgattctcaaggcagacagtaaggaggtgtgcactcctcctgagttccctaagttctcagcacagaccacagaacatctaccagcacagaacagctctactcctcgtaagcacatcattacagttagaaatagtcatatgttactcttaagtttataagcagaaa

SEQ ID NO: 1176 - DNA, 464 bp, Rattus norvegicus
  Genbank Accession No. AA996974
tttttttttttttttatatttagtgtacttttattgctcagcttattgaccagaggcataccctgtgttccaaagatcaagtcctcaagcgtgccaacagtactgactccagtctctgtcacatcccaaacacccatccagacaagtcagggactgcagctgctccctgccattttcaagaagagacaaactgaaattcctaacttcttaaggatcttcctacaaatgattttattataaatatttctcttggaataaacaaaggctgtattcagcactatcttccaacttgttctaaagcagaagagaaaacatggaatccagaaccatttagaaatcaagataaacagcagacacctgagtgccatgctaagtgtctttctagtaaaataaaacaaacaacccagaaagttaaacaggaacacccagtcccactagcctgctggatgaaaataatgagtttg

SEQ ID NO: 1177 - DNA, 235 bp, Rattus norvegicus
  Genbank Accession No. AA997030
ttttttttttttttgttggaataagccactttattgaatggtctctttcatgcctccccaaccccaacttctcgtcaggtcagaatggctttgggttgaagtcaccaatggtctctccttcctgtctctctctgtccacggcaccctgagattcagtggtctctgtggcatctgggagtgggcaggtaaccgtgagatcctggcatggtgcaaggtgtgccggcagctgacataa

SEQ ID NO: 1178 - DNA, 513 bp, Rattus norvegicus
  Genbank Accession No. AA997048
tttttttttttttttttgaagatggaaattttggttttatttgaactgactgtagtagataataacacaaactatatgcgttttttcaaaatcagcagcctaggcacatcagcgatgacgtaacctttgaggaaaagaggagcctccacccacttcatctcaggggagcgtctacttctagtgcaaagtatgtgaggctccagccttctatgcccgtgcatcttgctacaccttagccaagctcctagttaaccacgaaagcaggaaaattgaaattattctgggtttttgggtcttacaatttaaatcacaacatctctaaaaagataggtcaactctaatgcttctaaagtgattttttctttctttcttttttttcggagctggggaccgaacccagggccttgtgcttcctaggcaagcgctctaccactgagctaaatccccaacccctttttttttttgcttttttaaggtttgtttttaaccgttgtgtatgtgtacgtgtggagg

SEQ ID NO: 1179 - DNA, 358 bp, Rattus norvegicus
  Genbank Accession No. AA997062
cggccgcgagattttttttaaaagggatatattttcttgcacagctgtttaaagagagagagagagacacagttgcagccctcaaggctgttctgtgccttacaggcacacattttctagctcagacaactaagaaaagccacagaccactctcaagttcttactctgcacagtttcaggtcaggggttatttccctggtcataggccctgttcagtgttcagcgagtgggcaggtacggatctgacaggtgggacatgatgtactaaaatgttactttgtatcaaaaccaaaacagacttcagtacaacaaataaaggtcagtttgtgtaaaaaaaaaaaaaaaaaacctcgtgccg

SEQ ID NO: 1180 - DNA, 318 bp, Rattus norvegicus
  Genbank Accession No. AA997096
tttttttttttttttttagcaaaaatgtttaatctctccttaatgtgtgtttatttacaagtactaaatctgaagaaccgtaaaataggaaatagcggtatatttacacatctgatggctgagcgtattggctctgccgcttccagagaagcaatggccgaggcctgatctacttagaccatccaaatgaccagttttttttgggtgggtgggggttgggggaagcaggtaagagggagtgttctgcggcattaaaggacagctaatcatgggtttcaccttataaatatctttctctctctaaatatatctactcta

SEQ ID NO: 1181 - DNA, 396 bp, Rattus norvegicus
  Genbank Accession No. AA997237
  misc_feature (1)..(396): n = a or c or g or t
tttttttttttttttttaatggggcaacatttttatttctgtacattgacatacaaattttccccaaaggtacaacagatgcgacaccatgcagacacgcagctgtgaatgacagttcagagctcaacataaacttgtgctgtgaacaggtaccgcccccgtcgacacatacagtcacgcggctcttaagaggaaaagcacacatggttgggttgcagaaaggacagaggtanggaagcgttcctcactagacacaacacaccatattgtttttccaaaacacacacgatacattagagtgaggtggtgtccttcagaacagggaggagttgaagtgtgggcctccctcaacccatgtgccacccaagggctgggtgtgtgatggtcacgagattc

SEQ ID NO: 1182 - DNA, 510 bp, Rattus norvegicus
  Genbank Accession No. AA997297
  misc_feature (1)..(510): n = a or c or g or t
tttttttttttttttttctttcccctccatctctcttttttttattctaaataaaaaccacactttgtgctgaacaatggaatagaaaagaatcagatgtacgattttagacgtctactgttttggggagggaaaggtttacaaaatatacaaaactttacagcagatagtaaacacttaaatatttaggaggtcagtacttcttaatttaatggaaggagttagacagcaacggcctctctgcctcacaggagacttgagctactccagatggggtgggtggggactggcagaggggaaatgtcagggtcactgccacagggggcgtcttcttagacactgatcatgacgtaccatcacacggagatgtatacgtgcacccactttcggtctcacttgatgtgactgggacgtgtacacactcccagccaggcaaagaccatttcatanggcccactaccatgccaacgaattcagagtccatgtataaagggatatgaattcactttc

SEQ ID NO: 1183 - DNA, 483 bp, Rattus norvegicus
  Genbank Accession No. AA997338
tttttttttttttttttaccctgaacataaatggtctttattgcagaatgcatattcttgtgattcaaaatcaataatcttaaaagtaaaactaataaaaaatcaacatgaaaatgttttatttaaaatagttacaagaggcaaggagacattgaggttttaaagatcaaaagtaagtttccaagctcaaaaataaaactaaaatctcatattgctattatgttcaatgacaaatatttgaccagcagattgtaattgtacaataaataaaacggctttctaagttttcttctttaccaagaaatcatgagctgataaattaacaagtggaagttaatccttattaaaaaaggcacatccaggcaaacagttccggtgattgtaaaatgcagtgttaaactctgtacataatcaattaactgcaaataaattactttggaaaattcttaaacatgacaggaaagtctttgaaaatgcaagcaa

SEQ ID NO: 1184 - DNA, 497 bp, Rattus norvegicus
  Genbank Accession No. AA997342
tttttttttttttttttgataaaaagctgtttactgtctgacaaagtcaagctcacaaagaaatttccttgagtttaataaagatgctaaaaatgttactttttaagtagttaacttttttttttttacaaagttctgtacataaaataaatatacagaagcaaaccccatcaactgtgtacatcagtaatcctcactggtgggctcaccatttataaggaagacatcattcaacgcatcctgtcacagagaccaccctgtctgtcatcaaggacttctgccccaaagggccatcactgggcctcctcgatgaagtctgagaaacagcaagaagcctccaacctactgactagcaagtggccacaaaaccaatagctgtctcgtctagagtgtggcctagtggcaatgtctatgaccaaagcccttaaaatatgaggtgttcagaacagaaatcagccctacctctccttggccagtcactgtgaaagtgtgcgtaa

SEQ ID NO: 1185 - DNA, 468 bp, Rattus norvegicus
  Genbank Accession No. AA997345
  misc_feature (1)..(468): n = a or c or g or t
tttttttttttttttttgctgtatgaaaataatttttaataaaaaattttgaaagtgtcatgtcgatgggctattagaaccatgaaagttagtgttcctgtgaatgtaagttttctcagacagctaggaccagcccaccacaaggtacgcgtggaaccaaagtgcttagaggcttcggattttaattgtgcaaaagatcttgagcctaaaatgcctaagaaccatcaggctaacttgttaagagctagaacattgttaccaagcacatttgaagacggatcttttaattaaaatagggggcctggtgtcacagatcattggtagaattaacatgaaagggccctatcccaaaaatgatttggtagagtggtagagttgctcgtcttacagaacatcattctgcttgtgacaggttagaaagccattaaggcttctttgactccactgaatanaggtctgctcgtttct

SEQ ID NO: 1186 - DNA, 472 bp, Rattus norvegicus
  Genbank Accession No. AA997412
  misc_feature (1)..(472): n = a or c or g or t
tttttttttttttttttcaatttgttaaatgaaattgtattttgcccacggctgcttctgtttgatccccagggacagagaagcaggggaagggaggggtggggagagccgcaggagtgcccaggtgcaaggcgggaggggtgtccttgatgggaggctgcaggcttgggcaggaaagaagctcattgcagggtagagatacatcctaggcgggctaggtacccaggacgagcccagccgagcctgggcagacgccgccctgaaccctgctcaaaactcacactaatgggccctgccacgttgctggcactgaggccgctgctcgctgttggcacacgtcagacacgatcaacacgtagcctgtgccacacccagtcgggcatggggaggggcaggaggagaaggggactgacttgggctttttgggtcaacccaaactgttgcctgctgccttgagttccctcncccacgt

SEQ ID NO: 1187 - DNA, 340 bp, Rattus norvegicus
  Genbank Accession No. AA997555
tttttttttttttttttaacaggaagaaagtatttaatatgaaacaaaaatgcaaaacaaagtagtaccaaagtcacagaacacaatccctttggttcagtgatcgcaccaatatttcatgttcccactggctacagacctcttaccctaaagtgaagtcagactgccccaaaccaccacacaccttactgctcagcgatattgtttgtaacttatatggggtaagaacaggggaaacagcttggtttgaaaaggggggggggggactacacgtgcggaacaagtcactgggagagagctcgccactgggtcaccattacaaccctatacatgctacatt

SEQ ID NO: 1188 - DNA, 284 bp, Rattus norvegicus
  Genbank Accession No. AA997599
tttttttttttttttttaatttccaaaaagctttatgtgaaatattctagaagccctttacaagccaaagcattataattcaataaaaacataattttatagatatatttctctatacaaaaggctgatcgttacaaaaattagaataaataattggaaaatgagtgccactgatttaaaaaagatatctctgattgcttcatggtgaaatgccttctatgtcaccaaaagatgagggcgcggacagctgctccgagcccgggctgtgagtcccctgcgaagat

SEQ ID NO: 1189 - DNA, 460 bp, Rattus norvegicus
  Genbank Accession No. AA997699
tttttttttttttttttcatggttttgtagtagttgttttattcagtactttgtaaactgagactaatacactgacattcaaggaaagcacttctttacactgtcacatcttggcataggttatgccaagtaccagaacattcctttttacctgtcataagtagtgggtaacagtggggatagatccttccaccttaggaacgtcatggtcatgtcacaatacacctggtttagatggagcaccaaaattccagaggacatcctacccacgttctcaatctcctttccccatgaggtcctgacggacttttccaccaatcaaatccgagatgctctaaacctcaatacttctattcagttgggtgcaatggggtcgacatggaagatccctcatctcaatttacaactttaggactaaacaacgttgagtagggtaggtgaatgacatccgaaatcaagc

SEQ ID NO: 1190 - DNA, 459 bp, Rattus norvegicus
  Genbank Accession No. AA997716
cggccgcccacagcatacagcagcccgcccaccacgcagcccgccagcccactgcggggcacctgtaggtctgccaggcgcagccaggagccattgctcgggttgtaggcctccaggtagctgagcgactgtcggaagtaaccgcccgcagtgtagatgaggcggcccactttgggcgcccggcagggcaccgcttgtgtgggcttgtgcagcgtgagctcctggaagatctgcaccaggtagtccttgcagcgcgcgtcggcctgcaggatctcgcacttttgcagctgtgtctgcaggaagcgtggcgtgagagcgtggcagcgcacggcccgtagcagtgcctgcacgtagaagcgccgctgcgggcagtcgtatttgacccagtcgatgcacgcatggaacacctcggactcgcagcgcacgttcagatcatcgcggccctcgtgccgaattctt

SEQ ID NO: 1191 - DNA, 370 bp, Rattus norvegicus
  Genbank Accession No. AA997765
tttttttttttttttttactttaaacccaggagactttatttcacctccagaaaggcctctccagcctcaacccacacaagaacacaaaaccaaggtgtaaactaaaacagggagggaggggaggatcactttgttgtgacatcatgacattaacccctggttggcaggaatgacggagagcggttttggcatattgcacaggcggcgtgatggaggctgcgctggtgatcctctggtggctgaggccgtttccttgtcctccccaacctcagtgcacacgcgggccagtctcagaatccactaccacttggtgtagatgtttaacaagtctttggtcttaataagcaccattacaaaccctcacattaa

SEQ ID NO: 1192 - DNA, 428 bp, Rattus norvegicus
  Genbank Accession No. AA997788
ttttttttttttttgttgctcaaattttctttattaagaaaatatttcatatataaacagactgatgaactcatttttgtaataagttacgcagcacatatccttttctctaagcttctcatgcaaagttagaatgtttttcttaaagcagagcaagtcagtgcaaacggtttcaaggcagagctggaagtcagcctagaaaggaatgcttacaaagccaattacactccaaccccatcctgccacactcccccaagtgcttcactgaatctctatgagaatgaataaccctttaaatgaagtcagatcaattactggcgaagaacctataaactaacacaatgccattcatcttaggaacacactggtggtctccgggctctatttacattaaaaaacaaaacagaaatctgccctcgtgccgaatt

SEQ ID NO: 1193 - DNA, 382 bp, Rattus norvegicus
  Genbank Accession No. AA997800
tttttttttttttttttggcagtgaatttcacagagctttattgggtaggacagagggccacatttctacctgtttacccaccaaacatttaaactgctattgctctgagagatccctggtgatcttcatgatctccattggagcttgaagagagtatgatcaggaaagctcaaagcttccttccttaagcacaggcaatattatttacagttcaccttcacactggagatgaaaatcatactggaatctatcactaaaccaaatttacttttccttcttaaatgtctttgctacacagtttcacttttctggtgacttcttgttcttaatatcttggtgtatacaatgtcttcatccttcttcagagtttttgcatctttc

SEQ ID NO: 1194 - DNA, 366 bp, Rattus norvegicus
  Genbank Accession No. AA997806
tttttttttttttttttcccatacctattactttaattaattttcatgaacaatcctatataggtattatccctatttttttttctgaaccagggttaggaaagccagattgctcgcgatctaatatgttacaatacaaatgagccaagttgaggggtatgctacacaataaggaagtatttatttgctttcccctccctcctactttccatcccgagtttgtcaagataactcagatcttgatttttctctaacttgtaaaaatatgtcatcttgagtttgggctgcttcagaattcttggtctttgtgccagcttggttgcaggtgtagttcctatgcgcttcctgctcttgctgttgactgca

SEQ ID NO: 1195 - DNA, 540 bp, Rattus norvegicus
  Genbank Accession No. AA997883
tttttttttttttttttacaaaaatacagatttattgtgtttcaacattcttgcaactgtacagagaccaagacacacaaacgtagtcttcgtgttaaattatgaacaaattgggaaagcctcagggagtctaagctgctacggtgagaggcactccgcctcaaccccaccacagtctacagtcgctggttaatgctatggcagcaacagagaagaaagcaacgtaaggttctgatggctcagttctgtactcccagcacttgggaagctgaggcaggaggactgctacaagtctggaagtagcataggccacaccgtgagttctaaactgggataggagacagaataagaccctgactcaaagactaaaattaaaaaaacaaaaacaaaacagccatggtcttgatgtccagaggccacgggtgtgcacatgacctgagaagtcatcaacccaaagacaaacgatccaggatgcttggtcttccatggtgggaaggtgttgtcctaagcccacgagtacatcctgcaacaacaaaacct

SEQ ID NO: 1196 - DNA, 398 bp, Rattus norvegicus
  Genbank Accession No. AA997904
cggccgctgccgccgcctgccggggcatgtcgtggacgccggcagagacaaacgcgctcatcgctgtgtggggcaacgagcggctggtggaggcgcggtaccagcagctggagggagccggcacggtattcggcagcaaggcccctgggccggccatgtacgagcgcgtgtcccgggccctggccgagctgggctacgagcggaccccgtcccaatgccgggagcgcatcaaggtaaccggccgctctgcccggggcagcgaaccagaggcagagaaggcggggaagcgggcctgggggcgggggccgggccgagcacggggctcccctcccgggccccgggtaccccttgtgtctgctccgcctctttcttctctccctgggaaggggcgcttcttt

SEQ ID NO: 1197 - DNA, 390 bp, Rattus norvegicus
  Genbank Accession No. AA997905
tttttttttttttttttcaaattataacaattttattatttaacataatcccaatgtatatacattatcctcccaaataagaaaaaatttaattccagagtttaaaatgtggtttccaaaatgaatccttattgtaaattttgaagaaaaaaaaaaaaaacccctgaaaactaattctaacgttaaattttgatctttgactaaaatacacaccttataccaatcagctctctcatacaaaaatgcatattataaataaaactttcaaaagtgatcttggatgttttattgcacatcaaagagaagatctgccagtctgaatggctctcagcctctttttatcatgcagtttcaaaagctactgactctgggtggatacactgaggacat

SEQ ID NO: 1198 - DNA, 391 bp, Rattus norvegicus
  Genbank Accession No. AA997928
tttttttttttttttttgacagcacacacctttaatctcagcactcaggaggcagaggcaggtggatctccgagtccaaggtaagccagatctacagagcgagttccaggacagccagggctaaagagagaaactctatctaagcagagaaactgtcttgaaaagcaagacagaaaaaactaatgtgcccaagtggacaacccgcccactcctgatggaaggaatggtggctgggtctcctgggtaaagttatggcaaaagccaaggcacagagcactcagagctgatcctgtgtgtgctgatcctgtgtgcacggaaggacacacgggcttcacatggctcgcaaatggattccatggaggaaagacttggtgttccacacaaggaatgg

SEQ ID NO: 1199 - DNA, 457 bp, Rattus norvegicus
  Genbank Accession No. AA997958
  misc_feature (1)..(457): n = a or c or g or t
cggccgcaaaggttttttattagtagtaattacccagtctcctgggaatgttgggaaaagatgtcaaattattagagatatagaagcacatagcttctggtcttatattttaatgaaagaatacagacaaaatacaaatttgtattatttgagctaagcaactgctggaataaaaaaaaatgtgttatttccacccttttggatatttgccccaaagtgtgaaactcagcacatttgtctcagttttatgaatcggtaacatttgaacttttaaaaacttatttatgggtctgtgtgtacctgcttaagtttattatgcatcatgtgtgtgcaagggccagagagggtcggaagagggtgcctgacccacaggaacggaggtacagacagtttggacctncatgtggagagcagtaactgttgtccactgtgttgagacaacgtatctggggtactg

SEQ ID NO: 1200 - DNA, 493 bp, Rattus norvegicus
  Genbank Accession No. AA997980
tttttttttttttttttaatgtactttgatgtttatgctgatgagttttatgtacttttggtggtgtttagtcttatgaactcttctgacgtcaggaaagtaccactggtagtttgcagtctcattgtgtaaccagcctaccacaggcttccatgtataataaagtaattaatactgtgcaagtgtaaaacacttctgttataaaagcagtgtttggaaaataagaaattattaaaaatggttacaaaatactagttaattccctttttccacctcccaccttttagctttagttagctaaagggtaccaacttgtcattgaaagatttttagaaaagtgtttaattcttttaatacactcagtactaaaatgtctgtatgtcttattaagtgcagtaagttctattgggtacagagacaagtgtgatcaaagatggaaaggacctttacccctgtatctcttaaactggatgatttctctctctctttggtt

SEQ ID NO: 1201 - DNA, 424 bp, Rattus norvegicus
  Genbank Accession No. AA997990
tttttttttttttttatagaaaggggatttatttgaataatttacaggctatatggtctggctaatccaatggcttgctataaatggaaaattcatgaatccagaatccccttagtccatccacaaggctggaggtttcaactggtcttcagtagaggtgctgggatcctagtgaaggaatggacttgctaacaagctgatagcaagaaggcacagagcaaaagcttccttcttccacgtcgtcagatacgctgggaaattgaggagactcaccactgtggacgagtgggcagaattatagcaatgctcgactctaaaagctctactgcagctctacaccaatgttcttatttccttggaagattatggccttttcaggacaccaacgggttcagaacacagcctgtaacttacttgcaactgg

SEQ ID NO: 1202 - DNA, 507 bp, Rattus norvegicus
  Genbank Accession No. AA998062
tttttttttttttttttcagcacagacgcattcacgcctttattacattttcttagcattccaagtcacaaataaggtctctgacaacaggcaaacctgtatttaaactcatagcgtcttcttctttaaataactgttactgtagggttgtgatttaatcacggttgtaaaaattgtgcaggtatctttaaaaaaattgcttctgtctttggtctccaagtgtccatctcagaacattaagtgacaggagccaacatagactgctaaataaaagaaaaatctaacatgacacaaatattttttaaaaaagacatcacgtgatttcctcgtagctgttaattcttaataacatacgaaggcagatagggagaacaggtccatcgaagttttattggaaaccttgatttcaagtaagattgcatgacactgtcggttaaaaatgtagtccagtcctaccagcaaactaactcactttccttgtttgctcaagcctccaggcaccggtca

SEQ ID NO: 1203 - DNA, 517 bp, Rattus norvegicus
  Genbank Accession No. AA998078
tttttttttttttttttccagagaaagtcctcctgacccttttattgaaattaaaaaataaaagatacttaaatacaatggtgaacatatagggtaaaacaaatcataaaatttaatgttcgattaagcagtgagctgaatgtttgggtttccaaagaggctttgaacccaggactgcttcagaatgggcgagttcacagttaacggccatcacttagaggtgagagaacggtcggagctgttccagttgaacttccagggaaattctctcctcaaggacatcctttaattgctgttgcaattcactgttcagtctggccagaacggtgttggtctccttattgcgtctaattgatgcctggatcgccttcttatctttccccacagatctggggatagacggctgagacgctagaacagcagctaagacacctgtcttttgtgtgtgctcatccacatctggccgcaactcatcttctgactttaatcttctccgaacaggttttggtggtggagc

SEQ ID NO: 1204 - DNA, 424 bp, Rattus norvegicus
  Genbank Accession No. AA998084
cggccgctttccagcactcacactaacgtacctccaagaggcattcggatctccgggggttacgctcctatcccggacgagcccccaatgaaagatccccagacttggggagactctgtgttgtcccttccttagaagctgtgaatgtttaagcaacagggagaatttttcttcaggatctaaggtaaagctttcaggttcttgttaatgcctgcttcagacggatcactcgctaaccgggagtccttcatacacaacggttaacagcagctgggctggacaatgggagtaaagagaggggcagctctccttggggaggaggctcaagagagaaagataaaactccccggcagaaaacaatttctctcaagcaaattatttttaacttttaagttaagtaccaggaggaccaagcctcgtgccg

SEQ ID NO: 1205 - DNA, 249 bp, Rattus norvegicus
  Genbank Accession No. AA998092
  misc_feature (1)..(249): n = a or c or g or t
tttttttttttttttttcagtgaacagtcttggcaaagaatcgccactttatttttctaccaattcagtatcaatgatatacaaaaggatataaacagattatcataaatatcaataggaagacacacaaaacactcctgaagacatcacgcaccggaacccagtgtgacttagccgtgtctactcaacagaaggttaagtctacaagtttcccactactctgcanaagcaatttgtggcttcctatgt

SEQ ID NO: 1206 - DNA, 277 bp, Rattus norvegicus
  Genbank Accession No. AA998097
tttttttttttttttttaaaaaaattaaatatttatttgaataacaacttttatgttggagctgcaacgttggcaatgcaggtttttaacacaaatcacaaaatgcgtgcacaaaaaggtacgggcgcaaggacaaaatgatgctaagaattgggctaaagagctgctgattttaaacaagaggcctgaaatcactatacaaaatataaaatgtattaaacactaccatccacagaacagtctttagtattgatcatatttaaaaatcatttgcgaa

SEQ ID NO: 1207 - DNA, 347 bp, Rattus norvegicus
  Genbank Accession No. AA998110
tttttttttttttttttagaacagaacttccatctatttaggttgggacctagagggctcaggaaagaaattcatccaaatttgccaaaacaatggctggaggagagtcagggaaaagccacttccttgactcagcctcagagtcttcaaacagcacactgaaaccagctgggccaggtttaaaatttaatgcttgttcaggcctgggtccctcattcctgccgctgtcgggtccactgctctggggtcagagttttctgctcaaaggcatggatgtgcgggagctcttcggctaagcactcgttcaccagccggtgtctctggagcagtggctttccctcgaactt

SEQ ID NO: 1208 - DNA, 401 bp, Rattus norvegicus
  Genbank Accession No. AA998123
tttttttttttttttttcgtgtaactcagtgtcactcatgttgtcaaaccacgaggccactggaacggcattgtctggatggaagacgtatgaggcgggtgagttgtctaagattagcacccgccgcaggtctcggcccagcctgctcaggtcctttacgtagtttccccgatggaagacacaggactctcgaaacagcctggcacggaaggctccccacttgtccagcagatcagctacagggtctgcgtacttggcaagactggcagtgaacaacacacactcaaagagctcgcccattcgctgtaggaactcatctacgtggggccgtttcagtacatagacctggtgaaccactccatcaatctccaccgggatgatgaagtcagcgttgttcactg

SEQ ID NO: 1209 - DNA, 208 bp, Rattus norvegicus
  Genbank Accession No. AA998132
tttttttttttttttttcgtgaccatgattttttatttaacttgggagcatccccttgctgcgtaaatacttacaatcaatcacacgttcccacacggcacaagtctcagcctgggagccaggctgccccctgtgcctgtgtagaggaggcaaggccagcacatgggggcccttttaggacaccactggaccccaggtgtcccagcca

SEQ ID NO: 1210 - DNA, 504 bp, Rattus norvegicus
  Genbank Accession No. AA998172
tttttttttttttttttcccgtggaaaaacatttttttactgatagaatttaagaattaaaccaataagaaaaccaaccaaacaaacaagcaaataaacaagcatgtctagggattacctcagcggcagagcacttgcttagtatgtgctaagccccgggtttgattccagtactgtaaaatatatctatttatatataatatatataaaacgaaaacaagcatatacaccttaagataatataaaacttgaaataacatcaggcattatggaatgggaaacaattttgacaccacccccacctcctacaatacaaaggaaaacaacaggttgggggtatgatgacaagcagaactctggatgattaacattacacagaccctacatcacagaacaccacagagtgagttatacattagtaagatcgtcctgacggcagtgcaagtcctagatcaaaaatgagttaaaagtttgcggtgtaaataacccacctgtgaagagatg

SEQ ID NO: 1211 - DNA, 545 bp, Rattus norvegicus
  Genbank Accession No. AA998174
tttttttttttttttttgaattttaactttattatgtctcttgtagggatcacaaacggaactctccaatacactttaattattcaaaggcctttcagagattccattgcgtgaggtcaacactatttaataccatgcaattgtttcctaaaataaggccatctttgacgttagtttgcacacttgttctctgtaaaatgcctttcaggcacaggccagattaatttgctgttatcagcttagttcttaatgcagaaaagtaaatttaaaaaacacaagtctcattattttgtccaagctggcctcaaatccctatgctcaaatgatcctcctgcttcaacttctgaaaaaaccaagcttatagtaagcacccaggtaaattttagtaaacccagtgtacatggtggtatataccagacttgcctacatagcaaattcaaagccagtgtaagccatgcaagaccccatctcaagaaagaaagaaaacaaaaaacagaaaaacctttttagataacaaaaagtggctttgggagtggtggcatatt

SEQ ID NO: 1212 - DNA, 283 bp, Rattus norvegicus
  Genbank Accession No. AA998234
tttttttttttttttttaataaaaatatttttattatgccacaatgctttccaaagttatgtatcatctacagtcactgaaattgataaactaccagctccaaataaagaagcaaatcaaggagctatggacccgaaatcgaacttcaggaaggttatctaattaatgagctcctttggatttcctaattagtagaaccctgtgatcaaagcagggagcccagtctccaccaatctcctttcaggaagcatataagaagactgggctccctgcctcgtgccgc

SEQ ID NO: 1213 - DNA, 494 bp, Rattus norvegicus
  Genbank Accession No. AA998268
tttttttttttttttttactgaaaaagccattactttttattagaaacaataatgcttctcaagatgttggcaacaaggcatagtatagcacacatttcatacagtgtatttctccctttaattacattccagaagtgggtgggacacctccttggccatgagaagctgacgtatttgatggactatgtaagctggtctccttgtacacaaaccaagcatttcctccccaaagtatcatattcagaaagccaaagatcacggatacattcagggaccccatactagtcacagagacaaagtaacatgacacttctgacttacaaggatcaagttcttcaacaattctgtgtccagtagctaccttaatatctgtaagagctttagcccaggccgaggaactcaccaaccacaaaaaagtagcaacaagagtaacaataaagtcgatcatgggcagtttgcgactatcccggtagaggttggtgtaaccaacata

SEQ ID NO: 1214 - DNA, 233 bp, Rattus norvegicus
  Genbank Accession No. AA998325
tttttttttttttttttaaagggcaagagatagtttattagacacacaatggaacagcagcagcaggcaagacagccgagaactgcaggaaacactcgacaggctcccaccggggatctacacaggctgaagctcccaccggggacctacacaggctgaggctcccaccggggacctacacaggctgaagctcccaccgggaatctacacaggctgaggctcccaacggggat

SEQ ID NO: 1215 - DNA, 297 bp, Rattus norvegicus
  Genbank Accession No. AA998387
tttttttttttttttttgtggaaggcttaatatttatagtcatttattaccaaagttcaggcctatgtagtgaatgggaagttggcagacattcgctctgtaagacaaagcaatagcatatacatttttaaccctaccaacacaaaggcagagattccctactttggaaatgactagggcttctagagatgacatgtatctgctgtggtatgagggtaaagagggctggggaggagctgagtcctcccttcactgacagcttctcaatgaggcaacccctctgtcacacatctctgc

SEQ ID NO: 1216 - DNA, 287 bp, Rattus norvegicus
  Genbank Accession No. AA998415
tttttttttttttttttgcatagccaaacttctgactccttaatggattttgagtaaaaacaccaaccatgtgaacattcccacacggatacctagaaagcatcagcagattgggccctaattatgctgaatggccaaagctccctctatcaagttttgaagcgtgatgaacgccgaaggggaagatggagtccgggggatccaggcttcaccttgctgggtatcgtcacagtgtcctgagggctgggctggcagctgctaccactgctagaggtgaacagtgcagt

SEQ ID NO: 1217 - DNA, 246 bp, Rattus norvegicus
  Genbank Accession No. AA998422
tttttttttttttttttaaaaattgacaagtttatttatgtcacagcatctactacagccagttcccctcctagatcactctttctccttcctagtttttcaagacagggtttatttgtttaatagttctggccaccctggaacttgctttgtacaccaggctgggcttcaactatagggagggaccactatcacgccccccaactcattttttcctttttttcggagctggggactgaacccagt

SEQ ID NO: 1218 - DNA, 432 bp, Rattus norvegicus
  Genbank Accession No. AA998461
tttttttttttttttttcaggttgtaatgtatttattttaaggtagatgataaactgtaggtcttcagggatgctccagtttctgagatatttgagatgatccatgtaaagtgaaaaaactttagaccaagaacagtaggctgcacaagcaatagaatatggcctaaagtgttctgaaacttagaaaccaagcagtgtaggcttctcaagaaataccattacaatcaccttgctaacactaatgcattctacagtagttcagcagtggaagctgtaatacttggttacttttctgttatttttctcccaaagcaagttctttatgctgacgtttccagtgttaggaactgttaagtactgctaaattgtcttcattctttgctttaccaaggagggtcttttcctccatcttgatctgaacctcgtgccgaa

SEQ ID NO: 1219 - DNA, 352 bp, Rattus norvegicus
  Genbank Accession No. AA998471
tttttttttttttttttggggttttaaaggtttttttgtttgtttttaaacagtctggtccctgataggggcctcctacccctctgcagcctgctacagttctgaacgtctctcaatcttgagcagttccacctcaaacaccagggttgctccacctggagggagaaatgtcatcagactgggacctgggactctgggagagtgatgggctgagggtgttaagggttttacctggtatctttgggggtgggaggatgagccccctactgtaatggtgtgtggggtgggagatgagccccctactgtaatggtgtgtggggtgggagatgagtcccctactgaaatggtgtgt

SEQ ID NO: 1220 - DNA, 419 bp, Rattus norvegicus
  Genbank Accession No. AA998506
tttttttttttttttttacttgatctgagagtttacttaaagtgaggagacagtttttagttatcaccttatttatacaaatctgatccccttgctacagctagtgtggatatgtaatcactaaatatggataaagtctgaatagcttgaataaacacagtatattgttttctaatatcgccatcctacttttctgtcatcgatcctgattttttttacagccacacaacttcatgctaattagaaaccaacttgtttcttacacatatctctttgagaagagttttagcatcctcagtcactatgtcaaggaaataatatttcaggtaagatatttctctaagatcacgatcatcagtaaataaatgtccattagccgaacagtaatcatgataatatcttgaaagcctttcatgtat

SEQ ID NO: 1221 - DNA, 225 bp, Rattus norvegicus
  Genbank Accession No. AA998523
tttttttttttttttttcagaatatatgggcctttatttactttaattcagtgccaagaatcaaacccatggaaccttgcacatgcttggcaattctacctactgagctacaataccagccctgtaaacttttgggaagaactgacaactgctggccattcagtaatgtgtcagacattttatgaggctgtagcttcaatagaaccttgagggatgaagagggac

SEQ ID NO: 1222 - DNA, 447 bp, Rattus norvegicus
  Genbank Accession No. AA998540
tttttttttttttttttaaaacgatcaagtttctgtttattcagtgcacaagtgggtgctatttcatatcaggctgcacatgccccacggctgcagcatttaatctcgcccttcacctcctgagtgctgtgacccagcagaggtcacatagtgtggaatggttccaacgtcaccaacgccacagtggacacattcgccaagtggtaacatccggtgtctgatgcctcatttccacataatacttttatagccctgaaaatggaaaccctggcatcgaacgcagctgaacatgttaacactagtacaaggcactgtgctgtggcgtttgtttaaaagatcatgtttgcatagattgctagcaatttagtgtgcaagaaaatacaggcccagcgagtgtggctttttgatggatgaagccatgtgatgctcctctgcccaaggagagca

SEQ ID NO: 1223 - DNA, 355 bp, Rattus norvegicus
  Genbank Accession No. AA998547
tttttttttttttttttaaagggcaaagatttcactttattccacagccttcgagcctgctagaagaggcccagttggtacggtaatacttattcaccaagctggtcatcgacgagagtgaggatatcctggccatcctgctgcaggtgatggtgattgtgttgttgagcccatatcccaagaagaagtggtggtgcttccagactgagaatgttgagctgccagttgagccagggcctgtgcagtcttgaattgctccaagaactgagagcctgttgtactgccacctttagcttccccaacatcaccaaatcctttccccaacatgctcaccatgctatgatgagaaaatgta

SEQ ID NO: 1224 - DNA, 447 bp, Rattus norvegicus
  Genbank Accession No. AA998579
tttttttttttttttttacaatgaaccattttatttgacaagagacatagcttttggtgtacaaagtgcttgctgtataaactcgagggcctgagttcagatccccagcactgaggtaaaagctaggcatggtggtccattagtaatcttgctgctggggtgcaacattccaccccatggcttgctaacagcagtctcgtctccacagagacagcaactgagagcacgcacaactcttcagaggacccgagtccacttcccagcatcaaccagggcagcctcctccagcttcctcttctgacctccacaggcacatccgggcacttcaaatcccatggtctgcttcttcccggacacagtcatctttgcaacttttggcacaatttcagattcactctgggatgaccgagatataactgattttccttttgaaagctgtcctgcaca

SEQ ID NO: 1225 - DNA, 435 bp, Rattus norvegicus
  Genbank Accession No. AA998619
  misc_feature (1)..(435): n = a or c or g or t
cggccgccgcagggccgctcctcacggcaggacaagtattcggtgcttttgcccacctacaacgaacgggagaacctgccgctcatcgtgtggctgctggtgaagagcttctccgagaggtanacggaacttctcgcgcgggtgccgggagccagccgcggactgcatgtcggcggttggctccgcgaggagaccctccgaggcctggcctcctcttcctcccgagcctgctcgaggcttttttcccgctggggaaaaccgaggcgaacagccccgcatctgcatcccgggctctcattcctgctctggtctctagcgagtcctgtgtttacctaatgacagatcgttctggtgtcagtcccccgcctttctcttgaaagggctaacttcacttttacttcggggcgagactcaaagcctgacctcatccctctt

SEQ ID NO: 1226 - DNA, 482 bp, Rattus norvegicus
  Genbank Accession No. AA998638
tttttttttttttttttcagctagaagagccaagtttatttagataaaattctgaaccacgttttcacaatggaaataacaacaatgatggtaatgatttgccatgtggcaggcactgaggtgggtcttacacaccctgactttgttactgtttttcccagtccccaatgtccaacacattcacctgcgagttcccggtccccatgttctgtctcaccatctggctttgtatcaagatggatttcctcttcaaaagtctcctccctgctgatctgttaaaagtccatccagatcagatagaccctgcacttgctgcccctgatgtatatataacatgtgaagactgcactctcttgacttgttctccctcagcaatcacttggatgctacatatgttgatgtcaataatttattcccagtatcccaagatcctcctctttttcatttatacagttgccctctgtttctgaaggcttcatatc

SEQ ID NO: 1227 - DNA, 220 bp, Rattus norvegicus
  Genbank Accession No. AA998673
tttttttttttttttttccccagcaaacttttatttctattactgttcacaagggccaagatttcggcactttaacactggacgctctttcccgcccacccagtggacactgtcagtgtcatcgtgtcccctctagaacttacccccatgctggggccccttcccctcttgcccaccttcaattcaggcatacctttcaagcctgaatcgggtggtacta

SEQ ID NO: 1228 - DNA, 230 bp, Rattus norvegicus
  Genbank Accession No. AA998690
tttttttttttttttttggtgggaggcaatcctttaatggggtggggcacaagatagcaaaacttccatccaagagccacaggaactgaagccaacgtgaagcggcaagcttttcggtaacaatagttgaaatggcacaggtgaagggttgggcaaacaattcaaccctggtgagctctgccaagccccactgacagcatctggtacaaactaactcaggcgtggaaaac

SEQ ID NO: 1229 - DNA, 361 bp, Rattus norvegicus
  Genbank Accession No. AA998747
tttttttttttttttttgtggtttgaacaaaatttaatagaactctcatctctgtccctgtccccacaggcatcggggcagggtgacctagtacagtgtgaacatgtgcccctccctcaagcggggtcagcagcgagccaagcattgtcaccaccagcttccctgccagggccttggtgtaattctcgtggatgtacttctctttccaatcctcagggttgctgaacacctcccagagatcattatgtaggtgggtggtctggtaattatccagcgacagcaggtggccaaaggtatgccggttggtcaggaacatgaacacctcctgctgtcggacattggcgcagaaactcatgtcagg

SEQ ID NO: 1230 - DNA, 158 bp, Rattus norvegicus
  Genbank Accession No. AA998771
tttttttttttttttttacatttatatacattatttgtttattttgtcttgtccgaggtgtgaggatgcacatgggtatacacatacttggcactaagcttatatatagagattagaggaatacttctggagtaagttttctccttctctcatgaagg

SEQ ID NO: 1231 - DNA, 353 bp, Rattus norvegicus
  Genbank Accession No. AA998833
tttttttttttttttttacattcacagcttggggatttaatcttcactctcctgcataaagtcagggtggggatgttcgtccagccctagctgggtatattgactgggatctctgctcctgacagcctcttgaggtgacttgggggtttaagatccatccctcagctccatctttcttctggacttggagacagccgtgtgtgacggatgggaaggaagtcaatgctggggaggggtctcgtgaagatagcccatgttccccttccagccccctcgccaacaatccgaattcaaggagctcaccggggtgggcagttcagaccattgagctggaggagccttgaagcctctgg

SEQ ID NO: 1232 - DNA, 471 bp, Rattus norvegicus
  Genbank Accession No. AA998893
ttttttttttttattttaacaattttttatttaattctatgtatccaaaatatcatttaaaacacataatggttataaacaaattgagatttttaacattattttgtgttgtattagtaagtacctgaattccaacatgtttgcacatttacgcatatctgcattcagacaagccacatagtaactgttcatctgtaagtggctggtggctgagactggacagtgtgcctatgactgaatctgaaacagtacttgtcataagtgaggacaattcagcaacagccactatgtgttgactaatgcaagagacaccaccctacagtagtctagccaaaccaaaaagaatctcaatgtggtcagccttcaaaggcaattatcagtttacggaaatacaaaggagaaaaaccctcaccaaatggcatgctaaaaatgctcacagtaacacataggctacgggagcttaatacatga

SEQ ID NO: 1233 - DNA, 435 bp, Rattus norvegicus
  Genbank Accession No. AA998910
  misc_feature (1)..(435): n = a or c or g or t
tttttttttttttttttacatgtctctgtttaatgacccagccagctctgcccagaaaaagctcatgccccagtagggaagtcctcctcctggctgctgtcccctgaagagcccaccagagctctcactagcagcatccatccagtcctgtctcagcgtggcagcctcatcttagctccttcaccaagctgtcgatggaggccagcagttcccggaagtagccgtcatcttcaccttcttggagctccagggaggccanggcttggtattctgcctggagactgcccagtgtccggctcagctccaggtcttgacggtagcggtcccggcaggtggcgaggagggcgcccagcgtctgcagcaccttctcccgagcgtcgtgctctggaagggccangagctgggccgtgatctcacaccagccctgttcccgca

SEQ ID NO: 1234 - DNA, 422 bp, Rattus norvegicus
  Genbank Accession No. AA998968
tttttttttttttttttcagcacaacttaaaggtttaagtattaactcagtaaccgaaacaaaaatgattgcttaaacctgttggcacacagcaataattttagcctgtggaggctgatgcagggggacaataaattccaatctgggctatatagagagaccctgtctcagacagacagaacacggcttgtgtttgcattcaacagatcctcagagaatgaacttaagaattgtgatgcagggctgaggagagggccggctgggcagcctcgaggacctgggttcaccccctcaggcagagcactggctcatgctggaaccctgtgctgacgagttagatacatgtgaatatggggcttgctgtccggcctgtcaagggactctgtggaaagacacagactcaataaataaggtggaaggtc

SEQ ID NO: 1235 - DNA, 450 bp, Rattus norvegicus
  Genbank Accession No. AA998979
tttttttttttttttttcacaggtacagaggacctggcggtgggcaagtttattccacttcatgcagacactgacccacacgctcagggagcttaaaaatacactgacccacatggcatctatcccccacctccccatgagacacggagagacacttggctgagtggggtccatgggtccaaaagcctccatcctcattctggaacaaggcagcagtgtgggcccaggtagcagggaggagcagcgtcctttctccccagacgaaagtgcacagacagggcagaggccccagagccgggaggccccactctcccggtcaattggcaacaagcaggctgggcaggtatccttcacagtggctatcctttgaaggacctggtggcctagctgtgggtcacagcaatcaggaaaacagggagctggtggcaccactgtggctggctggacaca

SEQ ID NO: 1236 - DNA, 135 bp, Rattus norvegicus
  Genbank Accession No. AA999006
tttttttttttttttatcagtgatatataaatttttattatgaacatagagcaaatttacaaataactcccaattggctttagccgggcaaaatgaagtaacccaacattgcgtgggtgaagcaaaatatacaca

SEQ ID NO: 1237 - DNA, 407 bp, Rattus norvegicus
  Genbank Accession No. AA999060
  misc_feature (1)..(407): n = a or c or g or t
tttttttttttttttttgattctaagctcatgttttatttcactttgttctgtggataaacacaccaggcttaaagaggaaggaagctggttgacaagttgagctaccctttacattatagaacaatagtaaatatgtgtcctttaacttcagtaggacaagggcatagctcagtgcaacgcaggtgcaggagtccctggcttcaattctaagcatcaaaagaagaacacatcaggtgatggcagcacagcctttaatctcagcattctgaaggcagaggctggaggatctctgtgagttcaaggccagcctggtctgcagaattatattggtctgttttactttattctaaaattttgggccagcaagattgactcagtaggtanaggagcttgctgccaagcctg

SEQ ID NO: 1238 - DNA, 342 bp, Rattus norvegicus
  Genbank Accession No. AA999064
tttttttttttttttttgggaagggtcacttcttttattatcccaaaaatgcgaagtattgaaggcacttgcaagaacatggagagaggaggaaagcaggaagcaggatcccacctggtcgttacccagcctggagaaaaagaaaagctatagagccaggtcggaagtcagcccggtgtccactacagaaggcgaatcccattctacagacaatgaggaagttaagagcacgggggcaagggacggggaccagcagtcacgagttagtggttctttaaggaacacatttggcagtgaggacaccgttcagggcccctgctggaaaaggtctcggtacatctc

SEQ ID NO: 1239 - DNA, 335 bp, Rattus norvegicus
  Genbank Accession No. AA999138
tttttttttttttttttagactgacatcttttatttcatacactgtgtaacctggtacataaaaagtaccagattatagtcatgataaatattttcatttccatttggtctaccaaaccaaatcacttagctattaaaataaaaaggtggggactgagccaacagttatgtgcaaacagtaagttttctcttccagccctcaaagcagcagctgctgtgggaatgagatgcagacctgatggtgacatgccttttcaaagaagctgagcgtccactctccagtatgaagatgacgtagacgcctatgctgactatgagcacgcgagcacacgagt

SEQ ID NO: 1240 - DNA, 200 bp, Rattus norvegicus
  Genbank Accession No. AA999169
tttttttttttttttataaagaaccatatttattttcatttacagcatcaagtatcataaataaacctaaacatcgcttgctgtgtgtgtaaaatacagggttccgtatggcactgtaaatgaattctctagggtcacagacatgccacgagatggagaggagactgtctaaagaggctgagagcaggggtggggtgcgg

SEQ ID NO: 1241 - DNA, 403 bp, Rattus norvegicus
  Genbank Accession No. AA999171
tttttttttttttttttagatgtgcaaagacaattttattcaaccaatgaccaaaaagacagcaaaaaccgtttagcttggtggagtacagactgaagagagtactcatgaaaatgttcctacttctactggtgtttagttttgttcagccatagccaccaacaaagctaatcctgaagagagcaaccaagccttaagattaacacggccaatgcagaagctgcattaaggaacacgactgtttccttcccactctgatgaaggatgcccactccagtctgatatatcattgtatctaaagttgactttgaaccatgccatacgtaagacagtggaagacttgcagccatagaggataggggacatgtatctccaggacagaagtatccccacatcatgaagg

SEQ ID NO: 1242 - DNA, 403 bp, Rattus norvegicus
  Genbank Accession No. AA999183
tttttttttttttttttgaggcatggtcttggcatgtagcacacaagttggcctccaaactttgattatactgcctcagcctttgaacgaactgggattacaagtacacatcatctcactcagcctggtagcagtctgaatgtcttaagagctgtgttaagaagttggtttaggtcgttttgcagatggtccatctgagttagttctaccagagttattttcatcttctgcatcatcttcatcaccatccaaagcgtcctccggatcttccgccacgccctgtgcgtcctgctccactagggtcccgaagaactccgctaccaactccttcatgcggaccacgcccgccgacaggctctggagagggtccgcgtcgctcgacgcttcacaggacacttgtagc

SEQ ID NO: 1243 - DNA, 4171 bp, Rattus norvegicus
  Genbank Accession No. AB005540
ggcacgaggtctccccagcgcccggcggtccagcagcccgcgccccgccgcctcgctcctccccggctccgctgcccggagtactgggccgtccgcgaggctccgcggcccgggagccatgttgagcggggggctcggccacgcgtgaggcggccggcggccctcgcggagcggaaggcgcgagagggggaggcctgagcctgaggcgcctcggcgcgtccgccgccaccggacctgcatccgctcgttctgcgcgcccgcccgcccgtccgcccggagcccgcgatctccgcacttgctgaatttttcaagccatatccagctgataggatgaaaaagtttaagaggagactgtccctcacgctcaggggaagccagactattgatgagtccctgtcggagctggctgaacagatgaccatagaggagagcagtagcaaagacaacgagcccattgtgaagaatggcaggccgccaacgtctcacagcatgcattccttcctccatcagtacacagggtccttcaagaagcccccactgcgaagaccccacagcgttattggaggaagccttggttcctttatggcaatgcccagaaatggaagcagattagatattgttcatgaaaatctgaaaatgggatcagatggtgagagtgaccaagcttctgggacatcatctgatgaagtccagtcccctacaggtgtttgcctcagaaatcgtatacatagacggatctcgatggaggacttgaataagcggctgtcgctgcctgcagacatcaggatacccgatggctacctggagaagctgcagatcagcagcccgcccttcgaccagcccatgagccgcaggtcccgcagagcctccttatcagaaattgggtttgggaaaatggaaacctacatcaaattggaaaagcttggagagggcacatatgcaacggtatataaagggagaagtaagttgacagagaacttggtggcattaaaagagatccgcttggaacacgaagaaggtgcaccctgtacagctataagagaagtttcactgttaaaggacttaaaacatgcaaatatagtaacgttgcatgacatcgttcacacggacaagtctttgactctggtctttgagtacctggacaaagacctgaagcagtacatggacgactgtgggagcatcatgagcatgcacaacgtcaagctgttcctgtaccagattctccgtggtttggcatattgccatagaagaaaagtgttgcaccgggacctgaaaccacagaacctcctcattaatgaaagaggagaactaaagctggctgactttggactagccagagccaagtcagtccccaccaagacctactcaaatgaagttgtcacgctgtggtatcggccccctgacgtgcttcttggttcctcggagtactcaactcagatcgacatgtggggagttggctgcattttctttgaaatggcttctggaagaccactgtttccagggtcaactgtggaagatgaactgcacttaatatttcgactactaggaactccatctcaggaaacttggccaggtgtttcttcaaatgatgaattcaagaactacaacttcccaaaatataagccacaacctctaattaatcatgcacccaggttagattctgaaggaattgagttgataacaaagtttcttcagtatgaatctaagaaaagggctccagcagaagaggccatgaaacatgtgtacttccgaagtctagggccgagaatacatgctttaccagaaagcgtatcaatattcagtttgaaagagattcagttgcaaaaggacccgggttttcgaaattcttcctatccagagacaggtgtgtttgtcataaaccatttcacatgtcgatcatgaattttttttcgtggagccaagctttgggtttataaatcgatcagtaaaattattgatgtaaaaaaaaaaaaccaacaatgtacagtgcatcccaaaactctgtatttttagaattgcatatacttgctgttctgtacaatgtgggcagcgcagtaaatcttcagagagaaatgtgattcagtcaagtcagggatcctgcgagctgcagatggcacagagacctttcacaagtgacctggcttgaccactgcacacgccatccctggtacccgaggcagaagacacggcttgtgcttacctagccatccgcttcgtcactcggaagcctagaagctgtagactgaccccgtcaacacaaaggccctttaagacagtgccgaccactcttaccgtggaatagtagcgtttgctggtgggaatgttagcctcctagagtcaccaaatactgtatgtgggataatcactgagccttgaactgcctcatgaaatgactttatattttaggacatgggaagaacagaagacagagcatgctcttttaagtctggtagcttggtctcaagcccagccccagcctttcttaccagccatggactcagagctgaaggcagtcatttcttgtgctggacttgggatctccgtgtgtctgcactgtcctcttcccagtggagtctttttatttcagacctacagattgtttttatatttcttgtcacagtgtgacaatttttttttttttgtacagttggttttaaggtcttctctgcctgtagagccaggaggttacagctctcaatgtaactgtggctgcagatttgtgcaggactgagaaacacagtgcattatttattgtggaatcattgctgctaaataactactgtctgtttatttaacacaacagttgaatgcctgaagaagttgcagtggctttattagatgtgaacgcatctgtttctcctcacaaattgtttgactgctgcatttcgttgttgttttgttttgtttgtttgtttgtttttaaaaaaaaattaaactgcagtgtttcctggaatgtatatttagctttgcttagcagtaaaataagtgagccatcgtgaacactcgaagttcgtgctacttataatttcttaggagcattggccaatagagtagctgagagagggacagcaccgtgtgtttgggaagcgtgtaatgtgaggggctgagccaagcaaatgaatagcagccattttgggttcccacatcagacaccaatcaactaagaacaccaagttatccatttttacctattcctcacctgagagatgtctactgcctcttcgtatgcctacacttgattaacttttacactgtgctttcagttaacatttaaccgtagaggtcattcaaacaggaaaagccttgctgctgtttgtctgaagcacgtttcttttcctagatactacttcattttgaggaacagtttctttcacttgggggctgtgtatgtttcaaataacgttcacttggaataaccagctgaaactgactctgtctttaaatggagccatgatgaattagaaatgagaaataagagcccagaggactgccttagcattgtgggtattatctgctcatcagagacactaacagtgtaacttgaattatgcatgtccttgaccatcacagacactcggtgttggtaaccgtgtcttaggcattcgtgttcatcgttaaggactattggttagtgcatcttacaactagaaatcttaattggtatactttgaaatggtcatgtaagtttttgccttatatcatgaaaatagttataacttaatttttgtcctgccattcactgtaaaacattcagggtcctctcatttctgttcaggaaatcctgtagtttattgtttgttatttaacagtattaaagtgagtttttgtatattttcattttaactttatttgtgaatagtgattgtggcatgtttggggatgttattttaatatttcacaatactgaaattttaatttttttttttaaaaaaagaaagttctggaagaaacagattcatgtgtaacagtgaatattggaccactgctgcttttcacgattgtcagctggttttatgttaagccccgtagcctaactgctgttatttctaactgacagacatgtattaatattgtactttgaaggttataaatattatgtgaaaattccttccttcgttttgaaatttataataactaaatctctgtgttatataaaatgtgatctttgtgg

SEQ ID NO: 1244 - DNA, 944 bp, Rattus norvegicus
  Genbank Accession No. AB006450
caagatggaggagtacgcgagagagccgtgcccctggagaattgtggatgactgtggcggtgcctttaccatgggtaccataggtggtggcatcttccaggccttcaaaggttttcgaaattctccagtgggagtaaaccacagactccgagggagtttaacagctattaaaaccagggccccacaattgggaggtagctttgcagtttggggaggcctgttttccacgattgactgtggtatggttcagataagaggcaaagaagacccctggaactccatcactagcggtgccttaacaggagccatcctggcagcaagaaatggaccggtagccatggttgggtcagctgcgatgggcggcattctcctagctttaattgaaggagctggtatcctgttgaccaggtttgcctctgcacagtttcctaatggccctcagtttgctgaagaccactcccagttgccttcaagccagttgccgtcctcaccatttggagactaccgacagtatcagtaggacttggtccccgggattcctggacctgggtggactgcagtttggtagggtttcagaagatcaagttacagtctgttgaaagccttaggtgggacaccggcggccaagcaggccatcaagagacatttagcacatttttctatttaaaagagactcagagtgtggaaaagataccgagtttatttattcatgcttggattgcgtctgtgatcaaaataaatgtctaataccatttaaagaatgtatatgaacttagaagataaaggaccaaaggccacataacagtgaaattcgactgtccttccttcgggacttttttgcctggtgtttatgtacagttgttcagacaataaaaggcttttgggacttgacctttccaaaaaaaaaaaaaaaaaaaaaaaaaaaagcggccgctgaattctag

SEQ ID NO: 1245 - DNA, 1628 bp, Rattus norvegicus
  Genbank Accession No. AB008424
ctgtattgagtgttggccagtggtctttggtagcctgggcagcagcggggcagacatggagctgctggctgggactggcctgtggcccatggccatattcacagtcatcttcatattactggtggacctgatgcaccggcgccagcgctggacttctcgctaccctccaggccctgtgccgtggcctgtgctgggcaacctgctgcaggtggacctctgtaacatgccatacagcatgtacaagcttcaaaaccgctatggtgacgtgttcagcctacagatgggttggaagccagtggtggtgatcaatggactgaaggcagtgcaggaactgctggtgacctgtggagaggacactgctgaccgccctgaaatgcccatctttcaacatataggctatgggcacaaagctaaaggtgtggtgcttgcaccttacgggcctgagtggcgagagcagaggcgattctctgtgtccaccctgcgcaacttcggtgtgggcaagaaatccctggagcagtgggtgacagacgaggccagccacctctgtgatgccctcaccgctgaggcagggcggcccctcgatccttacaccctcctgaacaaggctgtgtgcaatgtaattgcatctctcatttatgcccgccgcttcgactatggagaccctgatttcatcaaggtgctaaaaatattgaaagaaagcatgggagagcaaactggcttgtttcctgaggttttgaacatgttcccagttctcctgcgcatcccagggttagctgacaaagtcttccctgggcaaaagacatttctcaccatggtggataacctggtgactgagcacaagaagacttgggaccctgaccagccacctcgagacctgactgatgcctttctggctgagatagagaaggccaaggggaaccctgagagtagtttcaatgatgcaaatctacgtctggtggtcaatgacctgtttggtgctgggatggtgactacttctatcactctaacctgggccctgctgctcatgatcctgcatccggatgtgcagtgccgagtacaacaggaaatcgatgaggtcatagggcaggtgcggcatccagagatggcagaccaggcccacatgccgttcaccaatgctgtcatccatgaggtgcagcgctttgcagacattgtcccaatgaatttgccacacaagacttctcgtgacattgaagtgcagggcttccttatccctaaggggacaaccctcatccccaacctgtcctcagtgctgaaggatgagactgtctgggagaagcccctccgattccaccctgaacacttcctggatgcccagggcaactttgtgaagcatgaggccttcatgccattctcagcaggccgcagagcatgcctgggggagcccctggcccgcatggagctcttcctcttcttcacctgcctcctgcaacgcttcagcttctccgtgcccactggacagccccggcccagcgactatggtgtctttgcctttctccttagcccttccccctaccagctctgtgcattcaaacgttagaaggaaagaaattctagtccagcctctaccttagtgtcatacacagattaaaacagttctgtggctgcca

SEQ ID NO: 1246 - DNA, 859 bp, Rattus norvegicus
  Genbank Accession No. AB008807
tgcttcctgagtcacccgcaaacgagagcaggaccctcttggctctccgtctgctcggcgcagcgatgtccggggcgtccgccaggagcctggggaagggaagcgcgccccctggcccggtcccggaggccagatccgagtctacagcatgaggttctgtccctttgctcagaggacgctgatggtcctgaaggccaagggaatccggcatgaaatcatcaacatcaacctgaagaataagcccgagtggttctttgagaagaatccctttgggctggtgccggttctggagaacactcagggtcacttgatcactgaatctgtcatcacttgcgagtacctggatgaagcatacccggagaagaagttattcccagatgacccgtacgagaaagcttgccagaagatgacctttgagttattctcaaaggtgccgtctctggttacgagttttattagggcgaagagaaaggaagaccatccgggcataaaggaagaactgaagaaagagttcagcaagctagaagaggctatggctaataagaggacagccttcttcggtgggaattcgctctcaatgatcgattatcttatttggccgtggtttcagcgactggaagcactggagctcaatgagtgtatagaccacaccccaaaactcaagctctggatggcaaccatgcaggaagaccctgtggcatcatcccacttcattgatgccaagacctaccgtgattacttaagtctctacctacaggacagccccgaggcctgtgattatgggctctgaggggcaagagccctcagcgaatgatgttttccttcatcgattgaatagcatgcttttattttacccatt

SEQ ID NO: 1247 - DNA, 987 bp, Rattus norvegicus
  Genbank Accession No. AB009246
atgcaggcagcctggctcttgggggccctactggtccctcaccttttgagttttggccatggagcccgaggtcatgggaaggaatgggaaggagtctggggaggtgccctggaggaggagcgagatcgggagtcactgatgttgaagaatctccaggaggccctagggctgcccactggggtgggaaataaggataatcttgctgaaaactctgaaggcaaagaggtctgggaggccacggagactcaaggggaagaagaggaagaggaaaccaccacaacaccttcttctagccccactcctttccccagcccttctcctacatcagaggacacagtcacttacatcctgggccgcttggccagcctcgatgcaggcctacaccaattgcacatccgtctgcatgttttggacacccgtgtggttgagctgacccaggggctgcggcggctgcgggatgccgcgagtgacacccgcgactcagtgcaagctctgaaggaggtacaggtccgttctgagcaggagcacggccgcttggagggctgcctgaagggcctgcgcctaggccacaaatgcttcctgctctcgcgagacttcgagacacaggcggcggcgcaagcgcggtgtaaggcgcgaggtgggagtttagcgcagcctgcggaccgccagcaaatggatgctctaagccggtacttacgagctgctcttgccccctacaactggccagtgtggctgggagtgcacgaccggcgctcggaggggctctaccttttcgagaacggccagcgcgtgtcattcttcgcctggcaccgcgcactcagcccggagtccggcgcccagcctagtgcggcatcccatccacttagcccggatcagcccaatggcggcatcctggagaactgcgtggcccaggcctcagacgacggctcctggtgggaccatgactgtgagcggcgcctctacttcgtctgcgagttccctttctag

SEQ ID NO: 1248 - DNA, 2346 bp, Rattus norvegicus
  Genbank Accession No. AB011679
ctcgcatctctctgcagcagcctccggggctacgttccatcctatcagtctgagaccagcccagaagaaaaaaaccaaaaatccttaattatcttcttttgctcggtacctacattgggaccatcaaaaaaaaattattacagtaaaccgtagccatgagggaaatcgtgcacatccaggccggacagtgtggcaaccagatcggtgctaagttctgggaggtgataagcgatgaacacggcatcgaccccaccggcacctaccacggagacagcgacttgcagctggaccgaatctctgtgtactacaatgaagctacaggtggcaagtatgtccctcgagctatcttagtggatctagaacccgggactatggactccgttcgctcaggtccttttggccagatcttcagaccggacaactttgtttttggtcagtctggggcaggcaacaactgggctaagggtcactacacagagggagctgagctggttgactctgtcttggatgtggtgcggaaggaggcggagagctgtgactgcctgcaaggctttcagctgacccactcgctgggtggaggcacgggctctggcatgggcaccctgctcatcagcaagattcgagaagaataccccgaccgcatcatgaacaccttcagcgtggtgccctcacccaaagtgtctgacaccgtggttgagccctacaacgccaccctgtccgtccaccagttggtagagaacacagatgagacctactgcattgacaacgaggctctctacgacatctgcttccgtacccttaagctcaccacgccaacctacggagacctgaaccatctcgtctctgccaccatgagcggtgtcaccacctgcctccgtttcccgggccagctgaacgccgaccttcggaagctggctgtcaacatggtgcccttcccgcgtctccacttcttcatgcctggctttgcccctctcaccagccgtggaagccagcagtaccgggccctcactgtgcctgaactcacccagcaggtcttcgacgccaagaacatgatggccgcctgtgacccacgccacggccggtacctcacggttgcggctgtcttccgtggacggatgtccatgaaggaggtagatgagcaaatgctcaacgtgcagaataagaatagcagctacttcgtggaatggatccccaacaacgtcaagacggctgtctgtgacatcccaccgcgaggcctcaagatggcagtcaccttcatcggaaacagcacggccatccaggagctcttcaagcgcatctctgagcagtttacggcaatgttccgtcggaaggctttcctccactggtacacgggtgagggcatggacgagatggagttcaccgaagctgagagcaacatgaatgacctcgtctctgagtatcagcagtaccaggacgccaccgcagaagaggaagaggatttcggagaggaggcagaagaagaggcctaaggcggaagccctgcgtcacctcaggctgcttagttcccttagcttttttccaactgccctttgtttctttctgctgcctctgtcctgtttttgttccgttttgttttctcattggggggtaaacggtgcctggcacgtggcaggcgctcaataaatatttctttgtggaatgtctcctttctctttccgatctgacattctgagcgttaaccctgtgcttcctcctggtacccatttctttattatgactgtccagttaatattcttccaatatattctccaggaaccagcgttcggctccagacccggggtagaacccagcccagttctaagaactcaagagagtagccaccatcttaaagcaaagtagcgggtggggaaaaggtgggtagaggagatgctacttagggggtgggattttccagtcagggccatttagacacgggaatcgctggggctttcagtcgatggggctttcttttttccctgcttcatctctcggcctcaggagaggtattaacagtattatcaccatttatatcctagctgtcctgagccaaatctgccattggaggtgtcttcccctgtgttggttctccaagggacgttgtatggggatttgtgggggcagggcagcaaggccttgttctctaaatgtccagaaacactctaattaccatttccacctgggtgcctcacacactccccagaggggaggtaacatctctgccccatttccatcctgttccttggcttggtcattccctacctttctattttctgttaaacttggctttttttttttcatattgaaaagatgacattgccccgagagccaaaaataaatgggaattgg

SEQ ID NO: 1249 - DNA, 1624 bp, Rattus norvegicus
  Genbank Accession No. AB012231
gaagtccaagccacaatgatcctgccaagaatcctccagggtacctagaggacagttttgtaaaatccggagtcttcaacgtatcagagcttgtgagagtatccagaacacccataacccaggggactggagtcaacttcccaatcggagaaatccccagccaaccatactatcatgacatgaactctggcgtgaacctgcagaggtcgctgtcttctccaccgagcagcaaaagacccaaaactatatccatagatgaaaatatggagccaagtcctacaggagacttttacccctctccaaattcaccagctgctggaagtcgaacatggcatgagcgagatcaagatatgtcttctccaactacaatgaagaagcctgagaagccactgtttagctctacatctccacaggattcttccccaagattgagcacttttccccagcaccaccatcccggaatacctggagtcgcgcacagtgtcatctcaactcgaactccacctccaccctcaccgttgccatttccaacgcaagctatccttcctccagcaccatcaagttacttttctcatccaacaatcagatatcctcctcacctgaatcctcaggatactctgaagaactatgtaccttcttatgacccgtccagtcctcaaacgagccagcctaacagcagtggtcaagtagtagggaaagtgcctggccatttcacgcctgtcttggcaccctctccccatcccagtgcagtgcgacctgtgaccctgaccatgacagatactaaacccatcactacatccactgaagcctacacagcctcaggcacatctcaagccaatcgatatgtgggactaagcccaagagacccatccttcctgcatcagcaacagtcctggtacctgggctagcttggttccttttcaagtgtcaaataggacacccatcttaccggcaaatgtccaaaattatggtttgaacataattggagaacctttccttcaagcggagacaagcaactgaggggaaagaaacacaaccatagtgtaagaaaattaggggaaaaacacccaacaaaagaaaagaggaagactggacaacagggagaaaggagagaaactgaagaaagaagacgctagaccagcattgcagcacttccggtcactaattcccttaaggttgagactgtagtgacaggaaagggtcaatgacatctcaccgatgctagactgcagcccctgcaccgtagcctttgttccatgaagtccgctgggaaatagatgttctgtctctatgacaatatattttaactgactttctagatgccttaatatttgcatgataagctagttttcttggttagtattcttgttgtttacgcatggagtcactattcctggttatctcaacaacgaaggctaggaggcggcgtcagaggggctggggacagagccatgagccagccattttataagcactctgatttctaaaagttaaaaaaaattatatatatatatatataaaaatctctgtagcctttagttatccgtacagatttattaaattttggcccttaacccagccttttccagtgtgtaacccagtttgaaaatcttaaaaaaaaaaa

SEQ ID NO: 1250 - DNA, 616 bp, Rattus norvegicus
  Genbank Accession No. AB012234
ggtccatcacctcccctccttccaccagcaccaccaagcgccccaagtccatcgacgacagtgagatggagagtccagtcgatgatgtattctatcctgggacaggccgctccccagcagctggcagcagccagtctagcggatggcccaacgacgtggatgcaggccctgcttctctaaagaagtcaggaaagctggacttctgcagcgccctctcctctcagggcagctccccacgcatggctttcacccaccacccgctgcctgtgcttgctggagtcagaccagggagcccccgggccacagcatcagcactgcacttcccttccacctccatcattcagcagtcgagcccgtacttcacacacccaaccatccgctaccaccaccaccatgggcaggactcgctgaaggagttcgtacagtttgtgtgctctgacggctcgggtcaggccaccgggcagcattcacaacgacaggcgcctcctctgccaaccggtttgtcagcatcggatcccgggacagcaactttctgaacatcccacagcagtctcagtcctggttcctctgattaagatcaacaaagaaacaacaaaattttaaaaaaaaaaaaaaa

SEQ ID NO: 1251 - DNA, 2090 bp, Rattus norvegicus
  Genbank Accession No. AB012600
ttgcaagcaccgtccttccaatggcggaccagagaatggacatttcctccacaatcagtgacttcatgtctccgggccccaccgacctgctctccggttccctgagcaccagtggtgtggactgcaaccgcaagaggaaaggcagtgccactgactaccaagaaagtatggacacagacaaagatgaccctcatggaaggttagaatatgcagaacaccaaggaaggatcaaaaatgcaagggaggcccacagtcagattgaaaagaggcgtcgggacaaaatgaacagttttattgacgaattggcttctttggtaccaacatgcaatgcgatgtcccggaagttagataaactcaccgtgctcaggatggctgttcagcacatgaaaacattgagaggtgccaccaacccatacacagaagcaaactacaagccaacatctctatccgatgacgaactgaaacacctaattctcagggcagcagatggatttttgtttgtcgtaggatgtgaccgagggaagatcctctttgtctccgaatctgtcttcaagatcctcaattatagccagaatgaccttattggccagagtttgttcgactacctgcatccaaaagatattgccaaagttaaggaacagctatcttcctcggacactgcacctcgggagcgactcatcgatgcgaagactggacttccggttaaaacggatataacccctgggccctcccgattgtgctctggagctcggcgctctttcttctgtaggatgaagtgcaacaggccttcagtaaaggtggaagataaggacttcgcctccacctgttcaaagaaaaaagcagatcgaaagagcttctgcacaatccacagcacaggctacttgaaaagctggccacccacaaagatggggctggacgaagacagtgaaccagacaatgagggctgcaatctgagctgcctcgttgcaatcgggcgactgcactcacacatggttccacagccagtgaacggggaaatacgggtgaagtctatggagtatgtgtctcgacatgcaatagatgggaaatttgtttttgtagatcagagggcgacggctattttggcatatctaccacaggaacttctaggtacatcgtgttatgagtattttcatcaagatgatataggacaccttgcggaatgtcacaggcaagttttacagacaagagaaaagatcacgactaattgctataagtttaagatcaaagatggttcctttatcacactacgaagtcgatggttcagtttcatgaacccgtggaccaaggaagtagaatacattgtctcaaccaacactgttgttttagccaatgtcctggaaggcggggacccaaccttcccacagctcacagcatccccccacagcatggacagcatgctgccctctggagaaggtggcccaaagaggactcatcccactgttccaggcattccagggggaaccagagctggagcaggaaaaataggtcgaatgattgccgaggaaatcatgggaatccacaggataagagggtcatcaccttccagctgtggctccagcccactgaacatcacaagtacgcctccccctgatgcttcctctccaggaggcaagaagattctaaatggagggactccagacattccttccgctggcctactaccagggcaggctcaggagaccccaggctatccctactctgatagttcgtctattcttggtgagaacccccacataggcatcgacatgatagacaacgaccaaggatcaagcagccccagtaacgacgaggcagcaatggctgtcaccatgagcctcttggaagcagatgcggggctgggtggtcccgttgactttagtgacttgccatggccactgtagacactacattttgctctggcaacagctacagtatcaaagtgcattactggtgaagttttacagtctgtgaagcttactggatagggagagaacagcttttatgtactgactccataaaagccatctcagagccattgagacaagtcaatcttaccatgtgtaacttcagacaaagtggaactaagcctg

SEQ ID NO: 1252 - DNA, 1903 bp, Rattus norvegicus
  Genbank Accession No. AB017544
gtcaggcctgaggaagatggcgtcctcggagcaggcagagcagccgaaccagcccagctcttctccaggaagtgaaaatgtggtgcctcgagagcctctgattgccacagcagtgaagttcctacagaactctcgggtccggcagagcccacttgcgaccaggagagcatttcttaagaagaaagggctgacagatgaagagattgacctggctttccagcagtcgggcactgcttccgacgagccttcacccgtgggcccagctaccccggtggttcctgtccagccccctcacctcatttcacagccatacagccccggaggttcccgatggcgagattacggtgccttggccatcatcctggcaggaattgcatttggcttccaccagctctacaagaagtacctgctgcccctcatcctgggaggccgagaggaccggaagcagctggagaggatggcggcgagtctctcggaactgagtggcagtgtggcccagacagtgactcaggtacagacaacactggcctctgtccaggagctactgagacagcagcagcagaaggtccaggagctagcccatgagctggccgctgccaaggctaccacatcaaccaactggatcctggagtcccagaatatcaatgagctcaagtcagaaatcaactctctgaaaggacttcttctgaatcggagacagttccctccctccccgtcagccccgaagatcccctcctggcagatcccagtgaagtctccgtcaccctccagccccgcggccgtgaaccaccacagcagcagtgacatctcccctgtcagcaatgagtctccgtcctcctctccagggaaggacggccacagccctgagggctccacagccacataccgcctgctggggcctcaggaagagggggaaggggtgatggacgtcaagggccaggtgaggatggaggtgcaaggggaggaggagaagagggaggacgaggagggcgaggaggatgaggatgatgacgtgagccacgtggatgaagaggacgtcctcggggtacagagggaggacagacggggcggcgatgggcagatcaatgagcaggtagagaagctgcggcggccagagggcgccagcaatgagagtgagcgagactagggctggcgcttggttgcccgccttcccagtgccccagggcctcagaggcgggtgggcaagagttgtggctctgcttccatgaggggggccggaaacccaggtaggggtggggccgtccttccgtgcagtgtgggctgcgtttcttttcaccagcctcccagacaggttcccagccccagccacgggcccaggccgagaactcgggagctctgcactccagccccctccttgacgggtgtcttgtctaggtgtgtcctctgagtaccttgaccacctgacaccatgcatggccagagctcatgtcatttcctgcctctgtcacctcagtgcaggggaactatggcccccctcggtcttgctgtctcccccactgtgccctggcctggcttgtggcttcttctttgcctgttccaatagccagggtgccagccccgctcttcatctctggggctgccagccttcccacagccaggtcctggctgacagatgccgcccttgggcgcctgtccccagcccacctgcccgttgttttttataccacacgagacgtcctcgcttgctgtgtcgtggtttagctactcagtggtgaggcgtgcttctccctcctgcggtggaggaggcagcagggccttcctgaccaacagccatgtctgtccttcccactgagaaacacatgttcatttacgtgatcatgtatagatttcagactataagataagactgtacataatgtaataaatacgagttgccatattt

SEQ ID NO: 1253 - DNA, 853 bp, Rattus norvegicus
  Genbank Accession No. AB020504
ggccacgcgtcgactagtacggggggggggggggaatgaggcggaccatctgaccccgctcgctcgctccacgcgctggcacgggagcgacagccaactgcagagcgaattcctctcacgccagtcactcagagcaatgaaactgtaacagttgttttcccaaatactgtacgatggtacgactgaccagcaacttccttttgttttgtattatatatatctttaaaatatcttgtcagttttactatgtatgttcatccattcaccaaagccctcaaaaagaagtttctccacagaacaggcacctcaggctctgtcccaaggaatgtgttttaatttttgcccggataaaagaaaataagctttgcacacactctcgattctttatttgcaggcaaacttcactctttattatctgaaacttttccattctcagcctcttagaggcacagatggctcaagtttcagtggcaaaaaagtctttttttttttttctttctgtaaccaaactagagcaaatttggaattcagtctgggactaaaacgtcacagcagaaaaaaaatgaaaaaaaaataatttgctttttctttctttcatttagcagcataaataagtttggccactgggagtacagtacaggggttgggacaacgatcccgtatttgaagacctacttctagcaccagcatcaagaactaaatccacctcaggactcacagaacccaggacaacttgccatctttgagcaacatatgcattgaagagtgtatatagaagcaacagtaaatagattaacagaggctaatactgtgattgattgacattggcaatggttggcaaaaaaaaaaaaaa

SEQ ID NO: 1254 - DNA, 1910 bp, Rattus norvegicus
  Genbank Accession No. AB022209
accctgtcaagtgtccatgatgctgggccctgagggaggtgaaggctatgtggtcaaactccgtggcctaccctggtcctgctcaattgaggacgtacaaaacttcctctccgactgcacaattcatgatggggtcgcaggtgttcatttcatttatactagagaaggcaggcagagtggtgaggcttttgttgaacttgagtcagaagatgatgtaaaattggctctgaaaaaagacagggaaagcatgggacaccggtatattgaggtgttcaagtcacacagaaccgagatggattgggtgttgaagcacagtggtccaaacagcgccgacagtgccaatgatggctttgtgaggcttcggggactcccgtttggatgcacaaaggaagaaatcgttcagttcttctcagggttggaaattgtgccaaacgggatcacactacctgtggacccggaaggcaagattacaggggaggccttcgttcagtttgcctcacaagagttagccgagaaagctttagggaagcacaaggagagaatagggcacaggtatattgaagtgttcaagagcagtcaggaggaagttaggtcatactcagatccacctctgaagtttatgtctgtgcagaggcctgggccttatgacaggcctggcacagcccggaggtacattggcattgtgaaacaggcaggcctggataggatgaggtctggtgcctatagtgcaggctatgggggctatgaagaatacagtggcctcagtgatggctatggcttcaccactgacctgtttgggagagacctcagctattgtctctcaggaatgtatgatcacagatacggagacagcgagttcacagtgcagagcaccaccggccactgcgtccacatgagagggctgccctacaaagcaacggagaacgacatttacaacttcttctctccactcaaccctgtgagagttcatattgagattggtcctgatggaagagtgaccggagaagctgatgttgagtttgctactcatgaagaagcagtggcagctatgtccaaggacagggccaacatgcagcacagatacatagaactcttcctgaattcaacaacaggagctagcaatggggcttatagcagccaggtgatgcagggcatgggtgtgtcagctgcccaggcaacttacagtggcctggagagccagtcagtgagtggctgttacggggccggctacagcggtcagaacagcatgggtggatatgattagtattgtaggaacatttgggttatttcaatcagaaaatttcacaggcagccaataaacagtcaagagcagtttataactctagaggaagctgggggacccactttgcaccatgagtttgtgaaatctggattaaaaaattacctcttcagtgtttctcatgcaaacttttcttctagcatgtaatattgagtaaactaaaaactattttcttccgcttttctcaattaacatttttggtagtatacttaagagtgatgttatctgagttaagtagtttaagtatgttgagtggatctttcagcacaccacagtgaacacactgggggcatgtacttttctggagaactcaaggtgctagatccctgatgcaaagagaagcatttctcatgttcattctagtttatattttcatttaaaatctttaggttaagtttaagctttttaaaagttagttttgagaattgagacacaatactaatactgtaggaattggtgaggccttgacttaaagctttctttgtactgtgatttccttttgggtgtattttgctaagtgaaacttgttaaattttttgttaactaaatttttttcttaaaataaagactttttcgcggccgcgaattcctgcagcccgggggatccact

SEQ ID NO: 1255 - DNA, 1493 bp, Rattus norvegicus
  Genbank Accession No. AF000899
ggaaacttttgtaaaatgtttctttacatggaaatttcactttaggcaatcattggtctatattattgatttgattttacttgtagaactaagagcccctcattgagtgactattcagatttcaaagtgactcgaattgtttacatagcttctacctgaaggatttagaatctgttttctgatagcaaaactaatatatatggtggccagagtataactatgttcatactttggcctgggagataatttatcatgagcttttactatttaaaatgttacacatttgcctactattttataaatgatgttgccttcagaatttgtgggaaggtagaaaactcaaaatatctcgcatcttttgtgcaatggaaagtcttgagttttgatgtcctaaatatgattgcagaaattgttctgttgctcttaaaaaatggacctacatatgacaaaaatccatgctatctgggtaattctcccaacctgtaaggctgaggactgtggtgtgcgttgttctttagtgtcttccaccagcagtgcctcctgttaaaatgtgacagtctcccaatgttaaagaaactggacatatgctttctctgttattcttgttagacataagaaagtaatatgtttcttttcctgttgtaacattttacaaaagagctgctagtcagatctttattcttaaattaatctcaaactggatgtaaaaatttaaaaatattttttaatttatttttttaatagtagtataagaactctggctgctacttagttgttattctgttttccggatagaagctatttaaaaaagtccagtttctgtcccagggtagcaaaatgtacttcctcattttgttgttttgtgatttataaattacactaccttttgaatatacaaacctcattcttcattggacaatgtgaaggctttgggttttttgaagttaaatttgaaggtgcagtttgctttggcattccctcagctctaagatgtattaaccactgtgcttgcagaggccaggactaagattgtactatgaaacttactgagtacttttcacaaattattatcaaaggagagatttttagatttttgtattctgcttagtttaaaaaaaaaaaaagagtagtttccacgaagggttagtgcatttgatgctgttgctgccaaacaaactcagccaattctctaacatagcaggtgtgggaaggatgacacgtggctttgattttgagtgcattttccagaatactgggaaggagcttctgaagccttggatgtattgggtctgtcaaggtgcacgtgtgcctttgtaaatgttcgttctccatctcattcgtcaggtgatgggtggtgaaatgtagctgagctgaagactagaactcaataatcacttttgtgaacaagttggaattgtcatgttactgtgtaattggtttgcttttaagatgaacaataaattaaataaaataaaaaaaaaaaaaaaaaaaaa

SEQ ID NO: 1256 - DNA, 789 bp, Rattus norvegicus
  Genbank Accession No. AF008587
gtgcctcaaagccagacctcgggctgcctttctttgaggctctgggttatgtggatgaccagctctttgtatcctacaatcacgagagtcgccgtgctgagcccagggccccatggatcttggggcagacatcaagccagctgtggctgcagctgagtcagagcctgaaagggtgggattacatgttcatagtggacttctggaccatcatgggcaactataaccacagtaaggtcacgaagttgagagtggtgcctgagtctcacatcctgcaggtgatcctaggatgtgaggtgcatgaagacaacagtaccagtgggttctggaaatatggctacgatgggcaagatcaccttgaattctgccccaagacactgaattggagtgcagccgagccaagggcctgggccaccaagatggagtgggaagagcacaggatccgtgccagacagagcagggactacctgcagaaggactgcccccagcagctgaagcaggtcctggagctccagagaggggttctgggacagcaagtgcctactttggtgaaagtgactcgccattgggcctctacagggacctctctaaggtgtcaggctctgaatttcttcccccagaacatcactatgaggtggttgaaggacagccagcccctagatgccaaggatgtcaaccctgagaacgtgctgccaaatggggatgggacctatcagggctggctgaccttggctgtggcccctggagaagagacaaggttcagctgtcaagtggagcacccaggcctggatc

SEQ ID NO: 1257 - DNA, 474 bp, Rattus norvegicus
  Genbank Accession No. AF009656
ttgcttaatgaatcaagaattgccttcatggagacaggatgtgtcctgtagaagtttaatgcttaagaggtatttgttataaaacaaatattcagaatctttaatttctgattttatttctgcaggactgaaagacttgctcgagatgtcatgaaggagatgggaggccatcacattgtggccctctgtgtgctgaaggggggctataagttctttgctgacctgctggattacattaaagcgctgaatagaaatagtgataggtccattcctatgactgtagattttatcagactgaagagctactgtgtaagtataattaacttacaattttttaaaaaaggactattctagttgtatctatatttttttctttgaagttctctaaactatactgtaatcatcttacttgatgatggtgcaattactattattatatattaattttctgtgctggagtggaacccagggcct

SEQ ID NO: 1258 - DNA, 2261 bp, Rattus norvegicus
  Genbank Accession No. AF012714
tcggtgcttagcccctacttcggcacgaagacacgctacgaagatgtcaacccctggctgctgggcgacccggtggcgccgcgacgggacccggagctgctggcggggacttgcaccccggtgcagctggtcgccctcatccgtcacggcacccgctaccctacgaccaagcagatccgcaagctgaggcagctgcaggggctgctgcagacccgcgagtccgtggatggcgggagccgagtggccgccgctctggaccaatggccgctgtggtacgatgactggatggacgggcagctggtggaaaaggggcggcaggacatgcgacagctggccctgcgtctggccgccctcttccctgacctcttctgccgggagaactacggccgcctgcggctgatcaccagctccaagcaccgctgtgtggacagcagcgccgccttcctccaagggttgtggcaacattaccacccaggattgccacctcccgacgtctcagacatggagtgtgaccctccgagagttaatgataagctaatgaggttcttcgatcactgtgagaagtttttaaccgaagtcgaaagaaacgccacggctctttatcatgtggaagccttcaaaaccgggccagaaatgcagacagttttaaagaaagttgcagccactttgcaagtgccagtgaacaatttaaatgcagacttaattcaggtagcctttttcacctgttcgtttgacctggcaattcaaggtgtccattctccctggtgcgatgtgtttgacgtagatgatgcgaaggttctggaatacttaaatgatctgaaacagtactggaaacgaagttatggctatgccattaacagccggtccagctgcaacctgtttcaggacatttttctacacctggacaaagcagttgagcagaagcaaaggtctcagccggtctcttcttcagtcatcctccagtttggtcatgcggagaccctcctacccctgctctcgctcatgggctacttcaaggacaaggagcccctgacagcatacaattttgaggagcaggtgcatcgcgagttccgaagtggtcacatcgtaccatatgcttcaaacctaatatttgtgctttaccattgtgaagacgcacagacccctcaagaaaaattccagatacaaatgctgctgaatgaaaaggtgttacccttagctcactcgcagaaaactgttgccttgtatgaggatctgaagaaccactaccaggacattcttcagagctgtcaaactagtaaagaatgtaacctacccaaggtgaacatcacgtccgacgagctctgaggactcatcagtgctctgctgagggcgcttgttgccaataggtagccactctaaaggcagcaacaggaggatctctgtgagctcaaggccaacctgttctacatagtgagttccaggccagccaaggctgcgtagagaaataaagtttggtccttttgtcttttcacagaaaatgatagtttcttttagaatctggacatacgggtaagacatgactctccctggagcagctctcttcagaaaaactaattcagcaaaacagctgtccctcccagtgtttgcagagctgaaattttcctaatgacctaagaaaatgctgatgtagaatggtattagaaaataacacttcaaaagtgttggataccaaagcacagtggcagctgggtgagccgcagtgagtgactgagatggggacttgagtgatcatgttgggttctttccttctccttcacgaaggacacaaagaaggaagtctaataacgtatccatccagacaggaaatcaactcgatattaagaaccaggctgaagtaaaactgaaagtgtgggctatttttgttgatgttatttacaaaaagatttaaacactgtcagtaattgcctttaacctccaagtaggtcttgcagaaccacctccatccctcggacctgtttgaggcgcgcagttataatggggcccagcctggtacagagccgacttccttgactgttgcctggttatctttcgttccatcatggctcccctttttatatcttgatattacataaagtttatcttttggtggcttggatttttttttaaataaagacttatctgcctaatttaattgtagagattcgaacctgattcaaagaaattttgagttctttcaaataccataaaaatgtttgctacaataaataaataaaattcttgtggctttactaccaaaaaaa

SEQ ID NO: 1259 - DNA, 2334 bp, Rattus norvegicus
  Genbank Accession No. AF015953
aattcgcggccgcgtcgaccagagaatggacatttcctccacaatcagtgacttcatgtctccgggccccaccgacctgctctccggttccctgagcaccagtggtgtggactgcaaccgcaagaggaaaggcagtgccactgactaccaagaaagtatggacacagacaaagatgaccctcatggaaggttagaatatgcagaacaccaaggaaggatcaaaaatgcaagggaggcccacagtcagattgaaaagaggcgtcgggacaaaatgaacagttttattgacgaattggcttctttggtaccaacatgcaatgcgatgtcccggaagttagataaactcaccgtgctcaggatggctgttcagcacatgaaaacattgagaggtgccaccaacccatacacagaagcaaactacaagccaacatttctatccgatgacgaactgaaacacctaattctcaggaatgaccttattggccagagtttgttcgactacctgcatccaaaagatattgccaaagttaaggaacagctatcttcctcggacactgcacctcgggagcgactcatcgatgcgaagactggacttccggttaaaacggatataacccctgggccctcccgattgtgctctggagctcggcgctctttcttctgtaggatgaagtgcaacaggccttcagtaaaggtggaagataaggacttcgcctccacctgttcaaagaaaaaagcagatcgaaagagcttctgcacaatccacagcacaggctacttgaaaagctggccacccacaaagatggggctggacgaagacagtgaaccagacaatgagggctgcaatctgagctgcctcgttgcaatcgggcgactgcactcacacatggttccacagccagtgaacggggaaatacgggtgaagtctatggagtatgtgtctcgacatgcaatagatgggaaatttgtttttgtagatcagagggcgacggctattttggcatatctaccacaggaacttctaggtacatcgtgttatgagtattttcatcaagatgatataggacaccttgcggaatgtcacaggcaagttttacagacaagagaaaagatcacgactaattgctataagtttaagatcaaagatggttcctttatcacactacgaagtcgatggttcagtttcatgaacccgtggaccaaggaagtagaatacattgtctcaaccaacactgttgttttagccaatgtcctggaaggcggggacccaaccttcccacagctcacagcatccccccacagcatggacagcatgctgccctctggagaaggtggcccaaagaggactcatcccactgttccaggcattccagggggaaccagagctggagcaggaaaaataggtcgaatgattgccgaggaaatcatggaaatccacaggataagagggtcatcaccttccagctgtggctccagcccactgaacatcacaagtacgcctccccctgatgcttcctctccaggaggcaagaagattctaaatggagggactccagacattccttccgctggcctactaccagggcaggctcaggagaccccaggctatccctactctgatagttcgtctattcttggtgagaacccccacataggcatcgacatgatagacaacgaccaaggatcaagcagccccagtaacgacgaggcagcaatggctgtcatcatgagcctcttggaagcagatgcggggctgggtggtcccgttgactttagtgacttgccatggccactgtagacactacattttgctctggcaacagctacagtatcaaagtgcattactgtgaagttttacagtctgtgaagcttactggatagggagagaacagcttttatgtactgactccataaaagccatctcagagccattgagacaagtcaatctaccatgtgtaacttcagacaaagtggaactaagcctgctccagtgtttcctcatcattgagtttgggctagctgtggatagcttgcattaattgtatattttggattttggttgtgttgaattttttaatcattgtgcacagaagcatcattggtagcttttatatccaaaatggtcatttcagatgtatggtgtttttacactacaaagaagtcccccatgtggatatttcttatactaattgtatcataaagctgtttattcttccttgtaagaatcctttactataaatatgggttaaagtataatgtattagacagttaaatatttttaataaatgtttcccttgttctataaaaaaaaaaaaaaaaacaaaaaaaaaaaaa

SEQ ID NO: 1260 - DNA, 669 bp, Rattus norvegicus
  Genbank Accession No. AF016387
ccaagatgaaggacatgcggatggataagtcggagctcgggtgcctgcgcgccattgtgctgttcaatccagatgccaagggtttgtccaacccctcggaggtggagtctcttcgagagaaggtttatgccaccctcgagccctataccaagcagaagtatccggaacagcctggcaggtttgccaagcttctgctgcgcctcccagctctgcgctccattggattgaaatgcctggaacacctcttcttcttcaagctcattggggatacccccattgacaccttcctcatggagatgttggagacccctctgcagatcacctgaaactcctcggcagtagcttcctcacccagagtgacccctgggctggtgtgtgtgtcgccctacccctgcacactgtcctctcccactctgacttcccttcctgtccccaaaatgtgatgcttgtcccgaataactacaacctttctacacatgagacttttctaggtggagttttgtatggttgttaaaggtgacccttctttgctacttaaggggctgagtctggcagttcttggaagagtagccaagcctctgtacatataattatcttggtttaaattattttttcacttgccatggaaagcaaacaaatggaaaagaaaataataaatacgatactggc

SEQ ID NO: 1261 - DNA, 453 bp, Rattus norvegicus
  Genbank Accession No. AF022952
  misc_feature (1)..(453): n = a or c or g or t
caagaggaaagtggtgtcatggatagatgtttatgcacgtgccacatgccagccaagggaggtggtggtacctctgagcatggaattcatgggtaatgtggtcaaacaattcgtgccaagctgtgtgactgtgcagcgctgtggtggctgctgtcctgacgatggcctggagtgtgtgcccattgggcaacaccaagtccgaatgcagatcctcatgatccagtacccgagcagtcagctgggggagatgtccctggaagaacacagccaatgtgaatgcagaccaaaaagaaaggagagtgctgtgaagccagacagccccaggaccctctgcccacgctgcaccnagcgccgtnagcgccctgatccccggacctgccgttgccgctgcagacgccgccgcttcctccattgccaagggcggggcttagagctcaacccagacacctgcag

SEQ ID NO: 1262 - DNA, 1110 bp, Rattus norvegicus
  Genbank Accession No. AF029357
cccctgcagccacagacagacggttcgcctctccgtaacaggcagctcaccatgcagacccttagaaaggaaaactgcagctcagtgtccgagttcatcctcctgggcttctccagcgaatcccagatcagaatggccctgtttatcttttttcttcttctctacatggtcaccctcctgggcaacggactcatcgtcgctctgatttacctagactctcgcctccacacgcccatgtacttctttctcagcatcctctctttggtagacatgagctacgtcactaccactgtgccccagatgctggttaacatggtgtgtccaaaaaggaccatctcctggggtgcttgtgtagcccagatgttcatcttcctggtcctgggtattgccgagtgtgttctctacgccatcatggcctatgacaggtacatcgccatctgcttcccccttcactattctgtactcatgagccgtcttgtgtgtgccaagatggttacaatatgctcctccatcagcgtcacgggcgctctgatctacactgtcttcaccatgcgtctgccctactgtggtccctacaagatcaaccacttcttctgtgaggtccccgctgtcctgaagttggcctgtgcagacacatccttcaatgaccgcttggacttcatcctgggtttcgtcttacttttggtccctctctccctcatcctggcctcttatgcctgcatctttgtctccatcttaagaatccgctcatcccaggggagactcaagtccttctccacatgtgcctcccacatcactgtggtcaccatgttctatgggccagccatggtcatgtacatgaggcctggttcttggtatgacccagagcgggacaagaagctggctctgttctacaacgttgtctctgctttcctcaaccccatcatctacagcctccggaataaggatgtgaagggcgcttttatgaaagtactcggaggcagagggacagcccagtgagccagaactgtatgactggatggagctcttttggcttactaaagacatcagttctgaataactcgagttttcctggagctctaagcagccaggagaggttgtggcacccct

SEQ ID NO: 1263 - DNA, 3312 bp, Rattus norvegicus
  Genbank Accession No. AF030050
atggacattcggaaattctttggggttatatcaagtggaaaaaagcctgtaaatgagacagtaaagaagaatgagaagacaaaaccttcggagggaactgtcaaaggaaagaaaggagtaaaggttgccaaggttaataatccctgcaaagaggatgcctccagaccaaagcagcacacagaaaaacgaggatcatctatgactcagattcagaatcagaggagacacgtgcaagtgaaagatgctaaaaagaaatcagaaaaattgccacgtgtgcttgtaaacctggtaaatctctcggaaggatcctcgttacctcatatttctgagacagatgaagacgcagtgactttttatgtaaaaaggcagcctccaaatcaaaagagaatggagtatctacgaaacagttaccttggagcatcaaacgtgaaaaagaatgaagaaaacactaagactaagagtaaaccgttatcaccaataaaactaacaccgacatcagtgcttgattattttggaactgaaagtgtccagagatctgggaagaagatggtggcgagcaaaaagaaagagtcttctcaaaccccagatgattccagattaaatgatgaggccatcgccaagcagctgcagcttgatgaagatgcagagctggagaggcagttgcatgaagatgaagaatttgcaagaacactggccttgttggatgaagaacctaagaccaaaaaggctcgaaaggactctgaagagggagaatcattttcacctgccaaagctgagttaagcaaagcagcaaagcagaagagccctgctaacgagcatttctcaattggaagaaagacctacagtcctgctaagtacggcaagggtagaggctcagaaggcaccaagcagccctgcagatcagctcaccagacggaagcctgctcctctctcaaggccagctccaagctggctcttatgaaagcacaagaagaaaactctcacacagacacagaactgctggctgcaaaaagagaaagtgccattgagcccaaaggagagaaaacaactcctaggaaaacgaaaggctctccaactaaaagagagtctgtaagcccagaagattctgaaaagaagcgcaccaattatcaagcttatcgaagctacttaaatcgagaaggtcccaaagccctgggctccaaagaaatacccaagggagctgaaaactgcttggagggcctgacgttcgtgatcaccggagtgctggagtccatcgaacgagaagaagccaagtctctaattgaacgttatggggggaaagtaacaggaaacgtgagcaagaaaaccagctacctcgtcatgggccgggacagcaggcagtccaagagtgacaaggcagcagctctgggaacaaaaatccttgatgaagacggcctgttggatctgattcgaactatgccgggcaaaaaatccaagtacgaaatcgctgctgaggctgagatgaagaaagaaaagtccaaattggagagaacaccccaaaaaaatgatcagggaaaaagaaaacttagtccaaccaagagggagttggagcctaaaaagagcaagctgactccccttaagcacagccctcggaaggcagtgaaggaggaggaacgtgtgtgtccgaggggcttggacgccaaggagcctcatggcagccacagtgccagcagagaggagtgcctgctctgggtggataagtacaagcccacctcactcaagaacataatcggacagcagggtgaccagagctgtgccaacaaactgctacgctggctcagaaactggcacaagagttctccagaagagaaaaagcatgcaaaatttggcaaagttgccagcaaagatgatggctccagtttcaaggcagcactgctgtctggccctccaggtgttggcaaaaccactacagcttctcttgtgtgtcaggaattgggctacagttatgtggaactaaatgcgagtgatactcggagtaagaacagtctgaaagcaattgttgctgagtcattgaacaacaccagcatcaaaggcttttatacaagtggagcatctccttctgtaagtgcgaggcatgctctcatcatggatgaagttgatggcatggcgggcaatgaggacaggggtggaattcaggagctaataggcctgataaagcatacgaaaattcccatcatttgtatgtgcaatgatagaaatcaccccaaaatccgctcattggttcattattgttttgatcttcgtttccaaagacctcgagttgaacagattaagagtgcaatgctgtctattgcatttaaagagggattaaagatcccacctccagctatgaatgaaataattttgggagctaatcaagatgtcagacaggttttacacaatctcagtatgtggtgtgcacagagtaaggtcctaacctatgaccaagccaaggctgattctcagagggccaagaaggacatcagattgggcccatttgatgtcacccggaaagtgtttgcagctggagaggagactccacacatgtcactgatggacaaatcggatctctttttccatgactattccattgcacccctctttgtccaggagaactacctccatgtaaagcctgtggctgcagggggtgacatgaaaaagcacttgatgcttttaagccgggcagcagatagcatatgtgacggtgacttagtggccaatcagatccggagtaagcaaaactggagtctctcccacacaggccatttacgccagcgttgttcctggagagttgatgaggggctacatgtctcagtttcccagcttcccaaggctggctgggaaagcactcgtctatgggcaagcactgatcggactgttcaggacctgtccttgcacatgagtcttagaacttactccagcaaaaggacagtgaacatggattacctgtcacacatcagagacgcacttgtacgacccttgacctcacaaggagtagaaggggttcagcgtgttgtcacacttatgttggtgaaagaagattttgacaacatcatggaagttagcagcgatacatactattgggggggcaagcccagtaccttttccaagctggaccccaaggtgaaagcagccttcacaagagcctataataaggaggcccacctgaccccatactcacttcaggtggtaaaggcatcgaggcccagcataggtccagcactggattctgagtacaatgaagagtcacaggaagatgccactcagtctgatgagaaagagcaggatgccctagagactgacgccatgatcaag

SEQ ID NO: 1264 - DNA, 816 bp, Rattus norvegicus
  Genbank Accession No. AF030087
gttgtgctagattaaagtttcagagctcagtagattgagattgtaatgtctgtcatgtatgcatgcatttctgtaacagacatgcatcaacttttacataagtacgcttgtgtgactcgttgagaaaacacaggaaagaaagattgtaagtccaaatcatgtcttccactttgctcttctatatttcttgaccacttagaaaaaaagctcacaagcctttgaagaaacagcagcaggctgttatttttttcaaggtttacaaattaagtgcttgatttttaatgtattctcgctactgttttgattttcagatcttgattcaatatttgaagatgtgccttttattgggtaatgttaattctcgaatgtagtaatgttgtaccacaattgtaatgttacatgatcatgggtgtggcattctctgacaaattatgtgacaagaaagtcattttcagagaactcatggctccgattgcacagtccccttgctaaagcaaagggcactctcttaaggctacttcagaactggtctttgtattttctctaagtgatggatgcgtcgtgtccatttagaggcagggtaccacgtgtcccaggcagccctagatatgtgccatgagaaagttcaaagactaacaaagtctacaggaactcaaaatttcatttttgtaatggtaaccccccaagattttctccaagaaataaattattttgtactttataacttaaaagcagctagtagtacatttctgagatatagcaggagaccaaaacatttttggaaaaagaataaatatataaagagaaaaaaaaaaa

SEQ ID NO: 1265 - DNA, 1892 bp, Rattus norvegicus
  Genbank Accession No. AF034218
cgggcgggcttagctggtaccaggatggcggcggccctggcgtgggtcctggcggcgcctggtgcgagttcctgagctgctaccaggcaggtgacacttcctgtagcccccagcatgcgggcaggactgggtcccatcatcacactggccctagtgctggaggtagcatgggcctcggagcttaagcccacagcgccgcccatcttcaccggccgaccctttgtggtagcatggaatgtacccacacaagaatgtgctccgcgccacaaagtgcccctggaccttagggccttcgatgtggaggctacacctaacgagggttttttcaaccagaatatcaccaccttctactatgaccgtctaggcctgtatccacgttttgatgcagctgggatgtctgtgcatggtggcgtgcctcagaacggtagcctctgtgcacacctgcccatgctgaaggaagctgtggaacgctacattcagacccaagagcctgcggggctggcggtcattgactgggaggaatggcgaccagtgtgggttcgaaactggcaggagaaagatgtgtaccggcagtcttcacgccagctggtggccagtcgacaccctgactggccatcagaccgaatagtgaagcaggcgcagtacgaattcgagttcgctgctcggcagttcatgttgaacacactccgttacgtcaaggcagtcagacctcagcacctgtggggcttctacctctttcctgactgctataatcatgattacgtacagaactgggatagctacacaggccgctgtcctgacgtggaggtggcacaaaatgaccagttggcctggctctgggctgaaaatacagctctctttccctccgtgtacctggacaagacgctggcatcctccaaacacagccgcaactttgtcagcttccgtgttcaggaagcccttcgtgtggctcacacccaccatgcaaaccatgcactccccgtgtatgtcttcacgcgtcccacatatacccgaaggctcacagaacttaaccagatggacctcatctctaccatcggtgaaagcgccgccctgggctcagctggtgttatcttctggggcgactcagtgtacgcttcaagtatggaaaactgccagaacctcaagaagtacctaacgcagacgctggtcccctacatagtcaatgtgtcctgggccacccagtactgcagttggacccagtgccatggccatgggcgctgtgtgcgccgcaatcccagcgccagtaccttcttgcacctcagtcccagcagcttccgcctggtgcctggccgcacgcccagtgaaccccagcttcgacctgagggggagctcagcgaagatgacctcagctacctgcagatgcactttcgctgccactgctatctgggctggggtggtgagcagtgccagtggaaccataaacgggcagctggggatgccagtagagcctgggctggagcccacctcgccagtctcctgggtttggtagctatgactctcacctggaccttataagggatctctccccgcagatagcagtccagctggcctctggcacaaggatctccttggcacaaggagcctgttagggggtaggcaaatgagtctggagttggagtgggcagtacccccaggatgcctagaagagcatccataccacctgtcacccccctgttctaagggggagagaaacatcccctgagatgccctcatcttgccagagaagacgaggatacagttaggccggggaaggcctacctctactctctgttcctggatagtttataatcttggggtctcttttgtaaattaaatacaaaacaactgcaaaaaaaaaaaaaaaaaaaaaaaaaaaaaaaaaaaaaaaaaaa

SEQ ID NO: 1266 - DNA, 1188 bp, Rattus norvegicus
  Genbank Accession No. AF034896
acgtgatgggatcagaaattcatgtaccctaaagttatacctaccaacttctatacacatgtcagttcctagttccagatgaaggtcttccaagcagcactgtcagtcactgaacatccctcctgaaaccctcagatgctttgtttgtaaccatgtaaatttatgcgtgagcccattccacagagcagacatgttctaaaagaagaggggaaatgcttagagatgagtgtcaactgttctctgtggcaggagaatagtttgtctgtcaaacgctttgcatttgccaagttctctgaggtccctggagaatgcttcctcctgttcaccctcatccttctcatgttcttagtatcactaacaggaaatactctcatagcccttgctatttgtaccagtccatctctacacacccccatgtacttctttctggccaacttgtctctcctggagattggctatacttgctctgtcatacccaagatgctgcagagccttgtgagtgaggcccgagggatctcttgggagggttgtgcctcacagatgttcttcttcatattctttggtataactgagtgctgcctattggcagccatggcctttgaccgctatatggctatatgttccccactccactatgcaacccgaatgagtcgtggggtatgtgcctatttggcaattgtctcatgggtgatgggatgcatagtaggtctgggacagaccaattttattttctccttgaacttctgtggaccctgtgagatagaccacttcttctgtgaccttccacctctcctggcacttgcctgtggtgatacatcccaaaatgaggctgccatctttgtggcagcagtgctctgcatatttagtccatttttactgatcatttcttcctatgtcagaattctcgttgcagtgctggtgatgccttcacctgaggggcgccataaagctctctctacctgttcatctcacctacttgtagtcacactcttctatggctcaacatctgccacctatttgaggtccaagtctagccactcaccaggagtggacaaactcttggccctcttctatacatcagtgacatccatgctgaatcccatcatctacagcttaaggaacaaggaagtaaagggtgcactgagaagaactctgggcctgaagaaagttctgacaatgaaaaggtaa

SEQ ID NO: 1267 - DNA, 1086 bp, Rattus norvegicus
  Genbank Accession No. AF034898
atgactgtcaactgttctctgtggcaggagaatagtttgactgtcaaacactttgcatttgccaagttctctgaggtccctggagaatgcttcctcctgttcaacctcatccttctcatgttcttagtatcactaacaggaaatactctcatagtccttgctatttgtaccagtccatctctacacacccccatgtacttctttctggccaacttgtctctcctggagattggctatacttgctctgtcatacccaagatgctgcagagccttgtgagtgaggccagagagatctctcgggagggatgtgccacacagatgttttttttcgcattttttggtataactgagtgctgcctattggcagccatggcctttgaccgctgcatggccatatgctccccactccactatgcaacccgaatgagtcgtgaggtatgtgcccatttggcaattgtttcatggggaatgggatgcatagtaagtctgggacaaaccaattttattttctccttgaacttctgtggaccctgtgaaatagaccacttcttctgtgaccttccacctctcctggcacttgcctgtggagatacatcccaaaacgaggctgccatctttgtggtagcagtcctctgcatatctagcccatttttgctgatcatttattcttatgtcaaaattctcattgcagtgctgctgatgccttcacctgaggggcgccataaagctctttccacctgttcgtctcacctacttgtagtcacacttttttatggctcagcatgtattacctatttgaggcccaagtctagccactcaccaggaatggacaaattcttggccctcttctacacagtagtgacatccatgctgaaccctatcatctatagtttaaggaacaaggaagtcaaggcagcactgagaagaactctgggcctgaaaaaaattctgtcaattaataggtaagaaaaccatgcaaagctgctaattaatttatggaactggaaaatatcatcctgagtgaggtaacccaatcgcagaaaaacacacatggtatgcactcattgataagtgggtattagccca

SEQ ID NO: 1268 - DNA, 966 bp, Rattus norvegicus
  Genbank Accession No. AF034900
atgagtgtcaactgttcgctgtggcaggagaatagtttgtctgtcaaacgctttgcatttgccaagttctctgaggtccctggagaatgcttcctcctgttcaccctcatccttctcatgttcttagtatcactaacaggaaatgctctcatagcccttgctgtttgtaccagtccatctctacacacccccatgtacttctttctggccaacttgtctctcctggagattggctatacttgctctgtcatacccaagatgctgcagagccttgtgagtgaggccagagagatctctagggagggatgtgccacacagatgtttttcttcacattttttggcataactgagtgctgcctattggcagccatggcctttgaccgctgcatgggcatatgctccccactccactatgcaacccgaatgagtcgtgaggtatgtgcccatttggcaattgtttcatggggaatgggatgcatagtaggtctgggacagaccaattttattttctccttgaacttctgtggaccttgtgagatagaccacttcttctgtgaccttccacctctcctggcacttgcctgtggtgatacatcccaaaacgaggctgccatctttgtggcagcaatcctctgtatatctagtccatttttggtgatcctttattcttatgtcagaattctcgttgcagtgctggtgatgccttcacctgaggggcgccataaagctctttccacctgttcctcacacctacttgtagtcacactcttttatggctctgtgtcctttacctatttgaggcccaagtctagccactcaccaggaatggacaaactcttggccctcttctacacagcagtgacatccatgctgaaccctatcatctacagtctaaggaacaaggaagtcaaggcagcactgagaagaactctcgacctgaaaaaaattatgtcaattaataggtaa

SEQ ID NO: 1269 - DNA, 1039 bp, Rattus norvegicus
  Genbank Accession No. AF036335
gaaacgcctcctcgttttgctcagcatggcacatttgagtatgaatattctcaacgatggaagtctttggatgaaatggaaaaacagcaaagggaacaagttgaaaaaaacatgaaggatgcaaaagacaagttggaaagtgaaatggaagatgcctaccatgaacaccaagcaaatcttttgcgccaagatctgatgagacgccaggaagaattaaggcgcatggaggaacttcacagtcaagaaatgcagaaacgtaaagaaatgcagttgaggcaagaggaggaacggcgtacaagagaggaagagatgatgattcgccaacgtgagatggaagaacaaatgagacgccaacgagaagaaagctacagcaggatgggctacatggatcccaagagaaagagacatgagaatgggtggtggtggaacaatgaacatgggagatccctatggttcaggaggccagaaatttccaccgctaggtggtggtggtggcataggttatgaagctaatcctggagttccaccagcaaccatgagtggttccatgatgggaagcgacatgcgtactgagcgctttgggcagggaggtgcgggtcctgtgggtggacagggtcctagaggaatggggcctggaacgccagcaggatatggtagagggagagaagagtatgaagggccaaataaaaaaccccgattttagatacttaggctttcattccagtttggttttgtcttcttgtttagataccacttaaattcttggcattttagtaagaaagctacctttttatggatgttagcagtttattgacctgatatttgtaaatggcctgtttgggcaggtaaaattatgtaacgcagtgttcaaaacaggagaaaaattttttcatttactttttttttaactgtataatgtttctcaagttaatggcagtgtaccttgtgccactgaatttccaaagtgtaccattttttttttactgtgcttcaaataaatagaaaaaaatagttatgaacaaaaaaaaaaaaaaaaaaa

SEQ ID NO: 1270 - DNA, 1807 bp, Rattus norvegicus
  Genbank Accession No. AF039584
  misc_feature (1)..(1807): n = a or c or g or t
atgatccgcacgcgggcgccggggactcgggctccgccgccgccgccgctgctgctgtcgctgtcgctgctgctgctgctgctgtccccgactgtaagcggagactgcggcccacctccagacattcctaatgccacgccaaactcgggtaaacacaccaagtttgcccaccaaagccaagtgacatattcgtgtaataagggcttcaaacaaattccagacaagccaaacacagtggtctgccttgaaaatgaccaatggtctaactacgaaactttctgtaataaaacctgtagtgctccactgagactgaattatgcatccctcaaaaaggagtatcgtaacatgaattttttcccaattggcaccactgtggaatttgagtgtcggccaggatttcaaaaagtaacttcacgcacaggaaaatcaacttgccttgaggaattagtatggtctccagttgttgaattttgtaaaaaaagagcatgccctaatcctagagaactgaaaaatggtcacatcaacataccaactgacatattattcggatcagaaataatcttctcatgcgacaaagggtacaagctggtcggtgtaacttctacattctgttctattacggggaatgctgtggactgggatgacgtatttccagtgtgcacaacaattttttgtccagacccaccaaaaatcaataatggaagaattcgagaggaaagcgactcctacgcatatagacagtcggtgacctattcctgtgaccaaggcttcattctggttggaaattcttccgttcattgtactctgaacggtgaagtaggagaatggagtagtgcaccacccaagtgcatagagagacacaaggtcccaactaagaccccaccagaagttgatattccaagtacaatgcctcatgaatccaccttaattaattttccaagtacaagagccccactgtctcataaacccactacagttaaagttccagcaacacagcatgtacctgtttccaagacaacggtacgtcatccaacgagaacatctaaagacagaggagagtctaattcaggtggtgaccattttatatatggaaagtttgacccacagggagttaaaagaaattgccatcactgtgggagacatagtccatatttctggaagagaatcttctcttataactgcctgagaaaaactatcaaaatgcagtgcctatgggtgcctaagggcagatgggtaaagccttttaatcggctggttttttggacaccgttaggcatccagcatggtccttcatatccccaacagtgctcctgctctaaggcagtcttaggacagcttcgggtcatctggccaatcagtcaggtagcactgagtgcccgctgtgtcagtgtgtcattttagtgacagaagaaacccaggaacaacagtcaatacagttcttatccaaagagcatagttaacgccatctccaaccatttttaggtctctgtcataggccaaacgtgaccaagagccccacttttcattatatctttccttcatctctagtaaagctttaagcagagttcttttagaatataccctctacatgcnaatatagtcggcgaaggtacaaaactgtctctgtgttgtgattccttttagcatttggtcagtattttttctttgtacattatacttactgttacttattaataaggtccacaaatccctgaacgaaatggtaaggggcattgttaagtgggaaaatagccaagtagtgtaccaaagtcntgggcgactgtaaataccctttcatggaaagatg

SEQ ID NO: 1271 - DNA, 1076 bp, Rattus norvegicus
  Genbank Accession No. AF044574
cacacagcaaacatgacccagcagccgcctgacgttgaggaggatgactgtctttctgaataccaccacctcttctgtccggaccttctccaggacaaagtggcttttatcactggtggtggttctgggattggcttccggatcgccgagattttcatgaggcatggctgccacactgtcatcgtcagcaggagtctgccgagagtgtccgaggctgctaagaagttggttgctgccactggaaagcggtgtctccctctgtctatggatgtccgagttcccccagctgtcatggctgctgtggaccaagcgctgaaagaatttggcaaaatcgacatcctcattaactgtgctgcagggaactttttatgccctgccagtgcattgtctttcaatgcctttaagactgtggtggacattgacacccttggcaccttcaatgtgtctcgtgtgctttatgagaagttcttccgggaccatggaggagtgatcgtgaacattaccgccaccctcagtatgcgggggcaggtgctgcagctccatgcaggcgctgccaaggcggctgtggatgctatgacgcgacacttggctgtggagtggggtccccagaatatccgtgtcaacagcctggctcctggtgccatcagcggcactgagggtctgcggagattaggaggccccaaggccagttcgaaatttaagtatctttcaagtcctattccaagactcggaaccaagacagaaatcgcccacagcgtgctgtacctagccagccctctggcttcctatgtctcagggattgtgttggtggttgatggtggtagctggatgacgctcccaaatgacattgggcgactgctagagtttgaatcctcctctgctaagctgtagtgtttgaagagcacacccaaggcttcaagcatgttaaagcaacagaatcaactgaactacgtcctctaccccaagataccttttttgacacataaacattgattgccttaagaaagttgtactgaggaggccgtgttcttccatggggaggcttccctgtctcacatagtctatagtcacacgaa

SEQ ID NO: 1272 - DNA, 2611 bp, Rattus norvegicus
  Genbank Accession No. AF047707
atacgactcactatagggctcgagcggtcgcccgggcaggtagcggccgctgaattctagaacagcgggccgggggatggcgctgctggacctggcccaggagggaatggccttgttcggcttcgtgctcttcgtggtgctgtggctgatgcatttcatgtccatcatctacacccggttacacctcaacaagaaggcaacagacaaacagccgtacagcaagctccctggagtctctcttctgaaaccactgaagggggtggaccctaacctaatcaacaacttggagacattctttgaactggattatcccaaatatgaagtactcctttgtgtacaagatcatgatgatccagccattgaggtgtgtaagaaactgcttggaaaatacccaaacgttgatgctagattatttataggtggtaaaaaggttggcattaatcctaaaattaataatttgatgccagcatatgaagttgcaaagtatgatctcatatggatttgtgatagcggaatacgagtcattccagacacattaactgacatggtcaatcagatgacggagagagtggggctggtccacgggcttccatacgtagctgacagacaaggctttgctgccaccttagagcaggtatattttggaacttcacacccaagatcctatatctctgccaatgtgaccggcttcaagtgtgtgacggggatgtcttgcttgatgaggaaggatgtgctagatcaggcaggagggctcatagcctttgctcagtacattgcggaagattacttcatggccaaagcaatagcggaccgaggctggaagttttcaatgtctacgcaagttgccatgcaaaactctggttcatactccatttctcagtttcaatccagaatgatcaggtggaccaaattgaggattaacatgcttcctgccacaataatttgtgagccaatttcagaatgctttgttgccagtttaattatcgggtgggcagcccaccacgtgttccgatgggatatcatggttttcttcatgtgtcactgcctggcatggtttatatttgactacattcaactcaggggtgtccagggtggcacactatgcttttcaaaacttgattatgctgtggcttggttcatccgcgaatccatgacaatatacattttcttgtcggcactgtgggaccctactataagctggagagccggtcgctacaggttgcgctgtggagggacggccgaggagatcctggatgtgtaacaaggcctctgtggccgactggacaggatggaatggaagtgttatagattatgtttatagagactttccaggacctgccttcagtggctcatccgtgtatgtgtggtatccgctctttaatttattcgcatggcccttgcatctgtgaaaagcaaaaaaacaaaagcaaaacatgtctgtagtcgtggccaaacagtgtattttatggaggtagagaatcaagacaattggttctaggaagtgggttttgttgttgtttatttttttaaacaaatatatatatatatctatcaatacacacacacacacacacacacacacacacacgactgctctgcagcagacactatgacagtatccttcagtagggaaagtttcttacctgagttactcactctgaggtccgcacgggcagaacagcagctctgtgagagggaaggggcaggtgctggccgcccctgtgtgaagggaatgggttgtacagggaggcgctgactgagaaactttttcatgctttatgcctacctcttgtagttgttgcagagcaaatagaagttagaagttgtgatatggtagctaggccttgcaaaaacaaatgggaaactttaataataaaagagccgagtctagtatttatataaatctgtgaggttttttttgttttgtttttttgtttttgttttgttttgttttattttttggtctcattgcaatgaaccaaaagtggttgagattggtttttagtggtaaccatgaattgaaggcatcttttggaccaactgttgttggttctgtcttgaaccatattaatcactgtgctgtaattaggagagctgaatctttccttccctgctcctcgcccagcccgccccatctttccattaatattcattctctctctctctccctctctccctctctccttctccctctctccctccctctctctctctctctctctctctctctccttctctccctctctctctctctctctctttctcgccttatgatgaatttgtttgaagggcattttctccgtgagcaaaggcttggatgcatattccagtttttatttttttttctgtgaaatgggtactattaccccctgaggaaaagttgcacagtgagaaccagtctagttatgacccactacatgtttatttttttacattactctctcacgagctgagttttgctgagtgcgtttgtcggtttgtttagtggcgtttggtggaagcccttctttgcgctgctgaagtgaaatcttgctgactagttagcttttttgttgatctcagtatgggcaaagaaacaaaatccaaatggctggacagacttctgtaaata

SEQ ID NO: 1273 - DNA, 834 bp, Rattus norvegicus
  Genbank Accession No. AF051943
caactcacgcttgccctgatcaaacctgatgcagttgcccacccactgattctggaggctgttcatcaacagattctcagcaacaagttcctcattgtacgaatgagagaattgctgtggaagccggaggactgccggaggttttaccgagagcatgaaggtcgttttttctatcagaggctggtggagttcatgacaagtgggccaatccgagcctacatccttgcccacaaagatgccatccaactttggaggacactgatgggacccaccagagtgtttcgagcacgccatatagccccagattcaattcgtgggagtttgggcctcactgacacccgaaataccacccatggctcagactctgtggtttccgccagcagagagatcgcagccttcttcccggacttcagtgaacagcgctggtacgaggaggaggagccccagctgcgctgtggtcctgtgcattacagcccagaggaaggcatccactgcgcagctgaaacaggaggccccaaaccagcttagtaaagtcctgtcggtccctgaggactatgcagtgtgcagcctttcttttagggtcaggaaggccgtctgaagacactgtctttgatggaccccaccacctgccggaaggtttcgcagaccacagttctgctacggcagcccagatctatctacctcttctatgagtattcacagaggtccaggaaggaggtgatgcctccttcctcgagaaagagcttgcctgttgaccagtcaggaaaacgcagtgcctgcctgtgtaaccagcatccacctggcttccttaataaacttcgtgctatcaaatgc

SEQ ID NO: 1274 - DNA, 648 bp, Rattus norvegicus
  Genbank Accession No. AF053092
ctaaaggcggacgccaacatcacgcccaaagaaggcgacctgctggcccggctgccctacctacgagagtggttccgcacacgcatcgccatcatcctgtacctcagcaatggcacagtacagattttcctgttccaggaccacaccaaacttatccgtggcgcccccctgatggcagcagtgacctacatcctcgagaggagggacttccggacacggtacctgagcctttccgaggaatatggcctggacaaggaactgcctcgccgcctccgctatgcccgaaagatggtagacctgaagctgagcccccgttccgcctgcaaccgcctctagtaggtcagcgtcgttaggactgttgcccctgcaaactgcttgatgatcgctcctagctctggcccttcagtactgggctcctcggcgctgctagttctgtgcgctggccctgggcctggcagggagcagtcgccctgtgaagggttgctctctgtaacttattttgtatacgattggtggtggtctcgagcctgttccctggccttgcgcctctgtaggcaatgcataaatatctctattgactctggcactcgcctttccttacgtttatatatattaaatatttgtacatcttcctctaaaaaaaaaaaa

SEQ ID NO: 1275 - DNA, 422 bp, Rattus norvegicus
  Genbank Accession No. AF055292
actctgaacctcaagtttatggctgaggtggggaccagccggggactgctaccagaacacttcctgttcctggcccagaagatcttcaatgacaacagccttagcatagaggcctttcagcaccgctgtgtgtcttggtcacagttcaacaaggagattctactgggccgaggcttcactttttggcagtggtttgatggtgtcctggacctcactaaacgctgtcttcggagctactggtcagatcggctgatcatcggctttatcagtaagcaatatgtcactagccttctcctcaacgagccagatggaaccttcctcctccgctttagcgactctgagattgggggcatcaccattgcccatgtcatccggggtcaggatggctcctcacagatagagaacatccagccgttttctgc

SEQ ID NO: 1276 - DNA, 3559 bp, Rattus norvegicus
  Genbank Accession No. AF061443
  misc_feature (1)..(3559): n = a or c or g or t
ccatctaagcntaaanactgcaaagcactcacatcgctcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccggaaaggggttgacggccgtaccggagggtctcagcgccttcacccaagcactggatatcagtatgaacaatatcacccagttaccagaagatgcatttaagagtttcccatttctagaggagctacaactggctggtaacgacctttctcttatccatccaaaagccttgtctgggctgaaagaactcaaagtcctaacactccagaataatcagttgagaacagtgcccagtgaagccattcacggactgagtgctttgcagtctttacgcttagatgccaaccatattacctcagtcccggaggacagttttgaagggcttgtccagttacgccatctgtggctggatgacaacagcttgacggaagtgcccgtgcgtcccctcagcaacctgccaaccctgcaggcgctgaccttggctctcaacaacatctcaagcatccctgacttcgctttcaccaacctttcaagcttggtggttctgcatctgcataacaataaaattaaaagcctcagtcaacactgttttgatggactagataacctggaaaccttggacttgaattacaattacttggatgagtttcctcaggctattaaagcccttcccagccttaaagagctgggatttcacagtaattctatttctgttattcctgatggagcatttggtggtaatccactgctaagaactattcatttgtatgataatcctctgtcttttgtggggaactcagcatttcacaacctgtctgatctgcattgcttagtcattcgtggtgcaagcctggtgcagtggttccccaatctgaccggaactgtccatttggagagtctaaccttgacagggacaaaaataagcagcatacctgatgatctgtgccaaaaccaaaagatgctgaggactctggacttatcttataacaatataagagaccttccaagttttaatggttgtcgtgcattggaagaaatttcattgcagcgtaatcaaatctccctaataaaggaaaatacttttcaaggcctaacatctctaaggattctagatctgagtagaaacctgatccgtgaaattcacagtggagcttttgcgaagcttgggacaattactaacctggatgtaagtttcaatgaattaacttcatttcctacggaaggcctaaatgggctcaatcaactaaagcttgtgggtaacttcaagctgaaagacgccttggcagccagagactttgctaatctcaggtctctatcagtaccatatgcttatcagtgttgtgcattttgggggtgtgactcttatgcaaatttaaacacagaagataacagcccccaagaacacagtgtgacaaaagagaaaggtgctacagatgcagcaaatgtcaccagcactgctgagaacgaagaacatagccaaataattatccactgtacaccttcaacaggtgctttcaagccctgtgaatatttactgggaagctggatgattcgccttacagtgtggttcattttcctggtcgccttgcttttcaacctgcttgtcattttaacagtgtttgcgtcttgttcatcactgcctgcctccaaactcttcataggcttgatttctgtgtctaacttactcatgggcatctatactggcatccttacttttcttgatgctgtgtcctggggccgatttgccgaatttggcatttggtgggaaactggcagcggctgcaaggtagccgggtctctggcagtcttctcctcagagagcgctgtattcctattaacactggcagctgtggaaagaagcgtatttgcaaaggatttgatgaaacacgggaagagcagtcacctcagacagttccaggtggccgccctcttagctttgctgggtgccgcagtggcaggctgcttcccccttttccacggagggcaatattctgcatcgcccttgtgtttgccgtttcctacaggagaaaccccatcgttaggattcactgtgaccttagtgctattaaactcactggcatttttactaatggccattatctacactaaactatactgcaacttagagaaggaggacctgtcggaaaactcccagtctagcgtgattaagcacgttgcctggctcatcttcacaaactgcatcttcttctgccctgttgcatttttctcatttgcaccattgatcacggcaatctccatcagccccgagataatgaagtctgttacactgatattcttcccgttgcctgcttgcctgaatccggtcctgtatgttttcttcaacccaaagtttaaagaagactggaagctactgaagcggcgtgttaccaggaaacacggatctgtttcagtttccatcagcagccaaggcggttgtggggaacaggatttctactatgactgtggcatgtattcccacttgcagggtaacctgactgtctgtgactgctgtgagtcatttcttttgacaaaaccagtatcatgcaaacacttaataaaatcgcacagttgtcctgtattgacagcggcctcttgccagaggccagaggcctactggtctgattgtggtacacagtcagcccattctgactatgcagatgaagaagattcctttgtctcagacagctctgaccaggtgcaggcctgtggacgagcctgcttctaccagagtcgtggattccctctggtgcgctatgcttacaatctacagagagtcagagactgaactccagtgtctgcctgcgactgtttttccccatcaaccaaatcacagtgctggcatgggagctatctgtctttagacctttcatctggaaagcacttgtagaatcacttcctggtgtcatgcagaagaggaggaaggtggcagtttatttctcagatcagacatctgtgaagaatgggtgcctaaactataaattgttgaaaaaaaattgtgatgccccagtaatgtgtgctctattctaaataaatgcaacttgaaaatggtttgatgtatggcatagcaatataaaattagggttttattttttttctttctgatccatcaggtgcaaagttcaaactatttctgaattaagcacaaaataaaggacagctgttaatatattttaaatgaaaatgngaaattgtaaaactaagaaaatgccttgctaatttcacctaatgattcatcattaatctcaggntgactgacttcagggccacaaaagagactgtctcccagctagagttatgnagagttcaaacaggcatccccttcatgtgttttctgtgtccataaattaaaggttctgttcaaatganttgtaaatctaaaacctgaagatgttttaaggactattgacagctgttagattttgggtaccgagctcgaattcgtaat

SEQ ID NO: 1277 - DNA, 852 bp, Rattus norvegicus
  Genbank Accession No. AF061945
ctagacgccttcatcatggacaaagcccttctggattatgaagtgtcaatagatgctgactgcaagcttctgaccgtaggaaagccatttgccatcgaaggatatggcattggtctccctccaaactctccattgacctctaatatatctgagctcatcagtcagtacaagtctcacgggtttatggatgtgctccatgacaagtggtacaaggtggttccctgcggaaagagaagctttgccgtcactgagactttgcaaatgggcatcaagcacttctctggactcttcgtgctgttgtgtataggatttggtctctccatcctgaccaccattggtgaacacatagtgcacagactgctgttaccacgcatcaaaaacaaatccaagctgcagtactggctgcacacgagtcagaggtttcacagagcattaaacacgtcattcgtagaagaaaagcagccacgttccaagacaaaacgtgtggagaagagcagatggagaagatggacctgcaagacagaaggggactctgaattgtctctgtttcctaggtccaacctgggaccccagcagctcatggtatggaatacttccaatctgagtcatgacaaccaacgaaaatacatctttaatgacgaggaaggacaaaaccagctgggtacccaggcccaccaggacatccctctccctcagaggagaagagagctccctgcctcactgaccaccaatgggaaagcagactccctcaatgtaactcggagctccgtgattcaggaactctctgagttggagaagcagatccaagtgatccgccaggagctgcagttggctgtaagcaggaagacagag

SEQ ID NO: 1278 - DNA, 1607 bp, Rattus norvegicus
  Genbank Accession No. AF062594
  misc_feature (1)..(1607): n = a or c or g or t
catgctgaaatatcgcggtttaccatatggggatggtggcgacaatctcctggagcccgtcagatcgcggaaattaccgatgcctgcgcagctccttccgctcagctccgcgtccgagcctcctggaacgatatttggagttcttaaaagatggcagacattgacaacaaagaacagtctgaacttgatcaagatttggaagatgttgaagaagtagaagaagaagaaacgggtgaagaaacaaaaatcaaagcacgtcagctaactgttcagatgatgcaaaatcctcagattcttgcagctcttcaggaaagacttgatggtctggtagacacaccaacaggatacattgaaagcttgcctaaggtagtcaaaagacgggtgaatgctctcaagaatcttcaagttaaatgtgcacagatagaagccaaattctatgaggaagttcatgaccttgagagaaagtatgctgttctctatcagcctctgtttgataagcgatttgagatcattaatgcaatttatgaacctacagaagaagaatgtgaatggaaaccagatgaggaagatgaagtttcggaggagctgaaagaaaaggccaagattgaagatgagaaaaaggatgaagaaaaagaagaccctaaaggaattcctgagttttggttgacagtttttaagaatgatttgctcagtgatatggttcaggaacatgacgaacctattctgaagcacttgaaagatattaaagtgaagttttcggacgctggccagcctatgagttttatcttagaatttcactttgaacccaacgaatatttcacaaatgaagtgttaacaaagacttacaggatgaggtcagaaccagatgattctgatcccttttcttttgatggaccagaaattatgggttgtacagggtgccagatagattggaaaaaaggaaagaatgttactttgaaaaccattaagaagaagcagaaacacaagggccgtgggacagttcgtactgtgactaaaacagtttccaagacttctttctttaacttttttgctcctcctgaagttcctgagaatggagatctggatgacgatgntgaggcaatactggctgcagactttgaaattggtcactttttacgtgagcgtataatcccaagatcagtgttatacttcactggagaagctattgaggacgatgacgatgactatgatgaagaaggtgaagaagctgatgaggaaggggaagaagaaggagatgaggaaaacgatccagactatgacccaaagaaggatcaaaacccagccgagtgcaagcagcagtgagcagtgactggccttgaggacggcctccctgtaatagcctaaacatgactcacttacttacagccttatggttttgtattttcttgatagaatcagtaagtttctaagggaaaggaaattgatattttgcagaccaatttgttctaaccagcatcccaactctagctctgtagccacgttaccgagtccagccctttactgcatgctcaggtcgctgcagtctggttctcctgagagatttcatcatgtagctattggtacattatgaaaccactgtgaacaat

SEQ ID NO: 1279 - DNA, 1629 bp, Rattus norvegicus
  Genbank Accession No. AF064856
ccaagctgcacgctgctctttatgagaggaagctactatctctggaggtgcgaaaacgtagacgacggagtggcagattgagggcaatgaggccaaaatacccagtgattacccttccagctgaaatgaatattaaaacggagacagagagtgaagaagaggaagaggttggattagacaatgaagatgaagagcaagaagcttcccaggaagagtctgcaggatctcttgcagaaaatcaagccaagtacacaccttcattgactgttatcgtagaaaattcacctagagaaaatgctatgaaagttgctgagtggactaataaaggtgaatcgtgctgcaaaatcgagactcaagagcctgagtctaaatttaatctgatgcagattctccaggataatggcaatctaagcaaagtgcaggcccggttagcattctctgcctatcttcagcatgtgcaagtccgtctgacaaaagacagtggtggtcagacactcagtcccagctgggctgccaaagaggacgaacagatggaactagtggttcgttttctcaagcgagcatcaagtaacctacaacactcactgaggatggtattacctagtcggcggttggcacttctggagcgcagaagaatccttgcccaccagctaggtgattttatcgttgtgtataacaaggaaacagaacaaatggctgaaaagaaatcaaagaagaaactagaagaagaggaagaagatggggtgaacgcagaaagctttcaggagtttatccgacaagcaagtgaggctgaactggaggaggtgttgactttttatacccaaaaaaacaagtctgccagtgtcttcctgggaactcattctaaaagttctaagaacagcagtagttactctgatagtggggcaaaaggcgatcaccctgagacaatacaagaagtgaaaataaagcaacccaaacagcaacaggcaacagaaatccactccgataaattatctcgatttaccacttcagcaggaaaagaggctaaactagtgtataccaattgttcttctttctctggccctgctgctgttctcctgcagagactccccagcacccatttgtcatctattatcacaacctctaccctctcctcaggccctggccaccattcctctttatctcagatttctccagctatccccagcatgcctcaccagtcagcacttttactgaaccctgtccccgacagtgcctctcccccagtacaccctgggaccccgaacgtaagccccgctgggctgccacgctgccggtcaggcagctacaccattggccccttttcctctttccaaagtgctgcccacatctatagccagaaactgtctcgtccctcttcagcaaaggcaggtgagtgagaagaacaagactgccagccatgtcagctcctccccagccccatggaaacagagcacttctttttcttcgccttctcttttactgcttctgctgtgactaaagaaggaagggccttgcattttggcactagcaacctgggcctgacacagaatgaaacagggctgcttttagggactacaagagagacgaaaagagtcctatatatagagtcctcctgctttccaccactgg

SEQ ID NO: 1280 - DNA, 3803 bp, Rattus norvegicus
  Genbank Accession No. AF074608
acagcccaaggttcaggcaaagtcttagtcgccaggctgtgaggtaagggcggggcaggggattccccatctccccagtttcacttcagcttttaacctgtgtcaggtccttctgctcgggtactgatgacgctctggaaattctcattcccattgggtgccgtaaaccctgtgaatcaatcagcgtcgccccaggcactgcacgtaaagtcgaagcagcccgacggatttagccaggtccgggatctcagatgggggcaaaggcacttcaggcgctgctcctgctggtggcggtcgccctggccccgacccagaccagcgcaggtgagtgcggggtcgggagggaaacggcctctgcgtggaagagcgggtgaggggaatcggggaagccgggtccccgcgtcgcataccagaccctcgccctttctcaacccgcgtccagagccccgcgccctgctccccgcccggcccgcacacccgcccgggatcccgggaggaggtcggggtctcaccgcgcgccgcccccaggctcacactcgctgcggtatttcgaaaccgccgtgtcccggcccggcctcggggagccacggttcatctctgtcggctacgtggacgacacggagttcgtgcgctacgacagtgacgcggagaatccgagatacgagccgcgggcgcggtggattgagtgggagaagccggactattgggagacgcagacacggagagccaagggaaacgagcagatttaccgagggagcctgacgaccctgctccactactacaaccagagcgaggacggtgagtgaccccgggtcggaggtcacgaccctccgggtccccacactgccagggacttccgggtccgaagtccgaggttcttagcagaaccgacccaggcccgtttccctttcagtttggaggagtccgcgggtgggcggggctggggcggggccgggtctgaccgcggggtcccgcaggctctcacaccatccagtggatgtatggctgtgacgtggggtcggacgggagcctcctccgcgggtattggcagcacgcctatgatggccgcgattacctcgccctgaatgaagacctgaaaacgtgggaggcctcggacagagcggcgcagaaaacccggaacaagtgggagcggaaaggtgttgcagagagaagcagggcctacctgaagggcacatgtgtggagtccgtccgcagatacctggagctcagaaaggagacgctcgtgcgctcaggtgcggggactgcgggcttctcctcctctgccctcgggctggggctcagtcctggggaagaagaaaccctcagctgggtgatgcccctgtctcagaggggagacagtgtctcctgatccctcatcacagtgactggactgcctctcccagggcccagccttctccctggagagttctgagtccctctcaggagggaaggagagaatttccccacttaacagcaggggctccctgctgtcagccatggcctctcccaggccaggttctctgcccacacccactctctgaggacactgactcctgtcctgctgagtgtgtcagcccttacacctcaggaccagaagtctcctttacctcagaggagacatggactccactgcactaggctggttcccccagtttctagaatttccatagaacacattctcacagatccctccctgaatgtgggttttgcatcccttcaatacctcatttctctctattcctacagtggagaatggtcccatgagcccttatggggtaccctggaggaatataaatcatgggatttctttttctattttctcttttttaatatttctttcttttttctttcccttttttttgaaggcatacttttgcttctagtcagtctttactgcaaacacatattaaatcaattattttccattccctcttctgttctatgaccacccacctcatgctatagaacatcacataaggacggccatgttgacccactggctcatgtggattccctcttagcttgtgagtccctcaggaaagtgtgcagttctctactgaggggaccagctctccctgcagctctctagtgagatgacagttgaagtgtcagacacacacagttcagtgtcatccttgatttaactgtgtcttgtgtagatttcagtttgtcttgttaactgtgtgatttcttaaatcttccacacagatcccccaaaggtgcgtgtgacccttcaccccagacctgaaggtgatgtcaccctgaggtgctgggccctgggcttctaccctgctgacatcaccctgacctggcagttgaatggggaggacctgacccaggacatggaacttgtggagaccaggcctgcaggggatggaaccttccagaagtgggcatctgtggtggtgcctcttgggaaggagcagagttacacatgccttgtggagcatgaggggctgcctgagccgcttacccagagatggggtaaggagggagccttctgtagaccctgagctggtcaagtctgagagctggggtcatgaccccactttcatttcctgaacctgtccttgcagagcctcctccatcaactgattccaacatgggaatcattgctgttctggctgtcgttggagctgtggctgtcattgtacttgtggccctcattggagttgttgtgaggaggaggaggaaaaacataggtaggaatgggcagggactgagtgtctcctcagcccactttagaagagtgctgttctcattaatggggcttgcagccacaccctgcattgcgactgtctccaactttgtccattctggaaacttcctcctgtgaagaccttccttgaactctcacagctttccttctcacaggtggaatatgaggagattacgcccctgctctaggttagtgtgggggcaggattatccctgagggtattggagtgaagctggagatgtggggagctcttggaatccatagtagctcctccagagaaatcttctggggtctagttttactgtgatgtacacatacacatatacatatacatatatacatatacagaaacacatacatatatacgtatgttttgttttaccctaggcagggacagctgccagagctctgatgtctctcccagattgtaaaggtgacactggggtctgactggggagtggcaatgtggacatgattgggtttcagggactcccagaatcccctgtgagtggagggttgttgggctgttgtcttcacagtgatggtttgtgactctccttctctagcatgaagacagctgcctggagtggactgagtgacagatgatgtgttcaggtctctcttgtgacatccagagccctcagttctctttagacaccagtgtctgatgttccctgtgattctatggcttcagtgtgaagaactgtggagcccagcctgccctgcacttcaggaccctgtccctgcactgccattccttcccttcctaggccaaccttagtggtccagcctgggggtggggggtggggacatctacatcctgtccctccttgctgccctgagtgtcagcccctcacttccacactgagaataagaatctgagtgtgaacttgattgttcacatccttgactcaagtgtggatggctttttcaattactggatggaatacttagaggtttttcagttttggggttttgttttgaaaaaaaataaatggcagatggagaagcttccagaatctgtgtcactaagctgtgtgtatctggtgggacaggatgaggatgtgggaggtgagtgtgaaca

SEQ ID NO: 1281 - DNA, 4784 bp, Rattus norvegicus
  Genbank Accession No. AF077000
gagaaagctctgtagtagacagagtgactacaggagaccctgggttcaaaggtggtagggtagagaggtggacctaacagaagaaaaaaagaaaaaaagaaaaagaaatgcaatctcaacgtcaacctcatgctgggccaggctcaggagtgcctgttggagaagtccatgttggacaaccggaagagcttcctagtggcccgcatcagtgcacaggtggtcgattactataaggaggcatgccgggccttggagaaccctgacactgcgtccctgctgggccgcatccagaaggactggaagaaactcgtccagatgaagatctactacttcgcggctgtggctcatctccacatggggaagcaggctgaggagcaacagaaatttggggaacgggtggcctacttccagagtgccctggacaagcttaatgaagccatcaagttggccaagggccagcccgacactgtgcaagatgcacttcgttttgctatggatgtcattgggggaaagtacaattctgccaagaaggacaatgactttatctaccatgaggctgtgccagcactggatacccttcagcctgtgaaaggagcccccttggtgaagcccttgccagtaaaccccacagacccagctgttacaggtcctgatatctttgccaagttggtacccatggctgcccatgaggcctcatcactgtacagtgaggagaaggccaagctacttcgggaaatgctggccaagattgaagataagaatgaagtcctagatcagttcatggactccatgcagcttgaccctgacacagtggacaacttggatgcctacaaccatatcccaccccagctcatggagaagtgtgcagcactcagtgtccggcctgacactgtcaagaaccttgtccagtctatgcaggtgctgtccggggtgttcacggatgtggaggcctccctgaaggacatccgggatctactggaggaagatgagctgcaagagcagaaattgcaggagaccttgggccaggctggggctggccctggcccttctgttaccaaggctgagctcggagaggtgaggcgagaatgggccaagtacacggaagtgcatgaaaaggcttccttcaccaacagtgagctgcatcgtgctatgaatctgcacgttggtaacttgcgcctgctcagtggaccactggaccaggtgcgcgctgccctacccacaccagccctcaccccagaggacaaggctgtgctgcagaacctaaagcgcatcctagccaaggtgcaggagatgcgggaccagcgcgtgtccctggaacagcagctccgagagctgatccagaaggatgacatcactgcctccctggtcaccactgaccactcagagatgaagaaactgtttgaggaacagctgaagaagtatgaccagctgaaggtgtacctggagcagaacctggctgcccaggacaatgtcctccgggcactgaccgaggccaacgtgcagtatgcagcagtgcggcgggtgcttagtgaactggaccaaaagtggaactccacactacagaccctggttgcatcctatgaagcctatgaggacctgatgaagaagtcccaggagggcaaggacttctatgcagacttggaaagcaaggtagccgccctgctggaacgggcacagtctctctgccgtgcccaagaggccgctcgccagcaactcctggacagggagctgaagaagaaggcaccaccacctcggcccacagccccaaagccattgctgtcccgccgtgaggagggagaggccgcagaggctggagaccaacccgaggagctgcgcagcctgccccctgacatgatggctggcccacggctgcctgacccattcctaggaactgctgcccctctccacttttctcctggccccttccctggttccacaggcccagcaacccactatctctcaggacccttaccacctggaacctactcaggccccactcagctgatgcagcctagggctgcagtgcccatggcccctggacctgtcctctacccagcccctgtctatacatcggagttgggccttgtacccagatcctctccccagcatggaattgtaagcagtccctatgcaggggtagggccaccccaaccaatcgtaggtcttccctctgctccaccaccccagttctcaggacctgagttagccatggacgtccggccagctaccactacagtagatagtgtccaagcccctatctctagccacatggcactacggccaggccctgccccagctcctccccagccttgctttccagtgcctcagcctgtaccccaatctgttccccagccgcagcctctgcccacaccctatacttattctatagggaccaagcagcacctcacaggccctctaccacagcatcactttcctcctgggatccctaccagttttcctgcccccaggattgggccccagcccccacctcagcttcagccccagccccagccccagccccagccccagcctccgcctcagccccagccccagccccagccccagccccagccccagccccagccccagccccaacggccagtatttgggccacaacccacacaacagccccttccattccagcatccacatctcttcccatctcaggccccagggattctcacaccaccacccccctacccttttactcctcagcctggtgttttgggacagccaccacccacccggcacacccagctctacccaggcccacctccagacactcttcccccacactcaggggctctgcctttcccgagccctgggcctcctcatcctcaccccaccctggcatatggccctgccccttcccctaggcccctgggtcctcaggcaacccctgtctccattcgaggtcccccaccagccaatcagcctgcccctagtccccacttggtgccttcacctgccccatcgccagggcctggcccagtaccttcaagacccccaacagcagagccaccaccatgtttgcgccgaggtgctgcagctgcagacctgctgtcttccagccctgagagccagcatggagggactcagcctcctgggggcgggcagcccttgctgcagcctaccaaggtagatgcagcggagcggccgacggcacaggccctgcggctaattgagcaggacccctatgaacatcctgagaggctgcagaagttgcagcaggagctggagagctttcggggccagctgggggatgcaggagcactggatgctgtctggagagagttgcaggaggcccaggaacacgatgcccgaggccgatccattgccattgcccgctgctactccctgaagaaccggcaccaggacgtcatgccgtatgacagtaaccgtgtggtgctgcgctcaggcaaagacgactacatcaatgctagctgtgtggaggggctctcgccatactgtccacccttagtggccacccagcgtccgctgcctggcacagctgcagatttctggctcatggtgcatgaacagaaagtgtccgtcattgtcatgctggtgtctgaggctgagatggaaaagcaaaaggtggcccgctacttccccattgagaggggccagcctatggtgcacggggccctgagcgtggccctgagcagtgttcgtactactgatacccatgtggagcgagtactgagcctgcagttccgggatcagagcctcaagcgctctctcgtgcacctacacttccctacttggcctgagttaggcctgccagacagccctggcaatctgctgcgcttcatccaggaggtgcacgcacattatttgcaccagcgacccctgcacacacctattgtcgtacactgcagctcgggggtgggccgcacaggagcctttgcgttgctgtatgccgccgtgcaggaggtagaggctgggagtaggattcctgagttgcctcagctggtgaggcggatgcggcagcagaggaaacacatgctgcaggagaaactgcacctcaaggttctgccacgaggcattggtgcgacatgtggagcaggtcctgcagcgccacggcgtgccgcctcctggcaagcctgtggccagcatgagcgtcagctagaagagccaccttcctcaggactcccaggatctggtccttggtggagacgtgcccatcagctccattcaggctaccattgccaagctcgcatccggcccctgggtggcctggattcccccgctgccagccttcccagccttgtagagcccccaggtcttccaccagctagccttccagagcccacccctgccccaccttcctcgcctccccccccctcttcccctctgcctgaacccccccagccagaggaggagccatcagtgcctgaagcccccagcttagggcctccctcgtcatccctggagctgttggcctctctgactccagaagcattttccctggacagctctttgcggggaaagcagcggatgagcaagcagaactttctgcaggctcacaacgggcagggtctcagggctgcccaacctacggatgaccccctcagcctcctggatccactctggacacttaacaagacctgagaaggctttgcctgtctggtccttacactacacctcccatccctgctgccttcagctgtgccagatggagatgcacttcaggcctcagtcaggctctgctccttcctttgcggaacctgacatttttccagccctgggctattgacataataaacttactctgtgaaaaa

SEQ ID NO: 1282 - DNA, 519 bp, Rattus norvegicus
  Genbank Accession No. AF079873
ctcattacggagatggttgctctcaacccagactttaaaccacctgcagattacaagcctccagcaacacgtgtgagcgataaagtaatgatcccccaagacgagtatccagaaatcaattttgtgggtctcctaattgggcccagagggaacaccctgaagaacattgagaaggaatgcaacgccaagatcatgatacggggaaagggatcagtaaaagaagggaaagttgggcgtaaagatggtcagatgttgccaggagaagatgaacctcttcatgctctagtcactgccaatacaatggagaatgtcaaaaaggcagtggaacagatcagaaacatcctgaagcagggtattgaaaccccagaggaccagaatgacctaaggaaaatgcagcttcgagagttagctcgcttgaatggcactctacgggaagatgataacaggatcttgagaccctggcagagctcagagacacgaagcattaccaacacgactgtgtgtactaagtgtggaggg

SEQ ID NO: 1283 - DNA, 7420 bp, Rattus norvegicus
  Genbank Accession No. AF084186
atggatccaagtggggtcaaagtgctggaaacagccgaggacatccaggagagacgacagcaggttctggatcggtaccaccgcttcaaggagctctctaccttgcggcggcagaaactggaggattcctatcgcttccagttttttcagagagatgctgaggagctggagaagtggattcaggagaagcttcaagttgcctctgatgagaactacaaagaccccaccaacttgcagggaaagctccagaaacaccaagcctttgaagctgaagtacaggccaactcaggagccattgtgaagctggatgagacaggaaacttgatgatttctgaagggcactttgcatctgagaccatccggacacgtttaatggagctgcaccgccagtgggagttgcttttggagaagatgcgggagaaaggaatcaaactgctgcaggcacagaagctggtgcagtatttgcgggagtgtgaggatgtaatggactggatcaatgacaaggaagcaattgtgacgtctgaggagctgggccaggatttggagcatgtagaggtactacagaagaagtttgaagagtttcaaactgatctggctgctcatgaagaaagagttaatgaagtaaaccagtttgctgccaaacttatccaggagcagcacccggaagaggagctgatcaagaccaagcaggaggaggtgaatgcagcttggcagcgactgaaaggcctggctcttcaaaggcaggggaagctctttggtgctgccgaggttcagcgctttaacagggatgtagatgagaccattggttggattaaggagaaagagcagttaatggcctctgatgactttggcagagacttagcaagtgttcaagctctgcttcggaagcatgagggtctggagagagatcttgctgctctagaggacaaggtgaaagccctgtgtgccgaggctgaccgcctgcaacagtcacaccctctgagtgccaaccagatccaggtgaagcgagaggaactaattaccaactgggagcagatccgaactctggccgcagagagacatgcacggcttgatgactcatacaggcttcagcgctttcttgctgacttccgtgacctcacgagctgggtgactgaaatgaaagccctcatcaatgcagacgagcttgccaatgacgtggctggtgctgaggccctgctggacaggcatcaagagcacaagggtgaaatcgatgctcatgaagatagctttaagtctgcagatgagtctgggcaggccctactcgctgctggtcactatgcctcagatgaagtgagggagaagctgagcatcctctctgaggagagagctgccctgctggagctgtgggagcttcggaggcagcagtatgagcagtgcatggacttgcagctcttctaccgagacactgagcaggtggacaactggatgagcaaacaggaggcattcctgctaaatgaagatttgggtgactccttagacagtgtggaagctcttttgaagaagcatgaggactttgagaaatctctcagtgcccaggaagaaaaaatcacagcacttgatgagtttgcaaccaagcttattcagaacaaccactacgcaatggaagatgtagccactcgacgagatgctctcctgagccgccgcaatgccctccatgagcgagccatgcatcgccgggcacagctggccgattccttccacctgcagcagttcttccgcgattccgatgagctcaaaagttgggtcaatgagaagatgaaaacggccactgatgaagcttacaaagatccgtccaacctgcaagggaaagtccaaaagcaccaggcttttgaggctgagctctcagccaaccagagccgtattgatgccctagagaaagctgggcaaaaactaatagatgtgaaccactatgccaaggaagaagtagcagctcggatgaatgaggtcatcagtttgtggaagaaacttctagaggccacagaactgaaaggagtcaagctccgagaagccaaccagcagcaacaatttaatcgcaatgttgaggacattgagttgtggctgtatgaagttgaaggtcacttggcttcagatgattatggtaaagacctcactaatgtccagaacctccagaagaagcatgctctgctagaggcagatgttgctgctcaccaggatcgaattgacggcatcacaattcaggcccgccagttccaagatgctggccatttcgatgccgaaaacattaaaaagaagcaagaggcccttgtagctcgctatgaggctctcaaggaacccatggtggcccggaagcagaagctggcagattctcttcgtctgcagcagctcttccgagatgtggaggatgaggaaacctggattcgagaaaaggagcctattgctgcgtccactaacagaggcaaagatcttattggagtccagaatctgctaaagaagcaccaagctttacaggcagaaattgctggccatgaacctcgcatcaaagcagtgacacaaaagggcaatgccatggtggaggaaggccattttgctgctgaggatgtgaaggccaaactgagtgagctcaaccagaagtgggaggcactgaaagccaaagcctcccagcggaggcaggatctggaggactcactacaggcccagcagtactttgccgacgccaatgaagctgagtcctggatgcgggagaaggagcccattgtgggcagtaccgactatgggaaggatgaagactctgctgaggctctgctcaagaagcatgaagctttgatgtccgatctcagtgcctacggcagcagcattcaagctttgcgagagcaggctcagtcatgccggcaacaagtggcccccatggatgatgagactggcaaggagctggtcttggctctctatgactatcaagagaagagccctcgtgaggtcaccatgaagaaaggggatatcctcaccttgctcaacagcacaaacaaggactggtggaaagtggaagtgaatgaccgtcagggttttgtgccagctgcgtatgtgaagaagctggaccccgcccagtcagcctcaagggagaacctcctggaagaacagggcagcattgctctgcggcaggggcagatcgacaaccagacacgcataactaaggaggccggcagtgtatctctgcgtatgaaacaggtggaagaactgtatcagtctctgctggagctgggtgagaagagaaaaggcatgttggagaagagttgcaagaagttcatgttgttccgggaagcgaacgagctacagcagtggatcaacgagaaggaagctgctctaacgagtgaagaggttggcgctgacttggagcaggtcgaggtgctgcagaagaagttcgatgacttccagaaggatctgaaagccaatgagtcccggctgaaggacattaacaaagtggccgaggacctggagtctgaaggtctcatggcggaagaagtgcaggccgtgcagcagcaggaggtgtatggtatgatgcccagggatgaagcagattccaagaccgcctccccatggaagtctgctcgactgatggtccacacagtggccaccttcaactccatcaaggagctgaatgagcgctggcggtccctgcaacagctggctgaggaacgtagccagctcctgggcagtgcacacgaagtacagaggttccacagggatgcggatgaaaccaaagaatggattgaggagaagaaccaggctctgaacacagacaactatggccatgatctagctagcgtccaggccctgcagcgcaaacacgaaggcttcgagagggaccttgcagctcttggtgacaaggtgaattcccttggggaaacagcccagaggctgatccagtcccaccctgaatctgcagaggacttaaaggaaaagtgcacagagttaaaccaggcctggaccagcctagggaagcgtgcagaccagcgcaaggccaaactgggtgactcccatgacctgcagcgcttccttagcgatttccgggacctcatgtcttggatcaatggaatacgagggttggtatcttcagatgaactggccaaggatgtcactggagctgaggctttgctggagcgacaccaggaacaccggacagaaattgatgccagggctggcactttccaggcatttgagcagtttgggcagcagctgttggctcatgggcactatgccagcccagagatcaaggagaaacttgatattcttgaccaggagcgcacagacctggagaaggcctgggttcagcgcagaatgatgctggaccactgcctggagttgcagctgttccatcgagactgtgagcaagcagagaactggatggctgcccgggaagccttcctaaacacagaagacaaaggagactcgctggacagtgtggaggctctgatcaaaaaacatgaagacttcgacaaagctatcaatgtccaggaggagaagatagctgccctgcaggcctttgccgaccagctcattgctgtggaccactatgccaagggagacattgcaaaccgacgcaatgaggtcctggacaggtggcgccgcctaaaagcccagatgattgagaaaaggtcaaagctcggagaatctcaaacacttcagcagttcagccgggatgtagatgagattgaagcctggatcagtgagaagttacaaacagccagcgatgagtcatacaaggaccccaccaacatccagagcaagcaccagaagcaccaagcctttgaggcagaactgcacgccaatgctgaccgaatccgtggagttattgacatgggcaactccctcattgagcgtggggcctgtgctggcagtgaggatgctgtcaaggcccgcctggctgcccttgcagaccagtggcagttcctggtgcagaagtcagctgagaagagccagaagctgaaagaggccaataagcagcagaacttcaacaccgggatcaaagactttgacttctggctttctgaggtggaggctctcctggcatctgaagactacggcaaagacctggcttccgtgaacaacctgctcaaaaagcatcagctgctggaggcagacatatcggcccacgaggatcgtctgaaggacctgaacagccaggctgacagcctgatgactagcagtgccttcgacacctcccaagtgaaagagaagcgggacaccatcaatggacgctttcagaagatcaagagcatggcaacctcccgaagagcaaaactgagcgagtcccatcgcctgcaccagtttttccgagacatggatgacgaggagtcctggatcaaggagaagaagttgttagtgagctctgaggactatggcagagacctcactggtgttcaaaatctgaggaagaaacacaagcggctagaagccgaactggccgcacacgaaccagccattcagggtgtcctggacacggggaagaagctgtctgatgacaacaccatcgggcaggaggagatccagcagcgtctcgcacagtttgtggagcactggaaggaactgaaacagctagcagctgcacggggccagcggctggaggagtccttggagtatcagcagtttgtggccaacgtggaggaggaggaggcttggatcaatgagaagatgaccctggtggccagcgaagactacggggacactcttgctgccatccagggcttactgaagaaacatgaagcttttgagacagacttcactgtccacaaggatcgagtgaatgatgtctgtactaatggacaagacctcattaagaagaacaatcaccatgaggagaacatctcttcaaagatgaagggtctgaatggtaaagtgtctgacctggagaaagcagcagctcagaggaaagcgaagctggatgagaactcggccttccttcagttcaattggaaggctgacgtggtggagtcctggattggtgaaaaggagaacagcttgaaaacagatgattatggccgagatctgtcttctgtccaaactctgctcaccaagcaggagacatttgatgctggcctgcaggccttccagcaggagggcattgccaatatcactgccctcaaagaccagctgctagctgccaagcacattcagtcgaaggccatcgaggcccgacatgcctccctcatgaagaggtggacccagctgttggccaattcagctacccgcaagaagaagttgctagaggcccagagtcatttccgaaaggtagaagacctcttcctgacctttgccaaaaaggcatcggctttcaacagctggtttgagaatgcagaagaggacctcacagacccagtgcgctgcaactctctggaagaaatcaaagccctccgagaggctcatgatgccttccgctcatcgctcagctctgcgcaggccgacttcaaccagctagccgagctggaccgtcagatcaagagtttccgagtggcctccaatccctacacctggttcaccatggaggccctggaagagacgtggaggaacctacagaagatcattaaggagcgagaactggagctgcagaaggaacagcggcggcaggaggagaatgacaagctacgccaagagtttgcccagcatgccaacgcgttccaccagtggatccaggaaacaagaacgtatctcctcgacgggtcctgcatggtcgaagagtcgggaactctggaatctcagcttgaagctaccaaacgcaagcaccaggagattcgggccatgagaagtcagctgaagaagattgaggacctgggggctgccatggaggaagccctcatcctggacaacaagtacactgagcacagcactgtgggcctggcccagcagtgggaccagttagaccagctgggcatgcgcatgcagcacaacctggagcagcagatccaggccaggaacacaacaggagtcactgaggaggccctcaaggagttcagcatgatgttcaaacacttcgacaaggacaagtctggccggctgaatcatcaagagttcaaatcctgccttcgttctctgggttacgacctgccaatggttgaggaaggagagcctgatcctgagtttgaggccatactggacactgttgatcccaacagggacggccacgtctccctgcaagagtacatggctttcatgatcagccgtgaaaccgagaatgtcaagtccagtgaagagatcgagagtgctttccgggccctcagctccgagggcaagccttatgtgaccaaggaggagctctaccagaacctgacccgggaacaagctgactactgtgtctcccacatgaagccctatgtggatggcaagggccgcgaacttccaactgccttcgactacgtggagttcacccgctctctctttgtgaattgat

SEQ ID NO: 1284 - DNA, 663 bp, Rattus norvegicus
  Genbank Accession No. AF091567
ggcaatatctccttctctgacctctgcttttcctctgttacgatgcccaagttgttgcagaacatgcagagccaagttccatccatcccctatgcaggctgcctgacacaattatacttttacctgtattttgcagaccttgagagcttcctgcttgaggccatggcctatgaccgctatgtggccacctgcttcccccttcattacatgagcatcatgagccccaagctctgtgtgagtctggtggtgctgtcctgggtgctgaccaccttccatgccatgctgcacaccctgctcatggccagattgtcattctgtgcggacaatatgatcccccactttttctgtgatatatctcctttattgaaactgtcctgctctgacacgcatgttaatgagttggtgatatttgtcatgggagggcttgttattgtcattccatttgtgctcatcattgtatcttatgcacgagttgtcgcctccattcttaaagtcccttctgtccgaggcatccacaagatcttctccacctgcggctcccatctgtctgtggtgtcactgttctatgggacaatcattggtctctacttatgtccgtcagctaataactctactgtgaaggagactgtcatggccatgatgtacacagtggtgacccccatg

SEQ ID NO: 1285 - DNA, 663 bp, Rattus norvegicus
  Genbank Accession No. AF091570
ggcaatatgtccttctctgacctctgcttttcctctgttacgatgcccaagttgttgcagaacatgcagagccaagttccatccatcccctatgtaggctgcctgtcacaaatatacttctttctgttttttggagacctcgggaacttcctgcttgtggccatggcctatgaccgctatgtggccacctgcttcccccttcattacatgagcatcatgagccccaagctctgtgtgagtctggtggtgctgtcctgggtgcggactaccttccatgccatgctgcacaccctgctccatggccagattgtcattctgtgaggacaatgtgatccccactttttctgtgacatgtctgctctgctaaagctggcctgctctgacacccgtgttaatgaggttgtgatatttattgtggtcagcctctttcttgtccttccatttgccctcattatcatgtcctatgtaagaattgtgtcttccattctcaaggtcccttcttctcaaggtatttacaaagccttttccacatgtggatctcacctgtctgtagtgtcactgttctatgggacagtcattggtctctatttatgtccttccagtaataattctactgtgaaggagactgtcatgtctttgatgtacacagcggtgactcccatg

SEQ ID NO: 1286 - DNA, 663 bp, Rattus norvegicus
  Genbank Accession No. AF091574
ggcaatttctccttctctgacctctgcttttcctctgtcacaatgcccaaattgcttcagaacatgcagagccaagtaccatctatatcctatgcaggctgcctgacacagctgtatttctttatggtttttgcagacatggagagcttccttcttgtggtcatggcctatgaccgctatgtggccatctgctttcctttgcattacaccaccatcatgagcaccaaggtttgtgcttcactacttatactactatgaatgctgacgacatcccatgccccgctgcataccctactcatggctagattgcctttttatgagaagaatgtgattctccactttttctgtgacgttactgctcttctgaagttgtcctgctcagacacttatgttaatgagatgatgatgtatatcttgggtggactcatcagtgttattccattcctatttattgttatgtcctatgtaaggattttcttctccattttgaagtttccatctattcaggacatccacaaggtcttctccacctgtggttcccatctgtctgtggtgaccttgttttatgggacaatttttggtctctacttatgtccatcaggtaataattctactgtgaaggaaattgccatggctatgatgtacacagtggtgactcctatg

SEQ ID NO: 1287 - DNA, 2304 bp, Rattus norvegicus
  Genbank Accession No. AF093139
attccatcctaatacgactcactatagggctcgagcggccgcccgggcaggtccaaggcgtccgggtgtttggtggcgtcaggttctgcgcctgagcccgcccctgtacctgcctgtgccatggcggacgaagggaagtcatacaacgaacatgatgaccgtgttagtttcccacaaagaagaaagaaaggtcgggggcctttccgatggaagtgtggtgtggggaatcgtaggtctggaagaggtggttctggtatacggtcttcccggtttgaggaagatgatggagatgtggcaatgaatgatccccaggatggcccccgagtgagattcaacccctataccacccgacctaaccgtcggagagatacttggcatgatcgagatcggattcatgttactgtacggagagacagagctcctcaagaaagaggaggtgctggcaccagtcaagatgggaccaccaagaactggttcaagattacaattccttatggcaaaaagtatgataaaatgtggcttctgagcatgattcaaagcaagtgcagtgtccccttcaaccccattgagtttcactatgaaaatacacgggcccatttttttgtggaaaatgccactaccgcttctgcattaaaggctgtcaactataagattcaggatcgagaaaacggaaggatatctatcatcatcaactcttctgctccaccctatattgtacagaatgaactgaagcctgaacaagtagagcagctcaagctgatcatgagcaaacgatatgatggctcccagcaagcacttgacctcaagggcctccgctcagacccagatttggtggcccagaacatcgatgttgttctaaaccgtagaggctgtatggcagccgccctgaggatcattgaagagaacattcctgagctattgtctttgaacttgagtaacaacaggctgtacaagcttgatgacatgtccagcattgtacagaaggcaccaaacttaaagatcctgaatctctctggaaacgaattgaagtccgagtgggaattagacaagataaaagggctgaagctggaagagctgtggcttgacagaaaccccatgtgtgacaccttcctagaccagtccacctatatcagcaccattcgcgaacgatttcccaagttattacgcctggatggccatgagctaccccctccaattgcctttgatgtcgaagcccctactatgttaccaccctgcaagggaagctattttggaacagagaacctaaagagtctggtcctgcacttcttgcagcagtactatgcaatttatgactcaggagaccgccagggtcttctggatgcctaccatgatggcgcctgttgctcgctaagcactccttccaaccctcagaaccctgtccgacacaacttagccaaatacttcaatgacagcagaaatgtgaagaagattaaagataccaccacgcggttccggctattaaagcatacacgtcttaatgtcgttgccttcctcaatgagttacctaaaactcaccatgacgttaactcctttgtggtagatataagtgcccaaacaagcacattgttgtgtttttctgtcaatggagtcttcaaggaagtggacgggaagtctcgagattctttacgtgctttcacgagaacgttcattgctgttcctgccagcaattcagggctatgtattgtaaatgacgaattatttgtgcggaacgccagccctgaagaaatccaaagagccttcgccatgcctgcacccacaccttcttccagcccagtacccacactctcccaagaacagcaggatatgttacaagcattttctacccagtctggcatgaacctcgagtggtctcagaagtgccttcaagacaataactgggactacaccagatctgcccaggccttcactcatctcaaggccaagggagagattccagaagtagcgtttatgaaatgatctcaagaaaagtccccttgtaaatagcccttggataatattgtctggctgtcatctgcggactcctgtccagcccgaggccacmctgtaactgtgactggggaggaagggctgcytcatccktcctcacctaccttctggaagmcttagcagaagacttccggaagattgagcctctatggtgccaggaagccaaagcttactttgtagagctdgacrctaaattaccggaaggacttaggtgctctgtgtacttaaccccagsattccctttactttttaagataaagagtgatattgtagtgtgtgtcccaaaaaaaaaaaaaa

SEQ ID NO: 1288 - DNA, 931 bp, Rattus norvegicus
  Genbank Accession No. AF099093
  misc_feature (1)..(931): n = a or c or g or t
agctccaccgcggtgngccgctctagaactagtggatccccgggctncaggaattcctttcccttccgggcgtgacgcctgagaggaaagccgagcggagatctcgcataggcagcgaggtgcttctcgggtctcccaagaccggcctcccgcggcttcggcgctccagtcgcggggcccgggttcctcaacacacntagcttcagccaccgtcagagcttgtcccccatccgtcgaagtcccggcggcaccgggcttcttggtggggaggatgacggagctgcagtcggcactgctactgcgaagacagctggcagaactcaacaaaaatccagtggaaggcttttcagcaggtttaatagacgacaatgatctctatcgttgggaagtccttattattggtcctccagatacactttatgaaggtggtgtttttaaggctcatctcactttcccaaaagattatcccctccgacctcctaaaatgaaattcattacagagatttggcacccaaatgttgataaaaatggtgatgtttgcatttctattcttcatgaacctggagaggataaatatggttatgagaagccagaggaacgctggctgcctatccatactgtggaaaccatcatgattagtgtcatttctatgctggcagatcctaatggagactcacctgcaaatgtagatgctgcgaaagaatggagggaagacagaaatggagaatttaaaaggaaagttgcccgctgtgtaagaaaaagccaagaaactgcttttgagtgatgtttattcaatagctagtaacttcacttatttcagggtctccaattgagaaacatggcactgtttttycttgcacctctacccaccttattgctgggacttctgttgtaacaagttggcaaactctggctggaactgggctgcaat

SEQ ID NO: 1289 - DNA, 7867 bp, Rattus norvegicus
  Genbank Accession No. AF102552
atggctcatgccgcttcccagttaaagaaaaacagggatttagaaatcaatgcggaagaagagaccgagaaaaaaaagaagcaccgtaaacggtcccgggatcgcaagaaaaagtcggatgccaatgcaagttacttgagagcagctcgggcggggcacctggaaaaggcccttgactacatcaaaaatggagtggacgtcaacatctgtaaccagaatgggttgaatgcgctccatcttgcttccaaagaaggccatgtggaagtggtctccgagctgctgcagagagaagccaacgtcgatgcagccacaaagaaaggaaacacagccttacacatcgcatccttggctggacaagcggaagtggtcaaggtcttggttacgaacggagcgaacgtcaacgcacagtctcagaatggcttcacgccgctgtatatggcggcccaggagaaccacctggaagtcgtcaggtttcttctggacaatggtgccagccaaagcctggctacagaggatggcttcacgccattggccgtggctcttcaacaaggtcacgaccaagtcgtatccctcctgctcgagaacgacacgaagggaaaagtgcgcctcccagccctccacatcgcggcccggaaagatgacaccaaagcggcagctctgctcctacagaacgacaccaatgcagacatagagtcaaagatggtggtgaatagagcaactgagagtggcttcacctcactccacatagctgcccactacgggaatatcaatgtggccacgttgctgttaaaccgagcggctgccgtggacttcaccgcacggaatgacatcactcctttgcatgttgcctcgaaacggggaaacgcaaatatggtaaagctgttgctcgaccggggtgcgaagatcgacgccaagaccagggacggtctgaccccgctgcactgcggggcgagaagtggccacgagcaggtggtagagatgttgctggacagagccgcccccatcctttcgaaaaccaagaatggactgtccccactgcacatggccacacaaggagaccatttaaactgcgtccaactcctcctccagcacaacgtgcccgtggatgacgtcaccaacgactacctgaccgccctccacgtggcggcccactgcggccattacaaagttgccaaggttcttttggataagaaagctaaccccaatgccaaagccctgaatggcttcacccctctccatatcgcctgcaaaaagaaccgaatccgagtaatggaactccttttgaagcacggtgcatctattcaagccgtaaccgagtcgggccttaccccaatccatgtcgctgccttcatgggacatgtaaatatcgtgtcacagctaatgcatcatggagcctccccaaacaccaccaacgtgagaggagaaacagcattgcatatggcggctcggtcggggcaagcagaagtggtgcggtatttggtacaagatggagctcaggtagaagcaaaagctaaggatgaccagaccccactccacatttcagcccgactcgggaaggctgacatagtgcaacaactgttacagcaaggagcgtccccgaatgcagcaacaacttccgggtacaccccccttcacctttcggccagagaggggcatgaggatgtagctgccttccttctggaccatggagcatctttatccataacaacaaagaagggattcacgcctctgcatgtggctgcaaagtatgggaagcttgaagtggcaagtctcctgctgcagaagagtgcgtctcctgatgccgctgggaagagcgggctaactccactgcatgtagcagcacattacgataatcagaaagtggcccttctgcttttggaccagggagcctcaccccacgcagctgcaaagaacggttatacgccactgcacatcgccgccaagaagaaccagatggacatagccacgtccctgctggagtacggtgctgatgcaaacccggttacccggcaagggattgcgtccgtccaccttgcagcgcaggaagggcacgtggacatggtgtcgctgctcctcagtagaaatgcgaacgtcaacttgagcaataagagcggcctcaccccactccacctggcggctcaagaagaccgagtgaacgtggctgaggtccttgtcaaccaaggggcccacgtggatgcacagacaaagatgggctacacgccgctccatgtgggctgtcactatggaaacatcaaaatagtcaattttctgctgcagcattctgcgaaagttaatgccaagacaaagaatggatacacgccactgcaccaggcagcccagcagggccacacacacatcatcaacgtcctgctccagaacaacgcttcccccaatgaactcactgtgaatgggaacacagccctggccatcgcccgacgccttggctacatctcggtggttgacaccctaaaggtcgtgacagaggaaattatgaccaccactaccatcacggagaagcacaaaatgaatgtcccagaaacaatgaatgaagtcctcgacatgtcagacgatgaagttggtaaagccagcgcccccgaaaagctcagtgatggggaatatatctcagatggtgaagaaggtgaagatgccatcacaggggacactgacaagtatctcgggccacaggacctcaaggagctgggcgatgactccctgcctgccgagggctatgtgggcttcagtctcggagcccgttctgccagccttcgctccttcagttcggataggtcctacaccctgaacagaagctcctatgcgcgggacagcatgatgatcgaggagcttctggtgccatccaaagagcagcaccttccattcacgagggagtttgactccgactccctcagacactacagttgggcagcagacacactggacaatgtgaacctggtctccagccctgtgcattctgggtttctggttagctttatggtggacgcgagagggggctccatgcgaggaagccgccaccacgggatgcggatcatcatccctccgcgcaagtgtacggcccccacccgcatcacttgccgcctggtaaagagacataaactggccaacccaccccccatggtggaaggagagggattagccagtaggctggtagaaatgggtcctgcgggggcacaatttttaggcccggtcatagtggaaatccctcattttgggtccatgagaggaaaggagagggaactcattgtcctccggagcgagaacggagagacctggaaggaacaccagtttgacagcaaaaacgaagacctctcggagctcctcaatggcatggacgaagaacttgacagcccagaagagttgggcacaaagcgcatctgcagaatcatcacgaaggatttcccccagtatttcgctgtggtttcccggattaagcaggaaagcaaccagattggtcccgaaggtgggattctgagcagcaccacggtccccctcgtccaggcgtctttcccagagggtgccttaaccaaaaggatccgtgtgggtctgcaggctcagcccgtaccagaggagactgtgaaaaagatccttggaaacaaagcaacgtttagcccaattgtcacggtggagccgaggaggaggaaattccataagccgatcaccatgaccatcccggtgcccccaccctcgggagaaggcgtgtccaatgggtacaagggggacaccacgcccagcctgcgactcctctgcagcattacaggagggacctcgccggctcagtgggaagacatcacaggcacaaccccgctgaccttcataaaggactgtgtgtctttcacaaccaatgtttcagccaggttctggctggcggactgccatcaggtgttagaaaccgtagggctagcctcgcagctgtacagagagttgatatgtgtcccctacatggccaagtttgttgtttttgccaaaacaaacgacccagtggaatcctccctaaggtgcttctgtatgacagacgacagagtggacaaaaccctggagcagcaggagaatttcgaggaggttgccagaagcaaagacatcgaggttctggaaggaaagcccatctatgttgattgctatggaaacctggctcctctgaccaaaggagggcagcagcttgtttttaacttctattctttcaaagaaaacagactgccattttccatcaaggttagagacaccagccaagagccctgcggccgtctgtctttcctgaaggagccgaaaacaacaaaaggattaccccaaacggctgtttgcaacttaaatattactctaccggcgcataaaaaggctgagaaggcagacagacgccagagcttcacatccctagccttacgtaagcgctacagctacttgactgagcccagcatgaaaacagttgaacggagttcaggaacagcaagatcccttcccactacttattcacacaagccattcttttctacaagaccataccagtcctggactacgactcccataacagtgcccgggccggccaaatcaggctccttatccagctccccctctaacacgccgtcagcgtctccgttaaaatccatatggtctgtttcaacgccttctccgatcaaatccacgctaggcgcctcaactacgtcatcagtcaaatccattagtgatgtggcgtctcctattagatctttccggacaatttcttcgccaataagaacggtggcatcgccgtctccatacaatacccaagtagcctctggtacccttgggagggtacccaccatcacagaggccacacctataaagggggtggctcccaactcaactttgtcctctcgaacttctcctgtgacgaccgcagggtctctgttggagaagtcgtccatcaccatgacaccccctgcctcccccaaagccaacatcaccatgtattcctccagcttgccatttaagtccattatcacgtcagcggcaccgctgatctcctcccctttaaagtcagtggtgtctccgaccaagtctgcagctgatgtcatctcaacagctaaagctgcgatggcatcgactctctcctcccccttaaagcagatgtctggacatgcagaagtagcgctagtcaatgggtctgtttctcctctgaagtatccttcctcttccgctttaattaacggatgcaaagccactgccacattacaggacaaaatttctacagccacaaatgctgtgagctcggtggtgagcgcggcccctgacacggtggagaaagcgctctccaccacaacagccatgcccttttccccactcaggtcttacgtttccgctgcagcgccctctgcttttcagtcccttagagctccctctgccagtgcactctacaactccctcgggccttcagtaggtgttactacctcatccgtaacttcatcgataatcacagtgccagtatactcggtaggcaatgttttggcagaaccagcattgaagaaacttccagactctaactcgctcacaaaatcggcagcggctttgctgtcgcccattaaaacattgactacggagacacgtcctcagccccatttcaatcgaacgtcatctcccgtcaagtcctctctgttcctggcatcctcggcccttaagccgtcagtaccatcttctttatcttccagtcaggagatcttaaaagatgtggccgagatgaaggaggacctcatgagaatgaccgccatactgcagacggatgtgcctgaggagaagccattccagaccgacctcccccgagaagggaggatagacgacgaagagcctttcaaaatcgttgagaaagtgaaggaagacttagtcaaagtcagtgagatactcaaaaaggacgtgtgtgtcgagagcaaagggccacccaagtccccaaagagtgacaaaggacactctccagaagatgactggacggaatttagttctgaggaaatacgagaagccaggcaggctgctgccagtcacgccccatccctgcccgagagagtacatggaaaggccaacctcaccagagtcatagactacctgaccaatgacatcgggagcagttcactgaccaacttaaagtacaagtttgaagaggctaagaaggaaggagaggagagacagaagagaattttaaagccagccatggccttgcaggagcataaactcaaaatgccgccagcctccatgagaccttccacctccgagaaggaactgtgcaagatggcggactccttttttggaacagatgccatcctagagtctcccgatgacttttctcaacatgaccaagacaaaagtcccttgtccgacagtggctttgaaacccgaagtgagaaaacaccttcagccccccaaagtgccgagagcaccggccctaagccactatttcatgaagtccccatcccccctgtcatcacagagacgagaactgaagtagtccacgtgatcaggagctacgagccctctactggggagatcccccagtcccagccagaggaccccgtgtctcccaaacctccccctacatttatggagttggaaccaaagcccaccgcccttagcattaaggaaaaagtgaaagcattccaaatgaaagccagtagcgaggaagaggaccacagtcgggttttaagcaaaggcatgcgtgtcaaagaagagactcacatcaccacaaccacgaggatggtgtatcactccccgcctggcagtgagtgtgcctccgagaggattgaggagaccatgtcagtccatgacattatgaaggcttttcagtccgggcgagacccttccaaagagctggcggggctgtttgaacacaagtcggccatgtctccggatgttgccaagtctgctgctgagacctcggcccagcacgcagagaaggacaaccaaatgaaacccaaactggagcgtattatagaggtccacatcgaaaaaggtccacagagtccttgtgagcggacggatatcaggatggcaatagtagccgatcacctgggacttagttggacagagctggcaagggaactgaatttttcagtggatgaaatcaaccaaatacgagtggaaaatcccaattctttaatttctcagagcttcatgttattaaaaaagtgggtgacgagagacgggaagaatgccacaactgatgccttaacttcggtcttaacaaaaattaaccgaatagacatagtaactctgctggaaggaccaatatttgattatgggaatatttcaggcaccagaagctttgcagatgaaaacaatgttttccatgacccagttgatggttggcagaacgagacgccaagtggaagcctagagtccccggcgcaagcgcgaagaataaccggtgggttactggaccgtctggacgacagctctgaccaggttcgggatcccattacctcatacctcacaggagaagctgggaagttcgaagcaaacggaaaccacgcagaagtcattccagaagcaaaggccaaggcctactttcctgaatcccaaaacgatatagggaaacagagcatcaaggagaacttgaaaccaaaaacacacggatgtggtcgcgctgaggaaccagtgtcgcccctcacagcctaccagaaatctctagaagaaaccagcaagcttgtcatagaagacgcacctaaaccctgtgtgcctgtcggcatgaaaaagatgaccaggactccggctgacggcaaagccaggctcaacctccaggaagaggaggggtccgccaggtcagagcctaagcagggagaaggctataaggtgaaaacaaagaaggaaatccggaatgtggagaagaaagcccact

SEQ ID NO: 1290 - DNA, 471 bp, Rattus norvegicus
  Genbank Accession No. AI007626
ggcaaaaaatgttagactcttttatacaaaaacaaagccaacaaaacaaaacaaaataaccccaaacccttgtaaattttaaagacctataataattacaacgatgtaaacttggatgtctgacagcttgaccaccctggggaacctgggttgtggcaggagccacagggagaaggtgacacggaactgttggatagcaacagctgccttagaggcggttaggtttagtctatcagagatggagcaggactactgacttcatttgtgctttctgctaaaggctgggagcttgaagaaataaagaaggcaggtccgggctggagcaaggacaggaggcccacgactagacagtgtgatagagagggtggtcatggacacagtgcagactaagaacaggcatggactctggactgtttacgagacctgatgctgtacagaactacaatgacgctgctgctgctacatgtgaga

SEQ ID NO: 1291 - DNA, 460 bp, Rattus norvegicus
  Genbank Accession No. AI007642
aaatatcttcaaggtttcattgtaacaaagctatgaagggactaccaacattcagaacaaacactatttttaaattatttctatgtcgtcatgcaaaagttctgcatcaaatgcctttcatttcctgtttaaaaggtggtttttttttttaaatagtctattaattgtctatagatgctgacattagccccagaagtggagtaagaacgctaagtggggctggagcagccatatgaagctatgggtctcaatgagctctaagaccatttgttgtcttcaagccagcacaaccaaaccctgtggtgaagggatctgttggctggcactgcaggctgcagggcaggaaggggctagggtccagggtctgaggcatgcacaaggtgcttgaggagcctggctaaattcaggcaccagcacccatgagtttgttctcttctcagctgggtccaaagtctgtagt

SEQ ID NO: 1292 - DNA, 564 bp, Rattus norvegicus
  Genbank Accession No. AI007666
cggctgctggagggaggatggggtgatgcaccgccgggtggtgcgcggcgtgcgcggcggctgcagggtgcgccgtggcggtgggtagaggcgtcgagtgtgccagcccgccacaggccgacgggtggaagccggcgtggtgacccccgtaaatctcgctcaccagtctcttcatctcctccagcgagttggtgagcatcaggatgtagtttcgcgccagcagcagcgtggcgatcttggagagcttgcgcaccgacgggccgtgcgcgtacggcatgacctccctcaggccgtccatggcgatgttgaggtcgtgcatgcgcttgcgctcgcggctgttgatcttcaggcgcagctgctgcagctcgggctcagtcatctgcttcttatctttcttggtggaagacgtggccgccgacgacgtggacgaggaggtgctggaggaagatgacttgaagccaccgccgcccagtttgtccccgggatgcgcgcccgccgtgcccatggctcctcgcagctcggagctcaactctggcgggcagtcgctcggcgtggatgaggaca

SEQ ID NO: 1293 - DNA, 239 bp, Rattus norvegicus
  Genbank Accession No. AI007672
aagctaaaattgcacctcactaataggaataagcttgcggccgctagagattttttttttttttttttttttttgaataaataagcattaagtttattgaatcatgaataatttaagactggtacaatcgtcagatttattctctatgacatggggcagatctccagcagattgttctcaaacccaaaaacctgatgacacatgagaattaaatagggagagggaggggtggggggcag

SEQ ID NO: 1294 - DNA, 516 bp, Rattus norvegicus
  Genbank Accession No. AI007748
aatgataaacaggacatttatttttcatattcatttgggggaaagggagaaaagtcagtctgccctattaaatgctggtccttctgaaagaacttccacttaccctacgacactggataaaattcttgattacagaggattctgtactcttaatttgtaagaagaactgcctttgaagagagtgcttacagagtgagccgttgtgagcagcttcgttggtgcacagccaggctccctctctgagtgaaactttttccacattggccacagaggtacggtgtctctcccgtgtggatttttccatgcagaataaattccccctggtgtggaagctcttccttctgtctcactccaggtgagtcttcctggagtgccttagaatctggggacttttgttccagcttctctcttctgaaagaactctggaaatcccagcttgaggatcctgtggcctctgaagaatcatacttgtgggcttctgtcatcacattgaaaaatgctacattctgcgccgta

SEQ ID NO: 1295 - DNA, 550 bp, Rattus norvegicus
  Genbank Accession No. AI007750
gatgataaattctaagctcaaattttatttctacaaaaaaaggcaatcaaaacaatataaaacacattgaaaggatattattgagcttcaagtggagcttgactggaaaggctttgggtccagaggggagggggaaaagccatcctgttcctgggctgccccaggagctgctctgaggaagaggcagaagccaccaaccctggctgatcccaccaagagtaaaccccaaggagggaaggccgtggtgcctgctgtgctgaggagtgggaacaccttagcacatcctatcagagcttggtagtagagaagcttgaaatttcaaaagaatattctggttttgctttgtatgtgatgaccaggtcttctaccacagctgtaggaaggactgctgactgtcagcctttctggagagaaattcatcacacaagtgcactgtattctccaatggcagacctcccttcaaggtcaccacaaacctgatataacagggttccccacaaagacccagcacagtctgaccactgatgtggaccatggggtctgtctgttg

SEQ ID NO: 1296 - DNA, 482 bp, Rattus norvegicus
  Genbank Accession No. AI007761
gcaaaggctttatttgaaaattttgaaacttacataccacaagattatcaccacaagaagaaagagataatacaaaaatatatatcacagcataggagccaggtaagagggagaagggctggagagatgaacaagaaagaggggagaacctgaagaaaggaaaagggagagggaaggaggggacatgaggggatgtgacgggacccaggaagagaaggtggatacggaggcagagctcccaatggccttgaaccagctggcttcagttcctggcagcctaggtacatttagggaggccttaggggagggtgggaggtggaggacctatggagggggctccgaattccatacagacacatacacacagacagccagggcagacaagacaagggacttgggagggaagggagaacatgggagccccatctcatgtagtgcagcaggtgactcccccaaatccatatttcaggtgacagagttta

SEQ ID NO: 1297 - DNA, 569 bp, Rattus norvegicus
  Genbank Accession No. AI007824
cctcactatagggaataagcttgcggacgctaaagttttttttttttttttttttttttttttttagtattactttgacttgtgagtctaggttaaaatcattcggaggattttttattctccgaggtcaccccaaccgaaattttttagttcatatttattttgttttagcccattaggttgtttttatataagttgaactagtaaattgaagctccatagggtcttctcgtcttattgggagattccagcctcttcactggaaggtcaatttcactgattgaaagtaagagacagttgaaccctcgtttagccattcattctagtccctaattaaggaacaagtgattatgctacctttgcacggtcaggataccgcggccgtttaactttagtcactgggcaggcaatgcctctaatacttgttatgctagaggtgatgtttttggtaaacaggcggggttcgtgtttgccgagttccttttactttttttaatctttccttaaagcacgcctgtgttgggctaacgagttagggataagtaattttattgttgggttagtaccta

SEQ ID NO: 1298 - DNA, 399 bp, Rattus norvegicus
  Genbank Accession No. AI007847
caaaaataattaaaaacaaaaaccacaacaatcttaaatgcagaagagcagttaaataaaactgctaccgaattcaaggatgtaccaaacgtacatgcttcctcactgtgaggcacatgactgtgtatgtaggcagataggtagggaagtgtgtgtgtgtgtgtgtgtgcgtgtgcgtgtgcgtgtgtgtgtgtggtgtgtgtggtgtcagatgataaaccttttgttggaactgaagaaattccaaacctcgctgcccgagcagccttcttactctccaagcttacaggcacattgaaacgttcagccctcttctgcattctctcagtttgaggtattccagatgtaatttttaccaccttcttttctgatgccatatcaacaactttttcaggaggt

SEQ ID NO: 1299 - DNA, 545 bp, Rattus norvegicus
  Genbank Accession No. AI007857
ctcactaaatagaataagcttgcggccgctagagtattttttttttttttttttttttttttttttaattttgaaatacattttattttcactgttctgcactggagagatgacatccaaggagtaggggagacagagatgcctgaaacttctacccttgctgtgcatgggtcacatcgttcttctgggtaccagggccatgcctggacaccacacagttcacatcggactctgggccaggctaaccatccccacagcagtcacctctggcaggccccgacacagctgggcattctccagaaaaggtcctacttgtcctgcagagtcccagtcccgggaaggtcggactgcatcaggaccaaagcagggaaccagtgacaggagccagaccactgaggacagggaggagggccaagggtgaaggcccaccccttgctcacagaagggacactacagggcagtaatgggaggaaatggctagttagacatataagtggtttctggagaactgtactgttactctggatggtgagcgccagactcaa

SEQ ID NO: 1300 - DNA, 635 bp, Rattus norvegicus
  Genbank Accession No. AI007877
gctccaaaagtaatagttaaaattaccagtgggtaaattatcttacacttactaaactaacattatatgttttacaattttgaacaactttacaagttactgttattttcaattctgagtagaaaggtaaactccaagcaagacaaagccaatagaggcttaagttcatcaccaacaagtttcaacaatttaccccaaatttactgttaaacagtacctggttgaagacacaagctgcgccttaaataagctggagcgactctgggatgttatgaacttaaccttgaaaggaagaaggtataggaacttctatttggtttggattgtaagaacagacaaattacttacagaaactgaattacttcaatacacatgtgaagacatagaagaaaacaataaaaatttacaatccaatcaggatataaacatcttttatatcatagaagttgtcaattatctatgcacatatagttagattttagcagtaaccaaacagttgcttataagttcaacaaaattacagatgtttttcagcatttcatagccacatcgttgggaatgggttgttgagcttcctttcactttaatgagtatctgggataagcaacttataaagacaaaagctttattttagc

SEQ ID NO: 1301 - DNA, 697 bp, Rattus norvegicus
  Genbank Accession No. AI007924
cactgctgaagtacatttactgtacaaagaagtaagaacaaagaaccaggaatggtggagtccacagcagcaagtgtagtgttgatggtgtgcacgcaggccaatccaagtcctcacagtctataccattctattcgcgactccagagaaaaggtctctgtcaacaacaacaggactggtgggggaaggtgatgcttgattgtatccagcctctgggccagggtcccaggggccactgcttatcaggcagttcccacaaccacagccctgtcccccactacaggcattaacccaatctcccagaactgcaggctggcgcagtgtctaccagtgccctagtaacatccatggcaaagatggtcttaggaaatgtgcactaagaggtccccagcaaggggtcatggctcctgttatagccaggaccctgagggcaagaggtagagttaagcaccagcgtgcctgagggctgtgtcaccaggcaaggacagggagtggtcacacaggacatccattggggacaacatccccacaggggaaaggctaaccagagcagactgggataggcggagcattgtggaagaatatagtccatggcttctttagaagtagctcggtctagtgagtccctaaggagggcttggtgttcaaccctaaggttgaggcctcttttccagagtgtcactaagaaattccagtg

SEQ ID NO: 1302 - DNA, 442 bp, Rattus norvegicus
  Genbank Accession No. AI007963
aataaaacaacaactttaatgagagactccgtgtgaccagtcttttccttggtgctacaggctagaggctgagcacctactgggtgtgccacctgcttcttgagactgacaaaaatctgcttggtggccgtgtagactcaactggctgtgggcctctgcgctggcctttaacactgctaagttaccgcagtggttaggacggtcctcgcacggaaggggtactgaccctcttctctgattcactcctagaacccaggcccacatgaagggaccaaggccagctctgtcccagcactgggaatcccacggatgacagtcaagaagttcgatagctttagctttcactgacccgtggctcccacaacttaatcccatttcccaggatgagccaggcacaagcctttgtgtttttacactccaaggctagttagagctagacggg

SEQ ID NO: 1303 - DNA, 434 bp, Rattus norvegicus
  Genbank Accession No. AI007981
cacatgaacaatttacatttatttgttgacagccgtagtcaaatgcacttcaaacacagcacatggtagagtctgtttgcacggtggagccactgcttgccaacgcactggtggttcatgagagtaacttgaggttcatcctcaggctgaggccccagctccaggctgacagctgacaggtgcctgtcccttctggacggaaggcgcagggagttactcctgtttctcgtacttgtgctttatgtgtttccacagtttcccctcgttgatgaatcgtagaccgcgtctgcaccctgatcgaaggcgcgctcgaagaacagggcgctcactgcgatggtgagggcgaaggtagaagtcctgcggaacagcaaggagtacaaacgcgaagtgaccgtcggcgacgccatgttgcctcgctgacgaaccctcgtgcc

SEQ ID NO: 1304 - DNA, 605 bp, Rattus norvegicus
  Genbank Accession No. AI008020
cgcaattgtttttttttttttttttttttttacaatgttattcatatctctaggctttaataaatctttgcataggtaaatacattcatttacaactacctgacaacatagaaacagacaagaaaagatagatcttttgactctcccccagataactaccctgaggaaacccttagtgagagtcaccattagaacgactacactgtaagtcacgcctgaaagagtccgtgtcttccccttcacggggtcactttatagagctgcccttggtaaaacccacacaagctttaaaggacttcaaaaccaggagtgtgtcgagatagacagagtgttctccaacctgagcttaggaattaaggctatttctagtcatgccgttatcaacttgtccaataaattaatacaacctgggaaaggctgactttttctcacagaatagttttagtaattaacatattttaatatgtgatagaaaggtaggcgtttgagatgtatttactcaggccctgagctctcagtcatctaagctaagcccagggacattagggcaggtgaccctcatggagcccgagcttgtctgggaaccatggtcttgccctcgtgcc

SEQ ID NO: 1305 - DNA, 489 bp, Rattus norvegicus
  Genbank Accession No. AI008066
  misc_feature (1)..(489): n = a or c or g or t
caagtttgcggatgagtttattgaggtggaatctctgctaacttcacagaagagaagctacttgccaaaatcaaggaggttctcaagaacttcctacgttagaaacaaatgttcaaaagcacagcaagctgttccgattcccagtgacgaggctgaggcaagcgactctgcatgtttacttcaagcttttgaagagtttgtgggccacacagtgatcccgtgcatgcaggaagtcaaagagctcctctgtacaatcctcttctgtctgtgatcgggaagacacgcgcctatcacacgactctagtcgttcccgggcttttacacacttctccaactgctcacagtgctctctcactgttgtcagggggtccactaattcttcctcttcttcctctttggggtctccggagccagtgagcatctttcgttcatcctctagtcncatggcggagccggtttgggattcancaccaagagcaacacctcgtg

SEQ ID NO: 1306 - DNA, 461 bp, Rattus norvegicus
  Genbank Accession No. AI008119
ctgtgtgcatgtgaacaaattaatgcaggattttaaactatctggtatgttctttaaatcccctctcaggacttggagcaggcagcagacacttgtacgttgcttaactgacaactctggattgagtgtttaaagggtaccatgactgtccgggtcatcttctttagctaaaggatggtttcctgactttggagagaatcaagacagggaaagagcagaagatttatttctgaagcttgccacagttttacagggtcacattgcatctgacctcattcctgttacccttgtagagcgctcatacgttagggaagcaatataacaaagtgtgggcttggctgtactactgaaaggcatgcaacacagcaagagcaagcatgcttggcgagagctggtacgagctccttgcattgaatgaacactcatatttgtttctggcaactgggttcaccggcacaaca

SEQ ID NO: 1307 - DNA, 478 bp, Rattus norvegicus
  Genbank Accession No. AI008316
aaaagatgtcatgtctgactcaatacaataatgtcatcttaaattttggccccttatttgaatactatagctacaatcaaaataatttgttaaattgcttatattaagagtaaacatggatatgacattggttgtccacctgcaaactttagaacaatttactgtagcttgatgcttagccaattttaagtgaggaattcaacatctaggacacggatagtggagatggcgtgagggccctcagccatgctaacaacttggaaagaaaagagagaagccaacggcaccgttacagtgaactctcaggtgaacttttcagttatgaaaacatctattttgaatctgtaaatattttaactgttttattaaggcatggacttaactattccttgacacctgttgggtagaatgaaaatttaaagccatagtggtaaaagatggcatactgattgtaaaataaacaaataataataatgac

SEQ ID NO: 1308 - DNA, 545 bp, Rattus norvegicus
  Genbank Accession No. AI008380
aagggtctgagggcatgtgaaaatacagcgcaccaatgaaacaaaatgtcaaaaaaaatacaaaaaaatataaaatagaaaaatgtatttacaggtagtctgttactatgatcagaaagcacaaagactgctataatacatgcactggttcaagaggcggttactaaaaactgtgaggaagaagcctgtaaaaagaaaagggtcaaaaagttcaaacttttcatccctaattttgctacactgatcaaaagaaggagcccccacagcccacgagtatcagttcaacgcgcccacagcttacaactgcacgtgactcacacaggagacggcagcttatgcgaggaagccacggtaaactgttctacatgctcaaatgacagcaagcccgtctgctacacggcatgatcttagcaggtttagtggctgtttactcataggtatctatgtgcacgtatatatatatatatatgtacgtatgtataaaaccgtgtcctgctcactgccaacacggttggacacagtcattacagcagattcttaggtgt

SEQ ID NO: 1309 - DNA, 512 bp, Rattus norvegicus
  Genbank Accession No. AI008384
gacgagggctggttgcgattgggtttgtgaatgactcgcctatttaaatgaggccactcaggaaaggcaccgagatacgcctggatgactggaaaccttgctgctcctccaccaggttttagcttattatataaataatatgggcaatcgtaggcctatcaaaggtgctggaaataccaactgaacaggcccaaagagaagttaattactgaacagcgattgctctgatataaccaattattggatcattaaatgtttattaccttttatatgctctttcccccccataagagcagtttcttttttttttaagtcattaaaatagaaatgggatctttaaaaaaaaattctgcttaaaaatttccacaagactgaagtattaaaaaggccttgtgtgatctgacagccgaatagcctattttcctttggtctgttgaattagtaattaacgaaatatgttgcttgagcagagaaaataagattaattttgcttaggaaataaacagaagcaa

SEQ ID NO: 1310 - DNA, 518 bp, Rattus norvegicus
  Genbank Accession No. AI008409
cctggttcccttgagtcatctgcctttaggattctagacagacctaaggggaaaagaactcaaaatatattttgtcccaccccaccccccaagcactttgcccaattacctcccctacacagtagtaagacttgcagaagactgcagtaggttagctgttcacagaactaaaacgtcttacaaaactggcgagactgttggctctaccattcattttccctcagatcgggttaagacaacttgccatctaccattcttctgggccttggcagtctgccctcaaaagcttcagacaagatgcaagaggacacaaccctgaaaaagaaaaacctccaacacccgcagcggcctacagccccagatgactctcttcacagacagaagcctacaaactcccccataccaaggcaaaataaacaagttaccatcctcaagttacagaaaccaccaccgcgttgccgacctcacgggatgttaccgcaccacatgctttccctgcagcctttcttgcacattga

SEQ ID NO: 1311 - DNA, 435 bp, Rattus norvegicus
  Genbank Accession No. AI008416
tcagtaaacaaccaattcgattttcctattctagccatataagccagctggactttgtaaggaaaatgttctgaagcgtcaccgtcaaggactacagaaaactgccacccacagataaactgccacagtaagtgactacagcgtggctctgtcactcataccagacaaccccaaataaatactttatgaaaagaattaaagtctatcaaaaccacttaaaatagaatcttaaatgcagaaatcttaattttccttcagttgggccagaaaccaccacagaccctacggtcagggttccaggaagctgcccggcgggtcatgggaataacgccgccgcatcgccagtcggcatcgtttatggtcggaactacgacggtatctgatcgtcttcgaacctccgactttcgttcttgattaatgaaaacattcttggca

SEQ ID NO: 1312 - DNA, 549 bp, Rattus norvegicus
  Genbank Accession No. AI008698
gaagattaaccaaagctcacaccctatcaaaggtattataataatctttcataaaacccacagcattaaaaaaaaaaaagctagtaaatactttaaagtgaaaagaaaaactttagtgctagctgttaaaataaagacataaatactgtttttcaaagggaggaatactcaagggaggggggagacaatcgtatcacatgagcagaagatttaaatatcagtttagttcctcattgccaacatggcatttatgtcccagatgagattccgtaattgatccataatctgcttcagctgttgattcttctgtttgagtttctccacagggatggggtcaattccaccacagttctcattacacttgtcatagaccagtcgtagcttcctgaagagaatagaaagttgccgaagatggtcctgtagctttgttaaccggtcttggtaagttccagtatggtaagtgacgccatttggcagctgcatgttcctgagcagctggaagatctccatggtgcggtacacgatgtcttgcacggtctcctgcccgat

SEQ ID NO: 1313 - DNA, 419 bp, Rattus norvegicus
  Genbank Accession No. AI008736
ccatgttgtggagagcagccatgtctctgtgtctctcatgacaaaaggggcctggctgttctcctagcaactcctcatccatccaaaagattcatcatccaccattcatccagtcagggagtgtttccaagcacctgcagagcgtaaggccacgagtgagtgtgagtgttcttggagctgtgggatgcgcaggctgaggggcacggtctgggaggggagtagacgtgcatgtgcccccaggaagccaagcacagtgtaggttaaaaaaaaaaaaaaacccgtgggagccggatggtccagagcaggcgcctccctcagagtgctaccatctcaccttccgacgtgacaaaacatcaagaaacccccatcccccgattaagccgccccgtcaaaattccccggcgtccacccacgcaaca

SEQ ID NO: 1314 - DNA, 437 bp, Rattus norvegicus
  Genbank Accession No. AI008758
ccattagaaagataatgaagttaaaatgctttaatgaaaatgctcaaagaaaggaagtaggaagaactgacgcaagtattccttcatgttagaatttgtgacacaaatattttcaacttttaacggggcaagtcgctatgttccaagctgcctcttctcactaggagacattggtaattttttaaaagcacatttacaatgctttcccatcacccttgctgtgtttatgtagcacctatagccataactggcagtgagcagctcttctcgaggcgagctgacagtagcctggttgggtttgtatgcttggacctgggtttctagccatattctctgttcccgcttctcttgttgctggcctaatgacatcattacccacgtcttgccacccccttaaataagggaacaagattttggaccagcctagtaagggggga

SEQ ID NO: 1315 - DNA, 416 bp, Rattus norvegicus
  Genbank Accession No. AI008793
acaaatccaacttttattctgaggaacttactgtacagtatctaaaaagaaagtcactggggaaaacatctttcttcttcctccctcacacgttgtttgtgtgtgtaggaatctgcagaagagaggaggtcagcacatgtgagcttctgtcgtttccccatgtgcatgaacttcaaagcatcctgggcaatctccttgatgcggtagctgacctcatctgtcagtagctggcaagtctcctcctgaatctgagcaatgcccatggattctgccaccaccttcatagactcggagggcaacacggtattgctgagtttcagtttcttctcctcagccatgctggagttccagctcctgtccctggaaggatgtcaccccagggtggagagatggagatccgctgccaaggcgccgct

SEQ ID NO: 1316 - DNA, 478 bp, Rattus norvegicus
  Genbank Accession No. AI008838
aaaccgacatttctgtaatcaacaacaactacttagacagacccactgctgtctgattatgtccataggtcaggggtgttctgcttacgcatttggtgcctcataattaagttcagctaacactagggcctatagtttgctgtcagtgagaccaggtctggtcttgacagtaaagccaccatcaaaagctgcattgagaacttcatccaggcggacagttgtacttttgttccaaggaagctccaccataagttccaaataatttctagtcagagcatattcaggcattgactgaggcatttttttgagtctttttatctgcttgacacagactttatgagcctgttctggcatactagatgttcttatttttttctccagcatgacaatgtcatcattatcttcctcttgctcttcatcttctaaagctcctgggatgtgtgtaatcctctgatggggcgtattgctataacccttt

SEQ ID NO: 1317 - DNA, 467 bp, Rattus norvegicus
  Genbank Accession No. AI008919
gctttgaaaattgatttatttattcattggttaatgtacctaacaacattgtaaaccaaggccaggatatgctcctgagatatgtgactagatcctgggtagcctcggccctctctggttgctagccctacccagagctccctccgcttcatgaaacgagtccgcaggctgggcgaggcctcattccgaggaaaaggcagtccccgcaagggcctggagcttccttcccgaattctgggcagcctgtaacctggctcacaacttgtgtggggtcaagagctgctattgcaaggtcgcctgtgcctggctctttcccctggctcaaatgcttgcctaacctatggccaccttccctggcaacctgcgtccccagggaagaggaagccactgcttccattacacgccttcacagcgaagggcctgccaagcccttgctcatgtcagtaaggagactgcttctcaggcac

SEQ ID NO: 1318 - DNA, 415 bp, Rattus norvegicus
  Genbank Accession No. AI008931
aatcaatctagcgtgacctggctcatggggttattgcaagattaatgagatgcggctggtaagtgttgggtaaagctcggctctgcttgttatcgagaataaaaatgatcaaaggaagtcagtggcagagacagacatggactccgctgcctagcatccaaaccactaatgctgccctctgcccactggggtgtggaggagatggggcacagcctggggctcagcgtgtgccgtccataaccgtgaagctgagcagcacagctcccctcctccagcctccacgagctcatgggaaaagcggggaccttaccccaaagccaggcagcacttggagtgaccgtgttgtgtccagaggatcttcagttctgccccctgtggtctattctgaaggtgcagcccatcatggttgagaaac

SEQ ID NO: 1319 - DNA, 538 bp, Rattus norvegicus
  Genbank Accession No. AI008975
atgactgtatatttttatgtagccccaagaacaatgtttttcacagcaaatcccagtagttctgcaaaaacatataatcactgctggttctggtttctatgcctgacagatagtgcaggaaaaagaaagtatcttttaaatcttggacggcctgaagctccagaggtccagcttagctcttggttttcaacaagcgcctttcttagaagccaccaaaggttattatcaaatagtttctggccactagagatagtgtccctcctaaatgtccttccagtgcatagcacagtcacacactccacattacaccctggtagagattcttcaccgacttctcactgttagtcaggctgaaatatagggcttttctcttcacgtcatctgcttccccttggcagaatcccaccttagcaggaagctgcagctggacactgtaggattctttggggtgagttccaaaaactgaagaccattggcaggatagagaaagagggcataggaatcacattcatcggatgccagaacggcctggaaagtg

SEQ ID NO: 1320 - DNA, 486 bp, Rattus norvegicus
  Genbank Accession No. AI009026
aaagaaatttgaagtctttattgaaccaattgcatgttaggttacaaagctatttcacttttccaaaatgctgtttctctttgtagaccaatctggccacaaaaggctacctggctaagtattagccagaaacttctaaatcccagtgtgatcttcttgtggcatttttccaacaaataatgcagaccaaatcacaagatggccacctcactggtcacatggtccttaggttaatgagcagaggctgacaggctgtctcctcactcttccaagaaccgcccccaagtgcacactgcagaaggaaagtttgttttgaataccacaggacagaaggacaggcagctcataactccagtggaaaaacatataggagagctgagtggcaacagcaggcactgtgataacctgggctgtcaaagtctctccgttactctggcatgcagttggagatcccatggctatgagcagccacagccccctcgtgcc

SEQ ID NO: 1321 - DNA, 549 bp, Rattus norvegicus
  Genbank Accession No. AI009098
agaaaagaatattttattgaaacagtttctcaattaacaatggaacaaagtacaatttgattcaaacctgtccaaccagcctgaactgctaatgaaagaactcaaacacacaggggggaactgtgtaggacctttaagtctctctgccaatgtggcaaaaaaaaaaaaaaaaaaggtggagaggggtgggggtggggtagaaaagacaaaacaactgacatcaggtttgctttgcccctgcactggggtggccctacctcctgctacaggtgcaatactggaggacaggcactctaggcatggttatagtgggcaaggggctctccttcctggcaaaggacactgtcaagttgaaccctgacccctctttctttacccacaaagcttgcctgagagtgaggtggcatttttacattcacaccatgatctctgtcccacagggtcttgggaaaggggctcacagtagatagcacatttttggtcagcccagggggaagaaggaaagagcctgaagggtagattttacaggaactggggatgaccaggatg

SEQ ID NO: 1322 - DNA, 564 bp, Rattus norvegicus
  Genbank Accession No. AI009131
aagggttacaaatattcagattttattataaataaaatactgttttctttttaaacataaaaaacgccaagtgttgcgctttattaacctccctgtggggaagactgtaaagttaaggcaaacagctaaggtgaaggcacatttaaaagggccacagttagagggaaattccatggaggtgggggtaggataaaaacaatctcttctgggtgacacccggcattccacagcagccatcctgtccattttattacataaaatacagattattggaactatacaatagaataatgaatggctgtgtcgcaggagtgtagtaaggtatcatcttgtaaataactttcatttttaaaaataaaattctttttaaaaatataccaacaacgatggagaagacaaaccaaaacaccccacccaccagcgctggagtagagctgacccaaaggatgctggtggcctgtcagccattttcttgcaactgtgaccagaatgttaaagtggtgacctcataatagaggaactagccaatcagcactgagcttggtgaggccctcgtgccgaatt

SEQ ID NO: 1323 - DNA, 320 bp, Rattus norvegicus
  Genbank Accession No. AI009141
cagctttgaaccctgaaactgcttgtggcaggttcagttactgacagcacaaattccattgagtctattcaaggattgaatgacttcacaagccctggtctcaggagattaactttcatattggggtagtggttcacttgagaatacaaaatcttcagattaactgatgtccaaaatactgtcttaaatcatgagatccatcaatttttagtattgtctagacctgcaaatagaattacattgtaaaatctttttcagcatgtgttaagatgtatgtgaaatttttttgtttaagtgtaaacttcataccatactgtcag

SEQ ID NO: 1324 - DNA, 569 bp, Rattus norvegicus
  Genbank Accession No. AI009170
cccacctgtgctgcagtttggctaaccaggtgggaaagggcagggccactctgaatcagggtgtccagagccttctgtacacttggattgtcaaagttaatacctgtggaagatacaggcctctggctagccatgttgctggcaggtgccaggcgactggaaggctgaccaaagagcccttgggaaggagccccaggcctagggcccatgttccgagcagaccctgcctgtcccacaatgtttggaggctgatttcctgaggcctgtggtctttgctgaggctgactgtttgctgctgtggaaaaattctggttctgggaacttccggtagccactgagggggatgcagagctgctgttggccgccaccgcgccactattgaataggctgaggattttggcctgaagctcttgctgggaggtggggggtgcggctggagtgggtgtagcagaatggagcacttggccgctctgaagcggttgggaacttggttgtgtcttcagcgaggaacccgaggccgtcccgagtggctggcgggaaatcgggccaggcagagagtcgacgctgct

SEQ ID NO: 1325 - DNA, 536 bp, Rattus norvegicus
  Genbank Accession No. AI009197
gaccaacatagaaaaatttattgttcaaaatccttctctttgaccaatagcagaaagcagcccaatggggacagaacctagaggcacatttggtcatttttctgtgtgtggttatagaggggtgtttgaatgagggtgatagggccttttagggacccacacacgatacacttgggcaaggctcatgtgctaaggcaaagcaagtcatgtcagcctggcatgaggtgggacctcagggctttttgaccttgtgttctggcaccttctggaagctaagcaacatcaggcccgcattgatggcataggtggtgatgcaaacaatgcagaaatcatacaggacaaagaacaggatccaggccaggtacagagaaccagcgacagacaccagggaactcaggatcagtaggatagaggcccaacgtcccctcaagcaacctaacaacagctgtatggtgtagaacatgcaaccaaatatgctgttggattggttgaggatgctgtcagctcctaacacatgctccaccagcccaaagccc

SEQ ID NO: 1326 - DNA, 525 bp, Rattus norvegicus
  Genbank Accession No. AI009198
agataactaaaaaattagatgtccagaagccgtcagtgtacaatgaaagagatcaaaccagttactttatcatgtatttcctcttcttcacaactaagcagagaaaaaaaggcattcttcaagggaaatgtcagaaaaataggccaatatatttttcttctccatgacagaaacagctacaggagatctggggtaaagtggacactaagttggcttttcatcacggcagcaggctttggcaggcactaggtgaacagactcctcctgcctgcaccgcacgctcagccagttccctcacaggcaacactgtagtggttcgtgcactggagcaatccatgccccaacagtctgtcccctttgccacaggcagagtaactgaaggccgatgccggtctctgcttgttcagtccatcaactgcatggcatctgcggcacacgtctgacgctgctcaggccttcacttcaggagttgacgaatagatggaatctgaattctctgaagcaatctcttccagctcttcttct

SEQ ID NO: 1327 - DNA, 487 bp, Rattus norvegicus
  Genbank Accession No. AI009341
aaggaatcacagaaaatgcattactttattgcaccaagatcttggcactatctgggcacccccacagaggaaggggaagagtacagggagtcctgcacacacacagacgcagccacacaggatgttggacagaaacagcccctaacaggcaggtgagcaagaacagaaacaccagggaggtggccctctgcaagtgggcctaagccacatctactgccaagcacaaagttcaaactgatttgatccaacagcatgactacttttagaaaagcttcatttatgtcagtacatgtcaccgagaactcattccgcctatggcctgttcctaatggcttctaaggaagaaaaggacttgccttcagtgacagcaacacaagctgccattagtcaggatggcgtcctgactgatggctgaaggctcaccatcccaggtcaaaatggtctgggcttgcactccccaagttgaactgctcttgggcctttgcat

SEQ ID NO: 1328 - DNA, 498 bp, Rattus norvegicus
  Genbank Accession No. AI009350
aatatagaaaaggagcccgaggcagctggaccagtagtacaaagcaccaggagttaacactattctggtgaaagggttggctttataaaagtgaaggaggaggcaggaactgcccggcttccgggaccaggcccagcctagtacccagaggcttagagcaggacctggaatgagattcactggagggggctgatgggtaatttttgaagctgagtgagttggagaccatggtgaccaatgataggcatagaggttcaggcagtgagaagcatttctgtggctgataaagacagagaactgctggcttaaagctcctcagtgagccttggggaggggctctcagctctagggccaggtagaaaatgctacagatacttgtggactttgtgaatccagacatgactctagggtgggagggtctttccccttctccacaggagccacctttgctatgactacacatggggctttaagggcccaaggcacagaagaggctca

SEQ ID NO: 1329 - DNA, 437 bp, Rattus norvegicus
  Genbank Accession No. AI009362
gaaaggaaaactaacatttattgagcgcctatgggtatgtgtatatatgtgtatacatacatacacacccttatacaatgtatgcctggtcttgtgcaaggagttctcatctacaacattccgtttgatcctcaccccaaccctgtgaggtaggtattatcctcacgtgtcaggtgaggactacgaggctcaaaaaggttaggtagtttgttcagggacactgaactagagaccagtgagctgagactgagttttaagtctccggcagttctatcctatcccggttctttcctacccccttgagccctgtagcccatggctccccaaaaagaagcctgccccatcctgctctgcaaggatgcagtcagttgaggattaagacataaataaaataaatagcagggtcaggttcccaaaagtgaggacgtttccatact

SEQ ID NO: 1330 - DNA, 483 bp, Rattus norvegicus
  Genbank Accession No. AI009363
acatcttagtttcttttatttattttttaaacaaaaagcaggcataaaaatacaattacattactacaaagatgcaacaaaataaaaaataaatcaagaggggatgatttttgtgttggggaaaggagctggttcaagatgactctctaaatcatgcagtttataacttattacagtttcaaacaaaagtcaccacagggaagggaacaaggcgaggtcccggggaacaacactcagcactgtcacacagtgcttgtcaaagtgctttaatattggctgtggcaccttcacgagccaggggagctgaagtcattttcagacagaaaaagagaatcagtagcagtcaagggcctgaaaagctcggaagctacttgctttccctggggtcaacatgctgcttaaagcatctctacaagggtaactagagtctgagtcttttactttaccctgcaatccaccagcctgatagcagcattttgacct

SEQ ID NO: 1331 - DNA, 533 bp, Rattus norvegicus
  Genbank Accession No. AI009371
acacaagactgaattttatttaaagtatagtaacaatgaagaaaaggtagctatccatcaagtggtcctcaggatcaagttctagtgagagcctttagctgctccatatgtttctttgtgaacaaaaggcagaaaaagatacatttatcttctagataacacccataagttttctttcctaatgtagtaaaaagtaaaaaattggatgttttattatttaaggcttaatggaatgttaccacaaaaagtaaacagaatcaaagtttggaactgccctaatttataagggacagagattatgtctggtaattaagccttctaggataaaatggggtcatgagaagcttcctttataaaaagctttcttcaggagtgacatttacatcgacataaagacactgactagatctgagaatactgggaccggactcattaacctagtgagagaagcactgaaagagcccgtgtcaagccaggccgtgagacctcagggtctagccttggaagtggggcaaaggtgcacagtgtggctg

SEQ ID NO: 1332 - DNA, 472 bp, Rattus norvegicus
  Genbank Accession No. AI009390
acatacttgatgaaggtgcttcccttaaacattctctccagcggaaaacagagcatggagagcagcttctagctgctctgctcagggcctgggctcctccttgcccaaatggtgaggcggaggggtgtacttcccctctttcatcagcttctcccgctgtttcttgatttcatgcatccgccttatcgttttgaaccgaagaaagcattcttcaaagtcttcatactctatcttgcactcttttttagcccgggtagcaccgatcccatgtgcgcattctatccactccttttcaaatgcgtggcatcgagcggcattcttgtaaggctgctcagcacttaggaatataaagtgtcgatctaggctaatgcccagccttttctgcacatgaaggaaaggcatgacttcttggctgaccggacacagcaagcgcctaccgcacctcagcaatgcccttctcaagtccctgggc

SEQ ID NO: 1333 - DNA, 471 bp, Rattus norvegicus
  Genbank Accession No. AI009411
ctttgttcaagattttattaaacgtctttacaagacaacatccagcctccaaatgcagctgccaagaccctgttatgctgtaggcactggctgaggcatggcgggtggctctggcttcccacccttctgttctgagatgggggtggtgggcaagatttcatctttaggttccacaatgctcacatgatcaggcagaggcttcttgggaccaatcttaccacttgggtcccagggcagcatgatcttaactttgatgcccagcacgccctgtctgaggagcacatggcgcacagcagtgtcaacatagtggttaacaggggctccgctgggaatcatcagaccatccacaaacttcatggacttggccctctgccctcggagcttcccagagaccacaaccttacagcccttggccccactttccataatgaaccgaagcacaccatagcaggcccttcaaactgcaagccc

SEQ ID NO: 1334 - DNA, 532 bp, Rattus norvegicus
  Genbank Accession No. AI009444
acaggatttgtcaacaataaacatctttagtgcaaatagtgcagaaacttttctcaaaacaaatatagcaatcattctaatctatacaaaatcagtctcaggtgcatatatactctataggcatctggatgtcagccatggtcatgaaaggccaattcctaagtcataaatagaaaataatgtgcttaggtttgtgtcacatttctttcttgatagttcatgttttcaggaaaatctagagaggagcatggaactggctgtgcatggctatcacctggtgaagcttctcttctttagctcttctacagtggcaaattgttctcttttccttgaagctattgagaaaatcatctatttcagtttttccctccaggaaatcttcggcaatattatcagactcctcctcagcctcatgtgcggctactttcaatcttgcctgtagggcacttgcactacaactctcgctgagttcatgctgcctttgcatcttcttttaaaggtagatttcatttgtataagtaattcatactta

SEQ ID NO: 1335 - DNA, 459 bp, Rattus norvegicus
  Genbank Accession No. AI009450
ggagaaaggaaaccttttattaataaacttacacagcagtaatacaggctcagtaaagataagtccaacggttgtggccaaagaaaatgcagattatttaaggtgaatttgcttctttttcatctgattcctcatcatccatcacctgctccacgccttccacttctggaatataaaactgcagcatgttctgaatcccgctcttcagggtgatgatagagctggggcagctggtgcaggagccctggagcttcagccgcacgatgccatcttcaaagcctctgtagatcacgtcacccccatcctcctgcacagtcggccgtattctagtatctaacagttctttaatcattgccacaacttcgtcatcttcctcaaaacctgcttttcctggaggcgtctcctcagtcactagaggtaatccatatgcaaagaagtccataattgttgcataaatgt

SEQ ID NO: 1336 - DNA, 482 bp, Rattus norvegicus
  Genbank Accession No. AI009484
ggggagaacacacttcgaaaagcttttattgggttttatttccaaagtacagatacttgaagcaattctgcaaagaccctgagttttcacagggctggttttggctatcgtaaaaaaaaaaaacaaaaacacgcacacacacactatagttttcctgcttgccataggatctctctgggagatggacaaccctcaaaggcactgattggtgacattggtagctctggtccttactcaggcagccagctcagccaaggcccggtccaagggatccactgaccagtagtcatcatcccagccgaggaaccagcccacaaaggaaggaggctcaaagccttgcctaacgacagtgatgggggtccgcctgtcccgattcgctgggtccgtctcgatgtaccgcttagcagaggtcaaggcttctgtcttttcctcttcctgagagtcccttccaaccctgacaaagacctggtcccaagtgtcca

SEQ ID NO: 1337 - DNA, 511 bp, Rattus norvegicus
  Genbank Accession No. AI009492
ccataatctcttatatacacatgaatttcacagtgtggttgccagtccttttttgtgaatgctatagacaaggtccaatggtgagactctacaatgagatgtggtcaggaggaagtgatgattttcaatcatctttctttccttcaagtttaatatcctttaattggggagagaaagaagtccattttcatcagctgtatctagaattttacagattactggagattcaaccccaagaatatactggcaggagtgaggctcaagcatatatacagtaacagcatgaggagaatctgattctttacactttagttttacagtcacctgtctgggtttgtcagttatatcacaaatatccccatttccataaaaatgtgacaccatcctgactgtctgggtgccatcgtcttgaagatgataagctctagcagtgtttttcttagcccactcaacatgctcttcttggttccatgtccccacaactacagaagttttcccattatctttggcc

SEQ ID NO: 1338 - DNA, 510 bp, Rattus norvegicus
  Genbank Accession No. AI009501
ggctcttttcagtttattgcatgaaggagttacactagtccaagttaaaagcggaccccaaatgattacattatacaagctgtgaggtttttaaacttgtgacaagggacagaagggaaattctactcattgcaaggaaatcctcacttaagcttcagagagccacaagcacttaaaacccatgaaccttcagctgatcgtccttagccagtccaatctctatcaggaactggcatatgttcttgcgctggtcaccctgtagctgaattacttctccatattctggatgctcaattacagtaccattgcaggcaaatttcttcttaaacgccttcactagtttctttttatcgtaatcatcagcgatcccttggacagttgtaagggtcttcctgccgtttctctgttgaattcttatatggatataatcctcagtgccagcaggaagcaggtcatcacccttacttgcatcaacaaaggggtcgaaagaatggaggttctggatagcgg

SEQ ID NO: 1339 - DNA, 439 bp, Rattus norvegicus
  Genbank Accession No. AI009555
ctcactactaggaataaggcgcggccgcttccaattttttttttttttttttttttttgtggctgcccatttttaaaagagaagctacaaagaagaaaggcagttttacattatgtagaataactgtttgcattgccattctgcaaaagaaagaaattttgatttaaaaaaaaaaaacctcaaactgtctaagactgtagtacaactaggtgatcctgtcccctaggcggcataagccagacagggacattagggacgggcagaaaatatgtaattttggcagttgattgactcagaagtctacacttttttcaggtaagactattccaatcacttttaaagataccatgtttttctgaagaagactggccagttgtcagatttcgcacaccaaccaacagctgtgtggtgacgcctgcgatgtgctgagaaactcaca

SEQ ID NO: 1340 - DNA, 583 bp, Rattus norvegicus
  Genbank Accession No. AI009589
ccaggatgaagtaacagtttaaataattaccagaattacgtataaatgaaacattcattcagacaaaacatcactgttcacaagtagctaagaaatattttgcaatttatataataaatatatctgtgtttaggttaacaggcaccatcttgataacagcaaagttttttaaaaccaataaataaacattcaagaaaacaaggtgtttatatttgaaatatgatacagccttaaatgcttttcttcatatagcacccaaatttccaaactgtctagaaagtttctgaaaatataactcctaccttaaatcattaaaatagcgcccaagaaaaaggttaattaaagacagaatttataatctatattcgtaattctccattcaataaaatatcaattaccaacgtattaaaagtcaatggactgtatatatgcatctgttaatggtgaaagcctgtaatacatacatttaaaagtcactctcctgacaggacttaagacactgcctctctggtgcagacctgaaaaccaccaagcatgtctgctgctctggctgtgtcttccaccacactcctatcccccaacc

SEQ ID NO: 1341 - DNA, 555 bp, Rattus norvegicus
  Genbank Accession No. AI009592
aatttaaatcatgatttatttaggttcacttctaagttatgtaaaatatgtaaatgtcacaactgtacaatgattttctgattccgtcaattttttgtaacacatgtcttatcacgatgcgtcaataccctgtgggacagtaggtcttcctgggacagctgatggtgaaaggaaggctgcagctcgttgtgagctggctacgactaggagttagtcacagaaggttcaagttaagccatgtcttcccagctttaggtcctacgcagctcctcatcccacacacttgggcacatcccaacctcaccattggtgtaacctaagcgattatttaccaaatttaagattcagtgcaccaaaacttgactagtcatcagctgcccagaagcattccttgtttcgtttccaagatgatgttgattcttcatatatttccttcttccatatgggcaccttggcttttaaagaatcaatggcgtagctcacggcttcaagggacccggctctgtgacctgaggacacagcaataactgtgcttgcttctgacactggaaccag

SEQ ID NO: 1342 - DNA, 590 bp, Rattus norvegicus
  Genbank Accession No. AI009603
aggatggcagtgcagtttattggggacttattaacaaaagtagtcctggatgacatcagaagtttgtggagagccatgacatgagtaggaactacaatataaaagaagtctgagcaaaaataagttcatccaagccagaacgcacctggttgatcttaagcttgtatcagacagacccattccagtcagtcactgcaacgaaaaccagtgttattctgggcagttatggcaactgtgaatgaagatggctatggttaggttgaatccatgactagttctattgttaacactacccagtagctagccattgggggagatggaatccgtggaattaatgaccaaagggttctgtattaaatagctatttatgtatacagattcagatcaaagatgatgaatgtttaagggccctgagtaaataccgaaaggaggatgtccgttcctgagcaaacatgcagccctttctgagtgatgaggcactaacctgtaagacagtactgggggggggctgctacagatggactaaagactttgaggtcagcttggcccacacagtaagatattacctcaaacctcaccccattccagct

SEQ ID NO: 1343 - DNA, 649 bp, Rattus norvegicus
  Genbank Accession No. AI009608
acaaaccaagaatatagcattttattcattttcagattatgtgtattacacaacatatacatatatttagataatatataaaagaaataaactatacgaagaaatattggtctgaatctgccttgtaggacgtctttaattcttccgtttgttgagtgtgtctctcacatgccagggcaggcagcacaggaaaccccagcacgtgtgtgtcactcaaagctctgcttttctccactgaacttagaatgcaaggaacacaactgtggcatggtcactggtgtccacgacaaggacacagtagtcagtgagccatagctcagtggattgtttaaatattttagcttcctttttaaacgaagactcagcgtccagagtctgtcccctcagctgctgtccagttattgtttggccttgttctgaactggtagatatagtttgaactctgctggcagctcatcctctgagtagagtctgtctgagaagtaaacccttcggatacgacagtttgcatggatctgcactctcagggtctcgatgtagtttgtaccatatgcccgccgggtgaagtcagataggttgaactgaatctggtttcagccatcatccagccgcatgggcatggtacagatgaagggcttgactcgagtgg

SEQ ID NO: 1344 - DNA, 592 bp, Rattus norvegicus
  Genbank Accession No. AI009647
aatgtctttatttaaaaaaagacaaaacaacaacaaaaaaacccaaactaggtataaaagcctttgttccaaatagatagtatacaaatggtttttttcttgtttgtattttaaagatttaagaaatttctaataccataaataaaggatttcttcctcaattgattttttttttgtagtgctgcattaaaaaaccaagtgtaaaagtgtagaaatttgtcatttatgaaaaaaaaagtctttactatgtagtgtttcttatgtaacagcaaacaaccattacagactatacgttctacagtgtggcaaaacctctgaaacatgcggttcataagcctctgaccacacgcaaaaacagccatttgtcaaaatagatttagctgtagccacataaacgtgaggttcttgagttttgatatttagctcagtagttttgagcgcattaagtttaggttaaaagtaacttacaatattcaacattataacccaaagttaatggcgactaccctccatgatgaaatgagacattacagcgaagtaggagaaacgaaacattgattattcactgagagctgtctgtatgtatttggag

SEQ ID NO: 1345 - DNA, 528 bp, Rattus norvegicus
  Genbank Accession No. AI009693
caacttaaacactattcacactgaacacgtatggcagcttaacctactcaaatatgaagtttaagaagccaaaactgttctagctttgttaaaagaaaacgtgtgctgcagactatagtcatgatggttattaacaaagcagggaagagcaccaaagtcacgccactgtctcttgagtgcttcaattgggttatgggttggtgtgggtcctggttagacttcacacggatggtatgatgcaatcaatcttcagaagacgcaagcctccaattgtatttcctcaagcttaacactaggagaacgcagcattcctaacatgataatacaccaggcaaaagtcagacagactacatcccatctgaccaccaccttgtaacctcaggcaaagacattcttgtgaaattactttaaaagttaacagattttctccagaaaaggttatttttgatggacaaatgcaactgagaaatctgtttaacaatcagaacttaatttaaacttacttatttacttattttttttacaacg

SEQ ID NO: 1346 - DNA, 601 bp, Rattus norvegicus
  Genbank Accession No. AI009700
cagggttaataaatctattttaataacattgctcttgacaacagtttgtacatatatgtaaagacaaccttcaacccccaggctctgttacagacttggggagtggactgcccttgccaggaagtgagcaaagctgtaacttcaagtctgcagatcccactctcggagaagggtgagttcacgctgctgggaaaaataactaagcatttagaatttttcattgtacacctgtacataggtttagattgaatggctcaaattaaacaaatatagatttcatatatacaaatatatcatgtataggtatatctattttcagaagaacaaactttaaactttgactgcatgcatggcccaaatttgttctattcccttaatcccaaagtgtgaacaggcttcctgcgcccttgctccagggctgcatgggacatggtgagaaggatgagcagggtctgctggttagcaacgcaggccacgctgtgggcctcggaccaccccctttacctgccttgggaaacagaattattgctagtgagctggaacctccagaagaggagtgccaggccccacacacctaccgaggtgggtgcctgatgggaaa

SEQ ID NO: 1347 - DNA, 518 bp, Rattus norvegicus
  Genbank Accession No. AI009703
gaaagaaaaagacatttatttctcccaaaatattcccagtttagcgtcccgtgtttattagttttagcccttgagatggcttctctgtctagccccagttgtcctggaactcactttgtagaccaggctgactccaaagtaagtcagaaatcttcctgcttctgccagggtcccatgtttaaattatccccaggttctccagtactggggtgcgagagagaccttcaggacatcaaaagttctgccaaaagccagggctgtcagagacaagccaggtttataccccagctccagaatagcaccacagtaagaaggcccttcttgtcctcagacttcagctgttgaggaggtcccagcgtggcataggcttttgaccctacccaggtctgcatggctgtggccacctgccttccagtgcacacatatagactctgaaaaatacccagttctcaaggtatggtaaggggctgtgccttctccaggtttccacccctaccctggggttagggacagtgttg

SEQ ID NO: 1348 - DNA, 617 bp, Rattus norvegicus
  Genbank Accession No. AI009709
cccacttcagggaactatccggaaggctgtttaatgaaaagaaacccacgctgttctcagagatccttcctagaatttacaagcaggcagggtgatcccaggcagttcacacccctattttccacaggtgggctgatggtaaagatatgaagactagcgtacatacagaggggctttagagggagggaaagaattctcctcatgtgatgttctgagcccggcgattggcaagtctttaaaaacaaactttccaagccgagtaaatattgtttctagacggtcctcctatggttgagttagtttcacataaatcacaatatttaggcaatgttggacattataggatcaatcagaacccctttaaagagaggcaagactgtagaagggaggctttcctaagtagtttaatgcagaagtaactctaatgttaccggataatcaaaatgagactgaccaatgtcttaggacataattatcatggtatataaaaaatagcaataaaggtaatgatgattacccacaccaccctctccaaggagatttttctctggaggctccagcttctctggaccttggtcttaaccttgacatgtgcctgttttatcatctgcagccac

SEQ ID NO: 1349 - DNA, 573 bp, Rattus norvegicus
  Genbank Accession No. AI009710
aaaacattgcagatgtcataattgttaacataacaatttaccaaactgtagttaactggtgcagtttgctgagcatgttttataaagaaaaggaaatgccaaaaccctgttaaaagtttttccattgcagcctagaagaacaagatttgtttctcagacacttgaatcaggcaaacagaaacagagttccctcccccatttgaagtcctccatcaaaagaaacaggctgataagtaactagacagtcaatgcactggtgagtccacacttgcactgtaataatggagaagtttaccttcttcagcttcaaagtcggagggttttggtcattaaaatcttaagtatcaaactagtacttttcagccacagtatcttcactctgagataaacattcttcttcacaacaagtttttaatatcctgacctcaattttaagacaaagcaattttaatactaggtgcatcccacatgcccttgctgcaaactgcttttcttgacaagttatgaagttgttcaaggaggtatggttaaagctggattactgaatggtgctggtaaatactacactttttt

SEQ ID NO: 1350 - DNA, 546 bp, Rattus norvegicus
  Genbank Accession No. AI009747
aaagaattttaatacaaacttaatataaactatttcagtccctcttaacatgtaagacactgactcaaaatacttttataccgtttttttttcaagtattgcacaatataggtacaaaattaatatttacgattacattttcttccataatatatagcaaaaatctttaaacctttaacagaaaatacatttttttgaaaaagcaaatattcgtacattttaattccaccactaaaggaatatcctgtacacaattttcagaatagttgatgtctttaagatggatattttacaatttcagtaaaaaaaatacaacatgaagccgctgccacagatcactgtagtaaaaagatagaaatgcaataccgtgtcgtagaaacaatatatatatgtatatatatatatatcctctgatagtttacaaactttgtactaaattaaattatacaattagaaaagaccaataaacccacttattagtgccaattttttatatatatatataaaaaaaaatcagccatgtccttgctatatcttaaatactgg

SEQ ID NO: 1351 - DNA, 547 bp, Rattus norvegicus
  Genbank Accession No. AI009752
aaaattataaaattcttttatttcaattatatgacacttcagtttgcctcaaattttactgaggttttggtcattttgcattccactctaccttgtaacagtagtatgaattcacatgattctgtaacgtgtcaacagcagtcatacagtaatcctctggtgattgtatatgtgctaatacttttagattcaactttacagttattttctaaatgattctttatatagaaaatacatacttccttcaggcagataaaacaacaactttccaataagaaaaatatcgagaaacaacaaataaaaatatctataccagatgcaaaattttgaattattacctaatgggtccctttgcacaagaacagccttttgtaatttttaagtagacattcaggcagaaggataactttaaaattgaaaaaaaaaataatggctgtttctcttcagtactaaagtaggaaatataatttcaacatgtcattagcagagaagagtaaaaaataaaatattcgatataaaatgaatttatcacatcacccgcatcttt

SEQ ID NO: 1352 - DNA, 567 bp, Rattus norvegicus
  Genbank Accession No. AI009761
caaagatggttccttcagtagtcaagttacgcacacttgacactgcaccaaatacagtgtttcttgtcgggtttttcttgagtgcacctccatcctccaggtttcttgttaccagtcgtgctgttacagacaggcttgcaggatagaccggttggtccttactgtgactcaggtccgactggtctctctgtggcaaagtccgttccacctgcccgtaaagacatttgtgaagggcccaactgttatggtctatactataaaatgtttctcagcacttttattataaactggaatttggcctcgtagatggttacagctagattagtcatttgacctaatttgccgtggctgtctgtaatctcaacacagataaggtctccaaaaagaagaaataaaaaaagaatcaccccgcaaaatgggagaagtctgtccagctgcagaaacggccacctgtggtttctctgctagtagcaaggaggccagcctgacctgttctgtaagggctgtagttgtaggttaagggtgggcttcaaaaggcttgctgctaaagcgttgtcctggaagggg

SEQ ID NO: 1353 - DNA, 683 bp, Rattus norvegicus
  Genbank Accession No. AI009768
aaaatatgccctcattttaatattcttcagagccaagtcacaaaaggtgcttttcctgtttaattttctttttaaaatgaatacctgtatgggtagtaattggacagttgtagcactttatgcaattactaactcatcccattctcactacctcacaggacctctctgctttcatcccaaagatgaggaagctgaggcatgagacagtcacgtaaggatgagcagaagagtagcactcagtgtttcctcattaactctggcaaggtgcagaggtcatacagtgcctgtggtatacagacgtgggatcagaatgcagatgaggcttgttctgtgtttccacgatggctgggaaatctcttggattgggagacaggggccaggagcctgaatttttcttttctttagtgctagagtcaaatgtagggcttgtgcatgctagtcaagtgcttgactactgagagacacaatcccaggaccagtattcccagccagcaagattggctccttccctcttccaaggatgaacagccaaggatggtggacaagaactcagctcttggtcagctgggcagggtcagaattcttgtcctgcttactggctttgtaactgtgggcaggttactttgctccttcaagcccattttcccctctgtaaaattggggaacaggggaggaccaatggg

SEQ ID NO: 1354 - DNA, 652 bp, Rattus norvegicus
  Genbank Accession No. AI009786
cactgaggaaggtatatattattattcatatacagatatattttttaaaaggatggcatataaaaaataaatttgcatatcgagtataaaaacatgaaatggtaacagctgaggggaaaatattttcatcatgtaagaacatcagaataaaagctctaacagctcgagaacaggtgactgaaaaacaaggaaatgtgtgaaataatggaagaaaatggaaagtaggtctggagaaggaaggtgagcacgggctaacatgagatgaccacacttctctgtaataactgctaacattctaaatatcccctgcggtctaccgtttccacattaaaaaccaatttctcaaaagggtgtgtaagcacaataaaacgagtctctgtaaggaagggaattgctaaactctggtatattcttacaaaagaataacagccatgaaaaggagaggagactaagttctggtggagaaggcatccaaaataaatgcaaaccagatacaaacagcacatgtgctagctttttaaagttgttctatctgatctgaaactcagtgtaccttaagtccacatcacacagacagcaatgctcctgcctcagacttctgagtgttgggattacaaccatgagccaccaatctttgttcccatttcctatt

SEQ ID NO: 1355 - DNA, 622 bp, Rattus norvegicus
  Genbank Accession No. AI009796
aaaatgtgtaaactgaatattattggtaacattttaaaattcaaataagttaatgtgtcgtgtctgtgactccggacagaaggctgggtagaagtaagagtagctcggacagggaattaacccacagaggtaacctcatcatcatcactgccgtcagggactgcatctgtcccaaagtaccggtcaccaaagttcccaatgcctgggatgatacggaaaaggtcattgacacgcttgtccacggctgtggtgatgattctcacacgtgggaatgcataggccacagaatgtacgcccatctctgccataagcagggatatcaaaaagatcttgtcctcaggcacatcatggtccaggagtacacgtacagccatcatggctgcagcacccgtagatactgtgcagtccatcaggatcacatggtcatcactaatatccttgggaagtctcaggtaatggagctcaggctcccctgtgagctggttggtctggatgaggatggtgccgatacgcacgtccttgcacacagcacgcagcgcaggctccatggtttctcccgcacgcagaatggacacgccggtgatctgttttccagcgtagcactttcccacgtagtcctgcg

SEQ ID NO: 1356 - DNA, 571 bp, Rattus norvegicus
  Genbank Accession No. AI009800
aaaactgacataattgtggtttattaacatgaattaaaatgcccagccagtgcttcaatgtgacagcatactgaaataaaaaggaaaggccatgtgctgtactactccacagagatcacacttttgcaaagacttgcatatgtacaatgctatataccaaatgaaaagggtgggaagcaattatacacgcaaaagaaatgcagtatttacatctgtcaggagacactagaaattatctacacattaaattacattttgcttgcaaaaaactgataaaacaaaatgagccatgtccacaccaaattataaaaacctgtattgcattttcagacctaaggtgcactcaaagaactgctgaccataaaaaagaaaatccttagtgctttctttagctgtatacttaatgcatatgtataaaataatacagaaaatagtcactaaatgaatttaactgcaacaatgaaatttaaggtcatgtacatcagctctctggtcagaaaagacagttggaatgctcacttacagaattaagatgcctacgactggcttagcacatttcatacggaatctt

SEQ ID NO: 1357 - DNA, 751 bp, Rattus norvegicus
  Genbank Accession No. AI009820
  misc_feature (1)..(751): n = a or c or g or t
atttgcctttcttttttattttaaccatttaaatttacttaggaaaagtaagattatttaaggaagcagcacccagttttagagtaatttagcacatttatatgtgaaaaatacaaaattactcaatacatctttaatacacaaatacatatacaaacattttattctaataatattctttatcacttcaatttaaaccattccattatgaaaatttcttaattgaagagagaatattcctttaaaactctaaatgaaacagagctttctcaactaatttatagccacacagcctttagaatacatgattttccagttcacaagtcttccctttaaaactgttacggcttgtcatggtttttaagatagaaggccccagacagcagggaggaccccagcgtgcagtgctcagagcaggtcttctcaggtgcccacccaccctctaagtgccaccaacctcgcatgagcacacttgccacactaacatttcttctgagtgctcacttggccatctaccaaactcaaaccagagcctgcaccactgcaggcgtgcaggctggcacccgccgtcagaaatgctcatctcacgtaggtgagctcccggacactgggaagtatgttaaacagggtccccaaaggaatcccgttccttgaatggtccacctattccttaactgaacggacacgtaaggcangctggtcctggacagcaactggactgcacgcactacagggaacgcccttcaccctg

SEQ ID NO: 1358 - DNA, 383 bp, Rattus norvegicus
  Genbank Accession No. AI009825
gccttcataagaatttttattattatttagaaatgcagttatatacatagaacaattaaaattaaattaaactttgtacaaatattaaaatactatcttcatacccactgcaatgtacaggataccaaaaaatatatatataaaataaaataaagcaaacccagattgacatcctgcacagtcaattaagcatgtgttgttttaaaccatgacgagtaccattctgcaaaggatcccatagtggtgcacagcctcaagaagccaggccagtatggatacagccatgcaaccctcaactacttcctctccctactccgcattccccacggtgagctctgctactgggagaggacagggtagggtgtgtgtgtgtgggggggggg

SEQ ID NO: 1359 - DNA, 104 bp, Rattus norvegicus
  Genbank Accession No. AI009950
ggcaatgcacacctttaatcccaggtcttggcataggtaatgagtctgaagccagcctggtcaacacagtaagttctaggacagccagagctatatggtgagac

SEQ ID NO: 1360 - DNA, 478 bp, Rattus norvegicus
  Genbank Accession No. AI010034
aagtgcatttaatagaaatatcagtcattacagtttcttattgctggtcacaaaaagcatatatatatcttttgtaatcaaagtaatttttaccatgcaaaaggtatttttattatattcatatgaacagattagatttgaaaacaagtttatacagacttcaaaaggcatattaggcccaaagaaaacatggagtttatttaaatagtactgaaattacatgggattccgctgggcatactcacattcacagtttataaaggtagaaaaccttaccttctagagtcagctgagagagatgtgtttgaatcagcacactcacttgctaggtctgttctaacacaggcagagcgaacactgagagtcaaacagctttaagagaacaaactcaacatgtcagcagtaaatttcagtcaaaccaggttggaaaccaatattcatagtgactaaaggacagtttcaagctgagcctcgtgcc

SEQ ID NO: 1361 - DNA, 415 bp, Rattus norvegicus
  Genbank Accession No. AI010055
tgttgttgtttattatcacacacattcattttgtgtgtgcacacaaacacatgcaggggtacatgtggcgaatacgtttataattcagaggagaactcgcagaaatagctcatctccttccactgtatgctctcgggaatcaaatccagggcctttaccagaggaaccagcttgttggtcttcatttgttgagtgtttgcttgtttcggttttgttttgctttgttttacgacagggcctcaagtagcccaagctggccttgtagctgaggatgaccttgacctcccaacccttccgccttcggctccacagtggtgggatgacagacagatgggcattaccacaccaccttttttattaagttcatgtttctgatcaaagaggtggatcctgggacatattgaacaaacgtttc

SEQ ID NO: 1362 - DNA, 400 bp, Rattus norvegicus
  Genbank Accession No. AI010057
gatgactctaaccacatttattcagccaatgattttaaaatattagaagatatggtttgcagaaaacaagctcaagaattcagctttgatggggtagcgcggactatggatgggcgagtgatcctgccaacaaaagaaggaataagttatgttcaaagactgcaccagttgactcatttaggggcagataaactaaaacaacttgtcaaagcttctaaataccatgtgttaaatttaaattcaacaattaggcaggtggttgactcttgcatggcctgtacacttactaacgccgctaagccctatcaagaacctggaaagagaagacgaggagaccgaccatgagtccactgggaagtggattttactgaaataaagccaggaaaatatgggaataaat

SEQ ID NO: 1363 - DNA, 438 bp, Rattus norvegicus
  Genbank Accession No. AI010100
caagtccagagccaccactgtggcaccgtttaatgctctctgcttgttgctatttcctcttgtccttggtgtgtcctcagcctcagggcaccctgacactggagccccagggtcacacagcatgtccacattcccacccttagtaccaccctctccacaagtgcctcctctcctaggatctggagggctgatggctcgatcccggcagaagagggcagggcaaagtgggaggtccaaaggctgtggagtgacaaaggaaggaagataggaaggatggacagtgggctactcagtccaggtgaacatgctggctatgacgaggacagaggaactgttagatgtagtgagttgaaaggatcacggctgatctcaccaacttgggctgcctgggggaggagccgctctaagtcaggtctgaagcacagcttgcaaaacaca

SEQ ID NO: 1364 - DNA, 565 bp, Rattus norvegicus
  Genbank Accession No. AI010104
gaagttttcctaaattttattggcactgaaatagaacacagattgagcataaacccctccaaaacaattatttaaaaaacaaaaatacacaaaaaacctgaatataaaccctaaccttctccccagcctctgtgggagttggttattgcccttaatgcagctagattgcccccacaattccaggtttgaatttagccaatataggacagctcaccgagtgtcaatataattcacagcaatgcatataagattccccaaggttaagtaaaaggggtatgggctgagggaggctctaggctagggatactgcatggaggaacaagataaccttttgggaactaaaccctggggaaaaggcagacaggaacaataaaaccaaatactaagtacattttaagtggattgtatgacctatagtaacaggtaaatcactaatactgaaatcttcttacataatgtttttggcaaaatatcatttttaatatagtatattcttctcagatgtggggtgagggtagtaaaaaattatgaagcttaaatgatcctgtcccaagactaatatctt

SEQ ID NO: 1365 - DNA, 484 bp, Rattus norvegicus
  Genbank Accession No. AI010110
atagaaagagatatttaatacttttaaaaaaaaaaaaaattaggagtaaagtccacttcacaggctggaggacagtgttgcccatctagggggcatgggtgtggccccacgtaccagggacaagccacgggttgtggggcagctgtagagaagagtgtaactgagtccagccaaagcctccctcatgatgcagagccgcggctgtggccagcctcgcatgctggttgaaaagggacctgccaactgcctgtggccagctgtagagtcacatgagcaggtagcagtggagctggctcaggggaaggtgccagggacctgggaatgtccactcttcagggcctttgtgcttggtcttcaacagggctgagctgggtctgtggtcccatgggaagtgtacacgttcatgccttgtgcacttctgcatgagcagcaggtgccaggtgtctccatatgctgagctggctgtgcttgcagcctcgtgccg

SEQ ID NO: 1366 - DNA, 273 bp, Rattus norvegicus
  Genbank Accession No. AI010123
gccaagactcaaagaaaaaaatttatttacaatagagaattttatttgaaacatgcattctttttaaaaaaatcaaaccagcaaatgtgggtcaattgtacactccttaaggcaagagtcccgatgcaggctgcatgtgttcacgtcacttcagatgctgctcgccaaaaggcaaggccaaggtcagcaattcgtattctattagagagtctgatgatcctcctggtacaggaactccgaggtcaacttgctacgaattatactagaaaatgc

SEQ ID NO: 1367 - DNA, 511 bp, Rattus norvegicus
  Genbank Accession No. AI010250
aagaagtccaggattttcttttataatcccaactgaggctcaaagagatcaatgcttctgaacttaccctactaattagcatcaggctgaacagcaatgctgcacagaggaggagtaggaaccatgaacgaagccttcttgttgctatttcttacacagcagtcttttagatctgcaggtcagttgagggctggctgatcttagtcaggcttagctgggtggtcatgtggtgatcatctgggctcactcctgtgtctggaagtcagctaatgtaggctgggcttggctggatgacttggctttgttttctgtgcctcattcttctcgtgggatcagtgggacaaccagagcatgctctcagtcagggttgaaacctccatgcatgactcgaggagttagttttcagagaaaagaataacaacactgaagggctcttttgatgctggctagctctggaggtgctcattccttcaatatgagaaaatagctatctctccaagctcctcgtgcc

SEQ ID NO: 1368 - DNA, 572 bp, Rattus norvegicus
  Genbank Accession No. AI010256
gaataaacaagtttatttgtaaatttagtcaacatacataattgacctaaaaacttcaataggatacttttaaaaaccacttgaaggccatctctataaaagggatttttttgccaggatagtaaccaggtgtaacctaacccatcttcattggcagagtccaataagctcaagctgtactcttacccccatgtttataaactccacaaggaaaagcaaaccttgtacagttttcccccttaaagattaaaaacaaaaccaaactcagtctaggtgtaagaccaaacacaatgaaaagctcactaactagattaggaacagatgatgctggtgtgaatagcttgttgttttactctagagcccttaaagaaaatccccgttagtgttttgtgttaccagccagagggtcaggggttagtgaacatgtggtagaatgaggacttatgcaaggtttaatacgcatagcattcttctactttgttaaaaacaaatgcagtctagtcagaaataccaactggactaaattacacacaccttaatgacaagactccccaccacttgtgaatgtaaaa

SEQ ID NO: 1369 - DNA, 651 bp, Rattus norvegicus
  Genbank Accession No. AI010275
cccggggagcccggcggttccatctgttctgtgtttttttttttttttttatgccaataacttaatagtttattagtcagtcaacaatattacaaatatttaaaaatgacttaatataaatagttggcagcaaactattccattacagagttaaattaccagtacaacagacagactggagatttagacacctggaagataacaataaaataaactaaattatttaacaaaaattttaagctgaaggcgttttacctagtgtccataaaagcatgggttctctttttatttagaaaaaaataaaaaacggctttaacaccccattaggaatataaaataaaatcaactgaaaatattaatttgcatatcaaagaaccatttatagttacaatccaaacactccataaaccacttgtgcgattctatacagaaactgggaattagaaactagttgctttaatattacaaagatttcagctccaaaaataattcaacataaaataaactttagcaattagtgtcataaaattatatattttcacataaaaatacaaaataatattaatgacaagaatatgaaaaattattccaagtattttactactattaaaataaaataaaacccataaaaacaaaatagaaatatgcatg

SEQ ID NO: 1370 - DNA, 561 bp, Rattus norvegicus
  Genbank Accession No. AI010277
atatacatatatttatcaaatataacaaggtcatacaaaagcataatataattcacacatacaaaaggctgctgtatttgttgtcccttttacatcctatcttagacaaacaatggtgcagagaatgacaggtttgcacaacattctgaaaactaggttgttggtttttgtttttaacaaaacagacctggtcatctacaccttctctcaaacttctgaaaagaggcttactggggtgtaccctttggatcaacttaaataaatcttcactccatctgaaagaactatacattttcagtggttgaaagtcaggtagaaaaagaatttaaaatgacccataagtcaaaacatttcttataaaagaaagtttaaacaaacccaggtagcaaaaaggggaaatgtactgaatttaaaaacttctgaaaatagcatctttcctggaccactgtacaaaatgtgttcagaactgttggaaacagtttatacagacaagactacgggattaaaaaaacaaaacaaaactcccaacccctaccaaatgtattaaatccatttaaagtc

SEQ ID NO: 1371 - DNA, 515 bp, Rattus norvegicus
  Genbank Accession No. AI010339
  misc_feature (1)..(515): n = a or c or g or t
aaagtaaactctttttaattgaacatttctgtctcctgttattctgcggggtgagaactgtccttccttacgcacaaggaccgtctcttcgccatcaaactgtcggtgaggggttaggctacgagcaagcccacagcctcttcagggtagggagctcagaccgtgattgtatttgcactgtttgagggcctcgctgaagccctcacacagggttaggtcgctctgagtggtggagcagtccaggaactgcttgatctcataggcgcagggccccatctgcagggggtgagaggcaggacgggcaggggcctgctggaccgcaggctgggcaggctctgagcttcccccactaaaggcactggtcagggcgctacccatgacatgccctacagctgagcccacagctacgcccgcggcggtggatgccatctgagccataagacccggctgtcccnaggtggcaggtgcggnggcggnggctgaaggtggtgggtgcgcangaggatgggctgggc

SEQ ID NO: 1372 - DNA, 618 bp, Rattus norvegicus
  Genbank Accession No. AI010354
cgtctgcaggctttggatttatttgatcttctagacatttttatttatataaaagacaaacgctgcatagattgaaaataagtgctttaggtcttgatataaaaagagtattgtgcattcacattcctatttgaatacatgagtatggctgaagtgttcaataaaagaataaaaccttccctttacgcagagtagtgaacaagagtcaacactttcaggaatgacaggaatgatattccttggtcttttatctcgaataaagaaaagaaaaatgacacaaacaaaacaagccacagtaacatgacaccatattccagtttctgatgatgacccggaagtgaagtcatttttgaaccctagaaaccccacaagtggaccagcattctgtcaattcaccactagagggcgcagaacaacagctactgggttagcactggcgagcccaaaggagcaagtgggttggggttttttccacggcgttcccagcccactttcatgggaaagagagcatagatttttgccctacccccgacctgactgtgtaccctacctacagaacaaaagacccctcgatggttttccaatcacggtcctatctggctgaaaataagtcgcttc

SEQ ID NO: 1373 - DNA, 550 bp, Rattus norvegicus
  Genbank Accession No. AI010362
acacttgcacaatcattaaatcttttatttacataatagaaattagtaaaacttaaaacaaaaccaaatgcaacttgtacagaaatcctttaattttctttattttcacacattaaaaaaatgaaacacactatacaaatggttttcatagcagattacacgtgggtccattcagactcgctctcgtgtgctgcctcagacgacagctgttaaccagggagccaatgtattgatttaagtgcggtagcatgcagcctcagcatggaaggttcggttcccctctgtctgtgagttagggtaaatggcattggcgtctgtttacagactgaaatgtgtcagtcctgagcagtcctgctgtagcttgagaccagctggtggaaactgtggtctcagctttaaaaaggaaggtccaaatggtggcaggctggctgctatgaactcgagttgtttccactttattcactggaactatctgctcgtgggtcacggagaccctgctagatgggttaaaccaagtaactgtaggtgtccttctcaccatcgactcgct

SEQ ID NO: 1374 - DNA, 664 bp, Rattus norvegicus
  Genbank Accession No. AI010430
  misc_feature (1)..(664): n = a or c or g or t
agttaaatacgcacaattttattgattgaagagattaggacaaaaacattaaaccaaatacaggacaaagcaccagaggccattagtccccatcatgcatgttaccaatctttcctcccacccaggactttaaaaacaggggagagggaagataaaaggtccttcttgccacagcaccatcttctgaatgtaaaaaccctttctctgtatcttccattatcaaaatagaatcaagggtaaatccatggcagctttgtcccctgattatcaatggggaagctgccctcctggggacaggggctccagtggagtaggcgtgaagcatccaagagtccgcacacacatgccacatacgagagtgaagcacagattcaagtaacatttacatactagagtccacgtgttacctacccaaaaacaggaccatttcacaanacatatgcaagcagtaaaacccaaatgactgaggtactgggaacacaaatatttatgccaaaagagttctgtatcatacagcaatanaaaagccagaatacaaaaggaaaacattttgccactcgaaatcaaataaggctatctagagagagccaaataaaaggttattccagggacagatatactcaatacaggggaataaaattataaatgttaaactacagcatgt

SEQ ID NO: 1375 - DNA, 530 bp, Rattus norvegicus
  Genbank Accession No. AI010449
gttacgtccaatgcacataaaacaggacaacaaaggggcttgaggattgcctaaaccacaaactaccattgattaaatctcaagatgcctcctaatcagttctctaaggaaacggacacccagaaataggagagctaggaccgcagtgactcgctctgcccgttagccacagatgacggcaggctgccatggcctgggatcccgtccttggaacttctcacaagaaatgaaaccaaatcaactctttggatctcaactgtctatgaagatgcttttttcccatggcttctgtctgagggacctcttgtgctttgtggcacccagccgatcatgtgggagccatgggtgggggtgcagtagctctggactgcgttcagtctaggatgtggcagggcaaggggtcatctgtgttagagttccctgtacctggagaaacacccaaacccctttcaccttcacttctgaaatggtaagactaatgaaaaaaaataatcacaaaagcgtaatatctagtcaaaagatgaaatatt

SEQ ID NO: 1376 - DNA, 477 bp, Rattus norvegicus
  Genbank Accession No. AI010568
ccaagaaaataaatttattgaactttgaggggaaaaatccacagacataaaagaaagttaaatacagactgcaggacacaactagtcacatggtgaataatggcttgtgtggccagcaaagtaccaaaaatgacattctgggactgattgaggtatttagctatttttggctatagcaacgtggtcagcctatggtgaaatggtaagatagttcatcaaaacacacatctttaagctgaataggttctaaattgatgatacttcatatgaactaaatcatgtacccattggggaaaccatagcagcaaggtatcagaaaaaaatctattaaaatctactacagaataacacagtgaaccttaaacacccaagtctaaatttttcactgtctctcctgcatgaaagagatttaaaaaccactaaacattaaccctgtttccccacaaaggtctctgcaaaatggtaaatatcattgaa

SEQ ID NO: 1377 - DNA, 464 bp, Rattus norvegicus
  Genbank Accession No. AI010618
aagaacatcagctcctttattatgaacattattatttactcttatcttccccctaaacaacagctcaattcacacaatgaagacacccccacccccacatacacaataccactagcctgcgtgccaggctgtctgacctttgcttggttcctggtggagctgcctgaagacagctctctgtaaaaacctgacttggacacaggggacacaataaaggggaccttagccggagaattaactgaggggctcccagagtccttggtggtgatggtttgagagccatggggtcatgctgcgaaaaatccagactgtgttttatgtggataaatcccatatggggatataagacctatctataacctcttctagacagagagtttagaaacacactgaggtaagccaatgagtcccatcaaccaagccacatataaggagggcccagagcaggggatctgggtggtggg

SEQ ID NO: 1378 - DNA, 416 bp, Rattus norvegicus
  Genbank Accession No. AI010637
aaagcaaaaataatcaactttatttttcaactgtccatatatttacaatgataaaaaccttcatgcatcatataacataaaagacacttgactttgacagttattcaaaattaagaatgttaggaaaatctaatcagaaaatgttaagtaaattgtagcccagatcttatgacagtcataaacagcatttaatcatcaataccatcattttcatttacaagtctgctaacagtgcttagatcacaattccatacggttactttatgccaaatagtcacaggcagaagtagcatttaattgaaggtttcttatggtccacactatgaagatatactttaatgaggattacatgatgcgcagccagcaaaagaagcctgtcggacagggcggcaaactgccaacacactgacacacac

SEQ ID NO: 1379 - DNA, 437 bp, Rattus norvegicus
  Genbank Accession No. AI010642
attggttaagtagttttattatataaagagatcctgtaacttgatatgaaaaacaaagcaactccaaaagatatcacaaggacattaacatttgaccaaagagaaaatgtagcttttcaaaatacacaagtattcaaccttactattaataaaaaagaaaaaaaaatcaggatgcaatttcttgcttgcttattcaatacacaaagttagtagcaatttttaccttaacttctaaaagcactcaaatatgtctgaagttaacaacaacaacaaaaaaaaaatggagtcattttaaaaaaacaaagtatgaaaattctgttaatgaagaaatcatgaaaagcattaaaatgaatcaacacatgtatgtatgggcagtaagtaaagttcagatgccagaagccaaatccttttgaattacattaaaggactgttaatgg

SEQ ID NO: 1380 - DNA, 417 bp, Rattus norvegicus
  Genbank Accession No. AI010660
cacatacacattagccattcaatggagaagccgaagagtcaggcaaagatggtataacagaagcgcagtgacgggggtggggtggggcggggcgggcggagaggggacagacgggctggctgcctacttgcattccgctaggacactgaaaacccagaaaacaaaacagacagtaaactacccttgtttcttatgtatctcagtgcagagacgggggagggggttggagggcagagaagggagaccaggctgaaagaggagcagagggaagggacgctaaggggaagcacaccaaatccattagtactatatatatagagatactcgtatatactgcgtttcttagcctaagaagaaacttgtttgacgggacgggcggcctttgcggtccgcgatgctggtgctggtggggcgcac

SEQ ID NO: 1381 - DNA, 406 bp, Rattus norvegicus
  Genbank Accession No. AI010662
ccagcctcaaagttttattatcaactgtgcacattcgagttcacatcccatggtgtacagcttataacacggacagtgagagacggcaggggctgcgtgagccatttggtgaaatggtcttgctcagaacccacagtcctgggcaagcaggggcctaagagatcccaggttccacacctcagcattgagcaaatgcacacagagtccttgtgcatacggaactactgaacgcaaacaaatacagggtctccagttttctgtagtgtgaactcataggtgttggtctcccagcaggaggtgtctttgtccagcatgcttcgttctgtgaaggtcacatggccatctgcatccacaaggatgatggtgttggttctggtgccataggtggcagagcggacacacacag

SEQ ID NO: 1382 - DNA, 380 bp, Rattus norvegicus
  Genbank Accession No. AI010755
ggttgtgcaaaactattgtatttacaaaaatggcacaaaagtgaatgcaatagtcagtgcacatgcacgcccattcacatcttcaacagagaaagctgtccccacacactgcagaaccgaggaagaacactagcttcagtgacagctggtaagcactggagtcacacaagtcacaccagagcgggcaaatatcgcccagataagatgctcttgttaaagctggaacagcaggtttaaggccgtcaagtccaagccatcaaatcttttgcagcccatttacttgtgtttggattatgtgtcttgtcttccaacttgtggtcttaaacttctgtcttacaaaattcaaaaggaagatgcagaagaaatcaacacaacagagg

SEQ ID NO: 1383 - DNA, 382 bp, Rattus norvegicus
  Genbank Accession No. AI010758
cagccctccattaaggtctttattagatttccccgtctctcaaaggcttaaagaaatgaacattcaataaccagtcaggcttttatttgtaaagaactgaagttacaactggtctacaatatattatcgtaatataaacgacataaatagaagatcctgtaggcccaacactagtcgtccgcccagacccactcgaagccatgttacaatactgtctgtgaacgtgtgcagtaacaaaggtgcaatccaagcgaggctaagcagcagagaaagtgcttccattagcagttaacatcgccagcaaacatctgacgctcctttaattccactgactagacacacataggaagtctaaaattcacacacatgctacttaatatga

SEQ ID NO: 1384 - DNA, 265 bp, Rattus norvegicus
  Genbank Accession No. AI010763
aaaagtagaaaacaaatctttatttgatgaaaacattttcaaatttccagtgtgaagtaacaaaaatcaacaacctacaaatctttcagtcctttacatttcaagctaaataatctcttcagaaacaggaccattttgtaattcggtaggctaaacatatatgcatggataaatggatataaaattcaagagaaaaatgaattttgtttaaaaagtcaaaaccttcctttttattgcaatatggttccaacatactcagaacctt

SEQ ID NO: 1385 - DNA, 501 bp, Rattus norvegicus
  Genbank Accession No. AI010944
gacataattcacctaaatagaatagatttggatataggtagtgttggccaggtttatttaaataatgcccttcagttgctttaactttatttcctgaatggtataatcctagaaatatatactattcacttatatttgcaaatgaaatgcaaattggacatatacattaaagggatctagcacatgacaggctcatcaaataaatagtgcaaatacaccgaatgctattatttttttctgctcaaactgcttattttactctttaatattttcaaaatttacaaatcagtatcttagacaagctaaagaaaattgaaaggagcaaagtccttttacaattacactgccttgcctctgtcttgtgcttaccaaaccagcttctggaacattcatcatttagagcagcgatgcttttttcctgttccatagccattcccattatttcacttgtgtaatcttttcctatcaatgacatatatccaacaggataatcactgggac

SEQ ID NO: 1386 - DNA, 490 bp, Rattus norvegicus
  Genbank Accession No. AI010951
ctaatttcaaggaaatcaactaggaaaacctcaggtaaagggttgtttggctggttgatttttaacaaactcacctcaatataaagattcgaactctggcgcctcacctcttcgattcagtagtcaactaaaaaatatttctcctgcagtgttctttatttagcaaaggcttttggtcaccaggaccaggagagccctatggtaggccaactgttgactgacagatgtaaacacactcatccttcacacagcagcctctgcagtttttccttcatgtaacccctacttaacaaagcatgattatctccatttgttcagtatggaaataaaaaactttgctaccaaaaaataaatgaaaaatcctagggcaaacggttaccgttacctcacaaaggtcgagtctgtctttccgtaagtgaaaggtcctgcccaaacaggaattataaagcagtgctaaagacctactcgctaaactgtccaggtctggggg

SEQ ID NO: 1387 - DNA, 460 bp, Rattus norvegicus
  Genbank Accession No. AI011082
  misc_feature (1)..(460): n = a or c or g or t
agtcaaggactcttgctttcaacttaacagaagttcaagtctgtaacaggttgcagctcaggtagagaccatgcacagcatttgattattcaaaacagcaggaacacacaggctgaagtgagtggtcaaataggatttgctgttctcaaaaattaggtagaatggcgaaagcgttaccattgatatctaaagctcttcctccaaccctggcttctgaggcagataataaacatcaattaatggtaggtgaagtacagttttaaaaaacttatctttttaatcaacaaccaagtttcttgtttttaagttacttttgtgtcagtttcaccaatgaaaatcatttggcttgtactttaattcttccacataagaatacganaatatgtttgtggaggacagtgatggaggctcagatcacactgcacctctgtagtcttccaacatgagtatacatcatacc

SEQ ID NO: 1388 - DNA, 196 bp, Rattus norvegicus
  Genbank Accession No. AI011177
aaccctcactaaagggaataagcttgcggccgctcacttttttttttttttttttgttttagggctttttatggagttggtagtgttctacttgtttagtttgaataataaggtggagttagttgattttgatagtctaggcgattgattaatgtatgagattgatgatgttggggttatgttggagggggggatt

SEQ ID NO: 1389 - DNA, 490 bp, Rattus norvegicus
  Genbank Accession No. AI011285
aagatttctttgatagtaacttttattagttgtacaaagctcattcagtctattgctcatttaggatgactgttgacaaatatagcacatggggcaatttgagccacactgaattacactccagaagaaaaaaatgacatgctaaatcaatgtattttaaaatttcagataaagattttccactgtaggtaccaaattacaggtactagtttttgttttggtttttactaactttaagacattataatgtttaatggtaaatattactaagtacattttgatttataatatttcaacaatgttttcttacacttatttagcctgtttattgacattcacgtaaaagagcacatagtccaaatgcaactcagaatggtgacctctaaaccttctgttaaactaccgtagtaatttatacaattaccatagtaatttacacagttaagaacaagacaaagatcagagcaagtgatggcttacttgattttac

SEQ ID NO: 1390 - DNA, 403 bp, Rattus norvegicus
  Genbank Accession No. AI011306
aaaagatttattatgtacagtgttctgcctgcatatgtgcctgggcgccaaaagagggcgccaagatcccactacagatggttgtgagccaccatgtggttgctgggaattgaactcaggacctttggaaaagcggtcagtgctcttaacccctgagctatctttccagccccaaagagctacttcttaagccaagaagctgatgacagcatccatgaagtcttggggtttgtcgctgtggacccagtggccagcattaggcacagtctgaatctgggtttgagggaagagccgcctaatcgctgagtggtggctgggtggtacgtagggagaatttccaccaagcagaaagagagttgaccccgggtaggattcaagttgctgtgggaaggtcaaaatcttg

SEQ ID NO: 1391 - DNA, 459 bp, Rattus norvegicus
  Genbank Accession No. AI011322
aacaaagtaacacaaggtacagaaaaacagctaaaaccaagatttcttttgtgtgtatatgcggttttgtttttttgtttttggacagggtctttctgcttttgtgtgtcgtacaatgactgtactcaaattcgcaaccattcgttctccttccatagccacccaattgccgggatcacaggcatgaaccaccacacctggctaaaaccaggtaactaggtacatattccaattcaggaaagaaataattaagttacaaactaacctttctaacactgttttatataatgtgttcctatcttctcaatgactatagacaataaaaattagtaccagaattatcattccaatgattgttttaaattaaaaaaaaagttctccaagtgccattttcttctcagcagaatgcccccgccttactacagtgattcataatccagtgcttataaccctgcagct

SEQ ID NO: 1392 - DNA, 479 bp, Rattus norvegicus
  Genbank Accession No. AI011367
tccggctttattttgggatctgtatgtatgttctaggattaaaactgaagctttacactagctaagtaagcatgccccggtttggttttgtaactacaagtggttggcaactgtttccttcatagttattgcaggagtaggtccgacatgagtccatatgtagcccttctctggtcgggtgggaactgtgggaaatggtgatgaccttgacttgaaatactcagaaggggcgtggcagacaaattccaggtactccatcttccttggaaggtcttcctctggccctattatatatgatgcaggatcaaactggtctctgggactagcgagggtgggaatgagccatgtcagtgcggcactcttctcacaatactggtcctgaatgaaacccctgatctgagcatagtacggcttcccatcttgctcatcaatcacagaaacaacatcaccaatttggtaatatactcccttgtagaaga

SEQ ID NO: 1393 - DNA, 420 bp, Rattus norvegicus
  Genbank Accession No. AI011436
aaaccgacatttctgtaatcaacaacaactacttagacagacccactgctgtctgattatgtccataggtcaggggtgttctgcttacgcatttggtgcctcataattaagttcagctaacactagggcctatagtttgctgtcagtgagaccaggtctggtcttgacagtaaagccaccaggctcacagcatctaagatctggagcttctctttgttgcttgttcgaataatggaagtgagaatgtccggcagggcttcccttggcagactatctaagaggcgtctcaacttagcaactgcagggacggacatatccaacatttaaaccaattgtactgagtatctgtagaattgctccgacagctctcccagctcctccctggttttgcaggtattgggaaattcctcaagtcggtcc

SEQ ID NO: 1394 - DNA, 571 bp, Rattus norvegicus
  Genbank Accession No. AI011456
agtaggaaattagcctttctcatccagaatataaagattcttacagaatactccagaaattttaacacagaccaatagaaactctatcattcatcagaaacttgaacacattcaatgagatcaagtactcagaagatccaagatgccaaaccctgggattgcacacatgctcttgataccctaagttagcacccacacattgtctatcagaatcactttttcaaaacatacaatcaatgcatctattttaaaacactaatcttttagatacagacttcattctactcaacaaggtgtctgtcttccacagcagctctttacattccagaaatacactcgagaggtttgtgatcactgctagcctatttatgtcattctaacccactaaatctaatgtccttgattgtgtaaaatctaatgtttcttgatgaaactataattctcttctccaattacaattttttaaaagtatgtgataaatttagtgttattgccatgaatgggggaaaaaaaggtgtaattttgttccaaaattaacttagtctcatggatctctattaagtctttcaag

SEQ ID NO: 1395 - DNA, 689 bp, Rattus norvegicus
  Genbank Accession No. AI011510
aaaaatttaagagctcatttatttaaactttactctcattcaaggcaccttccacaatggttgaccaggtctctgggtactgtggcccagcaaagctgacacataagatcagcacacagggttgagaaacaaacaggtgacatttccaatcgtttatctgaaatccacagggattagctcaatgatcctccgggtacatgagggaatcgtcaccattttagacatgaaaggttagagaatttacatggtttttttgggtgaccaccttggggggtgggggagacaaaaagccatttaaacccaaccactgggcaccggagtcactactccctccagtggcatcacacagaaccatgcgacaagtcgctggcagttcgttagattaggaatgagaatccagtgcgcccggcacctccctccgtggccactttgagtaggtatctggcattttctcaggtggcagtaaatgcgcctcacagtatagaaccagcagaatcgggacatttgcagtctagccctgctccctgggaagcaacatggaccctgaaaggaagcaggacagagccggcctggtactggtgcctgcccctgagagtgatgagggtagcccttggtgacagctataccaacttcatgcggacccctggcaaatgtccttgaaaggaaaccccacatgctctcaagccact

SEQ ID NO: 1396 - DNA, 199 bp, Rattus norvegicus
  Genbank Accession No. AI011560
acaaactccaaatccagcatttatttcgggggaaaaacaaaaagggggctcaacccaggttaggtcattcccaaacagaaacagctgggcaggaacccctgggaatgcctatctacccaactatgagtttggaaggaagaaaaaaggctaattctggatctgctaccaacacagctgccacagccagaagctgggaaac

SEQ ID NO: 1397 - DNA, 412 bp, Rattus norvegicus
  Genbank Accession No. AI011571
agaattagtggcagtttattgccttatacaaatttaaccaacatggcaaccatgccgaaggaattaaaacattttcaggacgtatgtacacactgtacattttaaaaacaaacaaaaatgcaagaacaatctgtgcattatgtgtcaactcaactgggtggaaacatcaatgctcaatgggattacaaaggcacttcctacacaaaagaaaacagcctacagggagctcagagtgcataactactgcacaacctcaactgggggggggggggaagcagaatttaatcgacatttataggattcaatgtgatccaattttacaaaatctttacacagtctcatctttggctgtatgttctttgtcttggctttctggctctacactctggcttctatgatgatcctgtatgtc

SEQ ID NO: 1398 - DNA, 471 bp, Rattus norvegicus
  Genbank Accession No. AI011598
caaacaagtcactttaattccatacccacaattttacagatctcagtactgaaagctgtcgggcaagagggacaaagtataaatatgtctgttccgcagtgtaaaccagaaatgacttgttaatcacaaaaagtgtacgcaaacactaggtctgggaacctcaatgccagcgtagcgggaagacactggggttggcctgcctctgggtcagtgcctttccctgcttggaaattgctagggttcctgaggggcatccgctcatccccactgctccctggatgcgtgcagaagcagtcatgttgacaggggccccgttgaacagcagcttcctcagacatcctcggtaggcagggggctctggccaggcagcttcaaacttgggcgggctcccaaggtgcaaaagcgctggagaatcagccaaggtctctggcaaacggcctgtggtgtggttgctgtgtgtgtcgacttcta

SEQ ID NO: 1399 - DNA, 475 bp, Rattus norvegicus
  Genbank Accession No. AI011606
gtaatatagaatttaattttatctttatgaagtatctgaagtcaaagacgatgatacatgcattgggcacatcccacagaagacatttacaatggttgacatttcctttttatttattcctagaaactgcccgtattgcagagttttcatggatgaaatatggaattgagcagattcctttttctacaaaattatggtataaacttgctcgattttctatcttattgctaataacccttacagacgcacagtttgtaaagtaaaccccttaaggactgaatgtgtagagcatgctgcaaggtacaagaaataagctaaaactgagcttttacataaacctacatctggaccgacacagtactgaacactggcaaacatttatcatgacacggggagaaatcaatagaaagcgatacagctcagtcctgaaagggttattatgtttctaaccatccatcccaagtaacagtgcttg

SEQ ID NO: 1400 - DNA, 426 bp, Rattus norvegicus
  Genbank Accession No. AI011678
cggcacgacagactttattttggcacttaaacaaatttgctttacagcagtgacaaaatatttgccagtattttttccctggcatagatattccaagcaagtcattctacaattagggtttcactgttttgcacagttagaggtataaccactacattctcagcctccgtgattgagggcattgtgcagctttggaagggcccatcatttcctcttaattctaaataaggtgaattacggctataattggacagaaattaaggccattaaggattcagacacaacactgttccaagtgttactttagttttgtttgaatgagttctgtgacaagcccagggaaggtgctcaaagtagtcaaacttttatcgaaagttgactgtatgttggaaaagttgcggttcttgctgtcttctttctacttcc

SEQ ID NO: 1401 - DNA, 351 bp, Rattus norvegicus
  Genbank Accession No. AI011706
gaagtctcaaacaaaactttaatttcctgtacatactcctgtcaaatgaagttatttcctgtacaccacttttgccaactggtcttctatttcctttcatttgacctagatcggctacgagacctagagaaggatcgagacggcttgtgatttctctcacgagacagagacctttctcttctcctatctctagaaagagacctgctccggcttcgcgaaaagcttctccttcttggggattagttttgggtttcaacaagaagaaatggtgaggtgaggctgccggactgacggccaggaagaatttgctgaaaaggttttgccagatgttgcgttggatttagttggttg

SEQ ID NO: 1402 - DNA, 616 bp, Rattus norvegicus
  Genbank Accession No. AI011709
gagagaaacaacaccacaaatgagtggctgactttattcatccagctcttggcagatccttttggtatggacagatgttgctgcagcttccggcatgggcctcgagtgcagggggtagtttggggaaagtccagagggcacggcagacaaacgccatgcttactgggctcttcttgcaaacgaatgtggaagattagaattatgttctcacaccaccagcttggcttaaatacttctctgacaaaaataataataataaattatcttcaactcagaaaataaattgtgttcagcagggtgacaggagggtccattcgtcgcattgcaccacagggctaccaggagaggacagacaggcaggataccaacacaggggtcacagggcacagggcccgcctgaagtgggtaaacatgtgcctttgtctccaggcaggtggcagccctggctgtgtcatccacaggagacggggcctccttcctcctcacgtgcgcctggtcttctgattcttggtttgtctcttcatgtcttctgggccactgctgtcagaggccgcctggccaaaggctctgactccctgaagacgactcgtcagttgcagcagcaaagggatgagct

SEQ ID NO: 1403 - DNA, 672 bp, Rattus norvegicus
  Genbank Accession No. AI011716
aaagatagaatttattctctgatggtttagtcatgcaaactgtacataaaagaaaatagtacagtttgtgtaacattgcaaatataaggactcaaatgctaagtacagaagtagtgtgacatcctggagttcaaaatggaattttttgtgtgtttatacaactaataatgatttttatttgctgagtacagactgatttacaacgagagctctgtcagccgtggtaaagtcattaacatgacttctcacatctatgtacttctactttacagttgcaagaatctgttaccaaagaaccgaagcttgcacaaatcgcaagatgaaagaaaaatgtcgagagggtgcagagggtgagacgtggaggctttgaccaactacaaaaaaagcttgcatggagaattcatgtttgtgcctttgagatcaactccttagcataagtatgacaaaattgtgattaaaactgattaaatatgggatcaggtgaagtaatagatacaaataggattggcaaccaaaatgctctcatttttaataagcccagtaacaaaattcctattaccttcatacttaaaagtcctgaaatgtcatttagatgatttgcatgtttcccagtttggaacttaggcatgtgggatgggtattcccctctcaagggcattccatacaggcttt

SEQ ID NO: 1404 - DNA, 643 bp, Rattus norvegicus
  Genbank Accession No. AI011738
actaaaagtttgctttatttatttttttttgtgaagtcaagtgctagctattaattacagttagattttgttttcgttcttttcaaatgttatcagaatattagcatcaccttatcagtaatcaaatacactaggtttcaatgtttctgtccacatctagaatgttcaggtgatcaggaactctcttactggattcctttagatttgagttcttgattatatttccagatccgaaacagctgagaggctcctgctgaccccacaaagaaattaacagcgaacaaactccaattttttggtataattacaagtgagtaccttgaccaaataaaccctgtagccatcagcacagtggattgagctgtgctgagtttctctgcaggtctggccatgtcagctaatccagcacataccaatccccacttcattatcggagcccagaaaaaaactgttctggggcctgccgggtggttgtatagcggcctcaatttctttggcagcaacaactccactttatccatgagtcggtggtaggtggcccgcaggccttgggcgccggcagctgccatctcggcggcctaaggatccactgcagctgggtgggaacgccgctgtgtccgcgttcctggctgacaatgaaagg

SEQ ID NO: 1405 - DNA, 517 bp, Rattus norvegicus
  Genbank Accession No. AI011806
tattcaagtatctgaaaacatcctacaatggaacttagtagatggctgcttgtattgtaccatggaccacgcacatggtgttttcagaagacttgagatgcagtgatgtttaaaaactgtacacctgacggagaaccaaggaagacaatgtttcatccggatccagaggcgcatcagattcaacagcagctccacttggcaaacagctgttacatgatggtatccaaggacagattgttgacaatggacaaactcagaaatgcttccccaaaggtggatggttctttaaaaagtttcacaacccttgcaggaaaacactgatgcccaacacgctgattctaagtccaggagactgggtcttctcggttccacacagcaggagtgccccaataagcatgtatctgtgctgtaataaaagggtcctttggactggacagaagggacgggagcaaatgccatcagtcatagtggatggcagtgtaaaagatgatccaaatgacctacgggagacacaagc

SEQ ID NO: 1406 - DNA, 533 bp, Rattus norvegicus
  Genbank Accession No. AI011812
aagagcaataatctttattgagtttttttaaaaaaagacaaaataatattaaaactcaactgtcacaagtaaacaaaacagtgacttaggttagacaacgttataatgtacgcccaaaccatgtttgggtgtaataccccatgatacagtacagtgtttggacccattcccactcaggagcaatgagaactggacactgtagatgtcagcactgaacacagaaccgttatggagtctacggccgagcctctgctcttcgcacctattggtgtctcctttaacgtcgtagtgcacatctgcgtttgctaacggagtccagaggtccaactccaggttagccagtttccactgatcaggatttctatagcttctgctgggacacggtccttcagaatgaacctacctcactttccacttctaactctatggcctcctcctttcctcctctctccagggcacagctctctcaccttcaaatgctgctcacacagtgctgaacgtgaggcggtaacttctgacaaagttgcagttta

SEQ ID NO: 1407 - DNA, 447 bp, Rattus norvegicus
  Genbank Accession No. AI011835
aatgattacagcatttctatgataggccccaatttgtcaacaattacaaaagcagaaaggcaatgattctagaccatttagactaaattgacctgatagttaagtgggaagttaagttttagctgttgatttcattcttgttggccaaattagttttgccattataattgtagatgataaggaatgaggtttgaggttggaagttctctctgtcgtcttcaaaatgttaaattcatgtcgtgtgaaatcataagactgcataaagaaagccttctcactttctgtttcttagagatggtagcattgtagagagcagactctccttagaaggcagaggcagacatctctgaacctaagtgctgggctttaaagctgtgcaccaccaagcacacctaaacttgtcttttaattcacggtagatgaatacatcttttgaatacagtgttg

SEQ ID NO: 1408 - DNA, 414 bp, Rattus norvegicus
  Genbank Accession No. AI011878
aaatctgtatttatattacaatgacataatgacacagcacagccccatctgttagacaggtgggatggggtcccattccagtctgcagctcaggtctcataactcacccactgcactggcaccaggccccttgtgtagccccagactctggcacggaacctgccctagtgccctagtttagaggcctgaaaacttgcttgctggcctgggatcaagaccctctgtgcaggcacaaggggtgagaggctaactgacccaccagaggcagggaaggcttggggcacacagaagggtgggggctgtccagccacagtttggtgcacaactccatctgcctagaagagcaagctcaagcacctgcaggttagaaatacagaggcagacctaaggcccatatggagacaaaactccgtg

SEQ ID NO: 1409 - DNA, 455 bp, Rattus norvegicus
  Genbank Accession No. AI011879
  misc_feature (1)..(455): n = a or c or g or t
gccagcatttattcagtgctgctaggatgtaggcgattcgaggcagagggcataaggggtgaagtccaaggaaatggaaatcttgaggtctgggagcccggtctttcctggtagtcattgagcccagaagcttcgggttcctgcgcaacactgccaccacgtggcctggagtcagactcaacggcaccggcaacactgggaggtaaccctgctttttccttttcacccaggtctttaagtggacagggcacaactctttttttgtgaaaggagacctggactcactgatgatgggcagtggaaggtgcgtgtctctgtcccccacatcctgnggtagcccgtgtccctctcccaagggtgctgcacgtggaatgggcatgctgccttcctctcatgccctctggcatcagcaccacagcccatctccagagggccacatgcttagtgacatctta

SEQ ID NO: 1410 - DNA, 319 bp, Rattus norvegicus
  Genbank Accession No. AI011922
gaaaccttatacatacattgtttggctgtagaattctaaaatcagtttccaaaatttatcccaaatcacagaatgattataagcaaaggaatacattaatcactcaatttgctcctcagtgtcatacagtgaattatttgctcatttggtaaacattacctcatcagcttcttcaccttcttcatcatagtcatcgtcatcgtcctcaatagcttctccagtgaagtataacactgatcttgggattatacgctcacgtaaaaagtgaccaatttcaaagtctgcagccagtattgcctcagcatcgtcatccagatct

SEQ ID NO: 1411 - DNA, 454 bp, Rattus norvegicus
  Genbank Accession No. AI011982
gaaaggataagtctttatttcaccttccagtatttttgacagtttctctgatgccggatcttcaatcttaggagtccaaatatacagcgctcagacttcagctctccagagcaaagtacccagatcagtcctcagggaatttttaggtgggaaaaatgacaatgacagatttctctgtaacaatccatgtcaatcttctcgcttcactgaaacacttttaatttaagtactccatcatccctaaaactgtgaaatctaggacaggaaagcactcatctctcatacacaacacaaaagaaggaacacagggtgagcgagcgcgaactccaagggccaaattgattcacccagaaagtggatttgattccatttaacaggcattcgtacaaaactgttctgtcttctcaaggtagtctggctagacttttgtatatgggaagtaattcccatatag

SEQ ID NO: 1412 - DNA, 470 bp, Rattus norvegicus
  Genbank Accession No. AI012027
  misc_feature (1)..(470): n = a or c or g or t
acaaacctgcaaactctttattaaattctcccatttcatctgtacagaaaaaaatgcacattatgttcagaatctcagtaacatctcaaaattacacagcatgaacatgtaaaaacaaggaactgcagggattttatacatagaaaggaaatccatttacaaaagaggtttgttaattgtactgttttctcaaaaaataaaaacgaaaagcaaaaacaggttagaggcccaagaccttgcacagcacgcggtgtactctgcctttctgctctatctgccctgcttgctgcaagtggctgccaggagccctccaacctccgtgctgcaagaccagaaaaggacccctgctctgaggctctcctgtcagtgtgggctgggccaaggtgaaacacgacacagagacatggcctgtctgcaggcctcctcacctangagactctccagtgcctggtgctcatggcccaggtaga

SEQ ID NO: 1413 - DNA, 484 bp, Rattus norvegicus
  Genbank Accession No. AI012103
aggacaaacagtgcggtagggtttatttagagcctgggcgttgttccatgctacttggtcatactagagagccaggcgagcttgaacaatgaaggtgcaggtgagccgtcttcctaacttgcaagctgtctgaatagagagccaggatgcgccgttgggtcacctactctggagagtgccggggggccaacctgccgttagaagaagaggaagtgccttaagcgtccacccatagcctcctgcctgtccccttcactgcaccccactcagaggccacacagcacaggcaacagcgctgaggagtggggatggctctagagaggaggatctgacagggacacactggaccagagcaggttactatgtgacacagttgcagtgtgaaggaggcccatgccaggaggggagtgaacatgcagtgccttccatggcctgctcctctgagggccacagcatggaagggctggccccgtgacatgggaac

SEQ ID NO: 1414 - DNA, 418 bp, Rattus norvegicus
  Genbank Accession No. AI012145
ggtacccatgtagacacagccaatggcggcggtcccgtagctgtgagttcgtgctcccagtgtcaggcctcccgcacaacctccaatgaagtagttcagggggtcatctggcttctctcggacctgggcactgacacaggtggtaaggccaaacatagctccaatagcagctggaattaccgcggctgctggcaccagacttgccctccaatggatcctcgttaaaggatttaaagtggactcattccaattacagggcctcgaaagagtcctgtattgttatttttcgtcactacctccccgggtcgggagtgggtaatttgcgcgcctgctgccttccttggatgtggtagccgtttctcaagctccctctccggaatcgaaccctgattccccgtcacccgtggtcaccatggta

SEQ ID NO: 1415 - DNA, 574 bp, Rattus norvegicus
  Genbank Accession No. AI012221
actgaaatacgttgtcttacccaacccacccaaaaataaaaatcttacccttgtcctctaatctttcccttatccccagtcccatccccggccctgcacaagtgccccggatttcctgcccattggctatatcggagtgtgtccattatgtagcaacgtggaagcctctgtggagagcacagagtgggtgaaggacccttaaaaaggtgctcatttgagagccctggccacttgctcataggccagctctatctcttcatcgtcaggacaggtggaggcgaattcttcccgagcgtaagcgttgctcaagtaccgatgcactccacggaacgcctccgggatggtgaatcctctgtactttttgcacaccacctggactatgtgaagctttggcagcaggttgcagtcagccagggtgagctcattgccatccagaaacttcctctgagagatgccctcatcctcggcgctggtttcatccacttcttccgggaggggggatgtcaagtaattgtctagaaccttcagggctttcaggagtcccttctctaggttgtcattgagggccgggttt

SEQ ID NO: 1416 - DNA, 628 bp, Rattus norvegicus
  Genbank Accession No. AI012222
attttataaatgtattttcattttattcttttaaatttcccttccctcctccctcccccatctccctaccctttcctctcagattcctggaggcttcccatggatatcaactcccccttgacatatcaagttagtatagagtctttaaaaagaacaagagagagaagaaaggatagagagatcaagagatgctctttagtctgctatttcgtcctttttgggactcatcagtatggggtagctaactctgtaagattttaaatattttttaaagacccaataatgtacacactagtgtaaaattaaatattaaatgcttagggatttaactcacatttgatggaaataagtccaataaaatggtaaaattaaaaggacatttgtttataaaatgtattatccttagagcagaataattaagtaattataattatacttagaacagtatagttggaaacaggaatattgcaaactaaggtaaagaaacatttcgccaatatgcctcatgttttaaattgcagagtataaagtgaaccttaaattttcacacttttaaaattcttctgcatgttggtttgaattttgaaaagcaggtataatgtgtttctccaaattatgggctgctaca

SEQ ID NO: 1417 - DNA, 620 bp, Rattus norvegicus
  Genbank Accession No. AI012226
cctggtgaaataacagcctgtttaattaggtttttataatacaaattcagaattgcagtgacacagattttgaatcattaactttatttgtcactctatacagatattggtccatttccacatgaacagtagcaatcatccacttccacttaatagtctacagattgaagccatatcgcacacaaaccagagtaacttcacagggggaaagttacggaaataaaaatactttatattcatgcttcaagatatccccccacagatttgattttatatatctaattacaagcatttattccacaaagctagtctcttctgaaatcaacatagtattcttaatatttttaatatctctactaaaccacacggatcaccaaacttgcagaacagattaaaaacagctagcttgccagtcatagacacttccagagctaagcgattgtataagcatatgcagtatttttgggctgctcttagttaacatatttcctcctgtctcagagatatttacatcagttcaagacatttacaaatggttcctagtgagtaagagctggactaggtagcctgtgcaaggaactcaagcatttgaaagcttctttaagaaaaccagtgcattc

SEQ ID NO: 1418 - DNA, 636 bp, Rattus norvegicus
  Genbank Accession No. AI012235
caaggacagtgccaaccatcacaccagtcacagtacgacaaaggaaaggaccaagtacacatttacatatttttttcaaaggcagaataatggaaaacagactcaaagagatgaatagattttttttccaacattttctttggtgagcaaaagcaatttattttaaaaatctatccagattattgtcactgataaaacagataaagccagatgtacaggaaatacacatctttagccctttagactgcctcagtgggaagccagtgtgattaactcaggaaacagtagtgttctcttactcgtttctacagcgtagaaatgtttgcagggcacctcatgaatgctaaatctttttaaatgtacaagcaagatgatatgtggaatcttcttcctagatgttcatgtgcctcgtgttatttggggaaagggatgttatttccatgaaaaattccttgagtaatgtttttctacactagatgcttctgaatccaaccagcgggcgggcgggattccagtaacaatgtgtccattgtaaccatagacgataactcggagtgtgcacacacagagacacatgactcttcgagataaatattttcatagccaagcagaatactttagaggtatccgacctcc

SEQ ID NO: 1419 - DNA, 497 bp, Rattus norvegicus
  Genbank Accession No. AI012242
aggcactcagagactttattacccagcctgtcccaggacagcaaagcttacagcctcagctcccctgcttgagcacgctgcagacctgctccagcacgtggcacatgccctggtccttcggggtcctgctggccaaggacatcttgagcttgtccaggtaggtatgctctgggctccaggcctcttggaacttcacaaggtcaggggcacctttgtagaactccaccagcatcatcatctcctgaagaacatcgttggtcaggaagctatcttggtcatacgccatctctacatccatggggattccatagtcactgggcctttgctcagggggaggcatcacccagaaagggcagatcttggactcagggcctgggttgccggagtagtagggggagcacagcagggccaggcagggctggaagccattgttggagccttgcagtctcaactggtactccatctgtgcatcgatgtcctgcaaggagggtgctgca

SEQ ID NO: 1420 - DNA, 643 bp, Rattus norvegicus
  Genbank Accession No. AI012244
  misc_feature (1)..(643): n = a or c or g or t
gcggccganacatttttttttttttttttttttttttttttttagataaacatggtttattactttacccatgaaagtcacgtctacgtgtggcgttcagcctccctaggttgtttccggctccttggcagaggctctggtctggttcggagcccacatcccaagtctggatctatgaaggcctcatggccggggttcccagaaacacagggacagtgctgctggctatggatggtacaaccagcttgcagccccacccagcagtgtggcccgggcataccacacatgttcctgggttcatcttgtattcaatgaggactcatctgggcacagccactggggtcgtgaaaataccttttaagaaaaataaatattctgcatgaagtatttacaaggatcaagtgttttgttcttcatcccagttacggtaagacggaaacgattgcttgacagccaagaagctcactctcggttgttcatgtcagttcagcacggaatacggggctgaaaacccaaaactccttttgatccatatttagaaatacacaacactgcagattttataggctgagaagagtctgagaaagaagtagaaatggcgttgggggtctcctcnccctcactgacggtgcacaactgccca

SEQ ID NO: 1421 - DNA, 477 bp, Rattus norvegicus
  Genbank Accession No. AI012246
aaaagcattaacaagagaaagaaagaaaaaagatacagagcagaagacatgccccttagtagtattcggtgggaaggtaggatttttggtttgctgaaattgagtgtttagtgtttttataaatgaaagaagaacaacaaacaaacaaacaaacaaaaacagttaaaggtccccaaagcccatggctattctatcacccacacccaccgagaagaaagagcaccaggaagagcagaggacaagggaaccaaaagcagaggcagatgtgggtgggggagggggaggctcccctgtgcagtgtactctgagggtcacggagagcaaaaagctcctttttgctagaaaaggcaaatgggactcggaagaaatgggagggaagcaaaaggttaacggggggaggggttgtaatgcataagaaaaggggttggcgggctgtgcacttttctcctaccccatagcctcaatattttaaggaac

SEQ ID NO: 1422 - DNA, 544 bp, Rattus norvegicus
  Genbank Accession No. AI012337
  misc_feature (1)..(544): n = a or c or g or t
gatggtgaaaaacaaccctgttcagacaaagataaaaatacaaaatcagatgtagcacaatataatagaaactggctgaaaacagtacacgctaacagacatgatacacaaactcagggagggaggagataggagagggcagaggccacggcctacaccaggagccgctcaatagactgctgaatggattggatctgctgctttagttgagagccttctttgatggttacagaacaggcgatgaccggcctggagactccacaggcccgtcctaaagcctgcttggagcgtacaaatacataggggacattcttgtcttcacacagcagagggaggtgcaggatgatctccaagggctcagcgtctgctgccatcacaatgaactcagagatgcctctgttgagggttttggtggcttcattggctcctttccgaagctgcttgtagttacacgactgctgaacaaggtccagcagcttcttggtgaggtgggcatctgcgaggggataggcctttgggttcacatcagcctncgcctcgtgcc

SEQ ID NO: 1423 - DNA, 636 bp, Rattus norvegicus
  Genbank Accession No. AI012356
ggatgttaaagtagttacagcaatatacaaaaacaaacaacaacataaaacaacccacaataatataaatttttacactagaaagtatacattggaatttgagtgcagtgaccaggacagaataaaagccactgtactgggaggccaagcaaactgcaggcatggctgggtgaggttggggacaagtggggccaaggggaggggaagtgggccgttccaagggctcactatgggtgattaacccagatacagacttcccagaacccctgaggtacaacacctgccccagagaagccctcaccttgttcctgggtccccaggattggaagccatcaacatgcccacgccttgccttcctaaataccctttcagtttatgagttcagcttattgtgtaactaaagaacctggccagggaagggagagcaatgactgcctcgaagcagaaggctggggtggtcaaggcaagcagtttgtcttggagacaatgtcctcactgcccttaattcagacactggttaactggagaaaaacaattccacagacagatcagctgagtaaggtggctttgagtcactgaatctagccatgcccctgtatcaagggaggcttgccttgaaccactcagtgttcaagt

SEQ ID NO: 1424 - DNA, 485 bp, Rattus norvegicus
  Genbank Accession No. AI012382
atttaggtaagatctttattgcattttaatctgtctcaatatatctccatcttccctttcagaatctgtggttccacatttccatattccctccagtgaggatgtaatatcctcagtaaagcacataaacacagggaggccaccttccagcctggaaacatctctaatgtctatataacatttcccctcaatgtatatttagagatagccatcttcaagcaaacgtgaatgcttcaattcacatatacaattgacacaggaccaaaattgagtgggtctcgaacttgtgccaatgctgttaaacataacactagttaaggaaactgacatctggggaaagtagctaattgtccaaagataaaaacgtgacctcactaggcttcataaacactataatatttccctttgaatcatcaaagaacatttgcaagccaacagaatatctgccaacctcctgtactggtcttacattttgcacaaagtac

SEQ ID NO: 1425 - DNA, 433 bp, Rattus norvegicus
  Genbank Accession No. AI012448
gctcgaacagcttttaattcggcttgggtataaagtccgtcttgaaaaaatggtgatcaatccgaaaatacttcgcaagataaactgcctctaaaactttctgacagtttatccaaatcttatctggctccccctgcacgctgtttgggtgtgcccagcctcccaggctggaaggccaacttgcctgaaggtggaatctaccaagtcgggatggcgggggggagcactttgggaaggagctgccagggtattacctacaccaaggtaggggaacgagaacggtgccgcgatgccctctgggaaatggagtccagtccttttgacaacttaaacatttgtcatcctccactggcctacggagacttttcttcgagttccacagggcccagagcccaaagagaagttttaccgggccctgggtctttaagtctgt

SEQ ID NO: 1426 - DNA, 386 bp, Rattus norvegicus
  Genbank Accession No. AI012505
cccacagacacccatgacgcttccaaatttacagaacaaaatgcacttgagaacttggtagaaaaggatttgcagtcattccttccaggagctggcacccatgggctgggtcagttcacctccagcacctcagtctctggaaggccgaatttggtcttgtgattgtcaaagagcttcaccagggcctccatgtacatggtgtggtacaggtcgatgtctttctgggtcgggtgctccagcttagggacggtgatgggctcccccacaacggtggtgatgggcttggagtagggcaccagcccccaggtgtcagaggagaagagactcggccatggaagatgcagggggcgaaaccaatatacttctggaacttcttctggacccat

SEQ ID NO: 1427 - DNA, 572 bp, Rattus norvegicus
  Genbank Accession No. AI012567
agctgtcaaaattcaacttttattaactcggggtaggctgtcagtccagggagcccggggctccgccgctcagccggtgatgcgcacgtccgggcggcgccgcagccgccgagcccgagccgcctcgggtagaatggcctgcagctgctcctgcaccagcatctccacaatctgctccttggtgcggatgtccggccgcagccactggcgggacagttcccgcagctgccggaaggcttcccggggacccgccgcatcctggtagcgaaactgccggaagcgctggcgaaaggtctcggggccgggacgagaggcgccgggcctcggggcggcgtcagcctgaggcgctgtgttcaaagctgcgggcgcgccggggagctccggggcaggggagctcatggagtcgggctcccgggccgcacagtcgccagctccttcctcctgctcgggcggcgccgcggggctttgggcggcctggctgggctgcggcgccgccatgactacggctgtccgcgtcaccctttgtttcgcagttacgcgcgccttctgcgtctctaacagcgaagctcccc

SEQ ID NO: 1428 - DNA, 528 bp, Rattus norvegicus
  Genbank Accession No. AI012577
  misc_feature (1)..(528): n = a or c or g or t
aagcaaaggtcaaatctctttattgcctccctcccaccccagttccctgtcccccaacagtactgctaggaaccttcctcagattccaagcccaggggctccctgcgagtaccagaccggtatgctccctggccccgaggtagatggggataggaagaaccaggtgtacggtttttggagcgttcccagcgagcacagtcccgagtcctgcgagctgaggggccctgccagctaccaggtcccttctcctgaggatgacctgtgaggcctttgttacggggttctgcctttaagtccacagtctccttgagaggcttctcaggaggtggcagttcttggatttcactggtaccttttggggcgcagcactccccgccttttgggtgcctccgatcatactgtcgccaggagccacgaccaggtcgtggaggatctagcatggatttctgggtctcacccagcctctgttgatttggcccagcccccgaagtcttctcataaacatactgggtanccatgggtaaagga

SEQ ID NO: 1429 - DNA, 631 bp, Rattus norvegicus
  Genbank Accession No. AI012589
ctgccttacaaactttattagtctgggaaaagggggacaaggagttcctgtcccttcgtccactactgtttaccattgccgttgatgggacggttcaaatggtcaggggaggacagaaaggccttgatcttggggcgggcactgaggcgagccacataggcagagagcagggggaagttgtccaggcagccaggggccaggacttggtggaccagcagcaggtccagcaagttgtaatctgcaaaggaaatctggttacccacaatgaaagctttgcctccctggttctgggacagcagggtctcaaaaggtttcagatgcccaggcagggccttcacatagtcatccttaccattctcatagttagtgtagatgagggtaccatatttgcatcgaaggtcctccaccccatcattcaccatatccaccaaggcagcctccttctggtctttcccataaagccctaaagagcgacccaggtgcctcaagatggcattagattggtaaagggtgaggtctccatcttcaaacttggggagctgcccatacagacaagtggacttgagcgagccttgaagccagacatctatggtaaccacctcctccttccagctctggccctggtcagcca

SEQ ID NO: 1430 - DNA, 651 bp, Rattus norvegicus
  Genbank Accession No. AI012590
tttccacatttcaacatgggaaatttgtaaattggttttatggcaagactgttttttattgtgaaaccactagctactgtttacaatgaccaatgtcccaaggaaaggtatggggatttacaacttgatatcccgttaactaagggaacatacaaactatctcaggattccgcagaaaaaatatagacaataagaagtggttttaaacaagtgacttaaaactaaattttcaaatgcttacttttggcatctggcattaatactttttaaagttttacaataaaatatcaccgtttgggaaagttaccacatttcctaatgaccgactaatgacgttacctgaattaacactgatggaaagtacacaagcaatcaataacttaccaacagcatctcaacttcagaaacacaagagttaaatttagcatcttcagtgtttggcttcttgggccaacaaactacttctaaacaatgtatgtgcacacttattcagataagagggctcctttggcacctgagttgagtataatacaaaaggaaagaatatctaacataaagctgtttaaaggctatatcttatctatctatacatatatacacatacctgtacacatatatgcacacacatatacaagaagcatacattttttc

SEQ ID NO: 1431 - DNA, 543 bp, Rattus norvegicus
  Genbank Accession No. AI012612
taatgacaattaatttattggtggattgaggaatacaattttaatgggacaataaggcacaactgtggataaaaacagtttgctatacagccaaggggggcataatcttagaaactttaaataattaaatcaagatgcttctgaagtacttctcaaacagataagtatcagacaattattccctttatacaattcttatatcacatcatttgatcacaaagtctgacatatttcataaagaattccccagttcatgtagaccctagccatctgtcctagccacgcccccactgctcgcctttacccatctcgtctgcagtgtttttgtttgtttgggttaacagcaatttatttcctaaagaattgcttacatatcttggatagccttccaaagcaacaaagcaagcaagcaagcaggcaacaccagagaaagccagccaagagcagattcacaggaacacagggcggaagcagcttgattcagtgacatctaaatcaagctgacattggcagagaatgtcacctcagttggtgccaccagtc

SEQ ID NO: 1432 - DNA, 548 bp, Rattus norvegicus
  Genbank Accession No. AI012631
gacagtttaagaaccaatgacatacctctataatgataaaaaaaaatcttcttgagaaaacaaaaaacccacaagactatttcattgtacattatcaccacaagattaggcactccgacaggtaggcaggattcttggtgagacacaggcactttcatttgtagagtgctgccaattctggtgttgaaagtagacattataaaagtcttcaaatagcttattcactgaccttgtatttctggccccaacacagcagcctgtattttaaatattctgtttatccctggtctttgtttatatacatatcaaaagtaacttcaaagcaagaatccaagagggccacatttcatgttctttaagtgttaaatgataattgataagtaggcatgtcatatgactatgtatccttgcctctgttagaaatgaaaaagcaaagaaaacacagaatgctaccccaaacccttcataggcattttaataaatagatctgttaaacctaactttgtgtaacccacttctggaaagtatttaaattagtagttgcataa

SEQ ID NO: 1433 - DNA, 390 bp, Rattus norvegicus
  Genbank Accession No. AI012632
atgaatgccattgattttataaacaaaagaaggatgcctaggccttcatgtcggagagtgtcctctctgctggaggctgtaaaaatgagcctccttcaagatgttgttaatatgcgagtaaggatcttggtcttggcacacttcatagtcctcctcttgggagaactcagggatattggagtctagttcagcagtgctctggtttaagctgttctctggcactctctcacggttaggattattgatgttggtttggttccttctattgtcactgcttgtcgactctatagcacaaggatcctgttcggtctggtccttccttgtcctcttggaatgagggggatgatggttgtcgtcctcattgtcatctggtcgtcgtttccctcacag

SEQ ID NO: 1434 - DNA, 564 bp, Rattus norvegicus
  Genbank Accession No. AI012636
aaaggagccagacatggcagctagactgaaaatcttccaaaattctgtacaaatgtataatatacaaatatacacaaggctattgccaggaaaggacataacaacaataaatgacagtggtggctttggtgttgacaaccactccgagcttctcaagcccccaagaagcagggacacaacacaggcgacaacatgtaaaacacattatatttacactatatacaccttgtataaaaagcccattgtcccctctgttcacaaatccttaggtgggaagaaaggttgtttaccaggtaacccacataagggagctcatttaaggtaggagaacccctcagaatgaagtggttcatcctaaaactattaacagcacaaggcatgccctagagacaggcagtaagagcaactgaagagatggcttgctccctgtgctcagcatggcttcgccagtctcactccatctcagtgaaccgggcaaacatggctttccgaacagcatctttgtaggaatcggcacctgacaacccatatgcaacgcctttggctcctaagccagctcctttt

SEQ ID NO: 1435 - DNA, 625 bp, Rattus norvegicus
  Genbank Accession No. AI012637
aaaacacatcagaattttattgcttgaagaatacagcatatgaaatcacaagaacatcaaaattaaaagtcactaggcttccaacatataatacattatcagatgcagcaaaatattaattaacctgaagtctgcatcggaaaaaaaaaggtatggaaaattatccaaattgtttacttgagaaacgtatacttaaaacaaaacaaaagactgttacagtacaaattagaaaagccaaaagcgactagctcatttccaaagactaaaccaccggcctttggtgctcaacctttctgaaggaaacggttccttctatgttttccaaacacaccatgggcagacccatgaaatgccttgaaataacttcaacataaaacattcagcaaaattactaccctttttgctaccctttttgttatagggggaagaatatctgataaatgcataataatatgcatataaatttcccttctaaaactgaaaaatatgaatattaagaaatctaatacttataaacatttcttagctctcgaaattgaaatcctagcagctagaatctcctctggggcttggtgaatacagatatttaaatggcttggcaactgacatgggaacttaatgactt

SEQ ID NO: 1436 - DNA, 436 bp, Rattus norvegicus
  Genbank Accession No. AI012689
tttaatggaatagctttggcgcaggcaaaggcagctcctagatatctcagggcatgtggagccccaagaagtggggacgtttgctaggtttctgggttttatttcctggtgcacgaatggttggtccctggctccaggcctcgcgcatctgttcagccttcagtagcaaagccttgatctgtgcattagggatcagagctgctgcttatgcagaagccaggaggtgcgtgaagaccactggccggtcttcacagcgcaggaagttacgctctctgccacaaagcgagaggaaagggaaggaagcctcgtagcgcccgctgtggttgggtctcagacgggagaagaaagtgaccaggaattgcaggtctttgaagcaagtgataaagttctcattttggagtcatctaggaaaagctggccttggtgattcacatag

SEQ ID NO: 1437 - DNA, 467 bp, Rattus norvegicus
  Genbank Accession No. AI012747
  misc_feature (1)..(467): n = a or c or g or t
agcaaagtcttttattcaaaagcttctcagcaccatcgagttatcagaaagaatgagcatcactttttctccccacccaacccccaacgcagagacagacgttaaagcattcaatggggtgccctagtgatgacagttgagcccctgacgaggtttaacctggcccaggtgagccccacagttcagaacaggaaggaatcatgtcagagccgatcagccttcccttctcgagctattagtcacatgagacaaccttgtggaagttgaattcagcgactgccaggtaggaaggacagtgacctgtgcggcagcatgcagcgttgagagttcaaatcctagctaaccctccctaatctactgtaggaacaaggagcccaggactgtttgttctccacacacctcagccgctcatcttactgtcttaccacanacacaaagaccatgaccgtggacaactacatccaatc

SEQ ID NO: 1438 - DNA, 504 bp, Rattus norvegicus
  Genbank Accession No. AI012761
catggaaaagatgatttattgtacattgtgggagaaatatcaagagtgactgtttcgcagcaaagctactaacctggctgagaaaacgtcaaagaccttacactgtcatcaagctgtctggagccaaccacagcggatgccaaaggagtttgctttgctgtctgcaaattaagatcttttttctaaaacatctgagacttccaattaaatgtcagccaaaataaattcccagatgtacaaaatgtgtgatttgtccttaaaaaaaaaaactggatgtcagctcaccgtcgttttggtcaacagtcaataaagtgctttacagacactttggactacgtcgaaagacattatccttgctcacctgatatgtatctgtttaaaataaaaaacactaaagtggtaggtcgttacaaatgagatacaaatatgttttgattaataaatactaaaatgaaaaaattatgtaaagaatgctcattaaaaaaagttactttaaaaagaaat

SEQ ID NO: 1439 - DNA, 558 bp, Rattus norvegicus
  Genbank Accession No. AI012785
cagtgttaattgctttatgtgtacaacagttagcagggcatcaatggtcagaccaagccagactccaacagatatgtgaaacaaggccactttcccaaaattaaagctaccagtaagatccccaaacctcaaaccagactgagagcttggtcagcccgagtggtagagcagagcagcaggcactcacagcctgggccgggactgctccgcctgtgagtcccacagaccaatgaggcgatcagcttccctccagccagacaggagggctccgtgtgtggtagaataaaatgtccgatgtgtggcttccccagcaaagagtacctggagctgggtgccagttccatctgctgggagaggctgagccatcagatctaggtcatcgccagtgctgcccacagccacatagctgtaggaccctcgggtgtatggggcactgtgccatcgagaactcagcacgctcttggctgctggcaattgtgggtttcctgtcaccctccggagtacttgggttagagacagaagcacttcttcatctgacagagtctccataaactccga

SEQ ID NO: 1440 - DNA, 567 bp, Rattus norvegicus
  Genbank Accession No. AI012812
  misc_feature (1)..(567): n = a or c or g or t
aaaatatacccacttaatttgtcttcttatcactttcataatacataagaagcacagtggactagatgcccattatgatgactatagtcacatttagggggtcctataatcaaggtagcatacataccacaacagtgttctaaaggctagctcagaaaaaaaaaggaaaaacctcacattaccttatcacaatatggaacgcactgtgttcttttttcccattaaagtatttaagccactgtttcatttagcattacagtaaataatagctctgcctcaactactacaagaaggaaaataatcctaaaagacatccttttccccttccaatgatttgaaagctacaattaattattccctgccaatttaaaacatcaggttgatttgtactagttgtgaaaacaatcaaggcacaagctcaacaggatatctgtagcttgtagtaaaatgatataccagtatgtctctccttagttaanaatacataattcttttattttgttatgcaacanaagaaattaacatcacaaacataanagactagggatgggaaactacattaaatgt

SEQ ID NO: 1441 - DNA, 348 bp, Rattus norvegicus
  Genbank Accession No. AI012822
aaacaaagacaactttttattattaaagtcaaaatgttaagaacgaagactagggcttagtgggtgtaaggtttgcccagaaaacatggccccctcaggttccattcccagcaccattagagtggttgcgaatgcctataattccagcattcggaaggaggaagtagaagaagccattcaaggtcatgctcattcttggccacatagtaatctcatgtcctgcctgtgctacaggagaccctgcctcaaaaaaagataaatcaaaactgtaaaactccctaacaagtaaaataccaaaatttttttaaagtaccaaataggattctgactttataaaacccttcctag

SEQ ID NO: 1442 - DNA, 513 bp, Rattus norvegicus
  Genbank Accession No. AI012945
caaagttaaaagcgcatcaaacacgcctagcatttattattttagtcaaacctacggacccctcagtaaaccctccttggggcctggccccagcagtttaaagctgaagaccttggatgtaggtggcatggatgggactagtaggtagggactggctctaaggactggctctgaaacagggttagtcccccagatggagaacggtgtggatgggacagaggtccggggtgacctagcttttgagtaggtgggttcaataaaaaaattcacaaacaaatgagcgatacaatatacttttgccaccattccttcaggtccctgccttttagggagatttctatttttccctggactgataaacagcctggacacgccctttctttaccattttctacaacttgaagggaagtattggggtacctagactgggtctacactaatccctatcatctcccccaaattggccctcaaggcagaaaaggcaagatcttctcaagggtgaggatctaagtc

SEQ ID NO: 1443 - DNA, 536 bp, Rattus norvegicus
  Genbank Accession No. AI012951
agatcagaaaatttttattatttagtttctttataaggttataaaaatttagacttttgtctgttcttataagtagttgttatcactcaatttttgaagacttcacgtcaactaactcagaactttaaaaagcattagtgatcccttctgaggcaacttgtgtgttctattgttcatcaaatttattgatccaataagcctggggactgagataagatggagccgacaactatctccacaatcttaaaagctaagtgaaacaaatgtcctcatggtccaagagacaatcaagtgtagccagatcacttgaccagcaactagcgtgtgactacataacttctagcagcagaacgcccgggacagccatgagcaaatgctttcattcaaccgcaaattaattcctctgtaagaaataattttaaaaatactctaaaatattgttcacctgcccgcaaacatgaaacacatcaaaggtcttgtttgtctccatttttccctgtagaatcaggtgtaccggcaacttattagtttcaaca

SEQ ID NO: 1444 - DNA, 473 bp, Rattus norvegicus
  Genbank Accession No. AI012979
accaacctttatgtatttattcacacacttgataaaaatgtcacagttatgagcaaactcattatgatgacacaagtaactgtacagagttaaattacaaaaccaagggcaaccataactacttagtacctgagccccagctcactcacacacacacacatgcttacaatcgctctcacactcacaggcattcaactacagatgttaaattcagatatatgaaagacattggggcttctcgatgcaactctctgccaacaactgaaaggacagaaacactgggggagttagttgtttccttggcacagaactcaataggcaacaagaaagttaaagggttatgttcaccttgggtttagtttcctttttcaacaccacaacagggtaggtagcaagcacgcacagaaaatttcagctatattaactccaggaaaagagagagaaggatgtaaaacttgatccctatttaccat

SEQ ID NO: 1445 - DNA, 475 bp, Rattus norvegicus
  Genbank Accession No. AI012991
caaagtaaactatgattttattgtgaaattctcatagatggaaaattaaattgaatatttattctgtccatttttcattttacaataatcttaccacttatttttgtaccatgtatttcaattgtctgtttagtgaaaaataaacctgtaatttttggcttatttttagattaatattttatcattaaagaccccataataaaatgtgttgtcaacagccacaccctaagcccccaattgaagaatgcttggctgccgcttaaaccaaaggaaacaacctttgacttttgtcaccttaaaatgctagtgtctacaagagactctgtttcccacagtaagacaaaagcagtctaggatctcgaaggtcctagttaacaaaactttcacacatgcaaaatttcaccgagataaatatattatttctcccatcattcccatctagcgttcatgttttcagttaatttggggaatagaa

SEQ ID NO: 1446 - DNA, 447 bp, Rattus norvegicus
  Genbank Accession No. AI012995
ttgtttgtttgtttaatgtataagagtctgacatgtcttggggaggggaatcagcatgaaggaagatgatccgcagtgacaaaacaatcaaaactggcagcaactcccagttttttttctcctcctttcttgaagttataagacttcctgatgaatggctgcagcaccccccccaccagactacatttcctagaattccttgcaacagaaggctacgtagcctgaactgaccaatgggatgagtatatctacataatttccggttcctgccactcaaggactgggctggtacacccccttttctattctagtcatggcgaagttggcgtgacctgcttgtttcctgagggtgatggagtgtgggggcgttggcttgtgactcagctgtcaataactttattataaacaggaccttccctatgtgccccagcaacgcatccccccccc

SEQ ID NO: 1447 - DNA, 536 bp, Rattus norvegicus
  Genbank Accession No. AI013031
aaattaggtcacactctccccagaaggaatccaaggaggaaaagcagtcatgtggccctggaaacatagcaaggtagccaactcagggtcacaggtacggctggtcccttgacagctcccacctcttcatgggaggagcaggtgtcactgccctcttagtggctgccacagcagaactctcagctgtcttgcccgacaccagggccttttgtgaggacatgatgattgagggaggcacaacttcccggcggccatcacgagtacagtagtaattgttggacagcttgtgactggggcccacagggagcttcggaggtggctgggtccatgtagatcaagtaggccttgaactcacagaaatctgcctgcctgtttcctgagtgctgggattaagggttgtaccactatgaccagccttgaatctgggttaggtggaagaatgacaggatgagggcagcaagcagggcctgctcaccgcttggcgatctcctggtagcgcagctgcagcttcgcctgcaggtcttgcccagacgccc

SEQ ID NO: 1448 - DNA, 602 bp, Rattus norvegicus
  Genbank Accession No. AI013044
atgtgttttttttttttttttttttcaattttaacactttattgcaattattcaagtctttcccactgtttacaaatgtttcatttttatgggacctttacaagtttgtcttcacaatgtggcctctgcccataggcctcacacaccacttgcctctgcctcgggacagaggaggggaatgtgcatgcacaggagcagggaccaggatacacgattcgttcttgggagtcatgtgatgtctgcaggctaacaggacatctacttgtccagagagccagtccctacccagggacaaaggcatacccaaccggtagatatgaaaacatagatgtgcacacataacaaaacaacaacaaaagccatcaagtccactctgtgccgcacatatgctcttgggtgtgtgggcatgcaatggagcccgatcaacctgccagtggctactcctgagagaaaactgactctccttcccctcagaagctatagctagctaatgagccattttcaataatttgttatctgttggcacctcggccaccagggggcgctctgcagtcagactgcctgaccctgggaatcatgtgacttatcttaatgcagcactc

SEQ ID NO: 1449 - DNA, 556 bp, Rattus norvegicus
  Genbank Accession No. AI013075
agaacagccaagatatatttattactaaaaataaaagcaactgaggattaccctgggacgcaatgtcagctcaggaacatccatgacgaaatgtgtatcttccctgattctcagctggtgccttcttccagagtgagttttagtttacaactcataatgaggacaaggaagcgggctccatccctttcctgttcagtctgaagactgaattgggctacactgggatggagacttgaggtgctgcaggtcagtgtcaaccaagggttcatgtgtcaggaactcgggctggtaagacgacacgaaggcttcatgctgaagctcaggcaggtccagggagcctggcagaatggaatcctcatggtcatcatcaaacgtctgtgtcggaaaggcttcaaggctcatagctgcatcattctctggcagctcctgagagagctgccccttcctgggtttgcacgcatcgaatttcacccactggtaattgacgcagttctgagcttctggacaactctgaatcaggttgtggatggttggatgagaaaacccaaaggaagtc

SEQ ID NO: 1450 - DNA, 461 bp, Rattus norvegicus
  Genbank Accession No. AI013083
aggaagaggcagcaaggaggttatggcacaggaggctgggggaatagtattggaggaagaaaagggaacattggttgctgcctcagccaagtccttagtcaggccctctttctgcctctggtgtcactcccagacacactgctgttccttgggaggtgtctcctaagagcaggaaacctgaaggtgtgtttccattgagtgatggctctcatctcagatgtacctgtgtgtgccgcccacaacctcccagctccacatgggtgtgggtctgacataagagactccatctttggcagcagcagctttcacacctggataatgagtgatcatacccaaatgttgacagtgatgattgggaatcctagatgctgctggaagagaaacccccctgggtggaaaaggcctctggcctatggggcaagtgtggctggtttgaaagcttatgaagtcttcatcatccc

SEQ ID NO: 1451 - DNA, 542 bp, Rattus norvegicus
  Genbank Accession No. AI013110
aaagatgaattatcggtcacgaagttaggttcttcctgggactggccgtggtgcgcaccatctgccttcattcagaagtcctgcagcttgtgggttggtaaggcagctgtcggaatgctgcagacaggatgcgcaccttgtgagtccttccctgtcgtgatgcgaacatcccaggtaggacccagagtgaactgttaggaaaaatatatcctattcacatatataattccattcccccaccccagcatacaaagcgtgttgagggccgtgatcactctagcagagttaagaaacgatttggtacaaacgccttctgtagaccaacattacaacctctgtgagcgccatcgagcagaatctgtaaggcgacacgggacgacatttaagaagcagatttctagctggctcgatgctgccagggattgtcgcagcacaggtgacataaacagctgaaggggactcttgaggggtaaaggatgcaggctatgaggtgtccttcactgtgggagccacagaaacaaaaggatgctctagggtatgat

SEQ ID NO: 1452 - DNA, 470 bp, Rattus norvegicus
  Genbank Accession No. AI013120
gaggagtagaaaaatcacttgttttgtaggctttaatgaagaggctgtcaggtaacaatgtgactagacacaaaacagtgggtaaagaagtcagccacactgcccaagtgtcagtccacagacagacaaccacaacaggaggaattgcactgggacaatctggtggtcaccacttcaacagtcaaatgtcacgtcagcagcagcctgttggcctgactgagttctgggatgcaggaggaaatgcaaccgtgaaatgccatagttaaggatgtttaacttgagcctttggcctcaacttcgatttcctagaagcttcaggacatttacttcagcacatgcaagccatgtatgaactctcagctcactcctgaatgtgacgaccagcacaccctgaaaacaacagaaaaatgggagggtctgttctaggcacaggaagcccaccaaacagaggacacgcagacactgattgg

SEQ ID NO: 1453 - DNA, 470 bp, Rattus norvegicus
  Genbank Accession No. AI013204
aatatctgtaatggtactgactttgcttgctttgaagtagcttttattttttgcagtaactgttagtttttaagtctcgtagtgttatgttctagtgaacctgctacagcaatttctgatttctaagaactgagtaatggtgtagaacactaattcataatcacgctaattgtaatctggagacgtgtaacattgtgtagccttttgtataaatagacagatagaaatggtccgattagtttcctttttaatatgcttaaaataagcaggtggatctatttcatgtttttgaacaagaactttattggggatacgtgcggtggggtaaatcagtaagaggtgttacttgagccttcttgttttggacagtataccagttgccttttcccaaagttgttgtaacctgccgtgatacaatgcttcaccagacgcggttataaaaatggttcagaattaaacttttaattcat

SEQ ID NO: 1454 - DNA, 374 bp, Rattus norvegicus
  Genbank Accession No. AI013222
cgctctctgtgacaaggaagctttctcactgtctctccgagtgctacagtacttgctttgatgtcacactgaacaaacggacactgtctctttgtcctcggacacagtttttcacggaggagaacaaagactgcacgcacattggcaatgaagcaccatacatagtatgttcaggaatgtcacacgccacgtacatccgtgtcccgggagagggcagccagctcatctcacctcacatctgtgggaaggcaggaagagttgaagctatgaccacagatacagggccgcttgacaacttatgtcttaatacatgcaggtgatatgtaatttaaaaaaaaaaaaatcaaattttccacagtttaagtgtaatcaaa

SEQ ID NO: 1455 - DNA, 469 bp, Rattus norvegicus
  Genbank Accession No. AI013273
acaaaatacaaaaaaaaaaaaaagccaatccaaagagtacagaccagtagtgacaggcacgtggctcgacagcaaattgtgtccagcgagacgttagttttccaactttattttagtgaacacatgcagtatataaaacagcgatagcaacagcaacggaaacaacacacgaagaggctacggctttcgggtggaagtgagagaaaaggaattaaaaaggcaaatgatactgttttccataaaaacataaaaactactataaaatgtctttttcccccctcctatcacactgattaaacctctcccggaacgtcacacatatacacaagaacggaacaaaaatgctgaacccgacagacagcaaatactcgagagggttgttaacctaggtaactgatcagtagtttaaagaaatcttctagacgtcctgaaacccgcctcttcgttcttccgtacagcatcccagcca

SEQ ID NO: 1456 - DNA, 487 bp, Rattus norvegicus
  Genbank Accession No. AI013297
aaaggtcacatttattaggagattaaggggtgcattatccatggactataaatagtgcacagctgacacttcagtcacagtcaagcagaaatgtagccagctccaacctattttgtagacactcttgttcttttgttccaagaaaagtttgcaccgtaagacttggacttgggtttcggaaccttcctcccttccacgtcatagctccatccatgcttttctgcaaaggcaaccgcatcttctttggcactgaaggtgagaaccatgttggagaggggatcggccgttgatgcccaacccatcaaaggattttcccatctctctctggtatcaaactccatcttccatttcttcgtgttgtttactccagactgcatgttattgcgagcaggaacaaagattctgacctttctggttttgatgtgctcttctggaacaccagttagaggagtaacatcctggatggaactctgcagacggaaaccgc

SEQ ID NO: 1457 - DNA, 458 bp, Rattus norvegicus
  Genbank Accession No. AI013305
aaaggtcagcagtaaaaatatagtttattctaagagtgacaggtcagtgaagaatgaaatataagacactgcacactatgtcctcagagctctaggtaaagaatcagaccttgctcatgatgtttctgagttagtcttgtgggaagtacgtgtcttcctctgttgtactcatcatagtcaacattattattgctgctgctgctgctgctgctgctgctgctgctgctgctgctgctgctgccacggaatacctgagagtgcggggaggcctaggtccagaccgtgtatgttctttgatgcttctctctgggagcccccaagggtccaggttggatcactctgttggtcttcatgtgtccccaccagcggggacccagttattcagggtcccgaagaggctttctacctatgggccaaaatgggggtgaagagaagaagaccaagcaagaatctgttcc

SEQ ID NO: 1458 - DNA, 311 bp, Rattus norvegicus
  Genbank Accession No. AI013369
acacaaactgacctttatttgttgtactgaagtctgttttggttttgatacaaagtaacattttagtacatcatgtcccacctgtcagatccgtacctgcccacttgctgaacactgaacagggcctatgaccagggaaataacccctgacctgaaactgtgcagagtaagaacttgagagtggtctgtggcttttcttagttgtctgagctagaaaatgtgtgcctgtaaggcacagaacagccttgagggctgcaactgtgtctctctctctctctttaaacagctgtgcaagaaaatatatccctttt

SEQ ID NO: 1459 - DNA, 444 bp, Rattus norvegicus
  Genbank Accession No. AI013440
cactgtggagaatgactttattaacttacatggagttgggtgtgactcttacaagattcacagtggcacctatgcagtgggcactcaggggccacagtttttaaagcagtatgtggggaggggggaagggttgaggatgtagtttatcagtggcaaccaaggcacctgcctgtcagtgatcttcacctgccagtgaggacatgtgtgtaacacccttctcaagggacacaaccctgatgccttcgaagagtttgcaaccacaagagacaggctaagaggggagggccttggcagggctgtttatagacaatctcattcatctctctgtgacacggttaaggaaactgacaccaggcagagccctcctaggtggtaaaatatggctcactcagctccagcagcatggtcccacgtctcacccaccatgccgccatccacagctaa

SEQ ID NO: 1460 - DNA, 396 bp, Rattus norvegicus
  Genbank Accession No. AI013442
agtcactgaagtgaaacctgtattttctcaacagtatggataggctataactacaatctctttgctttaaagtctctgccatcctctccctcaattcaggtcaaagttcatagcagcaatgctcaagtcttcagccaggccagtgttgtctgctcctgggccagagttcacaggtcaggatcagtcagtccggagaatcatgggaggatgttcactatcttcatccaggcgtagagcgctggcttcatcctctaggcatgcgccacccacagcacccaggtcatcggtgtaggcttccaagttggcgtcctgtcctttaccaagtcttgttggggacgagggcacataggcacctttggcagctgctgtgccgtatgtctgcgttactaaggggca

SEQ ID NO: 1461 - DNA, 506 bp, Rattus norvegicus
  Genbank Accession No. AI013448
agaaaaaaattgtcactttttacaagctgaaaaccagatttgacttaatacattttcagggatcttggccaagtcttgcaatctttagcagaatgatatcatagtaccaggtgccagcagtagggttataaactctttaagtacacttatctacagttttacgaagaaacagccaaagtctagtccttaaggtatgagtcacccaatctcttgacctatgaaggacagaatcacctgagttttgtggtgggcaagctatggagaaaccagaggaagtttctcttttttgagacaggatctcaccaggtacccctggttgtcctaaaactctatagaccaggctggccttgaactcatagagatccacctggctctgcctcccaagtgctgggatcatgacgtgtcccaccatacccagcttcctggtttaaatattccaggttgctgtcaatttaataaaagcctatgacaagcggacccacagatatttggttttactggtgtat

SEQ ID NO: 1462 - DNA, 692 bp, Rattus norvegicus
  Genbank Accession No. AI013475
aataaacttgcggccgcatgatgttttttttttttttttttttttaccagtacaaagttaaacacgtccagatttatttacacaatgctaaagagattttgcgttttatttccattttgtgggatgtcgttatgtggtctggctttgctgtataattgacacaggtttttgaaacttgataatcccacctcacatgcaatgttctgtcccaagagggcagaagtccggagttttcagtacacatgcagtggtggtcttgatcctgctctcccaggaaggcagccgcccctcacagccgggggaagggccacatgctcagaaagggaacagaagaccagaggggaggacaacaggcacgtggggaccctgagcgttctgtgcatggggataaggagaatgcagccccaacccttctccctggaggctcaaacacagggactcggctgagccaccaggggacaggaggtcacctgaccacagctgagggcacgcggaggatgagaactgcactaaaaattcggggcatactgataagtcattaacatgtacactatacagtttatacatgtatatatgtacacacacacatatatataaaggtacagattggcttgtgttatcttatataaacagatgcagagaatgtagtagtgtgagacagcacacagcaagtctttgaagacagtttcaag

SEQ ID NO: 1463 - DNA, 632 bp, Rattus norvegicus
  Genbank Accession No. AI013482
acaagatacaaaatgtaaacatggcaaaataaatagttaaaacaagtgatgcaggatcccatttcatgctcatgatcccattaaagaattatttttaaaatccattcagttgcaaattcaagtgcaaaagcatgatgatgaatatctactattcaagtaacagaaataatattgatgatacaaataaactattttacaaggtagtgattttcccaattttacaaaatatacatcatacatcgacttaacatccggtatactgtactccatttgggtccattgttctgctctgtgatccagagtgtcgcctttgtattccgctggaatatgaatgactgcaaccgtccacacaggtcaaagccacacactttacgttatgtcacttccatagctactgttgtctctgctattccatttaaacccagtctttctggttcatggttctctctggctatgctgctgatggcactgctgggagtaacctttggcactctgtccatactggcagcaattgtggcaagttttaaggctgttggcgatggtgctgaagtccgtgtattgatatgcaatttttcctttcactcataaatctgaatgcagtgcgcagtcatttgaaaccatcctcgtgccga

SEQ ID NO: 1464 - DNA, 610 bp, Rattus norvegicus
  Genbank Accession No. AI013494
cagcacccactcctttattcctcccttgtaaaggagacttcagttcaggagcttcctttcctgccctcaagtccccatgagacaagggatcacaggcaccagatcttgggtgagacagtacaggtctcagacacttgcctccagccctgaggttctggctgtttatgtcagcgagtcagtagtacccttccaaaaggagggaccagggtcagttctgagtggcaaaagtctcgagacaagaggccaccttaattaggtctgaggggaacccaccacagcaaaggtcacctgtctgaatagagactaagccagtgtgggcaagccagctcagttacctcaagggaacacagtccttcagtgagaaggacacagttcacatggaaggatgctctcacacacatcaaggcaacacgccaccttcttggcccatgtggctgcagctggcagcagacacagcaggcttcttggtggataaagagatggcctagattccagccataggagcttgtcacagcaggcttccagaagaactcaatcccgaggtcggttgaccatgacttcacccagggcctccaacacctctcgcttgtagtcatcaaagcctcgtgcc

SEQ ID NO: 1465 - DNA, 352 bp, Rattus norvegicus
  Genbank Accession No. AI013531
  misc_feature (1)..(352): n = a or c or g or t
tttttttttttttttgaacacacataaagagtcatttattccattttgattattcattatttccattgagagtcatttgttccattttgattattcattatttccatccctgaggaaatcacaaggcatcatagaattaagattagaactgtccctggacaggctacaaatgggagaaagggctgagttcaccattgttcaacttttttatcttgaacaaactgcccatgaggaccctctgcatctggagtcnaaaaggccaagtacacgggggtctctgctccttcttctgggcttttggtggcttttggtcctgccatgtcngttctgacccacccagggcagcaggcat

SEQ ID NO: 1466 - DNA, 590 bp, Rattus norvegicus
  Genbank Accession No. AI013558
tgtgatttttttttttttttttttgtaagaattgaagtctttatttgtgatatccataaacgttgctattctatgtttctattcaggaaggcaattttctcctattatcagtgtttgttttttttttataaacaacaacttgaattctattgcatgaagggctacaaatacacgttaaccaagcagaatacagatatttgtttttacaacttgcacctaaaaccccagtacacacagctgcttcagtagctatcagagcagtttggggctactgcccaagctatgcatagcagtttacatattcaaatctcacgtagaaaagcgactgatcacgggctgttaactacactcctgggaagcccgtctcagctacaagtaaatgcggacctttcaagtctgcagacttctggtggcaaactgctaaatctgatgaaattggtttttttaaaccaactttcttgcagctatactgccactctaccagcagatggtgctacatcggttggacttaaaaggacaaagttcagacttagggaagaaacggttttttttaaacctgctctgaaaatacatcttaaaaaaaactcatt

SEQ ID NO: 1467 - DNA, 510 bp, Rattus norvegicus
  Genbank Accession No. AI013667
  misc_feature (1)..(510): n = a or c or g or t
cccttataaacaagccaagattatatgtttggagcgatttaatgtgaaggaaagcacaagagttctattcattaaataacaatccaaggacatccaacactagtagcaatccctaaaccagaagacggaacggaaatcctgaggtgcctgttaccttccaattttcgaatctgaagaaaaagcacatggacctcccagtttaactcctgcggattactacggtcctgaagaggggcgggatatcacgggagcgagaacacgaaaataaataaaatcagtcaggaaccaccaaccgtagttccagcagcagcaagaaaagccagtctagggttccttgcttttcacaactctctccaggacgcaaaactcttcagagaagggggtgggaatcaaggaaatgcagcataaacatcacagagaaggaagtgaggttgagaaagagttcagacttaactgtacggactgctgacanacgaagttcacttcatgaaacaacacaacaccctcgtg

SEQ ID NO: 1468 - DNA, 475 bp, Rattus norvegicus
  Genbank Accession No. AI013755
agacgccagtccgttttattagataaacaatgccattttagcccatccacactagagttctgtcaccaatacccaggaaagcaggcagacactgtcctgtcttcttcttgttctggcccttgggtctcagctagcatctatgggtttctaagaagcgaagtccagcgtttcagaagaaaagaacactgtgaagcctaggggtcggcccctggctctcctattcacacgcagacacgcatctgtgcacaccatacagataaatatatatatactcttttttcttttacaaaaataacacagggtttgtgcagttctattaatttttaaaaatcacacaggcagaatttacactttagcataaccgttttttactttggattaaagtgggaattttaggtcccaaaataatttacaatcaccaaagagaggtcctgcagcaacaactgaatgcactctgaactgcacaaggacagtg

SEQ ID NO: 1469 - DNA, 495 bp, Rattus norvegicus
  Genbank Accession No. AI013773
aaacaaaaatatacattaaatctcagatttacagcatatagaaataatttatgatttgcattttaaattattaatattgcacccagtaagtctttgacacatttgcattgtcaacccttcccgccattcaaaaacaatgaaagcgaaacctgacaaaatttcacaagctaaattttctgtaaaaaaaaaagggaaaaacgtacaattctttttatatacatagtaaagttgtaaactttcagaaatttacctccaggagatagaagtacattctttcaatgcattctaaaagtacgatttaatttttcctgtcctgtgtatagaagacaaactacatatggtttcctctttggaattcacagactgctatgaacatttgcaaaggagaaaagtaacctgtgggcaccttctgtagaatagggagactgtttcgtgaaggaaataaaatgggggaggggataagttaccttttcaaggatattttcccctcgtgcc

SEQ ID NO: 1470 - DNA, 325 bp, Rattus norvegicus
  Genbank Accession No. AI013774
agagttctttgcacagctgtattttgaggtttctactgctgtgagacctgagattcacggtgtctctccctcagtcccaaaagctccgttctgagttctccaggctttggtggaatttcaggtattgtcaggtcaggccggtagtaccagtgcaccacctgggctccggcgcacatggccaggaggctggaggagagcattttcaagtagaccgaccagggcacgcccccgggcatggtggagaactggcagagacggaaagggcacagcgttagagggcagggtagctttcagacagcctgaccactgaggcaccagggtgcta

SEQ ID NO: 1471 - DNA, 620 bp, Rattus norvegicus
  Genbank Accession No. AI013775
gagaaacataaatcaagttttaatacaaaatgtaaacaaatgatacagaagaatggagttacttgtaattctcgtgaaacaaagttttacattagaacatctacttctccttaaatagatgagtcttatttcattaactcacaaactatagggtttttaatttgtgggtggagtgctagcttctcttatatccttaaaagaaaattttaaacaagattttcattacttatatttgtgagtatttctagaatgtatctgtgtaccacatgtgtacagagctcttggaatccagaagaggacgacacagatggctgtgagtcaccatgtagtgttgagaactgaacctgtataaacctctagaagaggagccagtattcttaaccagcctctctcttatggtcttttgagtttttgtctaaatctatacttaagacaaatcaaattcttcaaataagtacagaagagtcaaatgaatcaattaaattatatatttaaaagtttcaaaacatcagaagatgacaggcagctattcacaggtacagactgcctatctctgaggtctccaacagacaaacactgtacaaagaacacaaattattactcaaacagtcacctttcag

SEQ ID NO: 1472 - DNA, 601 bp, Rattus norvegicus
  Genbank Accession No. AI013781
gccaataaagatcacaaatgcttttaatacttaagtataattcaaacttttttcataataaaactgtctctgaatactgttcagttactttttattaactgcgtccagaaacttcagcaggtgcaggaagagattgatgatatccaagtagagactgatggcagccaacacgtactcttcaggtgagagtctgtgcatcagcgagtgtgtgtcatagatgatgaatccacagaagaggagggcacctagagaggccaagaccagttccaccgtctgactataaaaaaacaccttcaagaatcctgccaggcacaaaatccataaacaagcaaacagccctgctccgaatttgctgaaatctctctttgattgtagagtataggcagtcaagccaagaaagactgcagcagtcagtataaacgcatgcagaaccagatgcccatcatagaaagtaacaacagttgccacggtcagggcttctgacagtgtaaatgcaaaaagcagatagaggttcagaggatgcgtgtgtctgtgcagagtcaacgcaaagatcaagcccagagatccgagagcatacaccacaattaaggcaaggctgtca

SEQ ID NO: 1473 - DNA, 600 bp, Rattus norvegicus
  Genbank Accession No. AI013801
cagcataacttggaacatttgaaagcttttcaacctaaatgtgggggaaaacaggtaaggcattatttttgcacaaaactagcattcctaatagtgcaaatgaatctggtgcctcctaaaatggtgagaggccgtacactcactaaatcaatttaggttttctttctatggcttcacaggttatccctctataaatcctatctcaccagagctgttgctgttatcaaaagataactagataagggtccagccttttcctgtatccagcacaagggttttgctcatatgcaaaacatctcatttttaaattaggctacaagcaaaagtacaacttggactcctaaaaatcttctaatactggtagcaacaagctgatctggacagcagtctcaaaggagctccatagctcaaaaaatagtcaatctaaaacctgggtcatcctttcccctcccctgaattagctactacaatgtacttgagaagttaagacttggtttgaaaatgtcatacatacaatgagatgcatcagattcgtcatttgatcatctgataaaacttgcatagcaagatggaattcaataagccttttctgttgttgac

SEQ ID NO: 1474 - DNA, 501 bp, Rattus norvegicus
  Genbank Accession No. AI013816
caagccttttggaagccatttattagctgttagtggattctgggcagctttgcattgccctggtgggtctcctcatccctaagagttttgcatcatctgagaatggtaagccattttttcacaggctccggtaggtacccacagtgttatcaaagagtagagtattgggaaagtgtccagctttgtccaaaaggaagtagaagcgccggcctttgaccttcagaggcagcatagcaggaacttcacctctgtgggccatgcaggaaatctggttcaagggaactgtgaaatgggtacccaagccaaagggggcataagtggtcaatgtcacctgctgccctcctgcaaggagcatgactgaccgcacagatcggagcgagtagaggagaccagcaccagggaccaaggctcccatcatgccgcaaccaacagctaacccgtatcgccagagtgcggagcgcaggtccaggggagccccggttgggagcctccgcgggtact

SEQ ID NO: 1475 - DNA, 542 bp, Rattus norvegicus
  Genbank Accession No. AI013847
aacaaaaaagcaaatatggtatttattcagcttttaggaaattaaataacaaaacccagaataaagcaaatcaaaaaccgtaacatgacacatgactgatcatgtccaagcacaatagcacttgttaatcaatataaaaataaaatttattattcatagtttctcttttcccaacttttactacatggatgttattagaagcttaagctacccagccctatcatgtgacagagattacagtcccacagggaaaaaagtttctattcttggaggcctcatccgactagatccctcagaacttttgctctggcactttcatgaggaaaacaggcactgtctgtcagagcacaagctaacctggctctggtactcttcaagttttctaagctctccacaggacaacggttctatgccatcagtgatcctggcagccactgccccatcatcctcagtagtagcttcccccactgcaccaaaactgggactaacacaactaggtcagttggtgtgggaagataaggagctgctaactccactcagtg

SEQ ID NO: 1476 - DNA, 568 bp, Rattus norvegicus
  Genbank Accession No. AI013861
  misc_feature (1)..(568): n = a or c or g or t
atcaggatagaaatttatttaaatccaaaataatatgactatagttagaataatataataattatctaaaggaaatatcatcattggctctgaaacagtctaacggtgtcatttttctggagtcaaaaacatgtagtaaaaggatatacaggaagcaaaaatacagaagcaagccggctgagtgaggaagctgtaacaggagggtacactaagatactgtaacaatcgagacaggaagacaagtatagcaagctgtcttacctatcaacccctgcacagtaagtcagtaacccagaatgaaggaataatagcacgtggttaacaggacaaatttccctctaatttgtctttgtaactgatttctttccttttttaccatgggttccatctggttaacaaaacatttggttttatttgtaaagcagagtaaataaaatatcctgatcagagtgctcaattttgtttaaggtgctcaaggttcanacttaaaaaggtcaactgggctagtcagtgggaaccattgggtgtgtttgctaaacagatgaaagcagcagcatttaaaatggat

SEQ ID NO: 1477 - DNA, 505 bp, Rattus norvegicus
  Genbank Accession No. AI013865
ggcaagcactctaggcagaacccaagggatgaggagaatgggacgccagcctctgtgtggcaatacaacctagaagaacagtgtcaactccctcctaggctttgactctggttccatggtgaggtcctcaagagaccagacctcagcctcaagacccaaatgcagagttcgtcagcacccattccttactcttcagacagcagagagaccaccgtgggctccaactctccagagacagtgtgttctttggatgtgtttggccgctctcccaggccccacaccaccaggcatgggagaaaagggtgtaaggggaaaggagacaaaaggactgaaccaatattcaggtaaccaaggaacaggctgcccgacagaacaggcttaaggggaactgggcacacaggccagctgtgagtccaactttcacattgatgggtggaaggcgggtgggtgtgtgtgtgtgtgtgtgtgtgtgtgtgtgtgttaatgacacttgcctcgtgccgaa

SEQ ID NO: 1478 - DNA, 492 bp, Rattus norvegicus
  Genbank Accession No. AI013875
catgtgttttttttttttttttttcatacgtcggaagcgggagagatcagactaaagatgggtgggtatacctggtatttggatgagatgctctgtgggaggctcgcaggggattcgagggtggcttttataaaatggttttattttctagctgtatttaaaggggtgtttaacattacctacttcattaaaaaacaaaaacgcccctcaggaaatttagatacaattgcgctagtcatggttggcatctatgagagagagcaactgcattctgaatgagtaaaacggacgtgtgcattgtaatttacttttcctatgtccccttcgagaggggcaaagtaaaacaaagaaagcagtgcagttggctgaggagactgagcttgcaaagcaataggtctttctgtccaggcagctcctaccccttcagttccattccattttcccttgggactaaaagctctgctctgtctcatttaaagtcttgtcttccgg

SEQ ID NO: 1479 - DNA, 652 bp, Rattus norvegicus
  Genbank Accession No. AI013882
aaataaacctgttcaggggaacagctactagatgaatttaagggttttatgcaccttatagaacttatagcaaaaatagttttagttgatttcattataaataacgttttcaagaacctgtgcaaaactgtcaataatttcctaaagcacaattgatcagaaaaatccatgattgttcagccttcacacccttcttcatgtaagaactcccttcggtacatctcacagttacttattgggtggaaaggtatatggagaatggtcattagacgtctccacagtcacctgctgctggccacttgcttcctcaacgggaaccgtcgcagtctgcatgtgtgtgtactgtggtaagtaggctccttgcatggctgacgttgcaggcatgtatgttccggtgctgcctagtgacaggtgactcatctgctgggccagagggctgatcatagaagcaggttgtagtgacatggtgtgttccatggagggagttaacacggcaccaggatgctgcagaatgtatggttgaggctgcatccaggaaggactctgcaccttgagagcagggccccgatactttttctctctggtttcctttgccacctggtaggcagatacaggagatgcaatataaggtgtaagagaagtttgagtgatc

SEQ ID NO: 1480 - DNA, 322 bp, Rattus norvegicus
  Genbank Accession No. AI013883
aaatcttagataacccaatctaacgtgtagacagtaggttaagctcaaacactggaaacagaaaagctgacactgagttcaccgtggcctgtcatttagccctttgattgcagtttacagggtcttcacaatacttactacggccacagtagggctgcccagggacaaactcaatggcattcacccagtcctctgaacccgctcctacagttggaaagtttgggtttcgtgactcagcttcgcctggattcatttcagcaagtgatccaacaccagaagggagacttgaggaagcagcaggggatggctttgcactcaggtc

SEQ ID NO: 1481 - DNA, 652 bp, Rattus norvegicus
  Genbank Accession No. AI013888
tgttcttttttatttttttattttttttttttttttttttttgacacgggtaaaatttttattcactaatatggagaggtgtgacttctggatccagccagtcggtgacataaataaggtagcgcaaaaagatcgaagctagagtgtgtgtgtgtgtgcatttgtttatttgtgtgtgcgcgtaaggcttcttggagcagtgccacagacccggacgccagtgaagaggatcactgcggtccttggaaattaccatggagagcacaacgtgggtaattagatgaggatgctctaaagcgctctttccatcttgtgcacacacatgcccgccaaacatgaaatgttcgccttctcccttcccaagtgacggtggctgaacttatttttagtgtcatttgctaagccttcgtgctcacagagagacatcccactgacccggccgctgggcattgtctataccagttcacatcaaagcaggcgcgctttgtcaggtttccagtcgaatatccatttcgcatctgaagtacagtatcgaaagtgactggattatctgagctatttccttcagctgctaccgcttcctcccccaccgtgtttctgctcacgctaacataatttggcatccttgatgtgacacgatgttgatatttcc

SEQ ID NO: 1482 - DNA, 547 bp, Rattus norvegicus
  Genbank Accession No. AI013890
atttgcaaatacttgaacttttattaaacaaatcaacacacttttacagtgccttgctggagatctgcctcagaattgaaccatcacttctggtgaggaagaaactatggcttcaggtacatagcttaagtttggccatgcaccatcataaatgcttcaacatctccagggactgaaagctcaacaagaggactctttcccaacctcttatgaaaggtacttcttcaattcttcaaccatctcttgaggctcaggaaatttgagctttcgtggagggcccttcttaataccagtccagagttcaacacgactgttgtccgggcgcagcagcgtcacttcgaagctgcccctccgcggcttggaccggttcacttgcacagatatctctggggcctccagttgcagagcctggctcagggcagcagcatggcggccgtagacacgtcagctcgtacaatgctcaatgaccacggccgcgccctccgccagtttctcgcgcttgtccgccgactcgataggcgcggccccggccttacgctttcttccg

SEQ ID NO: 1483 - DNA, 622 bp, Rattus norvegicus
  Genbank Accession No. AI013900
ggagtggaccatctttattaatgcacacagttactgggacgaggccatgatgctggacacactgtcaaagtcgatcttctccacgatgttcttgggcttaatgctctcctcctggctgcagatgaagacctgccctgactcgtccgcgctccagccgtacttgctcatccacaccctcagctggttgtcagtcaggtctccgagcatctcggccagcagccagcggtcgatgtgctggtaggtgatgcccacgacatggcagataaattttcggacagagtcttcaaagccagttatgccttccaggaggtccatgttctcatccagggcttgccagaaggcttgaaagtggcaggtctccagcaggtccccgaggtacaagatctgtcggatgggccgctcttcttgatgtgcctggtcgatcatacatttacacagagtgaagtcggtgtggggcaggttggtgagggctttcagcagaatctgggcagtgactgtggtctggaagaaggctgggttgaactggtacagtttcaggacggccaggttggcttctagatcataggcattctccttggcctgtgtctccacataccgctccaaggtagccaagttctcagaa

SEQ ID NO: 1484 - DNA, 685 bp, Rattus norvegicus
  Genbank Accession No. AI013918
attagaattcttttaatagatataaaaaagtactaaaatacttgtgtggttctgctgtgttatttgccctaaaggaagtgaggggcagagtgaagaacccaagtgcagctgggtgggcctttccttaggctaaggcatgctcctcccatcatccagacttgtgagcccctgctgcccgagcccccaattcctgcagcaggaagccccagtggtctggctctggcactgggagtagaaggcacctgtagggctggctgggcaagtgaggacaggtgacctttaacacaaaatactactctggtatggggagcaggacatgtagctgaagcagctgtcgaggccctgcacctctatggcacacgtggatgttggatggccacttctccgggagcgaggaagcctagatcccaacaatactaaaacttgtttttggtacaaaataaatgcaaagaaggtagatgagggccaccatgaaagcacccatgttgccaatgaggctgaagaggcagctctctggggggtatgtgccacacttgctgatgagaggaacatcatccagggtgcagcaggtcttagggcccccttgttcagcagggtcaggagagcaggaatcattgtaggaccagttctccactgggcacacgtggcggttcatcacagccatggcatacacagtccatatgcc

SEQ ID NO: 1485 - DNA, 496 bp, Rattus norvegicus
  Genbank Accession No. AI013937
aaagtggccctactctaataataatagtttgttgctaaaaatcagtataacttacaagtggtctcaaatgtttgtataagttacatattgtcattgatgtcgttttttacctaacagaaaaataagctgagttgtgttcatggaaaggactctgttagaatgagaaaacaaaattgtgaaatattgactcgttgtataggtatagaagtgaaatagttaggggttggagatttagctcagtggtagagctcttgcctaggaagcgcaaggccctgggttcggtccccagctccgaaaaaaaaaaaaagaaccaaaaaaaaaaaaaaagaagtgaaatagtttgccaggctgcagtagacaaaggctgagttctgtgagtttgtgttcagcctgggctacatagtgagaccctgtatccaggtagaaaagggggaaaaaaggaaggaagaaaaatgacatgttttcaagcttaggctgtaactcagaggtaccatac

SEQ ID NO: 1486 - DNA, 468 bp, Rattus norvegicus
  Genbank Accession No. AI013946
aatgacagaggctgtttggaagcctggacatagtaatcataccttctcatttacaagggcacactgtatgaatgcacagatatgtgtacacagtagattatctttgatgcaaagagctccactgtgagccttggtgtcaccatttttacataaagtccatcatgtgacaggaatgcagaggtgaacacaccctacttgtattaaaacaattttaatgacaccaggtaagtagatcttgcttctgaccttccattgcacacaaccaaatgtaacttgcctggactgaaacatgcacagtggggaaccaaacacaagactttgggggagagggagggcacacaggcgaggtgagtgaagaaatgaccttagaaacaggcgtggtccacagtgacggtgaagctatgaagtgctgtggctagaggcagggcctccaaggcaggagtagcccagggcggttcttcatctaag

SEQ ID NO: 1487 - DNA, 423 bp, Rattus norvegicus
  Genbank Accession No. AI013993
atttaatatatacacagtacaaggctgaagcacctttgacttctctctcaaaacgtacgtttgtatgaaaacaccacacggcggtagcaatccactgggcaggctctctgtggacaactccacgtatcttccccaaggaaaacacggtactttgggtaagggtttgcctcttttcctaagagctgtcccaaggagaagcctttgactagcttgtgtgctccccggacctgtggctttgatgatgatggctgcgcaggaaggcgatgggactggtgggagggagccctttgcttgtacacacccggccttcccaacgcattagtcctgctcctgggaggaagaggtttaacccccggggccgtggcaacagcaacaccaccaaccagctggctctccctcagccatgtgcacggtgggcgtcag

SEQ ID NO: 1488 - DNA, 460 bp, Rattus norvegicus
  Genbank Accession No. AI014022
gcaaaatgtacagcatttattcacatacagacaaaaaggcacaaattctactaaatagttcaacaaaaaaatacagctgtcttcaactagttttataaatactttcaaaaaggggatagaaataaatacaggattgggccatgtaatataaaatagtcatctctacatagactttgtttaacttctgattttaactcttcatgcaccttttttttttcaattttagttgaatggacaccaagctaggcacataatgaaaaatcctctgtacaaggttacaaatgtaatgacgagtctgtccattttaaaataattaagatttgtacacaacacataaaacccttcatttaaatttttgtttataacctaacaaatgacattccaggcaactttacaaaagttcaactagcctacattttgacataatacattgatcataatcaaagatatttcttggtca

SEQ ID NO: 1489 - DNA, 438 bp, Rattus norvegicus
  Genbank Accession No. AI014076
ccagagattaaagacacgagatctttaaccttgaagggcaggcaagaggtcggctatgctgtcaacatagaagtcagggaccattttcttcttgaacatgcagtcactttcctgattgctcttcacatcctcaagactggagactccggtgagggtcaggatagtcttcaggctacaggtggagcccaggaggatgtctgtgtccaggcggtctcccaccatgacggtgcgctccgggttgataccatactcctgggacacgcagtcgaagatgaagcggctaggcttcccgatgatgtccgcctggcgctgggcggccatctccacggctcgcaccagacagccggtacccgcaatgaaacgggcgttctctaacgggagccggttgtccatgttggtgcccacgagcagacagtcgggctgctgcaagtaccgcac

SEQ ID NO: 1490 - DNA, 486 bp, Rattus norvegicus
  Genbank Accession No. AI014094
caatacataaatgcttttacttttccagcaggcagacaggaggaatttgggaacagaaagcagttatgaaggccatgtggcttgctctaggaagacactggatccacagtctgtgtccaggaggcacctcaccctgtgcatagtgaggggaggcagagaagccagagtgagcagaaggccctgagacaggtggggtagctagagggtgtggcagtacataaccgttctcacaatacactgccaggagttcaggagggggaagcctctggcttccacacaattttaaaacacacctcagagtgattctggggtcaatcacacctacccacactctgtaaagggcctaggtcctgacagacccagaacctctcctctgcacttctagacaggcagggacacatcattcaggtccgagaaggtcagtcccgcagtgcctggggctccactgaagaccctcatgctcttgtgtggaaagatcccttggca

SEQ ID NO: 1491 - DNA, 480 bp, Rattus norvegicus
  Genbank Accession No. AI014116
gttgttacagttggatggatttatttcttaaaggcccagtacaaaaaatggttgaagaaagtgactttttaataaaatatacacccgtagaaaaaaaccttaatatactgatatttaagcagtaagaacttaagaaaacacttcaatatctaggcacaatcggtcaagtattaatgataatttctgtcattcctttaaagtttaagccagcttttcaacttgactgttgtttatgagtcagtctaacagagaaggcacctctcactcccctaaggaccttttgagagtaattatttataacactttaaagaacgcgaggttctataagttatgtataaacacagttatttacatatcccatttgagggtaaactaaattacaatataactatgattttcacttttacatcctaagatggacatgactttcgaagacaccagaagacaatcctccatataagcttttacatacaagattta

SEQ ID NO: 1492 - DNA, 526 bp, Rattus norvegicus
  Genbank Accession No. AI014132
cttgcggccgcatgtattttttttttttttttttgcattttaaaacggctaactttattgtcattgaaaagataggcttaactttatttgatctaagtctcttgatttacagaataggatcataaccactacaaagaccacatacattagccaaaagtaattcttcttgagcaatctgccaaacccatgtagccatcttattcaacacatgccattaaccacaaaggaggtcagaaggatttgaaagcttcttttaacccactcttactaccagaagaaaatgtacatgcttccaacccttctcctaatgtcaatgggcggcactcgaaagaagaacttctaaaggttgtggcaggccaaaatcagtgacaatgaacccacagcgaatagttccctttgaaaatactttctgtaagaaggaacatatcctaagtaacacattccatgtatgaaggagcatgtaagataacagactgtatggctaacagatatgagcatttattaaagttagcgcatacatccatac

SEQ ID NO: 1493 - DNA, 291 bp, Rattus norvegicus
  Genbank Accession No. AI014148
ccacaaatgccaggcattatttaataaatattacagcccttaaaatgaacagagaaatatccccggtctatcttcaccccaatctttcccctaccaatactacagtatacattctccttttaaaatgggatcaattcctgacaggttgaaaggaacaaggtaggaaactgggtaaacataagagccgggattcccaaacttcccttctctttcgaagctgatccaaggactcacaagcagctgtttaagacaatgagggctctgatgctttccatctcaaccaaggcaaga

SEQ ID NO: 1494 - DNA, 508 bp, Rattus norvegicus
  Genbank Accession No. AI014169
gccattaaaaaactttattttgatttttttttttttacaaaggatagccccactttggggtgaaaatatatttggttaagtacaaaatatagtttttaatcatacaaaaagatacacaaaatacaaaaacaacaaagacgacacctccatcagctcacactttctggctgcacagttctcgggtggagtgcttagagtggagcttggagctctgacacaggacacggaacaaagtgctaaggcggagtaagttttggagtgctagaggccacggcgagagcagaactttctcctaacactggacaggaaatgggtctgggagcttccatggaaacctgcagttctcactgtgcctccatcactgttagggcatctcaatgtaagagtgtcaccagggtccagctgtcagcagcaacccttcatatgagtagtgtcagaatcacagaagtctgtgtgttgggggaaagcctccaaaagtaataaccaagctgggcctttaacctcagca

SEQ ID NO: 1495 - DNA, 515 bp, Rattus norvegicus
  Genbank Accession No. AI028849
tttttttttttttttttggattctggctattctttacttcacatactttaagaagccatggacaaacaatgttacacactgtagcatggatgaatggatggacagatggacaggtccatgattggagatctcaaggtcctctggaagttcttcacaaccttactggatatactgtcctgacaagagcactcttccctgctcccaattccaggcaacatgttccccaccattggtgatgttcaccttgcacccttcactgatgaacagctctacatggaacagttcaccaaagccaacttctggtgagtgtgccctagtgtcctggccaggccatggagccttccggcttggggatggacccagtccttgggtgggctctgtctcttctcttttttttctgctcctcctcagtaggatctgaagaacatgggctagacaagggccagctaataaagcaagtggattcacctgcctttcttactgctggtgaccctgtgggtggggttgtggatttc

SEQ ID NO: 1496 - DNA, 352 bp, Rattus norvegicus
  Genbank Accession No. AI028975
tttttttttttttttttgccaaaagcagaatctctttattatcaaacagtagcgacagatcaacctgtcactgtcacacacagactggggacagtgaaaatgttactgctttgcagcttgctgcttgcagcctctgtgttcagcgggcagtctctgatctggaactgggcttcattctcgttgggaatgtccttccatgtggccaggaacatctgccggtccatcttcccgtcctccacgaagaggacatgcagtgggtaaaagtgctgaagtagaagacgtcaatgttgttcttcacagccacctgaagattgttcagaggctccatcttcatgactgagcccaccgtgtt

SEQ ID NO: 1497 - DNA, 495 bp, Rattus norvegicus
  Genbank Accession No. AI028997
tttttttttttttttatcgtgcgttgtttgtttgttttattaaatcacatacaactcaggccagcaggccccaccaacttcattagaacctgtgggaagtagaaatcaaaggcaaacacagtttccccatcttttcatgaaagggacaaagacatcaaacattaccccaaggacatgggggtaaaaaaggccaaacagaagggactagaacagtgacagctaccctgaggttaggagggtgtggtgctggggtatcatggtccggtacttctgtccccaaattcatgtgggagtccgtatgttgaaggctttgggggtgattaggtcatggggtggagccctcatgaatggggctagtactcctgtataagaggcccgagggattttatctgtgcctctaccatgtgagaatgtgaacagaggggtttcctctgaaacactgggtttatgtggacttataaaccaacctccactgttcttagccacacgggtgta

SEQ ID NO: 1498 - DNA, 391 bp, Rattus norvegicus
  Genbank Accession No. AI029007
tttttttttttttttttgaacaaaaaggcctgtttattactttagccagcctatgactctgatgctgggaaaactgaaagagaccacagcggtgggttactggtggatacatgtcagctgggagcctggggaaggccatttttgagcaatgctgtgagaaagcttcccagctcctcatcttggtaagtccaggagaccagaagcactttagtaccaggatcctctgagtgggcagcagcttggataagaatggactccacggtcacagagccatccgggagatgctgtacacagtggtccttgagggtgctcttgagatggctgtacacacgtagggctgtttcttgttctttgcgtgtgtcctgcaggtgcacacgacaggtgaagcgca

SEQ ID NO: 1499 - DNA, 386 bp, Rattus norvegicus
  Genbank Accession No. AI029057
tttttttttttttttttctattacactcagtcatctttattagatacagcccaggttagtttttcttaaaacagcgatagtgccacatgaattattcatgcactcccaatacgtgtgtctcaatctcgttagcaggtgataaaaaagataacatcatctcaaaaaaataaaaatgtccttcagtgtcttgctttgctttaatgttctctataaaataattataatgaagagctaattctttttcattttgttcatgggggaaagaggaagagaaagcaccttgctgtgtagcccaggctgcacttgaactcacgatgctcctgtctcagattctcattgccatgcctcactcttgaagggttcttttttttcatttttcctcgtgc

SEQ ID NO: 1500 - DNA, 382 bp, Rattus norvegicus
  Genbank Accession No. AI029096
tttttttttttttttttggctttcattggctttattttacatttatggtttagagtttaaaagtagttacctgaaacaccatgcacaggatgacagggtgtataggtgaggtgtgcttatatgctaatctcagggcctgtctgagctattctccattgagtcatacttcttcacaaagcctcaaaggccctggaagagctttctagtccccattccatactgagaaagaaactgagactttgggtcacagtgactaagtggtataattgctcttctgttggcaacctcacataccgaaatggtgtttgcctccatttggatggtttaaggcagaaccctcagaaacttgtcataataaagcccccaggtgattactgcctgt

SEQ ID NO: 1501 - DNA, 501 bp, Rattus norvegicus
  Genbank Accession No. AI029116
  misc_feature (1)..(501): n = a or c or g or t
tttttttttttttttttggtatgtcatagcactttatttaatgagaacaagtagcaggtttcccacacgataggcatgttctttatccgacaccatttcccggccttctgacatgtcgaatgtacagcagagtgagaggcagttggttagtaacatgacctttagtcacacagttgtcagactagcaatacacttctccttcacgtcctacactgtagaacaaaggtgattcaatcctggagtggcaggcttccagatctgcctctctcccaccactgcacagatgtactgttctggctcctccaagggagaggagtgaaatgtctctggccagccagtctctcgtttccaattgatgtcccatcagtaagtcagtgttggggctgagttcaggctatacagggatctctgtantgtaacccagtatttcccaggcttgtgaaaaaaattttccaatgccctttgacatctcacagtttatgtatggggaaggtggggtgg

SEQ ID NO: 1502 - DNA, 386 bp, Rattus norvegicus
  Genbank Accession No. AI029229
tttttttttaattcatatctgagtgggcggtggcgatttttgcggcggctctggctccgagggacaaggggtagcgttactggttttggtggggttgtttttagtttaaaattttcctttctagcttcccattgccggcccgtgtgtacgttgtaatcctctgaggccatgtcaggagacgcagccgcggagcaagcagctgaatatgtcccagagaaggtgaagaaagcggaaaagaaattagaagaaaatccatatgaccttgatgcttggagcattctcattcgagaggcacagaatcaacctatagacaaagcacggaagacttacgaacgccttgttgcccagttccccagttctggcagattctggaaactgtacattga

SEQ ID NO: 1503 - DNA, 476 bp, Rattus norvegicus
  Genbank Accession No. AI029274
tttttttttttttttttgaggacgaagcaacctttgtttatttttggaaagataaacgcgtctggcccacactactcatgcattctgaaggaagtggacatcattcgacatttctcatctcaaataaataatacccagtttgactaactttgttaaccagagataaagttgaaaggagaaaagcagataacgcccaggacgttaaaggctcagagggaggatttgattcagagagaattaaagctcctggatggaggaacttagtagacactgagcacgtgaaggtgtacatagaaacactatgtgttcactttgacaaactgaaacgtctttcaggttcttagttatgagaacagcaacaaaatacgagtcagttaaaagccagcatttgagggtctgctatattacagcaccagggaagcctgagaaactctcgtctgccaatgggctgtgatgtttcactttcaaatgtgctt

SEQ ID NO: 1504 - DNA, 549 bp, Rattus norvegicus
  Genbank Accession No. AI029291
tttttttttttttttttcaactttaaagaatttattttcccatttttagaataacattattgtaaagtccacagttattgcaacatctgcattgcttaaaagtattcctaagaattttgttaaagcatatttttaaaaaacagaaccaaaataatgtacatttttatctctaaacattgtgtcattaaagtccatatactgtcttttgtataaatcaatgtgatgttacaataatatacatgatctgattcttatcttaaaggctgctgaccatgtatgatatccaagatagactcaatgcctttaatgccagactcagaaactgttatgaccctagagaacgagggaaggctgtatgcacaggtgggagtctgatggcttagctatttgcagcatcggcttggcgaggccatccgtcctcctccactccagagtcatagtcctcttccgaggactctttcgatggagcccgaatgtatcctggttcctttttgccttctactacttctttgtcaacctccacacatacaatgtcagaattaggaactt

SEQ ID NO: 1505 - DNA, 472 bp, Rattus norvegicus
  Genbank Accession No. AI029306
tttttttttttttttttactggaggcttggtttactgtggccagactactggggtgagcagtgtgggcaccagaatcccaaacccaggagttcagagcagccctgcaggtgggtcttcatggctgcactactcctcacaggatgttcctctccagtctttgtagtctgcgagacatgcgccactgtgcaccaaatccaccccacatttcagctccacaggtttttatctcaccacccgtttaaaagaaaaaaataattcagcctctgaacccttcagagaaagcagggttgtttttttttttgtttgtttgtttgttttttgtttttccttcctcttctcataaaagaaggtaatttcttcatctggtttagattgatacgagtggtcttcagagtgccaaaggtattctggggaggacactggtgctgtggggtggcaggtcacagagtcagcgtcagttggtgtccatgg

SEQ ID NO: 1506 - DNA, 149 bp, Rattus norvegicus
  Genbank Accession No. AI029415
tttttttttttttcaagtggcttgggtaaaaggataattctaatgaaactttatttttggcaaacacagccacagtggcagaaccttatgttttaacacacacagacttatggattgcgtaatctaaaacaaatgttacgaaaaaattt

SEQ ID NO: 1507 - DNA, 509 bp, Rattus norvegicus
  Genbank Accession No. AI029443
ttttttttttttttcttaaatagctcaaaacttgttttctaaatttcaagagttgtagaagttgttcctaacatgggaactgagcctaccctccaggagggagtagtttatggggctcttttagcccacccacgcttaacataggccagagagtgaagacacattgctgggttccctcactgtgttgctgagtccacgcaggtggggctaattttctcaggtggagtaagaggaagcccctgaaacccctgctgagtaaagactggtttgaagtagctaagagttcattctgggagctgttggtgtctcaacatactttcccctccccaatgttttctgcagccctgggtgtgggatagggtgtatgtgaaacactgagcttgattctcttaagccaggcatcacttgaggttgttcagattagactttccaatggctgtaccaaggacgaaggaggaaaaagcacagatgcttatctcaggagtgttaagtacctgccccactgtcat

SEQ ID NO: 1508 - DNA, 482 bp, Rattus norvegicus
  Genbank Accession No. AI029450
tttttttttttttttttacaattagttcatggtttttattaccctggctgtttacagaaaagtattttccactgttaatttgggcataagaatagctgtttattttgtgacctttttagaagttttaaaaaatgaaaaagaaaaactgtatctgagatcttagtatcattggttttaaaaaaaggacgggagaggcttctgtttcatccatcagtaactccgaccaaacaaggtgtagaacttggcaggattcttgccacagacacacatggctcctggctgcagctcacacagagggttgaaaggaatgcaaaggcttttggctcccatggatggagcaccaggttccacatcctgatccctggccgttgtcgttttgatccagtcttcacagtcaatttccccacagaatggaatctgtgcaaccttcccagaatctagcaccttctgaaagtcttccagtgtatccgatacaaccatgt

SEQ ID NO: 1509 - DNA, 540 bp, Rattus norvegicus
  Genbank Accession No. AI029455
tttttttttttttttttgataatttatgtttctttaatagattttaattcttaggaatgtttaactgtccaagtaaaattgaacatgaattccaaaatcagatttctcaaagctggaactagaggaactagagcttgtggtacagcatctgcacttgatctagcaaaaagacaccgaaggaagagaagcaataggagaagccacctgcacctaaaacttataagcaaaggaatcaacattcagataatggataagatgtttttgcttcattttttttctgaaagataaagcatttctcttttgtaaaaagaatgcctcctttacattttagaaaaaatgttaacaccacagtttacaagagcgatgtttatttttcacaacagtaaagtaaattactgtgaagttcggcagcacagtgagcactgatggatctgactttcagaatatgtttctggtacagtgcggtgaagccacttagacaattccagttatttgcccagcaccttccaaacagtttacccatattgctcatcaatgttc

SEQ ID NO: 1510 - DNA, 483 bp, Rattus norvegicus
  Genbank Accession No. AI029499
tttttttttttttttttcaatgtcactcagtttatttgaagtcatgggaaatctgagagaaacgttccaagcacttggtgtccctggcatgaaagatggagtgggtggcttcgacctcagtcccccattggcagccacagggccttggttcgtgctgcatgaagactcagctcctgttctgacccttggacttccacatcccaggcccttgggaagtccctgtttacccacacgggcttgaggtttcctgcagaggcccattccacaaactgggagccctgggctgaaccaaagtaccacatggcctggacatcctgatgtaaggccagacagcgggtcagatggtcccgatctcctgtcactacgttcaccaggccagcaggaaacagagcagctatatcctgacaggcttccaaggccagcagaggacatgatccactaggtactaagaccacagcgttgccatgggccaatgcaggggct

SEQ ID NO: 1511 - DNA, 505 bp, Rattus norvegicus
  Genbank Accession No. AI029506
tttttttttttttttttatcagtattcgagaaaatctgaacattttattcatttgtgacgtctccttgaaggcaaggtgacaaaatctaccctagcattcctgaatgataggatggaatttaaaaaaaaatctgtattgattcttgattgtttccaaacagaggtctggggaagggtttccaccggcttcacagggaagaagtggcatcagcgtagtgttgggcaagacagtagggcttaggccggaactttagcccacagacgccaagatgatatctactggcagctcctctgagcttctggctgtcacctgcattgtcactgtgtccaaaagcagaagccgggaacgcacaaggatgtcatgaccaccccggaacactccagctagcagcagcgtgtgagtgttcttgttttctggcactttgtctgacctttcacaaggatgcattcccaaaaacttcacaatattgcccacagcctcttcaagtgttttgatagtagacag

SEQ ID NO: 1512 - DNA, 433 bp, Rattus norvegicus
  Genbank Accession No. AI029649
tttttttttttttttttagagtatagccttctgttcctcaaaagacttgatggtttaatgtttaaaaaaaataattattattataataaaggagaaagaaaagggtagagtgggaaacccaagcaaaagcttcacattgtgggaggtccagctgtcaggagatcaccacgacctgcaccctttgccatcctgtccgagacacgatgagactgtgggtcccgaaggatcgacctagtttaacaacacccaagacgtcagccctggagtttaagcagcacatgtgacctggtccattcgggtttcaagttcaaaagcatcaggtcggtcctgtgggttagcagctaacatgtctttcaagagctgcttgaccccctcagacatggaagtcctacgtttctgggggatatgcaacttcatctttgggttttctagc

SEQ ID NO: 1513 - DNA, 338 bp, Rattus norvegicus
  Genbank Accession No. AI029675
tttttttttttttttttcttcgtttggattagtaacaagatgaagaacattcaacacgcgtctcagtatttacaacagctgggatggtccgtgttaggagtcagacccaatgttgccgatctgggctttttaagggttgcaaatgcaaccctgagttttcttttaaaagattacaatgtacattacattttgtgaagggaaacaaagagttaattacaagatgcaaaaagataagaaagagacgaactacagcgtgagtattgttcagaggtagtaagtgagcgctctaagctacagaacatgttgggattctattggtttgtatgagttcgcatgag

SEQ ID NO: 1514 - DNA, 286 bp, Rattus norvegicus
  Genbank Accession No. AI029713
tttttttttttttttttgcaatagcatgaggttttttattccacgtacgtggggctgctcatccacgcagggagaggcaaccccgaacccaaaaagcacacaacttttattcgttacagagggtagacttcagcaacagggttagctggcccattctcattggtggtacacaggacaaaggatctggtcaggtattggctggcctgctcaaggcgctgttcttggctcagttggtcactttcctcatccagccctacacctggccttggtgaatcactgggaaagg

SEQ ID NO: 1515 - DNA, 485 bp, Rattus norvegicus
  Genbank Accession No. AI029847
tttttttttttttttttggtggcataaattgctttattggagcagctgagctgggctcaggtttctccagtggcctggaagtccatgtcttccaccaagtcctggaggcaggccttgtactggtcagaggtaagggagatcggctggctgttggagatgtgcaagtccacggttttcagtgatgaggctcccccttcccgggccatctctaacagctccttaagacatgtaggaacaaccttgaccatcacaagcctattgacccacggctggtcctggggccacgattcccccacacagaaccacagagtgtatcgtggggaatgtctgcttccttccatgaaggcaatgagatctgggaacccaagagtcaggtcagtaaagaaagggtcacagttacagcagccggttcctggacttggtgggtacaggcctgtctttgccacaaagcttaatagcatgctctgaattcaaccaaccaccat

SEQ ID NO: 1516 - DNA, 326 bp, Rattus norvegicus
  Genbank Accession No. AI029858
ttttttttttttttagtgaccaaacttttatttttaagaatactatattgattggcttactaaggggaagtactctgatcttgagtggcattcacaggctctggatgttcacatgctgaacatttgcttacccggtgagcaaagatttcctgagatttccgtgcatttcattactctgttcgagtaaacagtgtgacttgagaggattgctgtggagtctgccctgggctataaggatcatttgataaaaaaaatcttgcactatttgatgtacagaatataagacatttcaatattgaattagacactcaaaaaccctcgggccg

SEQ ID NO: 1517 - DNA, 477 bp, Rattus norvegicus
  Genbank Accession No. AI029960
tttttttttttttttttgtcaccagttaaatttaagaacctctctcgtctctattaacagataggaagcttcagggaccaggtactttgaggagctttctgagccagtgaaagaaaacaaaatatttcctggaactggtaagcttgctgttttcagagtgtcaacaagcaaacacacacgccacacacgtacctcgtgaaaacaatgccgctctggccccggccacactgcctgcaggcactgctgcgtgtccttgtggtattctaacccacaccctccccactctgagctcatctgactaaatataaggaaaatggctatgatgtggatcacattttcaatgatttttaaattgtacttaaaaaaagatttcctagtaattgagtatataaaagtccttgatattaaatctctcagtgaaataaaatatgcttaaacaagacgatgtcaatttaagtctgaccacctagctctctt

SEQ ID NO: 1518 - DNA, 147 bp, Rattus norvegicus
  Genbank Accession No. AI029996
tttttttttttttttttacaaacagaatcccattttattagcagttagttcaagattgtacattaatggaggaaagttcccacatttaacacaacccaaaacggctggttcaagagccctcttcaggtgagctgggtagcatgccct

SEQ ID NO: 1519 - DNA, 179 bp, Rattus norvegicus
  Genbank Accession No. AI030001
ttttttttttttttattctggttttattggggtttgtttgctaaagagacaggtggcagcctagacagaaagctagtcagtgaactaaaaaaatgtgatatggacacgaaaactagctctccacaactgaaggcatctggtggtggtgtgggagggaaaggactcagttctatttaaga

SEQ ID NO: 1520 - DNA, 394 bp, Rattus norvegicus
  Genbank Accession No. AI030024
  misc_feature (1)..(394): n = a or c or g or t
tttttttttttttttttcaataaacaaaactttattttcctttaatacaaaaattaaatagcaagttttttaatacagtgataaattagaaatttacagtacagacatcaatgtagacacacttttgtacatccttaaaaagggggatatatttccttggaaattcagcaatttgttcagggcatggatagcaggggtttgccaggtacctctacactaagcatccgaatggccccaggttgcctccagggttctgcagttactgaaaggcatgaggatccacgtaaaaggcanagagcaactgggtaaactgctgcacaaaagacttctaactgtattttatcggcttgcagactgggattattattttagttcatccttcttatgaagagcc

SEQ ID NO: 1521 - DNA, 359 bp, Rattus norvegicus
  Genbank Accession No. AI030067
tttttttttttttttttaacattgcttgtctgtaaatctgtgggatggccttggagggaaaggcgaggctgctgcaagcggctaatcataggctgtggggatgctctactgtattctattccccgggcaggagaccgtgaacgaggtgaatttcgaggcgactgcttaggagatggtcggggtgaattccgtggggatggagaaaacctattaacagcagggtacacggcatggtgcatgctgtcgtcttcatcatccaagctctgtgcatccagttcctgatcgctgaacgtgccccgcctcgtggagttgcaagatgagcctgagctgcgacgagaggtggtggctgcatactcttg

SEQ ID NO: 1522 - DNA, 503 bp, Rattus norvegicus
  Genbank Accession No. AI030069
tttttttttttttttttaatcagcttacacatttaatgaaagattttggcaacctgggatttcattccatttacaagcttcgctggtattctcctgcacccgtgcagatgcagcagcatttattcagcttcagtcctgctcgcagaaggcgggctttctttctggttgtttgtccatggctctcagtcgtgctattttatggtctagactcttaatcattggtgggcttcgaggtctttacatctgcaggcctaccgggcagatgtccatgtgactttaggcatctgtaaggtgacaatccgacttaggactcgaagcagcgtagcgttctgatgacccgagaatgctgaggtcggtgtagatcactgaagggaggatacctgacctcgacccgtgaagagtacagtccgtgcttacgcgttggcgccgggacccttctgctgccccagacggtcccggacgccgcggcggagttcctcggtgaaagtgtccttgaaccgcga

SEQ ID NO: 1523 - DNA, 322 bp, Rattus norvegicus
  Genbank Accession No. AI030091
tttttttttttttttttaagcttttttttttattaaaatactgtcatacccagtggaatgcttcggcaatcctggtacagagtggcgtgacaaaacagccatgtttgcaccttaaatattcatgataacttaaacacacagacacacgtcatggtctttggcagaaaacgttcacagcacaaaaaaaaaaaaaaaaaaaataccaaatattaatccaaaatatattaagttgttttttttctttcacgatattttttgtttttccctcctttttttttgttttttttttaaacttttatctttgtaaacaacgcacatgaac

SEQ ID NO: 1524 - DNA, 275 bp, Rattus norvegicus
  Genbank Accession No. AI030118
tttttttttttttttttccactgaacagttgtttttaattccaatctgctccttagatgcctgctttcatacagaggtgagagtcacaactgggacacaaagatgggatgaaccctagcagggtgattgaaggtggcttctgcactccagagggagagcgctctccctccgctgcctagcccatacaggactcagtcctcccctggagctcacacagatgaccttcagtgagtttatctgccatggagccaaagatgggtcgtcctcgtgccgaa

SEQ ID NO: 1525 - DNA, 365 bp, Rattus norvegicus
  Genbank Accession No. AI030172
tttttttttttttttttccattttatttgattttattttgtcatgtgctcacagcatttctctttctctcctctccctggcaggtcacagagataaattaaaaataaaatctacaaggaaaataatttataaaaagcactcccaggctccactttctatccctactgctcagttaggaaacccctcctccctgcacagggaggaggatcagtgcttcccacccctcacccctgctagtctggggcaggcagtactccagagctgatcaagattggggggcggcagtggcagtttagaaaaaaaaaaaaaaaaaaagacactgtggtccgggaaccatctggctgtcttggtgctgcccctcactg

SEQ ID NO: 1526 - DNA, 372 bp, Rattus norvegicus
  Genbank Accession No. AI030259
tttttttttttttttttccctgcctccagtgtttatttggtcccagctacttccctcaccagactcatgacacagggctcgaggcctccagaaggtcaagggcaggcaggagatgggatagggagggtagaatatgttctttaggtacagcatctctcactgaggagtccagaggctccgcacctaccaccaggaagctgtgcatacccacagcccgagccccctggtaatcacagcggtaactatccccaacgtgagctgccgccgaaggctctacacaagcgagttgcaaagcctcacggaaaatccgaggatccggcttaggacagcccacagcctcagaagtcaaaacaaaatcaaaatgttctctca

SEQ ID NO: 1527 - DNA, 488 bp, Rattus norvegicus
  Genbank Accession No. AI030348
tttttttttttttttttgaagtaaaagcttcatgactttaattagtaacatgcaaactcttttccaggagcagggcggttgtaaagtggaagtgaccgcgttgagagtcacacacggtcacgtcagaaacctttgtttctagaaccaaccagagcagaggatgtgcagctgtagtgtactgtgctggcccgtggtgggggaggtgccgtggagtatgtcagccgtgtttgctttgtagtcctcatttccagttggacagggtgagaggatgagaatattttggctcagtcatttcatttatcgagtcacctgccggtgctttcccaagtactttgtgtgctgaccacatgcagtcctcacagcaaccttaggatgggggatggtccttctcctggaagccaggcttgagcagttacctcagcaatcaaaagcgtgccctgaggaggtgacagagcctagacagcccaggcagtgccccactgcctgcc

SEQ ID NO: 1528 - DNA, 325 bp, Rattus norvegicus
  Genbank Accession No. AI030376
  misc_feature (1)..(325): n = a or c or g or t
tttttttttttttttttgaacaagttgtgctcatttatttagacgaagaaatatattgcacataacaacaactaacaaaagaggcagtgagttacaaaaagaataaggaaggttatatggaagggtttgtggggagaaaatggaaaggagaaacgacattattatattctaacctcaaaagggaaaagataatttatttaaaactctagaaccagatatgccagacacctgcaatattcaggttttcaaggtttccctcacatgaggagatgcatgaatatctcctccaatgatcctgnggtcacatacaccatgctagctatgt

SEQ ID NO: 1529 - DNA, 484 bp, Rattus norvegicus
  Genbank Accession No. AI030465
tttttttttttttttttagagttcacagaacagcctgtttttatttatttgttttagatataaaagccaaaaaatgtgaggagacaaaaataccaaccaaaatagtccatcgttgtgcagtgcagagaaagaatgtcctgttttctctggtttctctcagagtgtctgcaagactgggtcctttgcaccagtgcaaaggcattgtcgtttccaggccttcctcttcctcttcctccttttctacctcctcctctttatccttcaagaccttctcggatggaagatgaagttttcggagtccaacaatgctagaaagttccaggagtggtaggaaaagtaatacctaggatgagacattttcttgcctccttcgtagtttggtagtgggaagccatagaggcttctaacagtcactacactggagtattgtcagggtggcacagagacacacaccatcgcatcctcctgagaactcccatcactt

SEQ ID NO: 1530 - DNA, 357 bp, Rattus norvegicus
  Genbank Accession No. AI030524
tttttttttttttttttagcggcagagacgtttattggaatttttggccggaggttgttcatctgaggtgtggcttttcaatgaagccatctcaagtccaaacaggagtttaggaggcagagacttgattaatccactatactgcttgaccccatcccccacacaaggaaagtgtagtgcctagccatttcttgccagtgattacggataataacgtaataataataataatgataaaaaacaaaaacaaaaaaccccaaccccccacaaagcctctgttctgaccacccttcagtcttctgctggatcagaaacgtccaaactgtttaagtacatatgcagttttgttttagctca

SEQ ID NO: 1531 - DNA, 313 bp, Rattus norvegicus
  Genbank Accession No. AI030643
tttttttttttttttttacaaccatattgtgctgcttttaattacgaaagatgtaaaatgatgcattataaaacctggaagctactttatacaaagtccaatctttcaatattgcttaacaaaaggctgggagttagggcactggccggaagtctgactagcggcgggatggccccattctggagcagtggaaacgatgggcaccatctgtgcatgaatcagaagagccctggagagtcccaacaggacacgtcttcagatatgtgcacgagcatgagtacacgcatgacctctcggcccagagtatacagta

SEQ ID NO: 1532 - DNA, 296 bp, Rattus norvegicus
  Genbank Accession No. AI030695
tttttttttttttttatatgttcagttttatttctttccatgccaagaaatacagagtcactagtgtgtgtggtggggaggaggcaattcttgatgttcaccaggatgcccaggagaggctgagtcactccgctcagccactgggatcatacagccggcagctgaaccaagccagagttcagatggcagggccccgtccctctgagctccagtgggaactggggactgagagaactctcactcactctccttccaccccaatgtctctctcctcctgccctgtgctccgtctgtcc

SEQ ID NO: 1533 - DNA, 222 bp, Rattus norvegicus
  Genbank Accession No. AI030706
  misc_feature (1)..(222): n = a or c or g or t
tttttttttttttttttcactccacagacattgctttttatattgtttttctttttggccaagggactgagagcattctaggcttaaaccattggtctacatggccatcgcacaagtgatcagtgctgtctatcatgtgcatgaacagtgcccatgtcatcctgtcccatggtanggaatggctgatagttagcctgagtcccttgtgaaaggggatgatgg

SEQ ID NO: 1534 - DNA, 473 bp, Rattus norvegicus
  Genbank Accession No. AI030731
tttttttttttttttttctccttagaaaaaggttttatttacactgtagtgattcattggcttctcacaggcggagttcagggagtagggccataagctaaagtttaacagtatgcaggcactgtacctgtctatttgagtatacccgtaattcactgagttacattgaaggcaactctggaggggcatctacaagtctttattctggtgagaatcgctggctgtattagagtctggccagatttttgggttatggttttagccagctcactggtgcatggaaagagtccataaagccaacatctctaggatcttcaagcttattgctacatacaattatgaagacgcagaactgggagctatgaggtcaaaacggccagaatgcaactgcactattacacgaaataaaacccagccaatagtcatatgcatctctgaatgtttctcattctaaaggccagaaacactgaaca

SEQ ID NO: 1535 - DNA, 460 bp, Rattus norvegicus
  Genbank Accession No. AI030750
tttttttttttttttttcaactttcaaaaaactaattttaatcaaaacaaaaattgttgatcattaacaagtttataaaacagtgatttagttacataaataaattgatatcagtgtatcaaatcttactttcaacttcatgagcatgtttacatgagtgaagaagtacgacctttttttttctttttacctattataataaataaaatggagcgcatgaaatagttcttctaaacaaaaatacctacaaacatacctctagcatgttttctaatgaagggaacaagagacacgggacaacttttgcaccaaaacataaagttgctttaaaaagcacaaggttacagaaccatcagctaaagtaaagacactacactgtaaccaaggttggtattttaataatataatgaacagtttggtagttagatctccagtttggttattttaaagcattaagaca

SEQ ID NO: 1536 - DNA, 384 bp, Rattus norvegicus
  Genbank Accession No. AI030771
tttttttttttttttttcctttttcttatgtaaagattggcatcgcaggcacataacagcagcagagtaagttgatgaattaaacaataatggttaggggtatagcccaaggaatcagatcctgctttggcctgtaaagtgaagtttgcgtgtgtctatggagattaagaagtgccacgcaccagtaaagaatgcgatgcatttcagacatattgcagaagtaggcatgtaggtcagtcagtagcaggagcatctattttctaacgctgaccattggagtgcctgggtaaaactgactgactgctctaaccaaggtactgctgtgcaggggggccattatgatttccacacgcatgaagggaacacacgccaagggtctccatt

SEQ ID NO: 1537 - DNA, 288 bp, Rattus norvegicus
  Genbank Accession No. AI030790
ttttttcttttttttttcagacaagcattttttggtttaatcaaggcctcttgaagaatttcgagacccaaatgagtggcagatcaggcaggcttagactcgatgtgggacaacagagccgaaagacagcccagaggccattgacactggcctccccttaaggttaccttgagtagagccctggaaggctctcctagtcccattccccaggctgaacattgaaggccatctggtttgactttggagcagagtctttagctggcttcactctttccctcgtgccgaatt

SEQ ID NO: 1538 - DNA, 509 bp, Rattus norvegicus
  Genbank Accession No. AI030799
tttttttttttttttttaaaacctctgcaattattagtttattagtatcatccaggactcatgttcagtattcctcctcaaattacagaacaaaggcaactgtaaagaacccaagtcaaaatgatataacagcactccatcacaaaagcgcggaaaattacaagaacgctattttaaaacactggcactttaagagaatgataatctcaaaaaaaaaaaaaaagaaaaagaaaaaaagaaaaaaagaaaacccacaaaattgccaaattgttccctaaactaagcagattaaacatgattaatgaatgagttcgggctttataaagaaaaagcaaatggcttagacaactggtactaatatgcaaagtttatccgctttccttgtatctgatttataaagggacaaaccacaatataggaaaatatacccttcattttaaatgtggcataattttaaaagctggctcaactaattaaatatacctttaaacagtcaagtttcctgagca

SEQ ID NO: 1539 - DNA, 435 bp, Rattus norvegicus
  Genbank Accession No. AI030833
tttttttttttttttgtcttatcagggtgtttattatagcaacagaaacgtgtctaacgcagtctgtgtgagcatgtgctgtatgtggggaggtgccccgggaccagaggaaggctttggctctcctggaactagagttacaatcatagctgcccagtgtgggtgcaggagtctgaacccaggacctcagcatgagctcttgcccacagatccttctctccaggtcagaggattactctgtggggtcggatctctccttccgcctttaagtgggttctgggcattgggtttgggttgtcaggcttggcagcaagtgaaccatctcactgtccccattgttgactctctgacagcacgtgttccctttctgcacttggggaccccagagatcacgccatcaatctgctttgggccacttcatcccctcgtgccgaa

SEQ ID NO: 1540 - DNA, 398 bp, Rattus norvegicus
  Genbank Accession No. AI030835
tttttttttttttttttatggtgagacctaggaattttattttaaaaatattccctgcaaagtaaataaacatagtcacagtgaaggaaaactcatggaatgcctagtacattgagcatgttaaagagaagttataagttcatggtactttccaaggatctgccgttaacatgggctcacacggaagtcctctggtagcacctgatgtgttcactgttctttctcgttgcctggtggttctgttgactgctgctctgtgacctttaattcatgatgctttgtccattgcatgataccaatcatcacctttgtctcattctcttgtgtggggaagaaccaaacttgttctggtgaccagacatctgagctagttgttcttcaactgccatcagtttgat

SEQ ID NO: 1541 - DNA, 389 bp, Rattus norvegicus
  Genbank Accession No. AI030845
tttttttttttttttatatggctgtgtgtgtacgtgtgtgtctatatgtgggctatgtatgcgcgggtgcctgctctggccagaagagggagtaatatcccctggaactggagttacaggtgtttgtaagctgcctgatgtgggtgctgggaactgaacgattaggtccttagaaaggggtgcaagtgctcttagcttttgagccctctctctaatcccccttgatgacagttggttttcagtatatgtgtgagagttttacctgcagttttgtctggaatctggcattaatgatggttgtgaactgccatgtgagtgctggggccttctgaaagagcagccagtgctcccaactgctgagccatcttttaagtccattatgacagttc

SEQ ID NO: 1542 - DNA, 342 bp, Rattus norvegicus
  Genbank Accession No. AI030869
tttttttttttttttttgaactacttctttattgacttttattttgcgtacgagtgctttgtccgaatgtgtgtaagtgcactgcacacatgagcgctgcccctggagagcaggagagggcatctgttcccttcactggagctgccatgagcttgctgggaactgaacccgggtcctctgtaagtgcagcagccactcttagtctctgggacatctctcctgctctctgctatcttttcaaaaagcttcatgtcggacttcggacatgggatctgggtgtgcgtcaacacaaaggtgtgatggctccttgctggcagagatgggtgctccactcacactagc

SEQ ID NO: 1543 - DNA, 310 bp, Rattus norvegicus
  Genbank Accession No. AI030877
ttttttttttttttcatgtttaatgtgaaaacagtgactggagtttacggagcaaagatgaagcatcgcttcacgttaacttcgaaggttacatgaagtcatcaagaagtagtataactgatgttacaagctatgctttccaaaaacgctgtgaaacataaatgacgtgaattcatctacagtgctgaggagtggggcctaaatccaactatttacagaagttttgttttttttttgttttttttttcagagctggggaccgaacccagggccttgcacttgctaggcaagcgcctcgtgccgaattctt

SEQ ID NO: 1544 - DNA, 278 bp, Rattus norvegicus
  Genbank Accession No. AI030907
tttttttttttttttttgaaggggagatgagacttttattaacttctacttataaccacttatgactcaagcaagctattaagatgtacggacagggaacaccaatgcaccaagaacctaccagaacccccaagatgcactagatgcccagcagccaccttctcttcatggtgaggacatgggatgtgggaaagtggtttgtttcccaagagccccacccacctgagcctcagtgagatgaggttctggaaaggctgggatatcaggtcaggaggtta

SEQ ID NO: 1545 - DNA, 152 bp, Rattus norvegicus
  Genbank Accession No. AI030921
tttttttttttttttttgcattttgagattttattatcaaccatgcaccacgcctatcacacccctcttgcagtgacacatgtgggaaaagcaggatggacacatactgtatcctctggctcctcccttagaatatatactcttcaagacca

SEQ ID NO: 1546 - DNA, 451 bp, Rattus norvegicus
  Genbank Accession No. AI030932
tttttttttttttttgtattcaaactagctgcttttctaatctaatcaggttaatttcaatacaaaaaaataaaaaataaaaaataaaaggtgccacctggtcagcaacatcatacactggtgacaagagcaggtttactgagttgtgagctcagactgctggaccttcaggctggccttgtccacctcggtagactgaggataaaagggacctaccagccagttgagaggcgtgttgttaacaaggtaatccataacttcatctaaggactccttcattttctgcagctgccccttgctagaagtgaggacgccatcagacacttccttgaaggaggtaacattgcggaacgccgagtagatgtcacctgccatcacccccaagtgtttggcctggtcttgaatgttctgtggtaacccttggacgttgaacaggaacgtctggcatgta

SEQ ID NO: 1547 - DNA, 390 bp, Rattus norvegicus
  Genbank Accession No. AI030989
tttttttttttttttttgcttctacattcagtttatacacagctctatacaatatacagaaaactttatatacagatatattcatagaataagctatattaatttgtctcttctctttacagcgatattagtgtggatctttcatacattaggtacaaaaaggtcatgggagaatggcacgtggagtgcagagggtgcatggggggctggctgttcactactagttgcatatggaagtcacccagatccctgggaggacaggccagcacacggctgggagagcttgtgctgcgggtctgggggacagtgtgggggatcaatctgaactgggatgaagggggtggctcagacccccccagaggtggcatggagtgaagggaacgtgcatca

SEQ ID NO: 1548 - DNA, 510 bp, Rattus norvegicus
  Genbank Accession No. AI031019
tttttttttttttttttcaggttttaaacatgtttagagtaaactcgcatcttttacagacaacattctgtgacagtgccatgtgaatggctcctgcattggtgttttttctatctggctggatcctgctgagggcatggagccagatgccgtcagctacagtgtctgctgtcttgtgaggcactgaaggtgtgtactcagccgatgtcaccgcatctctcagtgatgcagcacggctggggggtccctgctcctgtgccatctctcctcagctttgcagtctgtaattaacttgttcttccggagactgagtctctaaaaaccacaaggttgcttcaccttgcttctagaactgggaccaggcttcagatgtgacagcaagagtaaaaggattcttcaaggcctctgaaatgagcccttggcatacaggtctgaaagtcccattgttggcccctggctggctggagtggaaaggctgctcaccctgcacaagatgtgctccctgcatgt

SEQ ID NO: 1549 - DNA, 366 bp, Rattus norvegicus
  Genbank Accession No. AI031035
  misc_feature (1)..(366): n = a or c or g or t
ttttttttttttttgttagtggtgttttattttttgcttcataatcaggttcaaagaatgtggatgataaaaaccaggagggctgtgtgcctcctttcccaacccaagtcaagtcctacccaccccaaggcagacagacatccctgatgcaggtttccttctatggagaacatggaatttatctagtcagtggaatctggctgtcacaggttgcaagttagatgaagactggcaacttcaaagttgcctgccttgctgtcagcactgccagactgagtctgaacagccgaggtgccgcagtgcatcactggagctgaactgtatgtagcactgcttttcctgngctggctcaagacccaccatact

SEQ ID NO: 1550 - DNA, 323 bp, Rattus norvegicus
  Genbank Accession No. AI043601
tttttttttttttttttactggcatccgctcgtttaatagtgcgcacattctcaatagaaacccgtgggatgaggtgcgctttgtctccccggtgcaggcgagaaaaccgaggcagggcttgcgcgcgcacgcggcggctgatccggtatcatggccgcgctgtgttccgcgctcaggatcaggttcggacaggcggcgcgtaggcggagcaggccggcggcgctcacgttgcggcagaagtccacgtgaattgtctgcagcgcgcgcccgtgcgcggccaccgccgccagcgtgcggttggtaacgcgcgcgcagttctcga

SEQ ID NO: 1551 - DNA, 295 bp, Rattus norvegicus
  Genbank Accession No. AI043611
tttttttttttttttgtcattaaatgagatttattgccaaattccaagaaagatggatcataagcagaaggcactggatgcctcccccatgagggcagggaagcaatcctgtgcggtccccaccctactctaccccaccagcatgggaaccaacagcattggccagtaaggcagcaaccccagaagtacttgcccgactgtcacttgacagcacagacagaatctaattcctggaagcaggtgacctggcagaggtacagcatcctggttgctgtagaggacgatcctcgtgccg

SEQ ID NO: 1552 - DNA, 390 bp, Rattus norvegicus
  Genbank Accession No. AI043630
tttttttttttttttttggtctttacaactttattttacaagagagaatggcacttttaacttctgctaacatttcccgatacatataatttagacattcataatgacacatcccgtatcttcaaggttaaaacaccaatagttcacatccggcatccgtttacaattgaggtgctcacagttgggaagtggaacccttgcagggaattgatacctgctcatctctgcagaggcagtctgagttcgttgttgacaagcctcgctagcatctcagtattatagatcaggtattgaggagccctgggatgggtatagtatagtatggacggtgttctccagtaacatggtgactctggacgcttctgctacagagagcaatgccttctcctt

SEQ ID NO: 1553 - DNA, 410 bp, Rattus norvegicus
  Genbank Accession No. AI043655
tttttttttttttttttacaggaaggggaagatctttattgcaaagtggagcttatcaaaggaaaaagacacaattctccatgtccttcatttcagcttctgcttctctttctttcatggaatctccaggatgtcactcaaagccagaattgactcttgctctgcgttggaggttcaggaaccttctatgggcaggaggatgtcccctcctcgtgatctctttgggttcatcataaagaaagccaagtagataatcatttcttcgtcggtgggatcttgccatgtccccaaaaatcatctcctcactgctgttggactcggatgtggacgcccagcggcagtgagcccacacatccttcacctgtcccttggacatctgcactgtgctcctgcaagcagctgttggcaca

SEQ ID NO: 1554 - DNA, 481 bp, Rattus norvegicus
  Genbank Accession No. AI043694
tttttttttttttttttaactttttaaaagtactatttttagttactgcatgagtttcctgacctccaatcattacagtgttttggttaaggcttttgagaaacaagggattatagtatctaagtcacaggtttagaagggggttctaaaacaatgtaagaaatagcgtcaaattcatatacagacactagttacaagaatacaccgtttggagaacagttttacctttaccgtacaagagaaatacatctaacatctttcattacttatttgaaaaatatttattggccttgggatgcagggctttcgttttataaagtgttcagaagtgcagaagagcacacagttcaacagtgcaagccactgccacgacccaacccgaagggagagtcagtgcccagtaccaagaaccgattcatttttaattaaaaatttcagagtttatataagtttagctgtaaatctataatcaaaaagtttt

SEQ ID NO: 1555 - DNA, 507 bp, Rattus norvegicus
  Genbank Accession No. AI043709
tttttttttttttttttccgaaaagaacaaattcctgtcattttaatccttgaagattttaaggtcaaacaacattcacatgagcccaacatttctcagaaacctaagagttaaataatcacagcgaggtgacttgctatgttacaggctgggctatctgcagaaaactctaacttcctttttgcccgtaagcaaaatgactttatcgtgccaagtatattaaggcctagaatacacaagtcacatgtatttctctgatgttttgattaaattttaagaaggatggatcttgagctattccagacctcgggtcttggtttcagctacccgtgaaagttaagaatacttaaaatttttaatcaattttaattattcatacttacacatctgatggtagcaaagggggttgaatgaggaaactgagtcagcaaaacctaagacgtttacaaagcgagacacaggttgttggtgctgccagccctgggctctcaagtgctccaggagatg

SEQ ID NO: 1556 - DNA, 370 bp, Rattus norvegicus
  Genbank Accession No. AI043724
tttttttttttttttttaagttttcaaaaaggaatttaatccatcacagcaagacattctcagcctataaaaacatccgaacaagggtttcaaagcagttcccacccccaaagcaacacacacaggacaggcctgagatcagttcattcaaataatctttgtacgcagagcatcccagagtatcaccccagcctaacctggagaaacgtcaccgacaagtgcagcagtcagggtcagcaaaataaatagagttaatatatatgtgtgctatccttgaatatacagtgaagaccgggcccggtgccatagcacagagctccttacaagtgtcctagtggctggacagtgggcaccccaggaacccaagcaa

SEQ ID NO: 1557 - DNA, 478 bp, Rattus norvegicus
  Genbank Accession No. AI043753
tttgattttttttttttcatgtttaatgtgaaaacagtgactggagtttacggagcaaagatgaagcatcgcttcacgttaacttcgaaggttacatgaagtcatcaagaagtagtataactgatgttacaagctatgctttccaaaaacgctgtgaaacataaatgacgtgaattcatctacagtgctgaggagtggggctgctctgaagctttacatacagctgataagccatgttctttccacattaaaataatgactattagaggacatgggtaacaggctctgagacctaaatccaactatttacagaagttttgttttttttttgttttttttttcagagctggggaccgaacccagggccttgcacttgctaggcaagcgctctaacactgagctaaatccccaacccctatttacagaagtttaataatgttccagacagaacttaaaaaaaaacctcgtgccgaattct

SEQ ID NO: 1558 - DNA, 446 bp, Rattus norvegicus
  Genbank Accession No. AI043806
tttttttttttttttttgcatggtctcattttattagcttggcgatgcaagtcattctaatgaattgattcattacagtactacaaaaatcattggctgtgccttcagacacatatgtgaacacaatgatgtaggtcttctgtgatcaaaagggagcagagtcccaagttcaagcacctcaggaaagaaaagcatgagcatgagaggaaagaaccctttgaagaactgactagaaacttcactctgaagtgtgttgttgtgaaagaaaaatgaagcttctactcatgatagttttgtgttctgacaaggaaccacatctaaaatgagaactgacagctgagagatcacctgaccccgtccatcactttgctgtacagatgagttatccatccacaggccctgtcaaagacgacagagctcacaagcagagcagatactcttactgg

SEQ ID NO: 1559 - DNA, 417 bp, Rattus norvegicus
  Genbank Accession No. AI043836
tttttttttttttttttgtctttattatcaaagtttattactgggatcagtttctgtctagtagggagtaccagtctcagtgtgctatggtaattctcaggaaatagctgttctgctcagtagttgtcctggggctatgctaggtatagagcaccttaagtcagtggaagaatgtgcccagaagacccagacagcagaaccatcactctaggaaagttccagtgctatgcagcctaaaaggcatctcagctgatgagtgagggtatggaatgaaaaaggagttaaaccttaagattttctactcttaagatacctggcttttgtggggaaactcaaacatgacattctttatcaagcaagaaaaatagtctagaaacaggacagtcaaaggaagataattaaacacaaacctgatga

SEQ ID NO: 1560 - DNA, 451 bp, Rattus norvegicus
  Genbank Accession No. AI043849
tttttttttttttttttaaaggtcagaaaataggcttatgtttattcaaaagcttatcaccttgcacattactattttgtcttgttttaaacacacacaactcttttaagtgtggactttgcatccctgatatctagcaaaaatcatatctaatgacaaacacaagatttcaaggaaaattgatttgaagcatagacactggatctccaatctctaaaaaattgcttctattaacaaagattggggtgggaagtcagggagaggaccagaaaaaaagcagcttcaaattcagggaagcaaagtaaaatggagaggaacagaagtaactcaagtttactaatcctgaaacgtccaacaaagtgtcatcgtttagagtccagagcaactcatctggaattttaaataaataagcttaagtttattcacatcttctgcttcaagcatagcccta

SEQ ID NO: 1561 - DNA, 323 bp, Rattus norvegicus
  Genbank Accession No. AI043855
tttttttttttttttttagagctgaataataaattaccatttatttattattaaaatctgataatgccccagagagtaaggtgcctattataggaagaaaatataatcttattacaccagccattaagtaaatcatatacattgccactcatgtatcatatcagcctgcttggactgcagttccttcgtggatgaagtctgcaagtcccagccctgctgtagagccagccgctccctgactggagcgtctccatggtcggctttcctggctaatctcagtattgttaagcacaatggttattttttccttaatgaatatgagt

SEQ ID NO: 1562 - DNA, 504 bp, Rattus norvegicus
  Genbank Accession No. AI043877
tttttttttttttttttagtattatgaacctttattaagtggctcacatctcaatataaatcgcactaagaaggttttgtagagctatttacactacagtgctgacacgtttaaaaggaaaaaaagttggtataaataagctctatggaaaaaaccttaaattgtcaaaagaagaattctggctcatattacaaaaaatatatttatatgatttttgtcagctctattctaaaacctaaaactccaattcaaatgactttcctaaagactcctgcgtatttaaccctgcagtgtttacagtgcatctggccctaagtgcactcgttatacttcccgggtatggacaggcactgaggaatgttacaaagctacataaactatattttgtaacagacttgagagcatttcctaggcttgctttcagatttcatgaatcattacaaattatttttaaagaaaggtcatatgcaatgtccaagtttagcacacattgttctcatcact

SEQ ID NO: 1563 - DNA, 506 bp, Rattus norvegicus
  Genbank Accession No. AI043901
  misc_feature (1)..(506): n = a or c or g or t
tttttttttttttttttggtagcaaagttttttatttccatactgaacaaatggagataatcatgctttgttaagtaggggttacatgaaggaaaaactgcagaggctgctgtgtgaaggatgagtgtgtttacatctgtcagtcaacagttggcctaccatagggctctcctggtcctggtgaccaaaagcctttgctaaataaagaacactgcaagagaaatattttttagttgactactgaatcgaataggtgaggcgccagagttcgaatctttatattgacgtgagtttgttaaaaatcaactagccaaacaaccctttacctgaggttttcctagttgatttccttgaaattagagaacaaaaaagatttgttttcttccttcctgtttcattgttgtgatgttggcgatcaaacccttgtatgttctgggcgtcttcnccacactgagctccactccagctcaaatcgatggcctgtgcgtctctgtttatctccattc

SEQ ID NO: 1564 - DNA, 469 bp, Rattus norvegicus
  Genbank Accession No. AI043913
tttttttttttttttttaaattttttttacatttatttactttaattttgtatgtatgaatgttttgcttgcatgcatgtctgtaccacatgcatgcagtgccaacagaggccagatgttagatgcccttcctgggattacagtcagttcctcttgtacctccctactcaaaccccaaacctctgcctggccccacctggactaggacccctgtggacaaactccaaggctacctctgcttggtctgtagtatatgggtgctgggcccagagcaagtactcagtgaaaatctgtcaagtgcagaggcaatgtagagacagagaatttgagatggcagaaacaaaaccacaccacagttgggggccagcaagatggctcagtggggtcagggacttgtcactaagacgcacctagggaaagtagaagtcactcccacaagctgtcatctgactggtatgtgtatgtgact

SEQ ID NO: 1565 - DNA, 487 bp, Rattus norvegicus
  Genbank Accession No. AI043945
  misc_feature (1)..(487): n = a or c or g or t
tttttttttttttttttgaacttccacacgtttattaggctatgcgcctggggcatctcagcactcttgaagcacgcacttgttttggtttacagacacggcagtggccagtgaacggtgcctgcactgccaatagaagcagtgacaggcgaccactccgactcccgcactcccgtacccatggacttagggccgagtcggtgacataatgtgtgcgttcacagctggggctcanagcaggagccttgcagggcaagcacacagccctaagctatgcactcaggctaagtcttttacaaattatatttcgtaaattcgccatattcactgaagctctagctatatccgtaagactgtaaacatctcggtcaccactggcagctcgtanaggagacacactatactgttttaggaagttgttttgggcaataagtgcagaatctgtgcgtatctcataagataaaaatgtgaaactcatccctgggat

SEQ ID NO: 1566 - DNA, 482 bp, Rattus norvegicus
  Genbank Accession No. AI044035
tttttttttttttttttctctgtgtaaatcctattaataaattttatttggaatttgtaccacaacagttctaacagcatgattaaggctgcatgccccagcgtggccacaggggtgtgcagcatgggaaggaaagtcgcacctcagagctgaccatgatcaagttaagaacacctgacacaatatctgctgagaagtccccttcacgtcatgaccagcatgaaaagagtcgggagagagtctgcaaacattctgtaaatgtgtacagcaatgtgctgcattaggagtcaaaatcagattctacttagtgttaacatcaagagaggaagagaaggaatcgaggactcccactatgttcactaagtctccatcccactgggtactacttaggccacctaacaagacaattctccagggcgtcacaggcaagcacacaaggatcagaccacgcaggtaactaacttaggctctaaagcaagatt

SEQ ID NO: 1567 - DNA, 312 bp, Rattus norvegicus
  Genbank Accession No. AI044045
tttttttttttttttttatgttaatgaggtgtttattacatagtagttagaccttgcctcaaaaaacaaaataaaaaaagtgggtgagatcagtggctgagagtagttggagctcacaacttaaaactccagttctcaggaatcaataccttcttctggcctccaggggcactacacacatggtgcacataagggaagcagtcatacatcagacagaaaaaacacaaaaggatgggtggtgatcagggccagttaatgagggccactaggtaatcacacctgatccaaagtcacaacattaccctcgtgccg

SEQ ID NO: 1568 - DNA, 372 bp, Rattus norvegicus
  Genbank Accession No. AI044061
  misc_feature (1)..(372): n = a or c or g or t
tttttttttttttttttaaactgtggctcataatggctggagactttctgatgacttttcaaggttctgcagagcctgtgtatttgctgagggaccaggggactttcgccgagtgaataactaagaaaggttttacagtctcaggaagtcggaggcagtcccagatgaacaggaagagctggcgttgtctttctggctcatagatgatgaggggcccaaggcacagtctaaggcangaagctgggaacaatttcccatcagtagcgatgggtttgcccttagtcacctctgccctacttcattagcaataaaatctggaagagtaggagacggtgggaagggagacatcgtcgcggttgattttacgtatgt

SEQ ID NO: 1569 - DNA, 436 bp, Rattus norvegicus
  Genbank Accession No. AI044063
tttttttttttttttttcagtagaaaacatttttgttaccatagaaatgacaggcaatggtacggggaattcccatgctgttgggtgggcattcaggagtaagccccgtggggcagatgtataccaacaaggaaaaccaggtagggacacctgcccacacaggccttcagctgcaagacagatgggatgtcccagaactacctctgctgtacccgggctgctgcttaaatagagctcaaggccctgggctcactagcatggcagagagccaaacttgtccatgggaccagctagagaaggtgaggacaaagacaggctaggcggatggcaccagctctaatgactgggactgaggtccccatcaagaccctgacagacagacagcgtgaagatgagtccttgggtctgtaattcagaactctgccgggcatctcta

SEQ ID NO: 1570 - DNA, 196 bp, Rattus norvegicus
  Genbank Accession No. AI044064
tttttttttttttttttcaggctctccaattttattacatggcatgctgacggatggaggattaaaggcatttgggtggcacagtggcagctggggatgtgcatcgttatctgatgaagactcaaagccccattcaatcaatgctctccacaggactgctcagagaacctggcattgctgtcatccgctcagttta

SEQ ID NO: 1571 - DNA, 337 bp, Rattus norvegicus
  Genbank Accession No. AI044241
tttttttttttttttttcaacgcacaatttcattatgaatggaggtgactctgccggtgccactggcatcgctcagccccctctaccacatggcgcagagtaggtgagattcccagcagcatatggcccaggccttgcagcagtgaggaagtccaacgaaggagctccctgagtacttttctagggccaactccttgagactcgcagctcatggagtgcagcccgtataatgtagctttcacgttgaggctgccgatgaggtctcgacgattttgtttatacacatcatgggtgatgcgggcgatgtccttgccatgttttggcttctcccgtccta

SEQ ID NO: 1572 - DNA, 300 bp, Rattus norvegicus
  Genbank Accession No. AI044257
tttttttttttttttttgttttaaatccactctttatttaaaagacagtaaagggttacaaccagcctacagacaggaaagggttaccattagtctatacataacccgtgacaaagatcaatgaagacaacacacaaggcacccgtctgtcagatcaaggggctgacttcctacatgaggcaaagggacacagcagcacccagtgacattctgctgttctgcctaagtgcccagcacctagggcaaagagactcagatgcctaaatccgcctgtacctcagcatagctaggagtctggat

SEQ ID NO: 1573 - DNA, 355 bp, Rattus norvegicus
  Genbank Accession No. AI044263
tttttttttttttttttgtgtagccttggcttcttctgtcagattttgacctttttggtcaagtacaggattctcgttaagtttatttatgaacggacctttcacacaacaaaggtttattaaacaatcaaatcctttggatggctcatcctgcggacaggaaacggtctctgggagggagggttggttgagaatgagccaggacctttgactctagatttggagtagctgggagtgatgcttcagagttccagcaaaggggaaaaaagcccagtaagacatctgtttagcttctgttgaggggtgggcaggagtcaaaggcagacacctgaatatcagttctcaaaaagtgctt

SEQ ID NO: 1574 - DNA, 337 bp, Rattus norvegicus
  Genbank Accession No. AI044271
tttttttttttttttttcagatgcatacattttaataaggaggtatgctgcagggccagcttctctggaagtctgtgcatggcgtaccagcattcacggtattcttggccagtgtttctcataataccagttagtgttgtcctctacgcctgtcaggctgatcctcacatgggactggaggcagcatatctggtaagttctgcagtagaagtaggcctgttcaccctttttgcacgaaggcctacagaatcctctgttgcccatgcattgaagggtaggatttttgcctgaccaagagagagagataaagatagagggatggagggaggaaggagga

SEQ ID NO: 1575 - DNA, 428 bp, Rattus norvegicus
  Genbank Accession No. AI044323
tttttttttttttttttataagagtaccagaggctggctctgtgttttattatttttgttggtctccatcacagatggaagttttcactggtaattcctcagaactaaatccactcatagggaatccagagcagtgaaaataaatttcacgccttcgagcaggaaatggtaacaatagagcggagccaagggaccgcggaggaaggcaggccagctcagttctccactggggctgggttttgcacaggctggctcactataacctgcaccacatagtccttggggatcttcagctcctccagcttcatcttatcagtgagaggcctgccggagaagaaccaccgctggctgcctggctccacaccctccgtggcgtgtaagcgcctcttcatgtggaacacggtgtctgtgctgcggaccacgagctt

SEQ ID NO: 1576 - DNA, 427 bp, Rattus norvegicus
  Genbank Accession No. AI044328
tttttttttttttttttcaccgttcccagggcacggcacagcggcctgggaagctcatttatttgcagacagcctgtgctgtgccatctcacagagaagcaccacctctccacagcaccatgatgcaccacagagttcatggacaggcttcacagaaaggagggctggagaaagaggaggggatgtgatactcccaccactggacagagcacggagccattcaggcccaaagtttagtgtctgtgtttctgctgccattcttctccgtatttttaaaaagatcttttatgtgtggagaaacctgttcaaaagttctgctatctcacagcaagaggttttcagcaatgtcttcaggtctttttaatactgcggtccgggacaggagtctctcagaacccaagtcaatcctcacctcgtgccgaattct

SEQ ID NO: 1577 - DNA, 447 bp, Rattus norvegicus
  Genbank Accession No. AI044416
tttttttttttttttttaacaagcaaagggtattttattatatgtgtattctcaaaacaaaaactaaaaagccccacaaagatggaacccacaagtagaaagaacaagaattttagcgtctctaggatacacagggcgcccaactctatggaaacacagctgtgcaaggacaaattgaattactttatgtcaccttttgctttccgagtcggggaaaaaaaggttacagagtaaaacactttaaattgttctttgatagaaatttgctgcacaattaaacttcaacttactcaaagagttactgtgtaataaacggcagaaaatagagaggcattcaatatctgctcacattaacaactaagcacagacacggcagagattagcatgtattacttatttgttaagcctccatttatcatgagcagatcattttcattaatagtaact

SEQ ID NO: 1578 - DNA, 313 bp, Rattus norvegicus
  Genbank Accession No. AI044425
tttttttttttttttttccagaaataaaagcgctttaatatctggaccacccagatgaaatgtcatggcaaatctcataaaaacccagagggagcagaaactgatactaggggaaggaagggaaaccaaaaggcactgagcatgcttggcggggcaggaaaggacactgtcactccagagacaacgaataacaaagggacaggagccatccgggccagctcggggggcttcagaagcgggagacaagtctgagtccacaaaccaagttctctgcggcttttcaagaaagaggatttgcttgcaagatgcatga

SEQ ID NO: 1579 - DNA, 479 bp, Rattus norvegicus
  Genbank Accession No. AI044429
tttttttttttttttttgggatttcacaagtaagttcaaaatctatttttaggcaactattctatcaggcatataaacagttacttctacagaagatagtatgctgttctgtttctcaagatccaatccatacaggtctcgtgggctaacgtcacaccatgaagcatggctgctggcttcctcacatcgcatccagtcaggtaccgactaaccccaacctgaaaacagccagcactcgtggtctgtgccatgtctgtacaactctaaggtagtgcaggccagcttgttaacccctaactctggttaccaggaatctgacattagtccaggagacgtacgtagttctacttctgaaagaagcagatagtattcgttccccgctaggtggtcttttgtgcgtttggtgagctctttcttccactgaaggtgatgagtgaggggtccacttcccatctctccttcagtgcaactgagactct

SEQ ID NO: 1580 - DNA, 337 bp, Rattus norvegicus
  Genbank Accession No. AI044467
tttttttttttttttttcaggtgcatacattttagtacagaggcacgctgcatggccagcttctctggcagtctgtgcagggcgtatcaccattcacggtaatcttggcaattgtttctcatcacaccacttattgtggtcatctacgcctgtcaggctgatcctcacatgggactggttgtaccatatctggtaggttctgcagtcttagtacgcctgtgcaccctttttgcacggttgcctatacaatcctcggttgcccatgcattgaacggtaagatttttgcctgaccacaagaaagaaagaaagatagagggaaggaaggaggaaggagga

SEQ ID NO: 1581 - DNA, 445 bp, Rattus norvegicus
  Genbank Accession No. AI044476
  misc_feature (1)..(445): n = a or c or g or t
tttttttttttttttttaagtcggcattcccaccatatgtggtgtttatttccaaggaaggccaaccctaggtccctgtggacagacattgttttgtgccttactatcagggctggcagcccatacacagctgccttgagcaggtggccaaggatggaagctaccaggacccagaacagtgatgacctctactagtgtaggtcctgggagccctccccccatccctctgcagccagggacgtccccaaacattcccacctgcccctcatctggaatcagtctttaaaggtgtctgagaaggaaaaaacaaaacaaaaccagaagactaaaatgctctcaccccattgcccagacgcgactatgctctanaaggccttgggagcgaagtcactgaccccttccatcagccatctgtgagctcccgcccgactcctctagcccgatg

SEQ ID NO: 1582 - DNA, 475 bp, Rattus norvegicus
  Genbank Accession No. AI044530
tttttttttttttttttcctcttagagaacagagtcttgttatggatcccaagcaacttacaaaagtgtgtctgcgttgtgtcttagtcagcaagtgccgtcttacaattcaaaacgagccgtcgaaacaaaacaaaacaaaaaacgaaacaaaacataaaaacctatcgcaacaacagaaacaacccagaaaaaccctcagagctaggatgatctgacaagttctacatatttcatggtatacaaaatttaaataaggcttagcaaaagtaaaaaggatgctcacatccaagcaccaaatagctccagtcactttgttacaaaatgacgctctttattaatacagtaaagtgggttttttttgcatacaaataaagagactgtgttatgaaatgtgtggagctattcgatgcatcagaaatgaatgtgaaacccaggaacttgctaaaaacagcaagcttcatctacaacgtaa

SEQ ID NO: 1583 - DNA, 453 bp, Rattus norvegicus
  Genbank Accession No. AI044604
tttttttttttttttttactttacaacagtttatttaacatcccaatgataagtcatatttacatattatataaacgtatcaagtattataaaacgcctggactagaactgcactccacatggagttacttatttacttgcttacaaaattgtacaatttatataaagtatttccatccaaattgggtgacttttaataatccacacaaatactgttgacttttacaaacaggtgcatgttaaaatcttgggctaaaaattacagcattttcctgcgtaaaatttgctttggaaaagaagatggcttctttctgccccttccaagagtttttcctgctacttctgcagtctttcttggcttgctgacctttatttcatccaccggacttgccaagggagagatcagtttaatttctatagggggaggtgaccaagaacttccttttcctgtgt

SEQ ID NO: 1584 - DNA, 263 bp, Rattus norvegicus
  Genbank Accession No. AI044621
tttttttttttttttctgctcacatgtaactattaggtgaatcaaatgaagtgggaaatgaaagaccacagtggaacgaaagtccccgtccccgcctttcagtgccttttacagtcactgccagtcccccaactctctcctagtaaacggaaaagagtcgagtaactcggtgggagctttggaatcttccaaggctagtgtcggcagggcacggagtggagaactgaagcaacgatctggataaatcgcaggggaatgggtgg

SEQ ID NO: 1585 - DNA, 480 bp, Rattus norvegicus
  Genbank Accession No. AI044638
tttttttttttttttttacctcttgcaataaaacttatagaaaaaatagacaaatatgcacatgcaatttacagcttttccaacttaatccttgtgcttcacttgaaccactcatgttcacctttcaacattagcaacagtcttccaaagtcttctctcctacgccagggcagcaggtctctgaggaacccactcagaagagtgtgttaaagtggtcatactcgaatgaaggcactccaactctgcttgaagaaaatactagtgtgatccttttgtaaaattttctttttctctaaaaaggcaagcaagggtccatgcacagtgcggagaaactgttggggctacaagggtgcagggcctgcctgggcgcaggtcaaggggccccagatctcaggagccaacaagtacctccatgatgtggtccagctctgtgagatccattttgaaaggctgacttggggcaacaggctgattgctgta

SEQ ID NO: 1586 - DNA, 525 bp, Rattus norvegicus
  Genbank Accession No. AI044721
  misc_feature (1)..(525): n = a or c or g or t
tttttttttttttttttcaaataaacactttttttattttttgcaatacaacccactttccctccccaagaacatggactgacctcagccaccaaagcagaggacaaaagctgttgctgtgtcagaaggcaaggggttactagaaaaatagattatacccaacagtctcccaaggatccagacccctgtcccgagctcccctaacagggctaaccacatgtaactaaaaggcatggagaggccagaaacctcactgaaaagggaagagagcctggcagtgaagacttgggctcctacctaacgaaaaaaactaagatgcacagagaaaataatttattgggtaatggtagagatgtcatgctgaccattccagatctcactgaagctaaattctggccagtctatggaggtagaaattgggggtggaaggaaagcttaagaattcctacttccccaagaaaagtagactttacacagcactacccttttgcccagtctgacttcccacagagcctctaanactta

SEQ ID NO: 1587 - DNA, 463 bp, Rattus norvegicus
  Genbank Accession No. AI044759
tttttttttttttttttacctgcaagattttctctttatgcaaagcattgacaactgacagtatgagaaaagcctgacacattaaagtaccacataccagaacagtgctgacagctaagattacgtctgagcaacagataatctacagcagctcaattttgttaaactgtggttctcaattcccctgtatcttgacggatttctgctaatatgtttgttgtatattagcagttttactaatcatacaggccatcttcgaaacgtctttgtattacagtaatcatttctggaactggcaataaaaaaagccacagtggctgctcgcactgcagcccgcaatcggtgtaaagaagcatcacagttttcagggaggctctgctctcgattgcaaaatagatgcaacgtggcccaacccacacaagtcttaatgacctgaaggaagggaagtacaagcagcactttc

SEQ ID NO: 1588 - DNA, 465 bp, Rattus norvegicus
  Genbank Accession No. AI044791
  misc_feature (1)..(465): n = a or c or g or t
tttttttttttttttttacacttccagcatttatttcaggagcattggttgagtttgggctctgccaccattgtgctctgactgtgaccgatgtcacctctcctgagcatgagggcaggcagtgatataggccaccagcctttatcagactctgaattgctctgctgttcctaacagaagtgtttgatatgaagctccagagagtctttcctgtgagttggaattggtgtaaaagctgtgagaacctagcactgtgaggcgatccctcagcccgagagccatcatcacataagccccaaggagctgacttcttcccagtctgtctgctgcaaaatcacaaagcagctggacccgaggggaggcaaacaggctgaagggtggagccatggccagccagaggcacacgagcctgggaatcctanttgcccctcctagtgaccactccccgctgtctgcagactgcag

SEQ ID NO: 1589 - DNA, 414 bp, Rattus norvegicus
  Genbank Accession No. AI044826
  misc_feature (1)..(414): n = a or c or g or t
tttttttttttttttttgtgaattgaacaccaaaattttattaaaaaccagtctcacatttcaaatgttatcttacaagtgaacagcggccaggtgatataaataaggaggaggaggaggaggtcacttctggagaaatcaaattctggaagaagaaagaaatgtttcctacaattcatcctttctcttcagtgtgtcaagccggccagaggaggccttcccccagggtgacttctgacagacacagcagtactgacagtccaggagagaggtctgcctccagtcagccctggcatgtgctactccccacaagctcagatcagaacacacttgccacatgggccctagtgctcatgctatcctcacaatggcgttcctgagacacactanggcattctgttcccctgcagttag

SEQ ID NO: 1590 - DNA, 458 bp, Rattus norvegicus
  Genbank Accession No. AI044827
tttttttttttttttatatagtcactgtttatttcatgaaaactgaagttgtgctgagggctgagcagcactggcattgaaaaaaaatataataatcaatcataatgtctggacatctcttttggggctgggaagggaggtggaattgtacctgctcgactaggcttcttagtctcctggctcaaacgtgcctccctacctaacaaagtgcaatgctcagtgcatggaccagctctgttctccaagtgtgggagaagggaggataaaggaacaggaggaggagttgatgctaaataccccactttctctcaagccagaaggaagcaaagggacagggccctgggtggggtaagagtttgttattttcactggaaaaggggagggaaatgtcacgcccccgccccttccttttcagagaaagtgtactctaactagcagcctctactccgcccgtccca

SEQ ID NO: 1591 - DNA, 478 bp, Rattus norvegicus
  Genbank Accession No. AI044836
tttttttttttttttttaaatgtagaaaacaaaatgacatttatttttttcttaaactcaaaattaccaagtagggtaagaaattaaatataaacacaaagtccatcctagccctgtttatccaaggcagcataaccaaatagactcatggagaccacctggtcaacagaggatttattaagtatctcatcggcgtcttcggtctggactcctgcttcgtcttcggccacctcttcaagtatcccgtgcgcctgtccaaattcaggtggatattttttatttccccatattcagcgaacttgtcatggatatcttcttcagtggcttcttcgtggactccagtgacaaagagaatccaaccttcaacagagcgctgtggtccaggttcatcgccatcctgctccacactgtcataatcttcccgcatccgcgctcgggacccctcttcagaaccaaaaccgcggcccttccgtttctt

SEQ ID NO: 1592 - DNA, 390 bp, Rattus norvegicus
  Genbank Accession No. AI044861
tttttttttttcattttataaattttaatccataaaaaaaaaaaaaaaatggtaaatttttaagaaaggaaatatacatttagtgcaagttatgaattacagttcatctccagtgtcagcagtgaaacatcctgaaataaaagaatgatctaatttgaaaagagtcccagtgtttaacatgcaatcaataccaggtacagctaaacagaatccttccttctctccatgtcacacagcagcatttggtttaattatgctcaacagcacttttatgtcatagtaggaatttcagaaatagaaaatttgcataacattaggtcacattatccataaagtccgaggaaaaaataaaactgattacagtcaagtttgcctttgattctgaaccac

SEQ ID NO: 1593 - DNA, 401 bp, Rattus norvegicus
  Genbank Accession No. AI044862
tttttttttttttttttgattagaaagaccaggtctttactgcaaaatcattcaaataccacacacacagcagcagcttcttctctacattgccaaggcccacttgtcagaatattgcataaaatagcgttttttttcaatagtgtgggcactgcagaggttcacgtgagctctcttctggtgggggcaagcctcgaacttgagcacatcagtagcttagtaaaggggcaagagacagctctaatgctcacagtccaggtagcgggaggactctacctcctaggcaagttctgtaatacactctcatgggacaggccacagactcctgccattcaggacccaaaagaattccttccagatgcccatggctcctcgccgggctactgtgcccagcttcatga

SEQ ID NO: 1594 - DNA, 398 bp, Rattus norvegicus
  Genbank Accession No. AI044869
tttttttttttttttttcacagaaagatcttttattaagcagggaagaaaagttgaagtggctgctttctgactcagacagaaaaacatcagcaaaggaccttgcaggcataattcataagaagggggaaggggggaggtctgtgttagaatgggctgggggcaatggtgtgttttgactgggcatattaggtgaaccaaagcgggcttttgattgctagactttaatactttgacagctggaccttggtagtcagcctcaggaggaggaaggaattggctaaataagggaagagactgtgggaactagctttagaaatgcagtctagtggttttaggcaaggccgaaagaatgagagagaagggcacggcctgctacagccatgtctgtcaggtcca

SEQ ID NO: 1595 - DNA, 486 bp, Rattus norvegicus
  Genbank Accession No. AI044887
tttttttttttttttttcctctacattggtaccattctttattgtttctatgaatgatgtctagatgttgtggcttacccttaaacaattcatgttgctacatgctaaaactgaattaaaagacaagacattttaacacatacaaacaaatgttaagatgcaccatttctatgtatttatattcttgaaataggacaggaaatagcagcaaatgagaacaaagatattttccatagcttttggagaaaaatccagtcagaacggctaggagaaaaagacttctcaatgtaagcaaggctgtgaggcaatgttgtcctaaaagctaacctacagtgtttacggaatcatgatggagttttgtcctcaaaaatagccacttacttctcaaaacacttttcctttctagagaaatctgaggaatattaagaccaaacaggtgaacaaacgaaaaggacacaggctatacagtaagctgctgctgccctc

SEQ ID NO: 1596 - DNA, 388 bp, Rattus norvegicus
  Genbank Accession No. AI044900
tttttttttttttttttgagactgggtacccgcattgttctgaggaggatctgttctttagtgtactggaaacacgaggttaccagcaggcacaacagggaccctttggaacccttacaaaccagaagggtcacataaatgtactgcatgtgaggtggtgagggaaagggacaaggggaaggggttaagaagagaaatctctggtccactgtgactttcttcagcctggacagttgctcttaaaggggtagctttcttccagtgtactgtactcttcagagcagcagacggctgcagggtgtgcagccagcagcagacgtatcagaaagagtaagtcctaaccccttggttagaaaaacaggagacagaagttttaacacccacctta

SEQ ID NO: 1597 - DNA, 381 bp, Rattus norvegicus
  Genbank Accession No. AI044932
tttttttttttttttttaaatcctaaggcggcctagcgcaggccacggcaggcagcagtcaagggctgcccagtgttctctggcgtccgcatctcactctgcgaggcatctcggtggaaagtttgcagttgagacgagaagaaaccagcgcttccacggtggagcccaggcgcagcctccgttaacactccacgggtcttctctgttgctgtgggagggggcggctcagccccccgctgactccagtcccttgagtggctcgctctctctcaaggctcctcccacgtggccccactggatgtatctcgcggctcctcagctccgctccgctccgtctcggtctgggtctcgggctctctctttccctcgtgccgaattctt

SEQ ID NO: 1598 - DNA, 432 bp, Rattus norvegicus
  Genbank Accession No. AI044947
tttttttttttttttttaaacagcaccagcaggggtttatttagtgacagtaaggttaatgattccctcaaacaatataggacaggccacctggtttattcaaactgaatctaaaccttagatctgactcaacagtaacataaaaacctttaatgacaaacccgtgttaaaccaaagacagtttaggtgagtcttaaagctctactactgatgggctggcatctacacgacaagtgttcagttcggttacaaaagcacatttgagtttcttagggatatacaagtaatactccatgtagcctgctaggtcctcaatggtcacatcatccacatagacacgagcttgctcggaacaggatcgaggagagccagacagagttctggtgtgcagtgactgagagtagtcctcaagtgatcttcgttctggggcca

SEQ ID NO: 1599 - DNA, 498 bp, Rattus norvegicus
  Genbank Accession No. AI045092
tttttttttttttttttgtcactgttacataaactattttatttaaataaaaccaggactgaccctctcccacacgcaccagcacatgcactcgcacaatcatgtcctccgtttctgttcctcctgaacagccacctcaaaccccacaggttctcattgtgaccatccttgaaacctgaaaattgggagatcccatgcgagacactggcagaaggtgttgtcttccagaggcacatggacatttcacacactgctcacaggcaagctgggacaggagaagagcacaggctgccagggactcagcagcgtatctagggcatgccctctgggaagacagggccaggaatcaacgggtaagggcctgtccaatcactgggctaggatgttcatattctcacatgacctcctgtgtcttctagaccaagttccctgaggggaaaagcccgacagatagaagtcaggtcagaagaggaaatcaagagagcatcagagagactt

SEQ ID NO: 1600 - DNA, 350 bp, Rattus norvegicus
  Genbank Accession No. AI045120
tttttttttttttttttcccaagttctggaatttaagggatgtgcctttaatttttattttatttaactttaatttatttttgttttatgtgtatgggtgttttgcctctgtgtatgtccgtatagcataagcattcagtgcccacggtgtattcaggcaaacagccatacatgataaaatttgaaaataattttttaaaaatggagcaaaaaaagaaaggaaaaataatttgttggcctagagatgaggccagaacccacactaactaactttggcatctctgtgggtcactgtgtaccatgttcagtgctcctaggagctgaaggggtcactggttcctataaaacta

SEQ ID NO: 1601 - DNA, 395 bp, Rattus norvegicus
  Genbank Accession No. AI045148
  misc_feature (1)..(395): n = a or c or g or t
tttttttttttttttttcaagggcttgtgggcattttaatgcatgggtcctactgactgacttattgtagcgcacatctgatggctatacccttaaagtaaagcctgcatgacatttttggctgaaaagcaaagagaaagtcctattttgaaaggttttactgtggaaaggtgacaaaaggtggtttgggggatgggggagcttaaaagataactgagtttaattaaatttatgtgaccctgaaagtattaaattggaagcattccaggaagaaaagggtctggagttttgatgtgagcttcccgtgaaatttaaggganagaacggagatctttgtacagtatgctaagggctctgaggaaagggtcggcgggctaatggaaaaggctgggaaa

SEQ ID NO: 1602 - DNA, 517 bp, Rattus norvegicus
  Genbank Accession No. AI045154
tttttttttttttttttcagatttcaagatatttttattttaaactgttttattataaaactaatacaaataacaaatgaaatgtagagaaggaaagcagtccacttgctgccctgccatcctacagggaccatcgctggtgatctgattgtctactttcacagcctggtgtgtcattcgcatccatgccacgttaacgctgtggtccttctcttactgtagtgttgtctccatgctgctcacggatacctgcctatcgactagagctgtgggacagcagagacacagccagcctccgccactctgaacgtctccttggtgtaaacccccatgactgtactgtctctcagatagtcagctttatccagaacaatatacacagtctgatccttgagatgttcagcactggtcacttgcttaaacaaccggacaaagtcattaaatgtttcacaagtcgtttctgtagaacactctgcctctgaagaactaagatgactcagctcctcgtgccgaattc

SEQ ID NO: 1603 - DNA, 441 bp, Rattus norvegicus
  Genbank Accession No. AI045158
  misc_feature (1)..(441): n = a or c or g or t
tttttttttttttttttgagaaacaaacatttgtgtttattagccacagataattcagagcgtcaggctcctaaccaatccctcctatagtctacccacctaggccaactgccaaagaccaggaagagcagcagacaggccccatcctttcaacctcctccccagggtgagttcccaggaagccagggccctttgggtaaggaagaggaagtcagcaaaagaggacagacagggaagaaggaaatagggtctggggcagacagacttggcaaagcaattgattcccaactcagtggagagtaagcagcccaaatccagtctcacccgaggaaccacgcagaagcatacttgtgtcacaaaccttgttagggggtgggggaggccaagggcaacagcaaacctctgcaggtcagtccttgcttgccanaggatgctggtcta

SEQ ID NO: 1604 - DNA, 460 bp, Rattus norvegicus
  Genbank Accession No. AI045182
tttttttttttttttttcagcagataggctggaaaacaaaatagaaagaatcctcccagaggcgcaacaacaaacaataggaaagaaggaaaggggaacagacaaccactgtttaactgttgggagtttccagaagacgggacagagagaatgtggacaataaaacaataagaaacagttgacgagcaccagtttgaggggaccagtactgaccacatctaggcacagtcctaaataaaattggaacaatagggttagaaggaacatgttggaagtgcccagggaaggaaaaccaactgaagtaaatcttagaatagtctggcaacttcagtagcagtgctgaatgctagaagtcaaggaaccaatgattgacttttgaaaacttttgttcccagaactccatatagtacagaatgtcaagagtaatgcaaaaaaaaaaaccttcctcgtgccgaattct

SEQ ID NO: 1605 - DNA, 428 bp, Rattus norvegicus
  Genbank Accession No. AI045196
cggccgcacaggtttgttgtctcggcatgtttttgtgccgcgggaccgcgatcggctgcgtgagtacgaccgcgagtatcgccggtacttgcgctggtggcgcctgcgggaccgggatcgggatcgggaccgtctgctcctccgcggccggctatggctccgcgaggacgagcggctggagctgcgggagtggggtctggagctgcgggacgaagagcggctgcgggagcgcgaagacaggcggctggagcggcccgagcccgaggtggacggcgaggctttctcctgcggagagccgggccacatgtcgttcacatacttggacacggcggccgaagacatgacttccttctcagatcggggttccgtccgcgaacgcaacgacgtctaaggacttaaactgatgaagcgctcgcaagggcgagaga

SEQ ID NO: 1606 - DNA, 489 bp, Rattus norvegicus
  Genbank Accession No. AI045201
  misc_feature (1)..(489): n = a or c or g or t
tttttttttttttttttaacaaacacctaatatttattaataaattagtatacttgaaggcatttttctgatatcagttcctcaccactaagcccacccacacaaaggcagtgggcgtctagctctgcattagagtctgacaactgagcatcagaggacaggttgataaatgagagagcgtagttgcaaatttatcggacaggagttcttacagctgcagccatttttaacgaaagtggttggatgacaaaggaaacccagcaaggccttgagggcagactggacctatagactatgtgtattgagagagagagagagagagagagagtgtggtcaagtttccgtcgtgtatatgaactatagaacaagacatgaaaaaagacaactcaaaatctaatagagttacagtcatcaacagggtcgtagcctcnctccgtccttagaaacgctcgtgaaggacanacaatacgacagagagcagtgataatt

SEQ ID NO: 1607 - DNA, 353 bp, Rattus norvegicus
  Genbank Accession No. AI045253
  misc_feature (1)..(353): n = a or c or g or t
tttttttttttttttctgggttcagtcctcagctccagaaaaaaagaaaaaagaaaaaaaatttaaaaataaacctaaaaaaacaaatctatcttcagtgagggagctggcaagagggctcagcagataagagcacttgctgttcttgcaaaagacctaagttcagctattggctcctatatggtggcttgcaacttcctgtaattccaactccatgtagttcttactcctatttctgaccattgtgggacatcaggtatgcacggggtacacacacatatatgcagacaaaacatttaaataaacatgaaatanaataatctaaaagaccttcagagaggattggcaatgta

SEQ ID NO: 1608 - DNA, 462 bp, Rattus norvegicus
  Genbank Accession No. AI045321
tttttttttttttttttcactttctgactcattttattaatattgtttccacatggagtctttacgtaacccagaagagaagatccatgactcttcccattttacaaataaggaagctaaggcacagaggaaacttgccttgcatatgcagcaaaatggagcatgaaaccagacagctcagtcgagagttggtgttgtgtagtcctttgaaggtaagatgcttcccagtgcacaagattaagaaccagtgaggtttgttgagcatttactatgtccctgccttcacctaatcaactcattaagatgacaggcatcaacacagcaatgagaggcattttggcatctccagacagatcaaagcagaggtacagcaggtgcctgccttggagagtgcctcagtgctgtccccttgtggtcacatacatgggacttccatgtgccaccgctgagcctgcctcgtgc

SEQ ID NO: 1609 - DNA, 247 bp, Rattus norvegicus
  Genbank Accession No. AI045330
tttttttttttttttgtgggaaacaaatttattggcttttgctttctccagggtgctgtgcgggcccctggcaggtcccgtggtggtgctgattgatagggacagatgtttaatccactttgaaaatgtctatggatctatacagagatgatggaggttaaaagggaggggtatgaggcgaagacagaacagcccagagcacccctccctacctcacccataccccaagcagtgcacaagacgatgc

SEQ ID NO: 1610 - DNA, 406 bp, Rattus norvegicus
  Genbank Accession No. AI045333
cggccgctgaacatggccttgagcatggtgtcctgccccgtgagggtgcgcagcgtggtgtagtgcagcgagccgcccacgttcagcttcacatacttgctgttcggggtcaggggcttcagactgtacgagggggagccaggttcgacacctgaggggttaggggactccaggcattcggccgcagccgccgccgggccagaggcctcggccgacatgccagtgagcggacgcgggtgacagtcgaagctctctccgcgccccggacccgctccctgagaccccgcgactcctgcgcgggcgcccgaccgctcggcgcacacgcccactcgccgccgctactctgctacgtccaccagccgccccatcgcgcgctctctccacccggaagctggccctcgtgccg

SEQ ID NO: 1611 - DNA, 456 bp, Rattus norvegicus
  Genbank Accession No. AI045337
tttttttttttttttttgattgataagtaagtactttatctttgtaaacatactgagaacatcgttgagtatcagtggaaatgacagaacatgccttgtccacttctgccagtgtcaaagatcagaagagtcattcagcctagacaggagctggcttccccgaaaggaaagaagacttggtgttggaagacaatcttctttgaggaatgagtccgactgcaaaaccgggtcatatccgaagggtcctcgttcaatccttttttcccgggcagtccgtaggtccctgaaatacggtgagcggtttctgtgtgtggggagcccgacgacgggactctggagccatgggtttggcaccctgggcatcacattcttgttttcttgcacggaatctttatctggtaaggatttttgcctttccagtgtatactgccgcagttttaaaaaggcctcgtgccg

SEQ ID NO: 1612 - DNA, 438 bp, Rattus norvegicus
  Genbank Accession No. AI045451
gttttttttttttttttaaactgtgtatgtaccaaactttaattttcatttcacactcaaaagttctgtacaaaaagaggcaatgcaggcaaaagaacaaaaaattacaatgagttcggcaaacaacatacaaccgcttcaaagccccttctgatgtgcaaccatttttacagatgtactatgacaatgaagttctgaaggctggggctggcaaagataaaattccaatgttagttattaatatctagaacacttgagagatgtctacgatagaagattgaatgagaagtctgaactctactgcacaactggatccctagattgagcaggctttatcttgcgcttgcaaaagcatagcattattttgacttaattgtgatggtgtttcacgaacttaggcttgccattctcatttggcatcatgataataactaagaa

SEQ ID NO: 1613 - DNA, 403 bp, Rattus norvegicus
  Genbank Accession No. AI045458
ttttttttttttctgttaacatttttatttttccagataacaggagttgtatacaaatgacagtagacccttgcctctttattttttatctaaataaaagataactcaagatgaattctcaagagaaaaaaaagctatatacatcagggactgcatctccttcatcgtctacttggaaccagtagttgtgttgctgtcatggaatcaggaaagaggttgtggtatgttggaagaggtacatacgctgctgttatcattttaccagcaaaccacctgccatgcaacgcattgacagcagcaatagccgcagcaatcgatgggcacttcacatacacattgccctgagctgaatttttgtcaacataaatatgaatgactccaccatgtttattacattcttcaa

SEQ ID NO: 1614 - DNA, 305 bp, Rattus norvegicus
  Genbank Accession No. AI045475
tttttttttttttttttccaaagtgactaacagagcagattcacaccttgggaggagatcgtgcgcacagctcaggggcagtgacaggtaaggggtgcacacccctgggcagctgtctatttgggcttcccctcgctggctcgctcgctgtgtccagctctgaacatacgctgtactgaaccctgacttagaagagtctaggtgctggtgattagacacattgtcacaagctagtcaatgaattgtatcagagtgttaaaaaaaaacctttgcggccgctccaacatcagaatggcctcgtgccg

SEQ ID NO: 1615 - DNA, 376 bp, Rattus norvegicus
  Genbank Accession No. AI045488
tttttttttttttttttgaacttgacattcttttatgtttatttttagcatgaggaaactgaggaacagagaggcggtggaacctctctgccaacacagtgctcttcgccgaagctttttgcctctctctgacaatacataatatttttttcagggcatggtggcacgcacctgtgactctagcactggggagatggtagcgggaaaatcagaatttcaaggccatactcgatcacacaatgaatttgaagccagccaagaatccatgtgaccttgtctcaaagtagtaatgactggatcagcaggatgacttggggtagctgaggcattgttgttcatcccaggccttgactcaggtagttccagttctgtcttc

SEQ ID NO: 1616 - DNA, 384 bp, Rattus norvegicus
  Genbank Accession No. AI045492
tttttttttttttttttctgcattacaacttatttatttcacataaaaatccccacccccggcttgccaggccttgtgtcactgcagggactgtccccactgtctctgtgtttataactgcacaatttgctggtgggcagtgggcactgttgctctgggccagttgtcaaatggatcctgggaatctcagtaaagaagtcaaacagcctttcgccatgatgctgctgtacatctgcctcttgcctcactgtcccccaggtatctggagtggtggtctcctattttggggtcttcactggccctgatgggttctgcttgcctgtgtcagtgggtgctggtgattcccaaggggcggtgggtggtgggtggtgggcgtgccatgga

SEQ ID NO: 1617 - DNA, 460 bp, Rattus norvegicus
  Genbank Accession No. AI045521
tttttttttttttttttaagagcgacaaggtgaacctaccaactttatgaacgtccattaggcaaatgcacaagatggaaatggtgtttcctggggtttgggtcagaggaggggaactgcctgctgctgagagagcgtctttggggatgatacaatagtctgaaattggacagtgatcatagctggcaactctgaatataccaaaatcagtaagttatattcttcgaaggtataaatttggagctgagaacatagtgtactaacacagtacttggctagcatgcacaaggtttcaggtttgatccatagcacacatgcatgcagggacagggacacacacacacacacagaatttcatgttaataatgctattactcaaacacaaaaacaggtcatcagcatgagttcctatcctcccatgcagaagtccctcagaagggagcatgagggaagatgtact

SEQ ID NO: 1618 - DNA, 452 bp, Rattus norvegicus
  Genbank Accession No. AI045545
tttttttttttttttttagatagaaactctggttttattgtcaactttacatttttttgtcaactgcaagatgagcctgctggaacatgaatattccaatattccagtcacaacaaaaataggaacttctgggcttttcttcttctgagtctctgatttcccaatgatgttcagccaaataacaaaagcaatacaatagtaattgagtttactattatcaatggcactctcatcacggtccttacagatcgaataaggtttaatagttgagatttgattcctggctcctctccgaatccaccaatgccctggtctgttccccagccaatgttcttgaggaagcgctcctcgtgcagcacggcgatggcattcacgcacagcagggccgcctgcatcagggagtacaacgtaaaggccatagttacttcaaactgttcccaggcctgactgac

SEQ ID NO: 1619 - DNA, 471 bp, Rattus norvegicus
  Genbank Accession No. AI045556
cggccgcgggccttcctcccgccaccgccgcccggggctgctgctccccggcctctggctgctgctgctcgccgggccggcctcgtgcgcctcagacgaactctccctggaacagcacagccattctttacgcccctcggagttccagccagagacaagcatcatgcacagtgctgcacaagtgaccttatcagagactgttcccaggtcccaaccaagcatctctgtccttgtcctctcctctccgtctcctccctcttttgatacggcctttttaagccagagacaacagactcgaagtacagtggagcacagcatctttgaggcaaattatatatccgtgacgagtaatgaggtggctcttgatgaggaggagatggataactttctgccagacgctcactggacctcttcacgggtggtctccccagtgcggtatatcacaccgagcccactggacccaccccagga

SEQ ID NO: 1620 - DNA, 142 bp, Rattus norvegicus
  Genbank Accession No. AI045572
tttttttttttttttttcgttagaaagcactatttatttcgtcatactcttgattcgtttctcttcttacagcttctttttggagactctgggtgtgctggtctatatgtatatgtgatacacaatcacgcccataagtgct

SEQ ID NO: 1621 - DNA, 187 bp, Rattus norvegicus
  Genbank Accession No. AI045577
tttttttttttttttttgatttgcttctaaaagatctttaattttgttttcaaaaggcatcttcatctcagacagacagattgagagtttgttacggctcctgtcattacttccagagacaccacctacccacatccaggccaacagtgaaaacgtcttaggagtatcttcactgttcactgttgca

SEQ ID NO: 1622 - DNA, 179 bp, Rattus norvegicus
  Genbank Accession No. AI045584
tttttttttttttttttacagttctgagaacaagtgcactttattgggtccgatacaaagctgccagaaaagccagcaggtgggcaaatggtatctggtcctgccccatgggagtgccaagtcctcaatgttgcactgtgatgtggattctgcccagctgtatgtggggctgtcgctta

SEQ ID NO: 1623 - DNA, 487 bp, Rattus norvegicus
  Genbank Accession No. AI045600
ttttttttttttttttaggtggtccctaaactatttgaaggcaggtagctgagtctaagctaaagtatttctcagtcagagtaatcaatcacctcagagtaatcaatcaccctcccctcagacgcccctcacaatgcaggaacagtgcaacagcaaaatcaaagagcaaactgtattttcaagaacagaagagtcgccagtgctgaaggacagagtagaaagcagattctttgggggacatcagtcagtcagtttccggcccattaggaagacttctctttcctgctccgaggagagtcggctccattcgacgtgaccgtgccgttcacaccattctctgttccttttctggaagacctgcctttggtcacagccggtttccttttcacgggaggggcctggaaggcagaatgttccctccacctccgaagctggaagttaatgaacttccacatcatgaaggcttgagtgatgcaaatggacgcta

SEQ ID NO: 1624 - DNA, 378 bp, Rattus norvegicus
  Genbank Accession No. AI045602
tttttttttttttttttgttgagtgaatggtcatctttacttgcatatgaaccagtaactgccagaccatgacggagtgacgatgaacagatgggagatgacacagtttttttccctggggccaccgatgttcaggctgaagtctctgggcagcgaatctggcagagcaggcctgggggcttggtgcctgaagctagccttcctttgctgctctctggctgcattcacgtacggtaggtgggctagaggaagactgtgctctgttacggtctctccctgtcctgtcctccctgggtaggtgggtgtaagaaagcctctgctctagatgcctgagatgagaaggaaagacctagaacttggcctcacagtaaaatcctc

SEQ ID NO: 1625 - DNA, 400 bp, Rattus norvegicus
  Genbank Accession No. AI045608
  misc_feature (1)..(400): n = a or c or g or t
tttttttttttttttttgaaaatccaaaatgttttattttattttttttccttaaatagagataaccagtaaacaattttctgaacttggaagtttaaaaacgtgcatataaaaatgggcattatgtatttcttattgaatgtggattgactgccgtctgctaagaaaagtgggtgtgggggctgaagagaaaggaagttgtctttttttgttttttgtttttttttgttttttgtttttttttttttttaaggcttgcttgtgaaaggaacagttgtaaaaacaaaattgcttgaagcagggtcagcttagtgcttcacagtttgactgcttctctaagaggagcccttcctgcacacgtgcatcagaaaccacagaanacacanagacagacacctaa

SEQ ID NO: 1626 - DNA, 376 bp, Rattus norvegicus
  Genbank Accession No. AI045621
  misc_feature (1)..(376): n = a or c or g or t
cggccgcgtcgccgccggctgcagctgcggcctcgtccttggcgccgtcggcggtcgcgccttccgcctcagcgccctcgccggcctccttcttgctcttcttgaaggagaactgtgcacccatgctggcttcttcaacaaagaaactcaacagatccaagagaggaaacaaagagccttgggttggtgtaacgacggngcgagcagcagcagcggcggcagcagcagcaacagcggcggcggcacacacaccggagggagggaaaaaggtggaaaagtcgagcacanaaaaggagcccaagtgtagttttttaaaaaaagaagtaataaaaaaaatcccagatttgtagccgcactgtagacaagcctcgtgccg

SEQ ID NO: 1627 - DNA, 317 bp, Rattus norvegicus
  Genbank Accession No. AI045632
tttttttttttttttttagtttttgttcaggaccttgtgtgtactaatcaaatgttctacccttgcgttatataaccaattccttccccactcttttgactccaccactcactttgaggaaatggtccgaagggctgagttgtcttgggaactgacgggagagcagtcaccattaatgtgcccttggtgccatgtgtcctcaccccgggcacaccattgcctcttcttcgttttcttcttcatctatgtctctgttcactcaaagttaacaataattgtaatccataaatgagtttatatttatactctaacatgtc

SEQ ID NO: 1628 - DNA, 439 bp, Rattus norvegicus
  Genbank Accession No. AI045672
cggccgcaagtgttttttttctgtttttacaagaacatttctttataaaccgcttaacagatattcacatcaggacacagactttaagacaacgaaactggacttcgggatctcattttagacagtgctcgatttccggtcttgagagagatgtgggaactttgcctggagaatgttccctttctttttctgtaagcttctctttcttgcttcagtgcgggcatgtttctcaattctcagtctgataaagctatccacgtaaggcattgcgaagaaccgcctccggttgtatctcttatttaggtaccaaggtatatgccactgcttgaatttgtgccagacgattcttccaaagatgtgctgtctgcaagcaccgggtcttggcttttcttgaccggtctgaagcagccttaaagcatcttccctctgctggacaact

SEQ ID NO: 1629 - DNA, 406 bp, Rattus norvegicus
  Genbank Accession No. AI045704
  misc_feature (1)..(406): n = a or c or g or t
tttttttttttttttttaatggcttacagtttctggagtgatagaaatgaaaatcacactaccatttgaagtttattctacaggttttcagtgtcatttctgtacagtgcatttaatgtgtcacacttaggcttgtgttggctttcttcttttgccccagatcaaactgaacgatgtatatataacactatctgtctgtaaaatactttttttaagaaagcatttatatttatatgacagcttgaactgacaacattatgtatatagatcatcttgaagtattatttcacattgaaaagaagaaaaatatattgataactatagatgttatgaagaagaggctatttctagttttgtactaaaaatcaattggatgaactaaatccaaaaccggacactgtancag

SEQ ID NO: 1630 - DNA, 395 bp, Rattus norvegicus
  Genbank Accession No. AI045712
tttttttttttttttttctagtattggcttttattaatttttatgttgtttattattaatataataatatagtataaatatatttattttatattacatgttactttattacttttctgttattattaattttatgtacgtctgaattcctggtaactgtagaggccagaagtgtgtgttagatctcctgggactggaattacagctggttatgggtcaccacatgggcgctgggaattgtacctgggtcctctggaagaagccattgctccagccccagcatggctttatactgagagacactttgaaggcacacacctgccatgttttcgcaccctaccccaagaccatgaccgtgaccacacatgtgttagacagcattcacctctgagcta

SEQ ID NO: 1631 - DNA, 397 bp, Rattus norvegicus
  Genbank Accession No. AI045751
tttttttttttttttttaaaaactgaataatcatgtatggtttatttagtacaatgattataacctataatacaataaaacgtctccataactaaggagtgatatgccatgtattttctcaaaattttgtattgagtattttattaatgtcatttgctgttcaagtaacacctactgctttttctgataatgggaagaaaaaacataaagacaggaaaaagctactacccccaacaggaagtcaagggacaattgggcgtttgttcttttgtagaggcagtctcaactctttacttccttcctgcttcagggccacgtggttatggcctgcagcgctggagaaatctcgggtacaagcacacgtctcggatgtgatacctgttcagaatccagctta

SEQ ID NO: 1632 - DNA, 398 bp, Rattus norvegicus
  Genbank Accession No. AI045762
tttttttttttttttttaacatttttaaaagaatattttatttacatcaaactttgctgaactacagtgacattccaatcacaatagatgacgacgcctctgtcactaggcacttttaaaagggagtttaggctttacagagctcttccagatgcagtcctgtgtgatactacatcatcccaccaccctcgccccactaaaattacccttcggggaaatattcttttatatagcctgatcggtaaactatggaagaaattagtataaaatgaccacaggaaatgtatcgtttaagactaataaaacagcctaagttgtcacgtttgaaagaggagacaatttgtatatatttaaaactaattaaataatttaaatttgacttgtactttatatattag

SEQ ID NO: 1633 - DNA, 387 bp, Rattus norvegicus
  Genbank Accession No. AI045764
tttttttttttttttttaattaagtggagcaagactttaatagggaggaaaaagtgacgctcactaaacacctttttttctcacagtagagatgccacacaagtcaggaacgtgtaactgccatcacacggagcacaagagacggacttttgttttaatacagtgacaataggaaagccacaaagtaaagacacacaggacagcagggaggacagggctacttaaggagctttgccactttcagactgggcaccacaatctcctggaagatgggcacatagttggggctcgcttgcatggggccctgctccagtgtctccatgatggtctgcttcatgtcccggctggcgtctcctcgcagtgccagcagcgcaccacctcgtgccg

SEQ ID NO: 1634 - DNA, 399 bp, Rattus norvegicus
  Genbank Accession No. AI045774
tttttttttttttttttgaaagtgggacaggagctttttattgatttggaagtgggttcctcagtgacgtccctttaggtttaaggtcatgtttctgcttcctttcttcctgcagtttctgctgcctgagcttccatgcctgtaatcctgcatccatttcctgtgtcagcagcacaactcgtcttgcaagcttctccctttgagcttctcttcgaagttggcctttcattgggggagcagggcggccatccgcgaaagaccagtcaggaagctccgtgaggggcccatagccggaaggattggcagccagcccttgctggagtcgccactggctgccggcccgcgccactgcactactgtgcaacctccggacacctatggatagccaggtccctaagg

SEQ ID NO: 1635 - DNA, 153 bp, Rattus norvegicus
  Genbank Accession No. AI045827
tttttttttttttttttccaaaaatagagaactttattgtggggccacatgaaaagggctggggtaggggatgtggggccagcccccgaggcctggggatgaggaaaaagttaatacacagtacatatagaaggcacaagtggggaattggag

SEQ ID NO: 1636 - DNA, 438 bp, Rattus norvegicus
  Genbank Accession No. AI045850
tttttttttttttttttgaaattcaaaaacatttattccaaaatattttctagcttaaaacacttagaacatttcatttgaaatataatccccaaatcttttccctctcctacaaaagtgtataaggattaatcttccagtcctgagccaggagggcataaattccctttcctttagtttaatttggcatgctactaaaacgttagatgtgctaaatccatgataaaaatggttttgatgtttggaaaaaaacattattttatgtattcaagaaggtcaaacaagtccaagtagcacaaatgtagatttatgccccaaaacatcacaggaagaatgctaaagggcaatgagaattcaaaaagttacaggagaaaaatgatgacctgtcactcagaagggaacgtaaccgataacaccataccagaactgtggatccta

SEQ ID NO: 1637 - DNA, 414 bp, Rattus norvegicus
  Genbank Accession No. AI045871
tttttttttttttttttgcttttaacctttaatagataaacaacaaagtgatctggtttaaatacatattgagcaatgtcgtatttagaacaaagagctgctcagaacggttagggaaaacagacatgtcaacaaaaagaagacatttaacatttcaggctgtgtgtgtcaaaatgtcttccgattattattcccctacgaagaagcttcaaaaaccagttagttggttagaacttcacatattaaatcatacacgactggtgaaagaggaagaatttcagagattacctaagaggaatgagttaaacagtgcaaatactgagctgcttcctggaaatctcaccatgtgctttcctttcccctacaagaaatactgtaaagttgtctccagttttagcctcgtgccgaattctt

SEQ ID NO: 1638 - DNA, 453 bp, Rattus norvegicus
  Genbank Accession No. AI045908
tttttttttttttttttaagtattctcccatttatatcaaaccagtgactaaatacattataaaattaatacagaggtttctagttcagacttcaggccaaatttaatagtctcttcacagactctttgtactgagcaaggcttgcctcgttctccccctcattcttgagacgaacgacacacttctggtaatcttcgacctctttagtccccagcagctcttctctgctcggcgccacactgctctcggcagctctcatctgcagcagggtctggaggacgctgttctccgaggagctcttcgcccacacatactcatccatgtcttcctcagtcttatttttttcccattcttcagttttccaagattcatggtacaggactgtaaggagatacattgcatagtcatagttctgccgcttcaaagggcatctgtcagtcttcctcgtgccg

SEQ ID NO: 1639 - DNA, 366 bp, Rattus norvegicus
  Genbank Accession No. AI045965
tttttttttttttttttctctttgtctttttcccgaggttccttgcgtttccgttcactattcccaggctgttttatacttgatggagaggcttgcgctggctggccctgctgggcctgcgtggaaggggtggtggtggccacagcagcctgagcctgctcctgctcctggtagtactgagaggcccgtcggtcctcctcttcctggagtttctttgccaactccaagtcactgattccttctgggatttgctcccagttgatgtcttggctctgctgttcttgttgcagtgacagtgccataaggtagtcttgatctatttggtcttgttgacctttgtttcggcacgaggcctcgtgccgaatt

SEQ ID NO: 1640 - DNA, 172 bp, Rattus norvegicus
  Genbank Accession No. AI058340
tttttttttttttttttatatataaatttttattttaccttaaaaatgttttgttcagctgtttcattatcattgttaacatgctaccacggggctaaatccatgaattccagaaagggggcggttgggggggtattacccaaaccttgggattctaagtggaatcactgaa

SEQ ID NO: 1641 - DNA, 471 bp, Rattus norvegicus
  Genbank Accession No. AI058348
tttttttttttttttttcctgtctcagcgtttaatgttcacctctctgaaagcaacataggttttggtaaagatagattaattctaatttaacatgttttgaacagggaatttggctgagcacatcgatcccccaacatcgactgtgactgtaaaggaacagagtatcagatcagcaaatctattgcacttggtgaaaaaaggaaatccttcctttgtctcccagctgcagaaggcaatgtgtctcactggctgtgcaagctcttctcactcaagcccaggtctctatgttcagatatagtacatccatgactgtgtctttccagccttcggaaggctcacaaaacgccactccagtagctgcgtctccaggttttgagtctagaaatgaatttaaggtgtgatctaatcacagtcaacaacttgatcgtactgacttccacacgtcatgaatatgttcatcacaaagagc

SEQ ID NO: 1642 - DNA, 431 bp, Rattus norvegicus
  Genbank Accession No. AI058359
  misc_feature (1)..(431): n = a or c or g or t
tttttttttttttttttgctcagccaacagcagcagcacgttttattgcaaccagaatcccctggtcatgtgaggaagggacagaacaggacacaagacaggagatagcatgctttatggaccagcacacacagaccggtgggaagcatacccaatgatgctgacatggagggtagttggagaggaggcgggctccattttagcagagtcttccccacaagggacctgagggaaagggggcagttgacagtgcgggtcaaatgaccaaagagactcagcagtctctagggcaacttctgcatgggtcncctgtggatgttgttagatgaaaacaaagatatactctgtccattgagagtanggaaaacaaaggctcaaaatgacagtcactggccagcacccataggtgtgacctgagaccctgactccta

SEQ ID NO: 1643 - DNA, 327 bp, Rattus norvegicus
  Genbank Accession No. AI058365
tttttttttttttttttgagttttcaaagaagagatttttagttttttaattgtgtatacttttgtggctgtggacacaagtgaggtgcgcatgaaatcaggacaagacttcagatcccatggagccgcaggcacaggaggttgtgaggcacccaaaggggttctgggaaatgaactggggtcctcttggagagcagtgtgccacctttacaaagatctctctctctctctctctctctctctctctctctctctctctctctctgatgactatgaaacatggttttctgttctaaacagaaacatttgcccgtgggacccttcctt

SEQ ID NO: 1644 - DNA, 410 bp, Rattus norvegicus
  Genbank Accession No. AI058382
tttttttttttttttttcaaagcacaatttcattatgaatggaggtgactctgccggtgccactgccatcgctcagccccctccaccacatggcgcagagtagatgagattcccagcagcatatggcccaggccttgcagcagtgaggaagtccaacgaaggagctccctgagtacttttttagggccaactccttgaaaatcgcagctcatggagtagagcccgtacaatgtagctttcacgttgaggctgccgaagaggtctcgaggattttgtttatacacatcaaaggtgatgcgggcgatgtccttgctatgttttggcttctcccgtcctaggccgtatgacaacatcccactctttgggctccagctctgtccctgctctagagccatcaagcatgtgtcatc

SEQ ID NO: 1645 - DNA, 345 bp, Rattus norvegicus
  Genbank Accession No. AI058399
tttttttttttttttttgcatgggtcgcatctggaccactggagagctcttgacacctttattggggtgactcagatgacagggtcagacggagatctgcctgcaacaccccctgccccctggaagtcctatgactggtggaagatgcctttgcaagctgattcaggtgctactcctttgtgaagtcccatggctgctcaagaaaaaatcctgaagcaagcccacagagtaagagaacccagcagctcctgtgaggattactccataccccggtctggtaggagtcaaggggcttccgggcgtccaacatccattggaagatagcccttggtcctgtgcatcctg

SEQ ID NO: 1646 - DNA, 317 bp, Rattus norvegicus
  Genbank Accession No. AI058416
tttttttttttttttttcaagtggcaagggttttctttagaggcatattaaggaatttcacaacactaggaaaaaaaaatacaaatcatcccaaaaatcggcattggccccaaatacggttgaagaaattagataagaatacgtgtggatcgttaacagctagttaaataaatcaagttaaagtcttgcccttcaaattaaagtgccccattaaaaccgatgtcccaaaccttcagggtgataagaacatacacggattctccattggtaaccaccactatccccaccctatccacttcacgggccaacggtttgcc

SEQ ID NO: 1647 - DNA, 467 bp, Rattus norvegicus
  Genbank Accession No. AI058430
tttttttttttttttttataaaacttgataaaaaatagtatttcaaactgtacagtcaccagaagtacacagttatcaaaaacgcacacacgtcacttggcatctccagcaccgtccgctttctgtgcctggtctgttttggcatctccgttttctgcaggattattcgcatccttaccagcatccgctttccccttcttccccttgggtaccttctctcccttctttgcaggggcctttttaggcttgggctctggctttggaggagcaggtttagcagacaaccttgcagatcttctctgtggctcgtccttcaccttggctttgtctcctttagcatccccttcagcatttcttttgggcatggcggcggcaggggacgtcggcgctgagcacgggtttacagcggcgcacgggtttggtccgtccgggggtcgtcctcgctgcttcttcctcgtgccgaattc

SEQ ID NO: 1648 - DNA, 420 bp, Rattus norvegicus
  Genbank Accession No. AI058492
tttttttttttttttttcccttcccctgcctagggctcagggtcagcagtcacaggagaggctgagtcatgacccctgcccctcaccgcaaaggcatgagattttattgtcagcttggccactcagctgatttagctggcgcaggacagagggaacgcaacagggaatggggaggggtatctaagggaagtgtttgaagccgatcagtccaccagatccggaagctgccgggaaatgggggtgggggtagggggcttaaacgctccaaggctgagaggaggggcagcagtagcacccagaggcgccagggaactgtcccccgggagacggcactctcgggaagtttctcactggttgctcacagtaggaccggtgctcgaaacgccctcccaggccggaccagcttcccgatacagattg

SEQ ID NO: 1649 - DNA, 376 bp, Rattus norvegicus
  Genbank Accession No. AI058603
tttttttttttttttttgctttgttcaactttatttttctttcaagacagattggactagtaagtcgagtgatagttggtgaaaattctagaaagcaacaagaggatcaggaaggagatggagcatcgagacatggacggtgaagaataggatcatgggtattcgttagctttcttctttctctgttgacaaggcagctccagttacatgttattagggagcctgactttgtagcagaatgggaaagaagggacttaagagtgagtccagggttaagcatgtgctatggaaggattgtttgattcagccataggcccatgaaggagagacactgcctgccaccccatcccagcccaagttcctttacagctactca

SEQ ID NO: 1650 - DNA, 401 bp, Rattus norvegicus
  Genbank Accession No. AI058639
tttttttttttttttttgagggaaatataaatggggttggagaagggaaacagggtgtgggtgtggtcacatttcattgtatgcgtgtaagaaattctcaagaataaagaaaaatgtaaagtcccaaggaacgagaggccatcttccagtggtaactgtgacaggatttgactgcttggcagccatcgtaatcgaagtcatcagctacttcatgatctggttaaaccacatggagtatctcgggactgaggtgaggaggagcatgtgtgattgccctggtggtggcggcgagcttaggatccctgtgaggaaccaggtgcccttgtgctggcgggtcaccacacttccttccacccaaggccccatcacttcactgcccttctcacagcttgtcctcgtag

SEQ ID NO: 1651 - DNA, 414 bp, Rattus norvegicus
  Genbank Accession No. AI058665
tttttttttttttttttcctgagagtgttcttttattttttaagatttatgattttattcttaattgtgtgtatatgtacatttgtgtgtgggtatgtgcatgtgagaatcatgtgagaatcgttgcccaagatggccagaggcactggatctcctggagcaggagtcacaggcagttgggagccacctgacatgggtggtgggacccaaactttggttccctgacagcactacacactccaacctctgacccctctctccagcccatggtgggttcagatgaggcagcctgcctttccagtgctgcacttccagttcctcccacacccagtcagcctgggctcgccgtgatcgcattgtcctgtgctcggtcacttctgttacttttcatgcacagagtacagtcctgctgtt

SEQ ID NO: 1652 - DNA, 419 bp, Rattus norvegicus
  Genbank Accession No. AI058674
tttttttttttttttttaaagaacggtaattttatacctggggtggagaggaggggcagaatgttaaataaataattctcaatcatttccattaaaaacacctctatacttgaatgcaaataagcctggcccatgttgtaggtggattcttaagtggtgatggggaacagcacagggcacaggtatcatatatttagtgaggtgacagtaccttctgttcccaaagaaaagggcctaacaggcatatctgtgtgttagtgacttccacctcgaagtactgagaaggccactacgatacagggatcccacacctacagccaaggtcaaggctaccatgtacatgaactgaagggcaaacatagggagacggactgagacctggacaggtcctcaggacaggcggcagcctcgtgccgaat

SEQ ID NO: 1653 - DNA, 165 bp, Rattus norvegicus
  Genbank Accession No. AI058715
tttttttttttttttttccttccttccttcctttctttgagaaaagggtctctttctgaaactttgtttcagattggctggccaggacccctagaatccatttggtttgcctcctcctaggatttacagctgtatacctctaggtctgtgaacatggacactggg

SEQ ID NO: 1654 - DNA, 346 bp, Rattus norvegicus
  Genbank Accession No. AI058746
tttttttttttttttttacattattgactcagtgtaatggcttaaaaaacaaggttcctcaaggactgccaggggcccaggcatagtcacatcctttgtgaagagcggaaggaaaaggaggtgaccgaaaattaagttaggggagatgaaaacttcctgggaagagaagaggaagggtaaagtgctgtgttaggagccaagcgacaggagaccctgaggccagtgatgtcatcccagaaacaacatggtgacagaagtttaaaatctttaagccacgactttgaaggactagtgcagcagagcgagcacctatgctgagcatgacagcctttgctaccccagcaca

SEQ ID NO: 1655 - DNA, 342 bp, Rattus norvegicus
  Genbank Accession No. AI058759
tttttttttttttttttgaaccatctgcaactttattctggagcagaaataagtcattttctaacaataaatataaaaaaaaataataataagttaaggttccaaaaacaaaaacaaaaaccacccaataacacagatctgtaacactgacagcgacagttgtccaaaggggctaaaaacggggtggctgggtggtaagtctcctacaagtcggccaggcctcagcccgggaatgtctgttgcagggtatcctctgtccccagccctggcaaggtccctgccacacactcattctttccacaagtataaaatatatatttaaaaaaaacctcaacacagcca

SEQ ID NO: 1656 - DNA, 340 bp, Rattus norvegicus
  Genbank Accession No. AI058762
tttttttttttttttttaagctaaagaacagattttattgttttcccaaaacactaaaatagcccatggcatagtaatttaggacacaatataaatgacatatacagtcaggttcccaccccccccccatggctatttttaactgtcttggggaggaggctttaaaatgtccactcattcagtgacctttattaaagttatcaacaaaccacaaagggagagttacttgggcggaggggggggggggtcttaatgtaaaagaaatcacaagtcctgggtctgggtaaaggaaaatacttcatttgcgatctatgttctgtccgcagaaaaatctcaaact

SEQ ID NO: 1657 - DNA, 206 bp, Rattus norvegicus
  Genbank Accession No. AI058772
tttttttttttttttttccatgctgcatttgctacctgccatcattcctggctcactgcatccgcctgctttccccagtatgtgaaaggaacctgcggacatggtacatggtgctcccatcgccatgatgaggaagacaaggaggaggcctaccttcctgcatactcccttcctcctcccctcgtccgtagaggctgatctcacat

SEQ ID NO: 1658 - DNA, 188 bp, Rattus norvegicus
  Genbank Accession No. AI058796
tttttttttttttttttgggagaagttaggaagtgctttactgatgagatctgctagagtgtgaatctagaggtgactcggccatatgtgccaggaggaggtgacccggtcagttacaatctatatttgtctgacagcaagcaccataggtggcttcctgtcaagcagagaccctagcctgcttccga

SEQ ID NO: 1659 - DNA, 174 bp, Rattus norvegicus
  Genbank Accession No. AI058851
tttttttttttttttttagacaggatctcacatatccctgagcttctattcctcctgcctccaccttccaagttctaggttgctaggtgttacctcttagtactgggaacaaatgagttaggaggactgtaggtctgagagcagtgacagctctatagtgagttacaggccagg

SEQ ID NO: 1660 - DNA, 466 bp, Rattus norvegicus
  Genbank Accession No. AI058859
tttttttttttttttttgcttcagataaatttttattccttgtaccatgttatatagcacaacatgcatctcggagagataacaaataaacaacggtatcaataaatagcttagtatcccttttcaacttcacactatacataaacactttctcaaggaggttccagagtttctatgctcttgacatgtgtttgatttccactggccatttgccttagttgtagaaaatcttcacatttaacagaagtgtataaaacaagtaacaaactaccaatcagggcaactaggcagactgacatggtcaaataccctgatccaacgtaaggtctaagttgagtcaccacagcacatccgccagtcaacggttgacgtaagtctcttaggaaaggccattggttttcgaattatgttctctgagactaggatctgagtgctttctttcttcagggaaaagaacgaacgttta

SEQ ID NO: 1661 - DNA, 403 bp, Rattus norvegicus
  Genbank Accession No. AI058863
  misc_feature (1)..(403): n = a or c or g or t
tttttttttttttttttcactggggtcctcctatgttctcccaagggcaagtctgctgtgaaccaaactgtaggcagatgtcaagacggtcacatacacagctcttcaggggtggcagtaaggggtgaaaaggaaagagatggtatccaagagagccacgtgggactgagaaccacttctccatgggcacagggaaggaatggctttcctgacggaggaacaacctgggcaaaagcccaggcattaactgttcaggctgggacgcagagtgtgagagcagaccaggccaaggtanggagagacctgactgcaggtgaggagatggcgtgtcctgaagcctctactgccctcccaaagcaggtccttagacaagagatgcggctctggagtcctaatccaagac

SEQ ID NO: 1662 - DNA, 154 bp, Rattus norvegicus
  Genbank Accession No. AI058911
tttttttttttttttttaagctttccactaaagatttaataccagattgctgtactacagtgtgcgggcggattttaatattgaatgtgttggtcttttaatttgtctcagttcagctgacgcttccttaggtggtctgctggagcatcatttt

SEQ ID NO: 1663 - DNA, 444 bp, Rattus norvegicus
  Genbank Accession No. AI058913
  misc_feature (1)..(444): n = a or c or g or t
tttttttttttttttttaactgcttggctgttttattacagtcagtacaaaagtaactgtacagatctgaggtgtaagaacggagatgaggcagaggggctcccaggatctgagactgtaccccaaagtcagaaagttccctagtctggagcctagagcaaggtcncagtttgtacatatgtgcttgggctgcctgtatgctccaggatgtctgctaagcgtgctgcccccgtggggggcatcggggttgcctgcctgggcctgaagagacgagagagaaggctgggtcctaaaaacggcctagcacggtggcaaccagagccatgcggatgtacatgccgttctcagcttggcggaaataggctgctctggggtccgagtccacctccacgcttatctcattgacacgaagcattgggtgcatcaccaccatctttttcttgg

SEQ ID NO: 1664 - DNA, 412 bp, Rattus norvegicus
  Genbank Accession No. AI058933
  misc_feature (1)..(412): n = a or c or g or t
tttttttttttttttctctcttttcttttcttttctggcattaaaaagcctacttctttgaaactctggtatatactgaagacagacagacatccagccacatagactgaaccacactggattcttcaactttccgttggtagacagccactgttagtgagacattctagtaaatccgctctcaacatgcatacagagattcatcctatcagttctgttcattaatagaatctccagtaatatagccgtgtgtacatgcgtggtttttgttttgtttttccacctttccactgaggaagatgagccaaacaacaactgtgctccagagtgtttgtcctctgtttccttctcncaggcttgtctcagacccaccaagtgagaagtagctgcagtcaacccgaacccagaatga

SEQ ID NO: 1665 - DNA, 416 bp, Rattus norvegicus
  Genbank Accession No. AI058960
tttttttttttttttttaagggtttttcttttgttttattgacatagcatctcatgtaaacccaaggctgaatgaatttttatacagggtttcactatgtagccatggctaacctacaacacagataattggcctgtctttacttcccttggactaggattaaagtcctgtgccaccttgcctggcgccaaagctgactttgaacttctgatctcttgcttcacttcccaggtgctaggcagacattctatcaagagagccatgtccgtagccacacttgatgttggtgttttggtgggttgttttgtcttttatactttattttgtatataagcctgcgtgtgtgctttacaagtcatggtaagtgggtgaggccagaggacaaacaagaaaatctgtctcttcttctaccatgt

SEQ ID NO: 1666 - DNA, 430 bp, Rattus norvegicus
  Genbank Accession No. AI058964
tttttttttttttttttaaaatgaattctttttattgcaaacaaacgtctaaattactttctccacgcactttctttagaaagaaaaagaaatcagcaagctaaggagatatccattcaagaactgacatgattaacacttaagatataaatgggtgactcacaatttcattagcttacaaagatggtggagttaactactacaagcacactactaatacagtattttgtgggagaagggcatacagacatagctaacttcatatacatcccattagacaactggatttacaacaaattttttagcaacaaaatgggcaaagccagctttcttttcagaatcagaatgcacagcaaatggaaaattttgtggtatttaaccttcacaagtttgagcctccacatataatgcaaccaagtttacattttta

SEQ ID NO: 1667 - DNA, 453 bp, Rattus norvegicus
  Genbank Accession No. AI059048
tttttttttttttttttatataacttggtaaaatttcatttcttctagattccaaaagtacctacaaaacccatgcaaattttaccatttttaatatactatggaatatcatacaaagtaaggcatttcagtgtcatgtataaccaagttactgtcaatccaaaaatttttgcacatcaataaaaagatatctaagaacttaggaacaatattcttctcactactgtataaaaataaccacaatgaataagtatttgtgtaatatttactccattgtctcatttccagaaactgtgacaagctgtaaaggtatttcagtgttggtaaggatgtcttgattgctggtggcagaagcattgacagttcctatccctgacacagacccctgttgaatatttgcaaggataagtgttgttcctcctgcagtaatcaaggcatcatctctcccagctt

SEQ ID NO: 1668 - DNA, 337 bp, Rattus norvegicus
  Genbank Accession No. AI059095
tttttttttttttttttgggtgtggtaaacagtgtttattggtccctcctcatgtaatccacacttaccaaggcctaggtctcaagacgctgactgtgacttctgcctttattcctccgctacaattctatccaggctcacgtgtttcacaagctcagggtggggcgccatcatatcacatgtatgtctgttactcctgccattttacaatgcacccagcccacacaagtgtactggacagagctgcttcttctatgagcagagggaacaaagtgtctcgttggcacctgaaaacgcccactcgcagagcctggagcagtgggcagccctggagagt

SEQ ID NO: 1669 - DNA, 395 bp, Rattus norvegicus
  Genbank Accession No. AI059103
tttttttttttttttttggcttcagagtcccacaaaaggtgctcccttcccctcccttttatacaagtttcttgttcatattgtgaatagagacatttctcaacaagttttctggaacatttttctacttgtattccaaagcatgtaatatatacataaaaaatgatttgataactgctactctgtcatttgtatcattagaaatgaagtttggggaaaatttttttggaaaaaaagaagacacaagttaaaaaaaataacttattcctttttgcatatttgtatagcctcccgaaattggaaatcgccttttgcatattctttcactgttttgactttttgagacctattaaattttttttatgtagggcaataaacttatggtgtgctattga

SEQ ID NO: 1670 - DNA, 384 bp, Rattus norvegicus
  Genbank Accession No. AI059174
tttttttttttttttttgctggagaacaatggaaagagaggtttattttggctcgtgatttcagagggttcagtccatggttgctcccagaacatctttgtggccagggtggatggaagagaagctcctttacctcggaaagctcaggcagataagcaggcaggttggggcccagtggccaaaagctgtccatagcaagctcctcattcaaacaggaaacaccagtgaggccagacagggtggcaggctgtgatcagcagttcggtgatgccagggaatttatacccggattctccaccgatcaccggagtccataatgtgactagcatcccgactcctgctagctccagaccgaccacttgattctggcagagagttgttgag

SEQ ID NO: 1671 - DNA, 450 bp, Rattus norvegicus
  Genbank Accession No. AI059234
  misc_feature (1)..(450): n = a or c or g or t
tttttttttttttttttcacaacatacaaagaatttatttatgtaatacagacctttgctcaaatattttcacagaattccatacagcaatctactagaaaaagtagagttatatgacaccaaaataacattgtttcttggtacaaattactaatcaaaaacaaggtagagatagtctcataacaaatagggggaaggtgggtgctgcttacatggtacctgtttgtttgcctctggtcttgagccaaggctgtgggtgtggggttgggggggtcgtanggagcagccccaccggctctgcctctggtgagcttgggcaggcttcggtacttacagagactgtgagcccagagcgtttctgtcatttcaccctgtgcctcgaggacgacagagcagggaaagagagtactgatgaatgctgtaacttagatctttgcctcgtgccgaatt

SEQ ID NO: 1672 - DNA, 209 bp, Rattus norvegicus
  Genbank Accession No. AI059246
ttttttttttttttattgatttgtttatttttattttttttttttgcccaaatccacatttattcgaacctaacagccgaattacagcttgaggtgtggaatcggctataaacaagacttcgaatgattttaactactgactgatggcggatggaccattcaattgtgtgtggtgccatctatgggctggcagtcctagattctacaag

SEQ ID NO: 1673 - DNA, 404 bp, Rattus norvegicus
  Genbank Accession No. AI059258
  misc_feature (1)..(404): n = a or c or g or t
cggccgccagtcagctgcaggctctgaatgtcnccttcatgctggtggacatgaaggactccttccaccacaatgtggcagccctccgggcctccgtggagagcggtgagtagctgctttgccagcatggtcttgtttgttgtggggtatgatgtcagggctggggctgttttctctatattanggcaagttgctccaggcattgggttcattccggagaagttcaagctgctggtcttaagcatcttccatagagtaagagcttaggttcttctgaggaccagacggccacttcccgacagagcagacactggggatacccactggcctggctgtggccaagagcatccttgtgactggggaaagctttcggccctgttctactcagtgacatcttccgggtc

SEQ ID NO: 1674 - DNA, 324 bp, Rattus norvegicus
  Genbank Accession No. AI059270
tttttttttttttttttgcctttggataagtttttattgttgacaatagctttcgagaatacccttttcactaccatccgattgtcactctgtaaataaacacataccccatgctacatattggaagggctaagtttagtcctaagcggatatcaaatatgaatctgccatccactgcagcacgctggatgctaacacgctgaatacagttaacatttaaacagacttacttcttcctgtaatttaaattcagaaggatctgctgcaacagccatgaagtaaagcagtcttctaaattcttccctattttgggaatccagaagc

SEQ ID NO: 1675 - DNA, 202 bp, Rattus norvegicus
  Genbank Accession No. AI059277
tttttttttttttttatgatttcaacattttccttgctggcttttaatttcctgtttcacagattcctggacttatacattcgtaggtatacagcacagagttagagtctgaggaactcgtggcctcaagactggggaccacgaggtcctagacaggagacaatgaatggggatgctggcactacatctcctaaaaagacag

SEQ ID NO: 1676 - DNA, 421 bp, Rattus norvegicus
  Genbank Accession No. AI059337
  misc_feature (1)..(421): n = a or c or g or t
tttttttttttttgtttgttctttcactgctgtgactagtgagcctgagtggaagaagacatttccttttaccatctatattgccagtgcgggaggaggagtgagaccttgactaggtagctggtaccactgctgcgatctagctgttcagctaccctgctcaggcccaatatggtggctttacagtttctgtcaggcaaaacagccaagccattctggtttgaaggtttgtttcatcttgtcatcaagcccatgtgactcaggggcttcccaggaggtaggacatttcctatggaaactggnacaatcgagacacaccagcgtgaggtgtcaccctaatggcagcttgtgctttagaaatgtgacctttcactcagaggacacacctgatacacactggtgggcgggtcctcactcccag

SEQ ID NO: 1677 - DNA, 177 bp, Rattus norvegicus
  Genbank Accession No. AI059340
tttttttttttttttttgcaatcaaaataaggaaaagaaatatcttacaagttaccatgaacatatatattaaagtgacaggggaggagagaaataaaaataaaaaagttacaatctgtacagagaggaattaccatggacaaccaaaaaaaaaaaaaaatcccctttcttttggga

SEQ ID NO: 1678 - DNA, 206 bp, Rattus norvegicus
  Genbank Accession No. AI059378
tttttttttttttttttaaccaacaattttatttctttactctggtcttttataccttcttagataaaaaaaattctttagaaagttacctcagagataaaatgttacataaaatgggagttacagaaggatgttgatattaagttcaaagcagtgtttcattaaaatatactcatcaaaagttcaaagtaacagttttttgatgg

SEQ ID NO: 1679 - DNA, 243 bp, Rattus norvegicus
  Genbank Accession No. AI059386
  misc_feature (1)..(243): n = a or c or g or t
tttttttttttttttttacaggtgaaataaatttttattgatcagtataaaatatttcaacacacaatgtcttacatttgatattgtcttcagtctggtgactgtttccttgcaatagttgggatagaatctgaggcctcagacatgacaggcaggtcctccactactaaactatgccccagacccgaggggttctangcaagtgctctcctattgaaacatggccacagctcctcagtggta

SEQ ID NO: 1680 - DNA, 433 bp, Rattus norvegicus
  Genbank Accession No. AI059408
tttttttttttttttttaacatttacaccctttaattaaatcacactgttaccttataaaaatgtgaggctccacatttgctttttaaaaaaacaaaacaaaacaaaaaacaacagagcattggatggtttcaaatacagttactggaccaatagttaagatgagtctaaatgaaatatatgcagaactggtaacacaccaggctttccttttgctggctgagacaggctcgcaccatgcggctcaggctggcctctaatttccaatcctcctatgccagcctcctgagttccggaattagaagtgcacgtaccacactcagcttagaggctttcttttagataacatttattcaaatgatgaggtcataaattcaaatggaataacaacaaaatcttaataaacaaggaatgggagaaataaaaatttgttt

SEQ ID NO: 1681 - DNA, 325 bp, Rattus norvegicus
  Genbank Accession No. AI059434
tttttttttttttttttcaacttttttccctctgagtcagatagggatagtttattgagcatacgccccaggactggttgaggccgaaaagcacagcctacggttttaaacggcttcttctttgctttcggcttttaaattacacattgcaaagtcaccaaggagaaagctttaagaaaactttcatttgcaagggtacagcaagctggtcttcctttgcctcgaatatgttcgcgggctcattgttgtacgggttggaaatgatttcggattggtcactacaccacttcaatccacccagaaagctgtcggtgtccaggtcatt

SEQ ID NO: 1682 - DNA, 425 bp, Rattus norvegicus
  Genbank Accession No. AI059477
tttttttttttttttttgcaatcagcaagaggatttggtttattgtcgggatacacaggcacaggcacctgcgggcgctacagtcactcgggggactggcgcaccccacgggaccaaggatgggcttttataggattttggggatcagaagcatgcatacagaagcagatgcatggttacagggatataattggtggattctaatatggcaagggtttagcccgggggcaagtttcctagctaccttcctgaaacataacggctgactcggccccccaagggttcagcccgggggcaagtttcttagctacctttttggaacataacgactgactcggtcccccaccacggtgtgggacctctcccggggctttttttcattgtcaggtgttcaaccgaagtcgtccttttgccaggccttcaac

SEQ ID NO: 1683 - DNA, 532 bp, Rattus norvegicus
  Genbank Accession No. AI059511
tttttttttttttttttcaggcagtcacatcagcttcttttattctgaaaagtcactacataataaaaactctataaaacccggcataaatatcgagttacaaaagcaacgcaggtagggaaagcttactataaaaaagcagaagaggtcaaaaggatataggtgttcttgtcgacttgtgtggccttagtacagtcgccctctgttgctcctccactctccacataatccgtgggactggggctaagggagcataggtccaggaacaagccgctgaagcacagcctgtcctctcattttttgtttgcttcaaaaataggatgcccagcctggcattgccaagaggcatggcttcagggccagccactctggatttatgtcctagcatcactggctgcatgacattgcttctctggccctgtctcttccttcataaagtgaagccagtcagtgcacagggtagtggggtaagccctgtgtggttctccagtgcaaacagagtcagctaggagttcgtagcgtgttctcctga

SEQ ID NO: 1684 - DNA, 472 bp, Rattus norvegicus
  Genbank Accession No. AI059519
tttttttttttttttttcctggtgaccttcaatgatcaattttattataaagaacagtatcaaaatatacaaatctgcttatgaaccaccaagaaatgcagctttttaaagggccaagtgagtatcagctttttcagagtaggcagcttctccctctgaggtcttcctggagaaatggggttgatgtccatgggccacattttctatatatcctctcaataacttaaagggtgagtctggcttctgaatccagatgtctatcacaaatcctcatgggagagtggctgtgtggggttttcctctgtgacttcgctttgtgctgtctgcacacaagcgtcttctgtctcctcaaagccatccggacacacgcacacaaagctccctggaacattgtagcagttttcgtttcttctcttacaggctttttcttctagtgagcattcatctatgtctgcacactgtccactctgct

SEQ ID NO: 1685 - DNA, 299 bp, Rattus norvegicus
  Genbank Accession No. AI059549
  misc_feature (1)..(299): n = a or c or g or t
tttttttttttttttttggccaaaaaacttgtttttattattaaaccttgtagtacaaacctgaaaagtaaacaaagaacgggcaatcaaccacacagaacctccctgcgggagggtgcagagcagcgctaataaattaaatgtcaaactgtaagccataggcgagagtttactgtcaaagaggaaaagtacacagcaaggccatangaactggacaaccacattgggaaacactcgactgttaggtgatcgttaaatattccaacagttcagtcttctgcaacaaccaccacccacgt

SEQ ID NO: 1686 - DNA, 456 bp, Rattus norvegicus
  Genbank Accession No. AI059568
tttttttttttttttgtatgtaaaagacaagataaaattgcttattttgctaaggctgtgagtacgcgattggacagacggagacaataacaatgaagcaacgtgactaagacaatgaggcaaagagactgagacaatgacagccctgaacaatcctggctgggcatcctccaggagccccggcagaattccctcggagtccaggcggcctgcagagaaaaaaaaagcctcatttcaatgatccgcccgagaggcgagcgatggtaccccgcgggtgcgagcgatgataccccaagggtgcgagcgatgatacgccgacaatacagactccagcttgcaaaataattggcacgaattttatctcagctttcacaggcccgattgacactggctcctatgcatttccaagtttctttctttctttttttttttttcttttttcttttcgttttgttt

SEQ ID NO: 1687 - DNA, 406 bp, Rattus norvegicus
  Genbank Accession No. AI059574
tttttttttttttttttggttaaaaactttattagctttctgtttctcataatcatacatatctttaaggagttaacatgacagatcagatcagagcctggccaccagtacacagtgatagaattcagcatttggtgactctaatgacacgagatcacataaatcacccccagcagagttcccattccttttcctaaacatggcagccaagcaccattgtgcatcatttctggtcccatggtaacttacagatcagacccactcctctgtcttactccatgttagcgcatagccaaaggtgtaaaaaggcagcaggtagacaaacattatgaaacgctgcggtctaagtactatagtaaactcttcttcctcaggaaaagccaacagagaatatgaggcgagctca

SEQ ID NO: 1688 - DNA, 374 bp, Rattus norvegicus
  Genbank Accession No. AI059604
tttttttttttttttttaattttaaatctgaatttatgttttgaaataaaaatgcaagatatctgacttttataaaattgtcacatgggaacacattttaaaataccaccacatgctgtatttacttagaaaagagttaacagtaaatccagtctaaacaagaacctactatcagttataatgtgagttccttcctttctttgtgcaataaggaggcttatgggaaatgctggccccacagggagagccagcgatgactcagcacctccatgattaaggaagcctggagcacagacgccctgatggggaggaggggtggactccagtctgcagctcctccacatgggctgcagggcctattgccggatgctttc

SEQ ID NO: 1689 - DNA, 435 bp, Rattus norvegicus
  Genbank Accession No. AI059622
tttttttttttttttttatttttactatttatttattgattttatgtatctgagtgctcaatttgcacatataactgcatggcagaagaggacatcagatcccattacagatggttgagagctaccatgagggtgctgggaattaagtttaggaaatctgggggaacagccagtgctcttacctgtttagccccagatttattatccaagaatgtacgacagacacatatgggggaaattaagtgcacacatgcctttaatcccaagaggcaaagccaggtggctctgagtttgaggccaacctgatctacagagtgagttccaggacagccagaagtacacacagaaagcctgttttggaaaacaaaacaaagtgattctggagcagtggttctcagccttcccaaagctgcaacactttcacacagctcttta

SEQ ID NO: 1690 - DNA, 454 bp, Rattus norvegicus
  Genbank Accession No. AI059662
tttttttttttttttttaataatgaaataatttatttgttaatggacggacacataactgtacacacagcaaggagtctctaaatcatgatggcttctaaaaacacatgtgctaactgcagcccctcccccccaaagcaccgttctccacagtctcagaagtggttcacattggcaccatatttacataaagaaacatctggaaacacgcttcccactcttcacctgtggctctcctgtggaggctgtcacccttagaaagagggtcccccaaactagccactcgcagcaacatgacagagcaccaattctagggacagcagttgaggcaagcttggcttttagatcaaagctaaaatgcagaatgccctcttcaacccactgtcctcctagacagagtaagaactcagaggaagaaatccagatacttctcagcacagatcgcctccctgatt

SEQ ID NO: 1691 - DNA, 316 bp, Rattus norvegicus
  Genbank Accession No. AI059664
tttttttttttttttttgaggaaaactttcttttttcttaatgtggtactgaggatggaacataagacccacacatgctatacagtactgctaggcagtacagacccacacatgctatacagtactgcttgctaggcagtacagacccacacatgctatacagtactgctaggcagtacagacccacacatgctatacagtactgctaggcagtacagacccacacatgctatacagtactgcttgctaggcagtacagacccacacatgctatacagtactgctaggcagtacagacccacacatgctatacagt

SEQ ID NO: 1692 - DNA, 366 bp, Rattus norvegicus
  Genbank Accession No. AI059681
tttttttttttttttttgaagaatcagcgtcagttggtgccatgcttttattcaaatgaaaggggaactaaccgtaccgggaacgagcaagcctgacagcacggatcatctgcagcgctcaggagtggacaggaagcacaccacacactgcacattgcccaacagtgtccatgagtcacatcaaagaaggggactttggcttaagcagccaaataaaaactacaatagttctcctaaaacaaaacagagaaactgagaggaaaactttagaagttgtggtaagtagcagaagttgacaggccacactggttaccatgacaatgatttggcaaatttaactgagtagttaccatggccctcgtgccg

SEQ ID NO: 1693 - DNA, 347 bp, Rattus norvegicus
  Genbank Accession No. AI059707
tttttttttttttttttggacaaaaatatatatttttataaaaaactgatcacccaactttaatgatttcatacatggacttgagagtggtagtaaaggaacagacccaatcatgacaaggcgactgagggacagaaaatcaagttcctcagggagagaaagtataaagttagagagtgaagcacacttactcagccccatccatgccagtcctcccacagactacgctgggacacatgctctctgacagagaggctctcgtgccccctcgccccattaggagcgtatgtatcttcactggggaaaccgatcctgactgcctcgtctgaagtgctcttgcatcgctt

SEQ ID NO: 1694 - DNA, 272 bp, Rattus norvegicus
  Genbank Accession No. AI059709
tttttttttttttttttagtttagtgtttttaatgctgtgataaacaccatcaccaaaagtaacttgaggaggaaggggtttattgcctcataatttgtagtccctcatcctgggaagctgaggcaggaactgaagctgagccatagaggagtgctgcctatagcttgctcctcatgttccatttccttcactttccaccaaaaccacatccctgagggggcatcaccctctgtggcatgagcccactaactgctcaagcactgattaagcc

SEQ ID NO: 1695 - DNA, 436 bp, Rattus norvegicus
  Genbank Accession No. AI059883
tttttttttttttttctgatcaaggcgacaactttattttttcgcaaggctgaatttataccataacatgggtaacagagagaggggggaagtaagaaaactactgtggccaggaatacacatctatatcactagatatttaaacttccattttttcaaggatgatgtccaattgcatgccagtgattaagaacattcttgctacccatactttttgaaagggtggtcttctgacccagacatggtggctcatacctttactagcagcacaagggcagcagaggcaggaggatctgaaagccaggaattcaagaccagcctggtccacagagagtgtatatcctcactcaaaacagtaaaatccgaaagaactttttttttttgccttaaattccttgtttgacctgaagtgccttcagaagtgctaagatacagt

SEQ ID NO: 1696 - DNA, 347 bp, Rattus norvegicus
  Genbank Accession No. AI059885
tttttttttttttttctcgtcagagcagactttattgcggcgacacggccgctgttcgcacgctccgccggcagcacaccagccccaggcgcgcgccccccttcaccccagctccagttaccgtgcgccggggtcgcgcggaaagttcgccgactccagaggcggaaggcgcagcgccgacgccccactcctgccagcgactgaggccccaagcggcggttttgtcactgttgcaccgtggatggcggggttcgcgcgacgcggagcgccgtaaggcgacggcggcgcggagctgacgtcacgcgccaggggccagccagcgcgcgtgagggtcaccacgcccccta

SEQ ID NO: 1697 - DNA, 214 bp, Rattus norvegicus
  Genbank Accession No. AI059947
  misc_feature (1)..(214): n = a or c or g or t
tttttttttttttttttaagtgtaattaatatattctaataaaaaacactagtaaaaaaatagagccatcctgggcaacttagtgagatccagcctctaaataaaaggtcaatgcagctcattggcagggcacacgctcagcacgtcaaaggtttagggctcagccttccacatgcaggtttcttcaaagcctccaaagcagtgtntgtgcctt

SEQ ID NO: 1698 - DNA, 534 bp, Rattus norvegicus
  Genbank Accession No. AI059963
tttttttttttttttttgcatttgagaagagaggctttatttacaatatttaaacgggatttagcaaggaatacctctcccctcataccttagcagcatgaactatatacactttataagcaagaggagtatcctgggggacaggatatgaattctctcccgaaaattagttctgaagttcccagttctgaagagtatagctgggaggtaggatgtgtgtgttgggggagtcttagaaggtagatgtgaaacaccagcttctcactggggtccacaatcaggaattacttccgcactggccaggaaagcatcaggatttcacctcactcatggcttccatgaggcgagcactgtttgtaacagcagttgtcagaaaaataaatctgtaccctttctctctacccaggaagcgcagggctgatatctctgagaacgtgcagccccccaagaacaccaccaagatgaggcggagtgactcactggaagccttgtcttccttagccatgtctgtgaatgcaaagtcactgcagttag

SEQ ID NO: 1699 - DNA, 492 bp, Rattus norvegicus
  Genbank Accession No. AI059964
tttttttttttttttctcaatacaatttcatttaatttctttctatttacattcattcaatctgaaatcaaatattttaacacagtaaactaaatacaagatgaaaagcagaaaaggtgttgccctcatagaactcctaataaggcagctaaagaacttatgtgaaagatgcaaagccaacttggggtagaagaagacatagtttaaagagcaaacactgtcagaaacccgtcttttagatgctcctccagagaatccaggaaaataatacttgtgctatagtgttgagtcacacgagaaaagtattatattgttcagcaacaaaccataggccctgtgtgacaaatatcactgctgtttgtccagctagctaatgtctgctcctgggacaaaactacagatgtttggatactgacatattttgagatactaaccattttcattttcaaagcctcaaaatccattcttcataaattcaacatttctcttgag

SEQ ID NO: 1700 - DNA, 372 bp, Rattus norvegicus
  Genbank Accession No. AI059974
tttttttttttttttttacaatgtttccaatggccataatttattatctcaccacaaggcacaatacacagagctttgaaggtccaatgcagtcgtcgtggcagaacgctccgcagccttggcacatgatcatggctttcaggctgcatgcacactggagagagatgctttctactgcactgctgtcagtgaacatctgtagggacagtgatgcagtgtggcctgtaccaaagctggctttgtggctcagctgcaccacaccaccagcgaggcctctgggaaaggcggccgagctggaggagtaattaaagctgctgggactcagctgcagtttggaaaacttcccgtacaaagcctgcttgatgctgagtt

SEQ ID NO: 1701 - DNA, 130 bp, Rattus norvegicus
  Genbank Accession No. AI059983
tttttttttttttttttcactcaatagtattttatttaaaagttcacaattaaggcacagtaataaacaaaacacttaaaagcaacaaaagctaccttgaaagaaaaacatccagcatgtcaagggatgg

SEQ ID NO: 1702 - DNA, 243 bp, Rattus norvegicus
  Genbank Accession No. AI060028
tgtttttgtttttttttaatttttaagaaacactgttggacctgacaaaatggttaaaaagaacaacaacaaaaagacataagaaggaacatgatataaacttgacactccaagatgcatccaaattacacaaccactctttagcttttgctctgccccatttcacataaactgtgatcacgatttacgaagtgctgctgagtgaacactggagcacaaaatgctaaactagactgcagtgaa

SEQ ID NO: 1703 - DNA, 558 bp, Rattus norvegicus
  Genbank Accession No. AI060050
  misc_feature (1)..(558): n = a or c or g or t
tttttttttttatttttgtataatttaataaacagctttctagctgttactgcttctgtctgaacttcttatgtctgtgtttctgtccctctgagtcattcgtcttctttttgttcctgtttctgtttttcacgttgtgtgtttcatagtagcgcacaccgacttttttggattgttgctgccgagctgctctcctccgttccttacacgtcagcatcctctgagtcttatctgaaggctcttcttccacctgtgcattccacttccttgcccttttggtgggtgctgcatcactgacttctgcagacgctttcttctcttcttcatacttagcanaaaccttttcacttaagtctttggatattctgatggcagagaactttttagctttggctttatttagaaacctctggtacttggcaatcttctcatctagggctctgatcacagctttggtgtcatcttccacgggccctcnccgcgtgtctcgggaacactcttcctcagcatcctctcctgnctgctcctgctcctgctcctcctcctcctcagagcttt

SEQ ID NO: 1704 - DNA, 250 bp, Rattus norvegicus
  Genbank Accession No. AI060071
tttttttttttttttttgctgggcctttgcttgtttattttgcttcccgactcttctcttggggttcagagccactgaggggtggggcaagtccaggcaaggagtggaggttggaggaagatgcggaccacacaaacagcgccactgtacacattaccacaggcagcacgaatgaggaccacatatgcctagcatggcacaaaaggaggccaagtcagtcacagacacaaacattggcaaaggtggggga

SEQ ID NO: 1705 - DNA, 330 bp, Rattus norvegicus
  Genbank Accession No. AI060130
tttttttttttttttttcacgttagtggcagctaaaacgctcccagtccatttattgaccacctgaggtggttgtcaaggggggggggagtagttagaaggttatcatggggactcggatgataatgtccagcagtgtgagggttcaacgggagctcgaggcacgagaggtcagtgttcaggaagcacccgtctgttcggccacaggaggccggggtggcctggggtgtccaccgctggttcaatggagctgagcatccagctcgtacttctcacagaacttgtctgtgaaggggatgcaggtgaggaactcacaccattcctcgtgccg

SEQ ID NO: 1706 - DNA, 385 bp, Rattus norvegicus
  Genbank Accession No. AI060149
tttttttttttttttttagtattattttctatatatttatagacttgaattatttgaggttttggcgactagtgccctcagcagcagagatttacgtcactaatattttatcagcacagtaacaccacacagctgttccctttacatctgctaccaggaggaaaagaacggcttcctgcagtggaccgtctgggtaaaggagctgcccaggtgtacaacacgcccctggccaccacttttgctgcactccacgatcacgcatggcatctgtgccagctgcataggactcttgccatctctcagcgcctgagtgaggtttaagatctggcctctcatcacagacatctgactttcaaaagcagctctgtcaaatcctttgtcagtc

SEQ ID NO: 1707 - DNA, 422 bp, Rattus norvegicus
  Genbank Accession No. AI060178
  misc_feature (1)..(422): n = a or c or g or t
tttttttttttttttttcaaggtaaaataattcattaaaatctgaagttaaaggtctgaggtgaagggctaagttcccgtgccggggagctgttaagccattatttataagatgaggccctggctaccagccaggagacccgaatccaggatggcttttctcttatctcgatttgtctttgccacgacattcacctcctttgagttcagcttttccgtttgtaaaacggacaaacagcctgtttccctctttagcatccggagtctgatccgtangaaaacaaaaagcaaaccaaccaaaatgctttggagaggtaaacgcactgggccgaggtgaagcatcactccagccgcctgcggggtgggctgggctctttgcaaggccttgacgtcctccaaccgcccgggggcgctcgctcccgg

SEQ ID NO: 1708 - DNA, 512 bp, Rattus norvegicus
  Genbank Accession No. AI060198
tttttttttttttttttcggggagcatgcaaaacaggaaccattgtctttaatatattattttagaacttcctacatgcacagaatattttgatcaaatcaacatttgcctgttgcaggtagaacccacatttgtcagggtctaaaagattcccttgtaaagtcagacatctttattctgcaggcactcaaacttttcagatcgctgccacatacccaggtgctccgctttctttagtatctttgaagagtttgctggtcaggtgctgctcttccaatggggggacaagtcagtcctgcaccgacttgttttctaggccctgtagcatccccacagcagggggcgctgcagtagtgttcatcatcgtccaagtgagcgaccagtccagtcagaaaggggaccaggcaggaagggggtgtggcagacagctctcggatctctttggtcatgcaactttagtacccagtgctccttctgcccagactattcttctacgccgtatttcatcacgt

SEQ ID NO: 1709 - DNA, 495 bp, Rattus norvegicus
  Genbank Accession No. AI060207
  misc_feature (1)..(495): n = a or c or g or t
tttttttttttttttttgctcttctggactaagtgttgactcatctacatcaaccaatagtttgtcaaagtactgaatgtcatcaggttttagaaatggaagattcccagatggctggtcgttgacacttttcatagttctgtcttcagtttgcatgtgaaaaccagtcataccgcccaaaggtgtgggagttgctgtcagctttcgagctggagttcgaataggaacatagccagctggagggggaaggaccttgtatccttctgggaacatagcatctaattcctcatcagaaagtgggcggttgcgctcatcaatctctctctcccaccgccaagcctgaagctgctcaggagtcatgctcattatgtgacctggagtgggggtggccatgttcatggctggtgtgccaattggtgtttttcctggagtcagaacaggagtgcttccgcccatttgactagctggtgtttcgtcncaacgagactttctttt

SEQ ID NO: 1710 - DNA, 425 bp, Rattus norvegicus
  Genbank Accession No. AI060281
ttttttttttgttttttgtttgtttaataactctgaattttatttatttagatcttagagctaaagaatagtcctgctaagcattttcaatataccacgtagaaatcagatgtacattccttttatactataaatctcagccttctctttcctattttaaaaagtatctttaaattttatattttgttatagttttcaaatacttgagctgctttttatttttaaattttgctacatttagtttatttttcactcagagttcttgctgtaggctttgtcttgaagacgtaagaccatttggcgcgcatagaagtccctgtattcctctggtaactcagccagtgttttcaaagctctgtccaagatctgcatggctctggatgctgccacaggatctttgttgccatatgtgtctgttgtgtcat

SEQ ID NO: 1711 - DNA, 508 bp, Rattus norvegicus
  Genbank Accession No. AI060314
  misc_feature (1)..(508): n = a or c or g or t
tttttttttttttttctcaggctctggctgcagagcagcctttattctccctgctagtcaatcaagctaaggaacgcttcctccaccgagcggtactggtgcaactggatctggacctccaccgacaggggctctggctggtacccgctttctacggttggagccgccgcttttgacttatcttttttggagcctttctttaccttctttgaatcctgtccgctgcccagcaccctcagcacaggtggatcctggcgcagctctctgggtggctcctttttcttcctcgggcctttgtccttagcaggctcctctttctttttcttgtcgcctttccccttcttggcaggcaagggactctcaacaggagttggtaccacaggccaagagatgatagtggtcccagacagcatgaaggccttgacccttatcagctcctttaaggtgtgcttcatctcatangtgcaagggatgacatctgcccaaagcttgtgcatggtgctgaaga

SEQ ID NO: 1712 - DNA, 390 bp, Rattus norvegicus
  Genbank Accession No. AI069920
tttttttttttttttttcttagaaaggaaagcatttaatgggcgctcgcttacagtttcagagggtcagtccattatcacagcagggagcactcgggcaggcaaactctggggttgagctttacagtctgagcccaggcagcaggggcagactgggcctggaatgggcttatagaacctcaaagaccacccacagggtcgcacatcctcccagaggccatgcctcccaatccttctaatcctatcaaacggttccaatccctggtgacctaacctccaaatatgagaccatgatcccatattcattcaaaccaccacactggtggaggcaggacacaattttaatgggctatagagtacagaggtgatgttttttttctgtcaacttgcc

SEQ ID NO: 1713 - DNA, 448 bp, Rattus norvegicus
  Genbank Accession No. AI069922
  misc_feature (1)..(448): n = a or c or g or t
tttttttttttttttttatgtggaaagttatttaattgtaaaatagaaaatgaggccagagtacagtctcgagggtaactggttctttatacagagaagctagaagagcctgggggttgggtgggggtaaacatttccaaaaagcaataaaacaaaacaaaataataaagagttcaaagttacattttacaaaagagagtggaatagtctgtcaaatgtccatacatttcggaactgacaatattgtgagtcgcagcacaagcccggagcgttcacagggaacagcgaaagttatgttatacatacccatagcatcaccgagtacaaaaggtcctgctctacatacaaaagcaattttccataagaataatttcttanggggaggggagtaagtccatgaaatatttcagaaacccaaatgcactgagtttgctaaaaacattatctt

SEQ ID NO: 1714 - DNA, 432 bp, Rattus norvegicus
  Genbank Accession No. AI070033
tttttttttttttttttgctttctataaatccatttactgctttgaagttttcaactgattaacagctacagaaaactgtcataaatcacagtaaaaataatacaaaagaaaaccttaaattattcttagtttatatctagatactgcttgtggcttcccaccaacccattatcggtattcaatctgtgcagcctgggtacttactaagcctgggtacttactaagcactatttgcacttgcttcttctgtatcaggtttactttgcagtttcttctagaaagctaactgactttgtccaaggaagtctccctttttgaaaaaccaaagctgctacagtgtttccacatctacctccaaagctgaacttgggtgttggaagctcttcgaaaagttcaaatccttcactgaatgcatctagtaactctgcctt

SEQ ID NO: 1715 - DNA, 504 bp, Rattus norvegicus
  Genbank Accession No. AI070068
  misc_feature (1)..(504): n = a or c or g or t
tttttttttttttttttaaggcttaaccagtttattggaatgtctctgtagtagaaatttttaaaaaatatgcaagcgatctgtcttgctcagcacaatactaaagtagatgtgccttagctgcgaagtcccgggctcgagtcccggctcccgcgtcgagggtcgccgccctccgctgagttacgcacagttcactgtccagcggggtgggggacgcctcgccccacccctgcggcggtgtccagaccgtctgctgctgcgtgcagaggctggctgcatgattgccaggccttggctctaaagtctctgtctcctccagcctgaggtcccctccttcctgtcttggcgaccacctgtggtgctggctcctggctccatagcccaaggggcgggcgggcgcacactcccctctcctcgtctcagtctcggtgactccgcccctcccggaaggtatcacgggtagggtagcttttgagggattgttctggggaatganggggcgct

SEQ ID NO: 1716 - DNA, 529 bp, Rattus norvegicus
  Genbank Accession No. AI070108
tttttttttttttttttggcattttattggtttttattcatgaagtagagcttttacttcatcccagcgttttcctcagaggtagactttgatttgatttcaatgagttcttcgactcgagccaggacactttcaatcaagtcgaatgtgaagagggcggaatgtaagaccttaagctgcatctcaggaggcatagtggggatttcttctccgcctacagtcacagaacaaacacttttacacattgaggcagcttggctattttgttggctgtttttaatctctgcttcataatgtgcctttgacatattaagtcctacatgaagtggctgtagaaagttattttcaatctttccaagctctgtccataatccagtttggttgtcatcttcattatctttgataaccaaatacctcaacaaatttagtgaagccataatccggtctgagttctgcagtaaatctgtctcagcgccctcagggagggacaggaccaggtctaacagagaggtcagctgtgcgcctgcaa

SEQ ID NO: 1717 - DNA, 459 bp, Rattus norvegicus
  Genbank Accession No. AI070128
tttttttttttttttttaaacaaatagcttaagtattttatttgtttgcaactaagcttgttaacactatataatgaaaatgtacaaagaataatgttgcagtttttggttagatttaagtcaaagacattcattaataaggaatcttcaaatgtgaataccccagaaatgtccgcaagccagctgatcacaacaactgtctctgaatatcaccttactttggaaggtattggcaaacatttgaattaaaactcaagatttttccaaaataaagccgtaattaataaaactattctatattcaaactaaaacagttttcataaaactttcctttccaaaacaatagtaaaggaaacaaggcattttgtaaaatgtggtcctgaacaagtcacagtaaaaataaatgtatacttaactcccacctcctcaaaacagaggctgctttctgctcacagcctt

SEQ ID NO: 1718 - DNA, 523 bp, Rattus norvegicus
  Genbank Accession No. AI070138
tttttttttttttttttgccccatgagagctttactcagccagggccccagggaaaggctggttctccacatccttctggtttctagttcccacctccaccccttccagtgcagtcagagtcagtgtatggtttggggttggaaggagtgttcttgaccatggctagccaggggaggcaacacaggctcaggagggcctggagcagactgaagatactgtgcttttatctcccgtgcagctgtctggccttgggagcatgtaattccaactcttctgctcactcggggtggctgtcacaggctctgctttcctagctctgtagggtctctcttccatgtggcttgtctgctccagaatccactgccgctctgactcgttcactgccagcctgagtgtcacctcctggaagacgttgctcatagccacctgcttaaagtgtagtttctggaacatccggatgctgggttcattttcttgcccgattttggcctcaaacttggtcagacctagcttcgtcactcc

SEQ ID NO: 1719 - DNA, 344 bp, Rattus norvegicus
  Genbank Accession No. AI070233
tttttttttttttttttgtttaaagcttatatcttttttaataaaaaataaattgtctgtgacaagcagttgtgaatcccaaaacaaagggaggaggaagaggtcaagggtcagccacactagacaagtgaacaacaaggctcagattatgcccaccattctagccagggcagagacaataacaatctgtccaaactgaagcaagaaggaaggtggttagacttcagaaatgactttcccaaacacatggcatgattggtaagggaaacacaaggggccaactccataaagaatcttggagaccctgggaggagggagggctggtgttcaaagcagcagctttc

SEQ ID NO: 1720 - DNA, 400 bp, Rattus norvegicus
  Genbank Accession No. AI070270
gttttgtttttttttttccttaaaaaaaataaaatagaagcgaaaacgcctacatttgcgatgagacactgagctgggcccaggcgccatgttcctcaacactcatttttcttcctatttcaaaagacacaaggggctgggctccaggctccccatgtgtgagaaaacaagctggctgggtgcaggtggtacctgtgtccccgtgggaggaggggtgggaaggggggtaaggcaacacccaacttgtcccacagaggttatttacctgggactgtcacctgtgtgggtgccaaggatgaaggaacaggaggcccagaatgggcaagctggagactacgggacagatggtgctgggctgagaacgcagggccgcgccctgctgggggaggtagagcaagcc

SEQ ID NO: 1721 - DNA, 377 bp, Rattus norvegicus
  Genbank Accession No. AI070274
tttttttttttttttttcttttagatcatgtgtacgaatattttaccggaatgtatttctatacatcacatgcatgcctagtgcccacggaagtcagaaggcttcagattccttagaaatagagttaggcgtgattgtgagcctccatgtgggtactgaaaatcaaaccctggtcttctgcaagagtaacaagtgccttaaccactgaaccttccctcccctgcacagcccagtttttctttaaagtagcaaatgcagaaggacctgggagtctcttatggtagctggcccatcttcagaaaaagccagactacagccggaagttcatgaagaatactgagaagccaaccagacaagttactcttctgttttcatct

SEQ ID NO: 1722 - DNA, 525 bp, Rattus norvegicus
  Genbank Accession No. AI070275
tttttttttttttttttcatggattttttttttatttaacatatatagtacatgtaaacaaggggcataaaattcataaaaatacaatacttctgtgcaggactgcttttttcagacacatcctcccgttttctcctcgtgctgctggcacacactctgccaggcattttagaggtttatgttttaatggacggatttcccagctcacttttttaatgtcacaataataactattcgattgcctcccgtcttcccttccttcctcacactgaagcaaaaactatgcagaacactgagctttaatactgcactgtcagctacataaaacctatcactgctccaggctgccaaagtgtttacgccgcagagcactggctgccaccacgtgctggaggccaggcacacaggggaccccacggcctcagctccaagctgccttcctggcacacaagcagagcttgctggtggagttacataagacacacttacaaaaggtttctgcagagaaactaatttagactactt

SEQ ID NO: 1723 - DNA, 443 bp, Rattus norvegicus
  Genbank Accession No. AI070294
tttttttttttttttttggcactgaaatcaaaaccatttgttgagtaacgagctgtacgtgatctgaggatcgacacacactagtcgtcctgggcaccagatggccctctaactggccacaccaagatgggatgacaatgaaggggcgtgaggcggagccgtccacagatcaacctaggaaggcttcccaggaaggacacactgactcttttccaatcctttgctttttcctgtccttacctccacgcacatacttggaataccatgaattctgaaaccacatttggacataaactcagaacacacccaactcccactgaggtctttccaggctaggtgacattttcccgctgtttgttaatgtctaacctaaaaaaccaggagctgtgactgctccgagttcagagtcctctctactaggtatatatatagtgaggatcctt

SEQ ID NO: 1724 - DNA, 471 bp, Rattus norvegicus
  Genbank Accession No. AI070315
tttttttttttttttttcatattttaagttgcctttattcagtgcctgacacagaaacacccatccaagagaaaacccaagtgaatcctttcactgccgagtggacacttcagaaagctgggttggaacaggaaggtgtagagagagaaaattttagaggaagtccctcctctccccgagcttgggctcctgctcagtcatttctgcttcttggctccctgtctggtggaccaaggtcacagacaacatcagaaagaaagccatacaagaagatgcgcgcttggttgcagccagaggccctggtgttggtagcattggggctgagggtgggggaccctcaccagccctgctctgccagggcctttagatgtagagtggtgggaagggcagctcagtcgtgggctgaagccagttccctgggctccagacagtgccggcggcctccatgaggtggaaagcctcgtgccgaat

SEQ ID NO: 1725 - DNA, 477 bp, Rattus norvegicus
  Genbank Accession No. AI070336
tttttttttttttttttagggaatcagaatttgtttttatatccctagagttataaacatttgtatcaaaatatttacaattatagtatatgaaatatcctattaatgaagaagccaaatacagtactagaataacccaccaatgcaatgcaaattacatgagacataaatgtcacagaaaagaagtaaaagacaagggaatgcatggttctttctctccagtcataaatcaactttttaacaaaatgtgactatctttttctgttaattttcttatgaacataagacagcctagaacaaatgtatggtggtcaaattataatttaagaattattatagctttcctgaccagtatctctaccatcagctcagcaattaagtaacctacttgaacattcccttaaacataatacactagagaaatatacttagtaatgatccctttacataaataccagcaagtatagcataacaact

SEQ ID NO: 1726 - DNA, 471 bp, Rattus norvegicus
  Genbank Accession No. AI070350
  misc_feature (1)..(471): n = a or c or g or t
cggcctgtagcacgtccctggttatcccagctgctatgtccaatgctcttccgcttagctggctcgcggcgctgtctagagccacgtggtgctttagaaacagaggtcttatgacgcgatgatacagtagcaatgccccgttccagggcccgggtgtcatgcaaaataataggaaggcgcacttgcccgcgtagtagaaagggaaccagaacaggagtagatcgctgaagaactcgactagaccgaacagggcgtacaccacccagtaggttagccacacagtgtcgtcttccttgtttgggctctcgatagctttgactgaagcatatgcggggtatacaaatccgatgacattgcaaagtagagacgccccgtagccgaacagaagatacaggcctagaagggtgagggctcncgcggcgagataccgcttctctacaccggtcctggcttcgagcgcccccagcgcgt

SEQ ID NO: 1727 - DNA, 332 bp, Rattus norvegicus
  Genbank Accession No. AI070421
tttttttttttttttttaacgtttcctaatgtctgctttctttgcaactgtgagtggcgatggtcgccagctcagaccaaggcgactgtgcaaacctctgaacgaggttttcctttctgacagaagttggtctatcggggttctttctcaacagacatgatttctagaaacacagcagccatcttgtgactacgaagcaaggagcaatgagattactgagaggaggccccgccctcactgagcattgatacggcactccgttagatataatactgtgttagtcacctgctccaaggttcaggctatgcggataacaagccctcgtgccgaat

SEQ ID NO: 1728 - DNA, 487 bp, Rattus norvegicus
  Genbank Accession No. AI070516
tttttttttttttttttcttggtataatccattaattttgctagtttttattagagcattacaattaagacattaaattataaattcaggtggtatatttagaaattaaattacaaaacaatacaaatacttttaaggtgtgttgtgccaacaaagtttaaatgctatcattaaccaggggtcagctttagattcaaccgaatctatgatgtgtacaaaggttgaaaggaacaagggagatggaaagatgcttgcaaataaaatattccacaaaaaatttaaataaaaagataagctttcagcgaattaaattaatgttctaatctgttggcacaatgtacagaaaatacttacatgataatttcttaagcaaacagcagctttacaaacggtaatactttatacatacattaaagtaacaatgtgttacgtacgatttagcatttctgtattaagagtcaaaaatgaatgcaaagaccgctcttta

SEQ ID NO: 1729 - DNA, 544 bp, Rattus norvegicus
  Genbank Accession No. AI070601
tttttttttttttttttgtgggttttccttttaatgcaaaatgttgccatacagagtgatgtgaggaaagccccattcgcccctacactggagggctgagggagggcaagaatactgtcgcctgctgtctggggttgaccctaaccaaaggacagggctctcagtttggaactaaactttgtggacacagagcaagggagagcaggagtgaagatttaagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttc

SEQ ID NO: 1730 - DNA, 339 bp, Rattus norvegicus
  Genbank Accession No. AI070638
tttttttttttttttttcttgttctcttctttttccccttttcttctgggattatgtcagaatacaactgaatgagagactggctggatcctgaaaaattttgtccctgtgctgttacagcagggtcttggccacatgggacactgctattggctaccggaggctttcctggtaaaattggtgtgaatggaggcctcagtggagactgctgaaagctggatccagaaagatttccatgtccttgcttaacagaatggaagtttgggctcccaccagaagcagatggtgaatctggaacaaagggggtaggtcctacctgccttcgctcctcgtgccgaa

SEQ ID NO: 1731 - DNA, 364 bp, Rattus norvegicus
  Genbank Accession No. AI070712
tttttttttttttttttcaagacagggttcctcaaggtagtcctatagaccagagagacagagtgagaccctagctggcctagaactcagatttgcctacttctgccaccctagtgctgggattaaaggtgtgggccacacagtccagcttgctttagttttaagacaggacctcactgtgttgaccaccctggagcttgcttggaagaacaagctggccttgaactcagagatccacctacttctgtctccaaagtgttgggatcaaaggcgtgcaccaccaaccatatccattattattcaggttttttttttttttttttaaatagagtcttcatatgtaggccaggctggctttgaattt

SEQ ID NO: 1732 - DNA, 352 bp, Rattus norvegicus
  Genbank Accession No. AI070724
  misc_feature (1)..(352): n = a or c or g or t
tttttttttttttttntaagttatgtggcttttttaaaaagaggtaaaaataagcaagaaaaacattaacacgagtaaaatcctttgttcctgggctttgtatatatactgtgtacatatacatgtcaggtacacatgtatgtaagagggcaagcctgggtatcatccctcaagtgctctcttactagcctgagacaccccaagtaggctgggctggccgtctgcaggggctcctgtttcgtctccccattgctaagattacaagtacacctaccacagtttgctattctcatttgggttccagggcacttgtgtgttcaaggcaaacattttactgagctgtccctccaga

SEQ ID NO: 1733 - DNA, 329 bp, Rattus norvegicus
  Genbank Accession No. AI070784
ttttttttttttttcttaggaaggacatttaattggggggaggggaggtatacagattcacaggttcagtctattatcaaggtggaaggaatgtcagtgtccaagcagacatgatgctggagagagttctatatcttgatcagaaggcagccagaagactcttctgccctgggcagagtttaagcatggggtctcaaagcccatcccccctccacagtgacatacttcctcaaaggccacatctactccaaaaaggccatacctcctaacactgccacttgccatgggccaagtatatttaaaccaccgtacctttgaagatcacagta

SEQ ID NO: 1734 - DNA, 435 bp, Rattus norvegicus
  Genbank Accession No. AI070806
tttttttttttttttttaagtgaaaagatatgacactctttaatcacatataattacatcacataaatgtagcacagcatattaaatgcctcatataatgagatatgcccaaaatgagcaaatagcttctgatctgtctctctatcaggatcatctcttaaaaatgccaaaattcaaatttcccattaaaaaaatacaataaaatgaacaaggctggactctccccggggtcctctcatgggcatcacgcatggttattactccaggggaaacaaggcttggctgcacgctagcgagcactgcagagcacaggtcaagagggcttgcagaactaatggatgggcttctgtttggccttctctccagagcgtctggcctcctttatcaagcggtacataaaggagtagaagaacaaaagcctcgtgccgaattctt

SEQ ID NO: 1735 - DNA, 261 bp, Rattus norvegicus
  Genbank Accession No. AI070850
tttttttttttttttttcagtaaagatacccttttattgtactatgacacaaggtggtttattggatatgattataaaaaattaaatgtgcaagcttgactgttaaggaacaagctgagccacataagcgcaaatctatgtttaatatcaatggttccaagaagcaccttacaagttaagcaatctaaaaaaatgatttacttcaatggtgtgtgtgtgtgtatgtagtttatgcatgtatatcacacatatgaaaatgtc

SEQ ID NO: 1736 - DNA, 431 bp, Rattus norvegicus
  Genbank Accession No. AI070973
tttttttttttttttttactctctagccttctatctcatggctgggaagctgaagatttttttttttcctggtctatcttccattcactaacagaagttctaactgcaaattttctaacctgagtgattatatgtttcaatcctaaaatttctatgtaaatacctcatagcttccagttttctgctgaatggtccatctgtcacctaactcacctgtaggcataatgttattgtgcacattgtaaagactagcctattattcaaatgccccagtaatccagacatggcattgtaaggcttattctaaaaatttcctgtgtcgatgttgtgtaagcactgctccccatttattctctgatttgtcaataaaagctgatcagccaatggctgagcagagaagagagactaaagctcaacttccaatcccagcc

SEQ ID NO: 1737 - DNA, 226 bp, Rattus norvegicus
  Genbank Accession No. AI070982
tttttttttttttttttaattgctgtaatttctctttgaacacatccttaacttagtggagatttctctgtatccaagtttttataagcagataaaaagtaattttcattttcttgagactgagttgatgaaagggcatatggtgtccccagaaacgtctgatgcgtgagaacattaaaatgactaaactgatgggacatttttaattgattttggcctcgtgccg

SEQ ID NO: 1738 - DNA, 357 bp, Rattus norvegicus
  Genbank Accession No. AI070986
tttttttttttttttttgtagttcacggtgtttaatccacacttgacttttgtaaaccgaacctcctgcctccacatcctgcctgggcaggcccacagagggctgagggagacaatcgcttggctgagcagtgaggaaaaggaaacaggaagggtctggaaggaagccgtactggggaagagcatgcaggaagtggcttcccatccgcctgcctatccccacccaagtcctgaccagcctcggccacctccaggaagagccgccatgcctcacctcaacaacagccggggctagcccccaccccactccaagcagggatcatgataaacttccccggcctccagtctattcaaaagc

SEQ ID NO: 1739 - DNA, 459 bp, Rattus norvegicus
  Genbank Accession No. AI071023
tttttttttttttttttcacctggatttaattttaatttaatttaatcaccctggaatccatatgacagattctacaatgcagaaccagagatctgactctctgacctccatgtacacatttgcacaggcacacgacataaatataaaaagatataaaaataaatgtaatcatagatgtgttgtttcttacagaatcagtgcaaagtcaggtatggtggtttataacctcctcccatcaagctgaggcaagatgctgccacaaattcaaggctagcctgggctacccacccagttctgcctagaataaatctcatgaacacgaagcccctgagaacagtgagccaaggatggtggtgtcccagtatgatcacagaccacttaacgaccccacgctttgctgacgtccagcctcgtctacatcatccttcactgtgagccagtcaccacagctccgctac

SEQ ID NO: 1740 - DNA, 426 bp, Rattus norvegicus
  Genbank Accession No. AI071109
tttttttttttttttttggttcaaagagatgtattctacaaatattttaaatctaagcatttggaatcagaatattcagaaagaactttgttccaacttgtcattttatgcaagcatgagtttctaaatttaagaaaccacaagtctctgttgacatcccagagttgttaagggctgaatgacaatgtaatccattctgaacacacacacactaaaaggtccaagagctcacataagatgacacagatccagtcactatagaagcagcaagtactgactgatagcacagtgggtttttccaaaaggaggccagcagatgtgtgtgagaaaccaggtgtttgggtgacaaatcaccacctgagacttattttcttggaatcacacacatatctttataatcaagaagccttggtgtgatgaggtatt

SEQ ID NO: 1741 - DNA, 432 bp, Rattus norvegicus
  Genbank Accession No. AI071110
tttttttttttttttttgtccgataatctttttataaaatacaggagttttgaaggagagcctgggctcagccacagcgtgtgtagtgcgctcacacactgtgcggtgctgacacggtgagaacagaactagcaatgccagctccgagcacaccaggcactcggcagcttctggccctgctgtgccagacacatgcaggttcgtcacggtgttaggagtactcagcacatgccgggggcccgggggcacacccccaccgccacctgcctgtcgctccctgaagcgctgggcacagccctgcaaggccttgagcactcggccttctgtggccaggtccagtgggctccggccgccgtggtttgcgtagctcacatcagcaccctccaatgccaggaagcaggccactgcggcgcctacagtcaactctgtgct

SEQ ID NO: 1742 - DNA, 519 bp, Rattus norvegicus
  Genbank Accession No. AI071194
  misc_feature (1)..(519): n = a or c or g or t
cggccgcttggtggccctctcgtccctagtgctggtcctgccaaggtgccgggctgaatagttggacagtgggtcatactctagatctgttgatggctttgagctatccaccacgtatttgccaccgcgacgaggctggcccacagccttggggacatactccagggcaccagcgcctcctgcagctctgctctgacccctgtctgaaggggcaagtgagtacttgtgccctggctcggcagggacagccaatggggtgggctggtaggcagcgtccgggctcagcaggccgcctggcgtataagtcagggccaaggagaaggtgtcatcatcatccatgcttgtggcanggctgcaaggggccagtgctgaagccccagcaccgtggccccgtgcagtctccaggagctcctggtagcgcctctgctccagctccacctcgccacgcacagcctcgatggcctggttgaccagctccaactccagcatgccatcgccctgacccagagcaccattctc

SEQ ID NO: 1743 - DNA, 380 bp, Rattus norvegicus
  Genbank Accession No. AI071206
tttttttttttttatttacacaaattacagtatttaccacatataaatattgacagttgtcactgtaacagcagacaacttcactttcaagtgagcactttttgaaatatcacagagctccatgcctctgttcttgttctgctaccctgatggctcagtttattacatagctcaaggcggcccgacactcccagcaatccttcagcctcccaggcgctgggactaaggcaggagcctggctcagtgcccttggtaagtactctccatgagttgtgcagttctccttcagtctcatcccatagctgctatgtacaaaccaagcacaacagtaattgtgacaaaccctcaaacacgtgtgtaacagatgagaaccagcagtt

SEQ ID NO: 1744 - DNA, 565 bp, Rattus norvegicus
  Genbank Accession No. AI071243
tttttttttttctttttaaagttttaattttattcaaaaattacttcaaaacttcattaactctttacagactgtttacaatactgtcaatatcactatttctatagaaaagtattttctttacactatcgataattatgtttttacattgctttaaatatatttgttgggtaaatactacacacacaaactgacaaaaagtaatgtgcatttaaaaatttgatagttctctaatttttaaggaccatgctgtttaggaataaaaggagaaaggccagaaaagacatcacttttacacagtgatagatacgtgattaatcaatgcataaaagtatgttcaacagtagaaatataaagcctgtactaaacaggtgctttcttctgaggtttaggaattacaagtgttacaaatgcctgttacatgcacattctggcatggacatgagctaaccatcaaggagactgatcgcatgctaacactgttattttggtagtgttgaggaccatagtccatgctgtcagtttttaaggccatatgactgctaaaggtgcaaacatcacatca

SEQ ID NO: 1745 - DNA, 378 bp, Rattus norvegicus
  Genbank Accession No. AI071244
tttttttttttttttttaatttgctatttttattaaaagaacagcaaatacagagagagccagagtgagaaagagaagggtaaaaagctaagcaacctttcacagaaaggaagtgagtgaaaagacagtaaaggggacgtggctccaggaaagaccacaccatggctgccggggacaagctctccacaggcaatgatttaacacacgcacgcacacgcacgaacctgactgaagtgagctgctgttgctttgatttggggcctcaagtcagcccttgcacagtaccccacacccacagaaagaaccttgtggagaaacacaccttgctttgtttccaactctggaagtcaacacaggtaaagtaaaaccctcgtgccg

SEQ ID NO: 1746 - DNA, 481 bp, Rattus norvegicus
  Genbank Accession No. AI071247
tttttttttttttttttcaaagtacaacaacttttaatacaccatcaatactaatgattaaaaattattgcatagtcttatgcatttaccctaaaacattttctgaaagtaaagcaattatataaaagacaaagaaccctttaaaaccggatggccttcactacctcgctcttctctcctttcttgtcttttcagtacttttgtccatggttttctcactgtctcccctgcactttgggcaataccatttcccctttggtttataggtgagtgaaacgcaggaaaagtgaaaccactcaatgggacactgttcattgtcacagcctatcatctccccgtaagacacttggttacataagcagtaggtgggctcgttgggatctatggcaaactcaacaggtgacgcttccctctcctgcttggccttggagcgctttttcttcttggcggatttggatttcttttctttcgcctcgtgccg

SEQ ID NO: 1747 - DNA, 547 bp, Rattus norvegicus
  Genbank Accession No. AI071251
  misc_feature (1)..(547): n = a or c or g or t
tttttttttttttttttaaatttttcagcttgtttgggctttttcttttaataagataacatgataaataaacctgcttctgtacagctatttaatatttcagaaatacgtacatgttacatgccaagaaacgaccctggttttcttgtgagaaacaaggtgagaccataattggaaaaggaaaaccccacaaatgagaaaaaccaacaaagaaaacaagatcaccaatacacaactaactacagttctgtaactacaccgctagccgcgcataacacgagtctcaaaggaggggagtgcggagggacacacttgaaggcaggaggcccctgtcccctcaaactgaatgagaaaaacaaagtcaacaacaagtcaacattgcttaaaccagtggccacacagtaaaaactgtacattgttgtccattcatttaaaagcaaagtcactaggatgattaanaaaaaaaaagtgagaactggtgcctttgaactttctgatgatgaacacttttactcagagtttgacaattatctccactctccctgca

SEQ ID NO: 1748 - DNA, 397 bp, Rattus norvegicus
  Genbank Accession No. AI071278
tttttttttttttttttcagcggttattaattagttttattagtggcaggtccttaatgcaaaatgacagagggaagagagtgaatatccccatcactactaaaatacaaattgtccagatttaggatgtgctgttcgccgaacaggcacaggtcgcgtgccaggtccaagtggggaacagagtagagagccaagtgccttgatacaaaatgctggactattaacgcccggaccaagagtcagagtacttacctcaggtaattcaccaggagaaaatccactggctttgattatcaaggaggaagggcctcctccaaggggaagctggggagggttggtggtgaggacaagggagggacaggtcctgttctcacccatgaacaaggcctcagtgaga

SEQ ID NO: 1749 - DNA, 384 bp, Rattus norvegicus
  Genbank Accession No. AI071289
tttttttttttttttttacattcttcaagtatgttgttcggattttttatttttaagttggtaactatacacatatatatataaaaaaacaaacaaccaaaccttaaaagtgcggccaagggattttgcttaaaagttaggattaagggctacttcacaatactgaacaggattgcatggtcatcctatgggcttgatgatcttgcctccaatcctggcagttaagaaaggagcaggttcagaagtgatcatatttcagggttagcatgagaaagctagggagatgcctgtgttcttccacggcaggggaaatccaccctgaatctaaaattccaaactggaatgtggtgggacttcacagtagagttagtctggatgaggaga

SEQ ID NO: 1750 - DNA, 430 bp, Rattus norvegicus
  Genbank Accession No. AI071317
tttttttttttttttataatagaaattcatttataaaaagcgtcaacacaaacactaatacatttcttgaaggacatgtgttaagggtttgattgcttaagggatgtgactaaaacacacatatattaatacatgtattaagatatcacagtaaaactactttgtaaattactatgctaataaatttttaaaacatcttgaaagcatacagcttcttaatattgacatttatggagttgtttttctgttttggcaatagtcttaatgtaatctagttacccctcaaactcaaaatagtcttcctgcctcagcctcccaagagctgagattttccggcatgaacctccagacagagtcttcgcaatgctgaacatcaaaccaaggcctgttttgttttcgaagacaggatctccttatgatgcatttgtcc

SEQ ID NO: 1751 - DNA, 279 bp, Rattus norvegicus
  Genbank Accession No. AI071371
  misc_feature (1)..(279): n = a or c or g or t
tttttttttttttttttcctttataggagatacacgaaagtcatccaaagtgatatttagttaacacgcacaaacatatatgctccaagcataaacacacacacctcatcccataccacagagaagtgcaggctgccccaaacttaaggacaagtttttaagtccacttcagaacatgtaagatactgggtggatgggggtggtgaggtgcanagagaaaaggccctcggccctctgcgttataaaatgcatgaaggagtgtccgggccgccggaaaaa

SEQ ID NO: 1752 - DNA, 438 bp, Rattus norvegicus
  Genbank Accession No. AI071458
tttttttttttttttttgagaccagttagacatttaattgagcagagactccagcttaggtttcccgcttcagaggagggatggggggaaatctgcccctcctgggcactggcttcccctcccaggaccattccaatgttgtctgctttaatgtggctcccagctttgtgggcctctacccagttactctgatccacagaaattcttcagagggccacagggcagttgctatccctttgataccaaccacatcttccagaatacatctgggagaaggctggggatggagaatatacttctcaactgcttcagccttcaccacagccagagcctgtccattcacaagcctatggggctcctggcacaggacagcgtagggagaagctaacatcagtgggagggactacaactggctttgtgtaggatgccctcgtgccg

SEQ ID NO: 1753 - DNA, 474 bp, Rattus norvegicus
  Genbank Accession No. AI071490
tttttttttttttttttagttataaaataaaacatttttaatggacaaagtaatcatatatatatgtgtgtgtgtatgtgtgtgagacttagcaaacaaaggaagaatgtgaagcagtttgtttttttactatttacaaaatgccatttggagtggaggtggccatcttcagtaacttgggaaatgtctttcacatgaagtggtcactgaagtgtggctcctgggattggctcagaaaggccacacactgtcctgggaggaagcatccccctctagggagcaccagaaaggctcagtcttctgtctcctcataggtagtctcgtcaaagggcctgtccagcagaggcagcggccggtggcgggagtacttcagttgcagcagatccccaacttcatctatctccttcaaagccgtgtcaagtatttctttggtatgagccgctgacaggcaaaatctggctctggactcaatga

SEQ ID NO: 1754 - DNA, 507 bp, Rattus norvegicus
  Genbank Accession No. AI071492
tttttttttttttttttacagaatcccacatacattatattttagacatatacacacgcacacacgcacactaacagcaggtaatgagaaaggattattataaaattcagtaaactaagataactaagacctgaatactgtcacataagcatgcagatgctggcaaggtgaagctgatagcagatgtggtcctcagagactaggaagtgtgtagaattcacaatgcagttgccctggagaaggtgatgtgccagggagaacagggcagggcatagaggcttccacatttgggataggctaggaaattctcacagagccagtattcattccggcattttttcatttcttatcttcagatcgtgcttaatggtaagtggttgaaggggggagtaagtgaatatatcataaataaaagtaaaactgttactggatagagccctagtgtcccacaccgagaaaggaaattgcagtctaagagccagcaaaggcttgagagaagcagcacgt

SEQ ID NO: 1755 - DNA, 517 bp, Rattus norvegicus
  Genbank Accession No. AI071504
tttttttttttttttttaggtgcacagtgaaaaagtttattcatgacagatttcaaaacttgaaaaagaagacaaaatgcacaaaagcatctcacaaaactatcacataatataaaaacaccacaactgagctgctaaaaccatggctcaggattcatccgtgtatcacagcaacacattcagtgccttgaggtgagaaaacattgtctgacagaagaaaaaccaaccactcagtggaacaaaagaactaagagttcttaatgtggaaatcatacatggacagcatttctcatgacagggagacgtggaaaacaagttactctaatggattagagtttggagttgtttgtattctgaagaaaaaagacgagactgtgtgacagtttcccttccaggcctttggtaaccttggttagcatcagcacacggtacgaaacagtaaggaaaaagcatgtcttcatggttgtcagttgcttaaacatttaccaagaaaacacatcgcttttaaccactgatg

SEQ ID NO: 1756 - DNA, 433 bp, Rattus norvegicus
  Genbank Accession No. AI071526
tttttttttttttttttaccaggaagaatgatctttattaaacatgctgtcctttcagtgccctctcttctctccaccttctctcctccctcttctggtcctgcctcagttccagagcccaggaactgaaacctcacctacccctcttctgcccagctgtaggctgtaagcatctttattgaccaatcagggataacttggtggggggggacaagattacacagcatcactttggtgtacaggaggatctcctcgtcccagaggcaaccagggccagcatttagcatcacaacacacagcaacaaaccaaactcaacacaaaggcagggattctgagttcaagacctgcttgggccacacaggaagaaactgttcaagcactagaatggggtcaacagtatagctagtggaagtagaggagagcctcgtgccg

SEQ ID NO: 1757 - DNA, 463 bp, Rattus norvegicus
  Genbank Accession No. AI071557
  misc_feature (1)..(463): n = a or c or g or t
tttttttttttttttttcattaatttgcttttattttcgggaaataatgtanataaagaggaagaggagacggactgccttacatctcaacaagtaatttgtgatcttcacatcggacaaatcaaatttacaaattactttcccacctactggaccaagcggccaaaaccaaaactgatagatacacaggtattctccgcagatttcggagaatgaaggttcactaaaaactcacggaacagacaggggtgttttaaagagagacatacaggaaattggacctggaactcgggctcggtttgcttcccacaatgttgtaatttcaccaatttttgtttgtttgtttctaagctgacgctttgatattgtgcttagactggcgaagggtcagtcttgcgccctgcccagcctagcccgacccctgtaccctgacttagctgttttcttcacttccgatcctcca

SEQ ID NO: 1758 - DNA, 456 bp, Rattus norvegicus
  Genbank Accession No. AI071566
tttttttttttttttttaagaaaagaaggcttatctttattatttttaattacatataggtatgtgtatctgtgtatgagtgcattgcctacagaggtcagaggtgtcaaaaaacctacagctgaagttatagatagtgtgagtcttctgacatgggcactgggtctcctggaagagcagcaaaagttcttaactactgagccatcttgtcccagccgtccctgggacaaaagtcttcaaacccattccagcctggctattctgcggtgttctctacacagcctttccagcgcagggacagggcctcaatcgtgtcccgcagcatctgtgtccagtcatctcctctccgcattggggtacagcgtgtctccttgtgctccagggccaagatctctgcgggggtctcaggagtcagcccagccgcctggactgcttctgggaatttgactgctgaag

SEQ ID NO: 1759 - DNA, 429 bp, Rattus norvegicus
  Genbank Accession No. AI071570
tttttttttttttttgtattgtagctgctttaatctgccctcaccctcccagcaggaagctccttataagaaacccaagtcctcgtctttgagcttctcctttagccagggcaacatcatagtcatagaactcagagattccttctgcctttttcccattgatgtcgtaattagggtggaacaggacctcttcaatctccaggtcccgccttttcccctccacgttgaccttgatggagtgtttctgatcttccactgtgaagcaatgcgctgctgtcagcacgaagtactcggacaccacggcccccatacagttctcatgtcctttcagaggacgagtgactgagatcttggcttgccatggttgcttgtaataatcaccgcctttctgatgctcccacaccatgccacagagacccagagatttgg

SEQ ID NO: 1760 - DNA, 368 bp, Rattus norvegicus
  Genbank Accession No. AI071602
tttttttttttttttttgggtccttttttcggagctggggagaaagccagatcttatggcactatgcaaaagtcaaagtatacagagaggcaagaaccaacaacagtgaggagacagaccactgaaaagtaccaagtgcagactggtagtcaaggtgggaaaccgaaaattcccagactttcttagacttcctaagcatggggccacagagtgaaggcagcttactgcccataactatatgctcgctttgtatccactccactgccacagtgggaaagccagttcactttaatcataaggattgacaaggcaactaatttaccatatccgtggctgtgacaatccacaacactgtcagcaaattcaga

SEQ ID NO: 1761 - DNA, 399 bp, Rattus norvegicus
  Genbank Accession No. AI071606
tttttttttttttttttaggagttggcatgtttcttgaatgtttcccagaatacactgtagcacttcctgtgcatcgtgctggagatagccttcatacatagggttgagttccctcagggtgttaagcagtcgccttggctgtgtcgcaagttcatctgtatatttttctggatttaagagaaaactagcttgaagctgttcaactgagattattaaggactgtaaactgcatataagctcataacttgccaaaggatcttatttgcagcttcccttatccttctgaatagagtcatccttcagagcttctttcttccttgaaataatattaaataagtgcttcactccagccttgaagccaggacaaaagtacaacacctgaagaatactattcagat

SEQ ID NO: 1762 - DNA, 380 bp, Rattus norvegicus
  Genbank Accession No. AI071644
tttttttttttttttttaaaagggttacaaatattcagattttattataaataaaatactgttttctttttaaacataaaaaacgccaagtgttgcgctttattcctgtggggaagactgtaaagttaaggcaaacagctaaggtgaaggcacatttaaaagggccacagttagagggaaattccatggaggtgggggtaggataaaaacaatctctttaaactctgacttttcttgggtcaaaaggacagtgacagagagcagcagagaagtgggggggtctgaaaagtgtaatttttgtgtcaaggcaccgaggcctcacagggccccctgtcagggacactgccttacagccctcccaccactagggtttctcgatg

SEQ ID NO: 1763 - DNA, 484 bp, Rattus norvegicus
  Genbank Accession No. AI071666
tttttttttttttttttcactgtccagaatgtttattggtgtgtgtagcagacaacatggcactcattccagtggccttcagtttgtattatctaggtgcagcattacccaaatgttgtgtatacctggaatgcatcagagtggagaaagtaatcttctttgatggagggggttgattgggagccaaaccctttgccaattttagtcttttgctctcagacctaggccccacccgcactccagtgtaaaaccatgtgaccagtcttgattcttgtcacagagggaacattgagaaccatttccctaactcccctcctccccaaagctagcattccccattggatttgtaagaaacattccttcttatcctcagagcagtcagtcttgaatgatgaggtacttctgatgggtccttctcaagacagtgcaaagcactgttgagcttttgctgggacatggatttcttctccaaagctgggttgtc

SEQ ID NO: 1764 - DNA, 478 bp, Rattus norvegicus
  Genbank Accession No. AI071668
tttttttttttttttttgatacttttacagtttaatttgcaaacagaatctttttgtaacaaattatttttaaccaaatcatatcttgaaaactgtttatatagaaacccagggaataaggtgaagtgctcactgcactgcggagggccttacatcacattattacagtagaaaatacaggaggtagagggaactgaagaccaatgcagcgccagcttccgttccacggctcctgcagctccttacacacggttcaggaaccaaacccaaccttcccagtaaccagataacagttaagataaaaactgcatgaaagcccttatatcatgcttgatatagggaggtacgaagatgtaagaaccaggacacatgagacatgacatttatctacaactcctgtttgctttactgaggatgttgtttcaaaattcagtcaccttcttcaacttccgactcacattcctcctcagcatttttg

SEQ ID NO: 1765 - DNA, 530 bp, Rattus norvegicus
  Genbank Accession No. AI071688
tttttttttttttttttggatccaatctctttattgtcagccctccctaccccccgtgccgcccttcacaaccccctttactttcaaacctatagaaaaaccccaagcctgggaatgtcctgggaaaaaaagagcagagtgcttctgccccttggcccaggcagtgcagacaggaagagtgcgtgggataagggtaggccagtaactccacttgcaaaggatgtagcactcactggctgggatgcaatggggagagaagttactgctgccagccttcctctggtactctctctagactggcatccagagatgggtgcctggcttgaggcctgagacagtgatgcccttctgctgatggccaatgctcctgcttactgcaaggccccatcttctgcatctgtgtcctggctgtgctccagctcctcctcgctatgtgtgagcagtccctcctcatcaccatcatctcgagtttggacttctccttggggtgtgcctgcctcagaagctgtgtcttcttggggtgctggtgg

SEQ ID NO: 1766 - DNA, 402 bp, Rattus norvegicus
  Genbank Accession No. AI071696
tttttttttttttttttgtaataagcaaaggcgaggtttattacggagacctattacagagatctccgggccgacacgtatcccacgcaggagacagaggtgtcggccccgagaggctgggaaaaagagtatttaaaggcattcaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtca

SEQ ID NO: 1767 - DNA, 501 bp, Rattus norvegicus
  Genbank Accession No. AI071702
tttttttttttttttttcacattcatagatagctttatttagcctttagaaaaatatatacatcagaaccacggttctcttaaatatttttaaattaaaagtgtgcaagtgagaggaagattgtttccacagtcagaacatcaatactgtgtatgaaggagacgggaattctgaaggtctggaatggttaagaactagggaggagcagctcgtggctgccaagtggccagtgcggatcacacccaagagactgctgtttccacctgaaaacagaattactattacatgcctagctttgagtaaaacaactgaatgctgggcagatacaaacaggcattgattaaaccaaaatttgccatttcaattggtattaacttgaatttggctacattaggatctgtcagtcatcattcaagtgctagcagatgcaataaaacttcaggggcctaaggagcttgttaatgtcatctacttcagataagtcttgcctcgtgccgaatt

SEQ ID NO: 1768 - DNA, 496 bp, Rattus norvegicus
  Genbank Accession No. AI071703
tttttttttttttttttctgttacactagttaactgtaaaagtttatgaagaaaagaatccagcagcaggacctaggagcagaacatggcttcccagggaggccaggggcagggtcatttcccaacaacacgctgctgggccgcacccaggactgagggttacagagcagtaatttctgtagaatgtaaacataggtgggtgactacgcaaactgaccagtgattctggccacacatgggggtcgggagttcccagtttctttctgtcagatttcccactgtgcaatgggagtaacttgagaagaccaagccacagaaacaatggtgcctgggaactcgacctggacctgctaggagaatggatggcgtggccgggtgtttgtcggaccgtctgtaggttcgttctccgcgatgccctcaggatacgacccgagagggactagctgagtagctgagacccagcctcttgcctccttacccctcactcgcagccctt

SEQ ID NO: 1769 - DNA, 273 bp, Rattus norvegicus
  Genbank Accession No. AI071736
tttttttttttttttggtctttttaaaaattaaaagtagcctatattcagttagaacatggagagctggctcaacagttgtaagaacacttccaagtttagttcccagcaccaatggccagcagcagctcacggctgcctttaattccagctccaggggatttgcttcagtctctggcctctgggcatctgcatacacatgcacacatacacagaatctttttttaaaaatgaataaaattcacaaggaacagcctaatataatatatacctt

SEQ ID NO: 1770 - DNA, 352 bp, Rattus norvegicus
  Genbank Accession No. AI071794
tttttttttttttttttctaagtaaaacatttttatttatacaaatggacggtcatagcccaatccctttgtcctcagcttcttgcttcatggcttcacatggctcagctctgtcttcctcttcctcctcctcaatcagatattcctggatttcctcagagacggagcccctctggctgcggagttgagcctcagtcaggacgtatggtggcaatgggtccagggagggcaggtccttcatgttcacccggcagctgtaacataactgctctatgatgcaggcccatgcatcctccctcctgccgactgccctgtggcagctctgggtctgaccctctcctgcaccacagca

SEQ ID NO: 1771 - DNA, 345 bp, Rattus norvegicus
  Genbank Accession No. AI071866
ttttttttttttttgttaaacttgaattttctgaagccttttatgtaccactaagcaaataactttaatttttaaataaactgggtttatatccttagttatatttctaattgttataagacatacttgctaaagtaacttaagccctcaaatgtagccgggaagagtttgagatagacttcagttactttccctgtacccagtaaagcactaattttgttaccttattgcctttacattgcttagtcttgaattctgttcactgttttgtttgagatttaaagttattttcttactgtatttatcatacctactgttttaataatctgccgtccttaaatgcaa

SEQ ID NO: 1772 - DNA, 271 bp, Rattus norvegicus
  Genbank Accession No. AI071868
tttttttttttttttttacaatgttaaagactaatattttgagctttaccaagaactgaataggatagaccaaggcacaatttttaggaagtccttctgcaagccacagaaggtatgggaatagatgggtatctggctagaggtaacaaccaaggaaagagaaaacaaagaaagtcatacaaaggaggcagagatgggattttgtctgagctagatgagtttgggtgcaatgtgaggagtctgtttcattgaggaatcactgaggaatcta

SEQ ID NO: 1773 - DNA, 385 bp, Rattus norvegicus
  Genbank Accession No. AI071895
  misc_feature (1)..(385): n = a or c or g or t
tttttttttttttttttagaggaggatgagcacgtgacacgtgctttctttttggctgtcatcagggttttccctgagcattcagaaaaggcagtgggtaactttttgttttgtttttgaacaggctacctatgtcaaaagggatgttcctttgtgggaaaaacgtggacagagcttctgaagcacacgagagaagcccataaaggtgaggcaggcaggagctgtggaagagcggacggtgtgctttgggaggctgagatacatgcttgggccggaaaggaaggggttctgcatcgagttctgtgtantgctggcaggcgagggagccctgcaggcctcggctggtgctgctgtgccctggctttcctgaggccctgcaggactt

SEQ ID NO: 1774 - DNA, 332 bp, Rattus norvegicus
  Genbank Accession No. AI071911
tttttttttttttttttgtctgtgattaaagtcctttactttttagcaccacattaaacgattttacacatccagtcacttaatgaaatccaacaaactcttcaagagtccgggggatctggtcttggtagttaatgtcattagcccgaactgctcgggcagccaggcacttgaggctcatcttcatctgagttttaagtagtatttcagacaccccagttgtacttttgtctagcggagttttattctgcttgtttgtcatgtcggtatgagctccagcttccacaaggctaatgatgatggagtgcaaggtcagaaaatcactgatgggg

SEQ ID NO: 1775 - DNA, 450 bp, Rattus norvegicus
  Genbank Accession No. AI071965
tttttttttttttttttggcaagttcttttgaagtttattttcaaatagccagtaaaaattgacctgagttcaggatggttatgtaaaaacaaaaaacgtgaactaacagtggtggtgtaaactcatctccgagttcacacactggggaccaagtgcaacggccaggcaagattatacagggaaggagaacaagagtctcagccttcggtgagccaccatgcaaggaaagcaacagagtgtcaaacgggagaagcaacagagtctcagctttcagtgatccaccggtggcccctgagctcctgacttaacagtgcctcaacactgtcgcccaggggagagtccaaacacaaaggaactcaacagtgtcctggtgtttttgtaacacacctcttgctatatcaatatagctctgactgtcctgcaaaagaaataacttcagagggggggca

SEQ ID NO: 1776 - DNA, 399 bp, Rattus norvegicus
  Genbank Accession No. AI071972
tttttttttttgtttgtcagaatcctgagctctggattctgacaaacaaagaataaaaatgtcaaaaaggcagagtaactcagtgaaaaacagttagccagtaacctcagataatcattggctgtatgtccttaagatttgctaacaatcccattaaccgtgaaagccctatacagtgtcactttgaacttctaaaaccaatacccgactacgttctttgatcaagaagtagaatatacatttataattctataaagctaatactgattaaacacagcacaaaaggattagtttccactaatgaaaaaaaacataatgggaccctacttgcatatgtagccacaggaattatacattttaaaaaagctaaatgtcttcgctgaagctttgcatctctct

SEQ ID NO: 1777 - DNA, 362 bp, Rattus norvegicus
  Genbank Accession No. AI072014
  misc_feature (1)..(362): n = a or c or g or t
tttttttttttttttttcagatttttaaaggatttttatactatattaaaaaaacacaaaataaaaaagggatccatcaacatatatcttagaagtccatccaagagtttcagtgtccagcagccatggaggctgacgcctgtgccattgctcagtctgcagctcgtgtaaggatcaaggaggtgactttaagttacaatcacacttgctctgctagatccaagaccctgaatttatccaaattgtagaaacaggctttaaccacccgtccaccaaaatacctcccattcagatcgacaacagctttaattgccgattcgactctctcanattctagaaatatccgtactgcttcatcatca

SEQ ID NO: 1778 - DNA, 279 bp, Rattus norvegicus
  Genbank Accession No. AI072036
  misc_feature (1)..(279): n = a or c or g or t
tttttttttttttttttggggttgtgcaaatgtttttatttccacatttatatcacaagttgtccacttactggaccaaatagcaaagttgctcccttctgcgtgaacacagaagtctaggtactgtacattcactaaggctccttgtttttgcaaatcgagtttatgacaaccataaggcaaacgaatctaaaggaatggttatgagtgtttccagcanacagacggctctcccctagcccagcagggcaactcacaccagtagcaccctcgggaact

SEQ ID NO: 1779 - DNA, 454 bp, Rattus norvegicus
  Genbank Accession No. AI072050
tttttttttttttttttcattttttaaaaagttctattttgtctttaggaattacatcagaaacttacatctgtaagtacagaactcaaagttaatttgtagtcgagtttaaaaagataaatagtagagtcagaaatatttaagcaagtacatcaaaccatttattaaacagggctttgtgtagcctcctgtcaagagataacctctagtgcttcagagtggagaacaagagtggctgttgttctgaagtgggtattgctgtgttgctgagtgtgatataaaactccaggctcaaatgatccacgcacttccccttctaaagtgctgaggctaaatggctcagttaattttgggacagtcaccaaggagggaatacagatatccacagaaatagtcatcagaatgatacattatccaggctttgaatacgtttctactatgaatccattttcca

SEQ ID NO: 1780 - DNA, 210 bp, Rattus norvegicus
  Genbank Accession No. AI072081
tttttttttttttttttagaacaaatttttattgtgaatgctggtctggtcagtccatggccacagggcagtggtaactagaaacagctggagggacacggagggagggaaggaagagcaatcaggagcagaggacaaaagagacttgggaggggaggcggggctgtatagggccacagccagctgcctatttgtcttggcctcgtgccg

SEQ ID NO: 1781 - DNA, 302 bp, Rattus norvegicus
  Genbank Accession No. AI072121
tttttttttttttttttacaactggatcaacacttggtaacactttaatagccaattccaagttcttggcactaacatttccttcacctcccccaaatctgacaagacactcacgctgcacgagcctctcccctgtagacagacacatgactgcaggacggcaggcaacagaccttggcttcccgtatcgagccactctccactccgacagaccgacagaccggccgtctccatgtgtcccccctgctcgtacccggtgcttctcctgacacctgcagcttccagctcgctccgtcctcttt

SEQ ID NO: 1782 - DNA, 256 bp, Rattus norvegicus
  Genbank Accession No. AI072164
tttttttttttttttttgtaaaacacaagagcccactctgctttatttacaacacgtaggccgtctgtacaagcagccagccgatattattaaaaacaaggcgagtgataattgacaccttttttgctttccttcctcactccaccaggctttggttctccacctttgagcaacctcgctcaaatgggggagcccaaaattaaaaatacatccggtgtagaagaaagtaaatggaagaaagaagaaatgtgaggaa

SEQ ID NO: 1783 - DNA, 300 bp, Rattus norvegicus
  Genbank Accession No. AI072166
tttttttttttttttttagggttttgtgttacataacccaacttcttacaccatccctttagctcctgcctgttgagaatctgtttaaaatccaaccagcccactagttaggtcaggtaccaaaatagcatctggcctttttttaggctcagcactgtttcccaaaattaagtttaactgctaaaagaaaggaagaaacttttctcttgtacagcagtttggtcaggattaaataaatggtttggcataagcgtaatgaggttcacgaacttgaggaaagggaattggagacagtgggtt

SEQ ID NO: 1784 - DNA, 538 bp, Rattus norvegicus
  Genbank Accession No. AI072183
tttttttttttttttttcgcattcaacttaaatgcttttattgacaatgtcttggaacaataagcaaacaatgcttaaaattttttcattcaaattcactttccacatgtcgaaagacctcaggatagaaaaaaataaaataaaaatataaatatctgagaatccatcttaataaataaattgaaaacacaataaaacgttttcatggaaaactgttaatgtcagaacattcagaccacctcaacaatgcatgatcagttacatgacaatgaacatggacgctgaagagctacagtacgtggatatagcgatttatttctatctaccggaaaataaagttctatcttttcttagtttaatattggtcatttctaaattggaacacactattgccaggaacacagtaggtattgttaaaatcagctgcactagatacaatccgaaaaatatccagcaccaggttaattccaataatgaacccaacagattagttaatgctatgagaagactaaggagaaagagaaaagagacacagacc

SEQ ID NO: 1785 - DNA, 442 bp, Rattus norvegicus
  Genbank Accession No. AI072257
cggccgcttgctcaggtcaatggggccgtcggggactgggcccggagagggcgtgggggctgggccagcgctcgcgctcgcgggtctgggagaagagggcagctccgccgtaggggaggatacaaccggcaccggggccggccctgctgctgggggcggggcaccggctgcgggcagctcgtacagtttgcgacgccggcgcgtgcgcacgggcggagctgtcagcgcgggagccgcgggtcccggagccggcgtgggtacgggtggccggcgcggcggagggtcgtggcgtgaggcgcagtagtagcgcttgtgcacagtgtaggtttcgtggcggctaaaccggatgttgcaggcctcgcacagcgtgcggctgggatcgtcctctgcatcgtctaccgagctgcccgggctctggctgccctcgctgcccctcgtgccg

SEQ ID NO: 1786 - DNA, 508 bp, Rattus norvegicus
  Genbank Accession No. AI072294
tttttttttttttttttgttaaaacatgaagagaaaaaacagacaggatgagcacagatgtgtcttcacattcaaaacaactgcagacttagtggccaagtgtgggaaacagagattaatgctgatgtgtgagggacacgagcagagatggaggtgggatgtcaggagattgcacgtggatgacagggaagcacttacagtcaactgctgttttcctctttcctcaaggatgctatcgaagggttttttgtttttgataaagtagccaacagcaccaaaaaaaaaaaaaataacagaatggatttcctaatgaaatcaggcacaggtctccctcagtgaccctccaaggcaggcagtctttgtcctctctcttcctcgagcggatgcatagtgatgtgctggtgtgagaacctcgtcactcaaacctcacatttcgcttcagctgccatagccgcccagccaaacaaacggggctcaaagttacaaactcccctcgtgccgaattctt

SEQ ID NO: 1787 - DNA, 444 bp, Rattus norvegicus
  Genbank Accession No. AI072299
tttttttttttttttttaaattcaaaaagtttattgcaccaaatgtcacagaaagatggatcaaaacaatacatgaatgttgttttaggaaaaagtctctgcacactgacagtcatatccactctgctgacttagaaaccagtcctatcaatttctcttaatgaaagatcaatagtaacacagctcagagttgtctcctttttaaaacactgaaatttaaacataatggaaatagaagttccagatgtccaccaaattttaacatttaaaaaattaacattcaaagggggctgcttgatttagacaagaattgtattcttctccgccaagcacaataaaaacaaagggttcacattaactaaaagaagctacggaccttttcagtttaatgaaccaagtctgtgtgaacataacacctaagagtgcatcagtgggaaactccgg

SEQ ID NO: 1788 - DNA, 317 bp, Rattus norvegicus
  Genbank Accession No. AI072392
tttttttttttttttttggaaatcattgatttttattaatttcataactgggaaattctgtgtgaaagcaaaaggagcacgggccatccacgctagagagacacttgcttctcgggagggcacagtggttctggcacaaccctggggattcctagcttttgtctctgcgttccaggatttatgtacctgggagcaagaacactcagagctacgaaatgcgcaggaaccttctgctgtgacagaagttctgtctcatggtctttacaggtactacctggggatctccgcagagccatgttggcccccactgtgcaagg

SEQ ID NO: 1789 - DNA, 371 bp, Rattus norvegicus
  Genbank Accession No. AI072402
tttttttttttttttttcatagctgggtaagaatgtttattactttacatccatgatatcatacatagaaagtgtcatggagatgccaattgtcctgaaggagctgcttgacaaagtttcagtgcttggtcaacaactggaagacacttcactgccattggtggaaatctgcttaataccttttgttatatttctcactgtagcctctctccgaaagctagagccaggaatacaaggttgctgtaattctccagcatcaattccctgtacagattccactgagcaggctccaggcattcccactgctctacagagaaatcaatggccacttccctgaatgacagcatttccttcatgtcagagagcccact

SEQ ID NO: 1790 - DNA, 384 bp, Rattus norvegicus
  Genbank Accession No. AI072403
  misc_feature (1)..(384): n = a or c or g or t
tttttttttttttttgtggaccaagtctttattagtactgaagcctgagggaatggtattagggttcacactttggacacttgctgagttgagttcaacaaaagcctcaccactctgcctgccttctctagtataaatgaaatgaacacctgcgaccccatcatgaattgtgcagtcggagaggaagttttgtacgtcctcaattgagcaggaccagggtaggccacggagtttgaccacatagccttcacctccctcagggcccagcatcatggacacttgacagggttgatgtcacacaagcttgggcaattttttgtagcttaaagaaccaccacagatgccttctgtangaaacacagaatggaagataacaagttttcc

SEQ ID NO: 1791 - DNA, 496 bp, Rattus norvegicus
  Genbank Accession No. AI072405
tttttttttttttttttgggatttacagaggtttaatgaatgagccttttccagcagcatttaacacatcactcaaaagaacaagtcttaactgagaaatacaggctgcctcattttcacagtgaagtccaggtagtgaaaacagtaagacaccttccacaaaggaaggagaagcaggatgagtccagagtttgaaaggtgcccaaaccgtcacatccagcctgatcgtccactgacttcgtttgagtctttgggagtggtcattccttcttgttactcagttggttgttgtgcagccacggaaggaagaagctgaacatgaggatcatcagcagtacgcctagagaaggagcaacccaatatactacgaaaaacttatagaacgattcgtcaaagcacgggaagtgcagcgaaagtgccagtgctgggttaaacagcgctcctgtgaggctccctcctgcataggccaaaaaggtgatgagtgcagccagcacgt

SEQ ID NO: 1792 - DNA, 519 bp, Rattus norvegicus
  Genbank Accession No. AI072424
tttttttttttttttttaaagagaagaactttattctttattaagataccatgctagaagttatgaagaatttttgttggaacacatttggaaaatagagtagctttagtttaataacttgcactgcagagaaaattgttaaagaaattcatatcaaagtccaagtattagttcaatgtcccgtatttgattccatgatcttcacagggaggtcttctgcaatagaatatgctcctatacagccgagatatttaaggttgcttgattttccttaccattactccactgcaagcttctggtgtaatcccacatagcaagtcagtcttcattgtaacaggtcaggaccggcctcgaccccttttccctgcccgcggcctctttgttgttgggcacctcctctcgcaccacgaacgcctcttgctgatccagggcctcctctctgtgaataaccggctctaccacggggaggagcagccccgcgacctctggatggagcagcaccccttgctcctctaccac

SEQ ID NO: 1793 - DNA, 475 bp, Rattus norvegicus
  Genbank Accession No. AI072425
tttttttttttttttttcaggtaacaggctccttccttgatttactcacagatgaaaagattaaaacatcagcagatcaaataaaactcagggcaattcataaggcactttgggcagcagcaatgggctgaaatgggagagatgagcacacactcaacccggcctaggagtgccttcgccgacagggctgtatcgcaacactagggtgtcgtgaacaggcttccagacatggtactcagtacacgacctagctggtcacgtgagtactgggtcctcgatgccgtggtcggggttgcaggtgaaagcgatggtgatggcgtagcgggtgccccagaggactttctccactcggtgcaggttctcagaacctgaagtaaagaatgagactcgaccagctctgggctccactgtcttgttggacccttcctccatgaacacaaagcgccctccaccgaagtcctctaagtaatccgat

SEQ ID NO: 1794 - DNA, 501 bp, Rattus norvegicus
  Genbank Accession No. AI072439
tttttttttttttttttccattctgtattttattactgaaatacgttgtcttacccaacccacccaaaaataaaaatcttacccttgtcctctaatctttcccttatccccagtcccatccccggccctgcacaagtgccccggatttcctgcccattggctatatcggagtgtgtccattatgtagcaacgtggaagcctctgtggagagcacagagtgggtgaaggacccttaaaaaggtgctcatttgagagccctggccacttgctcataggcagaaaacttggcaaatatgtccagccccgaggtgttggattcggggttcagagcagccaactttgggtacctgggagggcacagcacggcctccaggaactcctcgattttgttggtatctgtgtgcacttcggtgccgtagagcaagaacgggagctgcccaccggggcaaagcttctgtaccgtctctgtccgtctcttggtgtccacggtggtaacgttga

SEQ ID NO: 1795 - DNA, 332 bp, Rattus norvegicus
  Genbank Accession No. AI072467
ttgtttttgttttttgtgtttttgtttgttttttgtttttttggttagaagctttggaattgcagttagtctatttttgaaattggtttgttattaatctttttttctttatttaaattcatttgtaattgttcatcttcaaagcttacaatctgaaggtgtccgttcctacactggtcagaccactgtccttggggcagctggggtctttgggaccctccaccgggctcgccggtccgtcggacttttggctgagatccgtgtcagactcctccgaatagtcgtctgttggcatcgagggctgaacccctgaggtgctgcatgaacttgag

SEQ ID NO: 1796 - DNA, 274 bp, Rattus norvegicus
  Genbank Accession No. AI072476
tttttttttttttttgtcccaggaacatgaagctagcctttactaatcacaaacattccagaatctgtcagacgcttcacgtacagtatttcatctaacataacaatcctgtaacattgatagtaaccttattttgttaatagggaatccaaggtttgacaaggttaattcgctgaccaaaagccatagtcaggtggctcaaggactccagatcccaagctcagtttactggccatgacattttcttgcactttatgtgtgaggtatacaaccc

SEQ ID NO: 1797 - DNA, 469 bp, Rattus norvegicus
  Genbank Accession No. AI072550
tttttttttttttttttgccagttattgcatttattattcatcagaaaaattaagtgactaacaccattgtgctcattggtctttcccaagaaaagaagggaattttatcccaatttctagaccacagttgtaggccgtggggaaagacaacggcagcagttatagctaacggttgatgcatagacgtgcaaggatttttctgcacactgtcttagcaatgagcgtgttctccctcaagtggctcattaaaacatgttacgtggttttcaccatgaatttactcagtgtattggcgagaggacagcttcgccattcttactgaactaatgagcacagtattgctgttttagcccagaacaattcgttactcttttgaaaagcaccttaggtttattttttcttccttccaaattgctcatagcaaacctttaacatttccccttctttttttggaatgaaagccttttt

SEQ ID NO: 1798 - DNA, 444 bp, Rattus norvegicus
  Genbank Accession No. AI072558
tttttttttttttttttggattttgagataaggtttttttttttttttgtgtagccttgagtgtcctggaactcactctatagaccatgctggcctcaaagtcatagctatcggcctgcaactgactcctgaatgctgggatcgaaggcacatgccatcacatcaggatgaatattactattttaaaaccaaaagttgaaaacggtaactgacttcttaacaagacttacaagtatggaatgttaatgtcaactaaatagcttgctaatgtggtgaagatgggcagctgtgagagctaaatcagaattttataaactatcataaaataaacagaattctcatcttactaactccttttaaaggaacggctataataacaaatgacagttcacatcagagattgattccttctgagcctttatcaaggcatctcctctctcttcc

SEQ ID NO: 1799 - DNA, 283 bp, Rattus norvegicus
  Genbank Accession No. AI072578
cggccgctctgcccccgagcggcgctgggctcgagagggcggccctgtgctcccgggcccgctggccaacaggcgcggggcggaggcgggaaccgggctcggacccggcgcgcaaggcggcggcggcggcggcggcgacgaccgcggagcagcagtctcggcgcgacgtggaaggatggaggcggcggtgcactaggcctcgtctggggctgcagcccggactcaaatgggttccagaaacccctgtgccaggatcagatttgcaagtatgtccctcgtgccg

SEQ ID NO: 1800 - DNA, 369 bp, Rattus norvegicus
  Genbank Accession No. AI072603
tttttttttttttttttcaaaaaacacgctagtcattaaagggcagcagatactactgagggccacagccaggaaggcagcgggtccagaggaactgccccaagcaggaaccaaagggagccccacctgcaccttcacaaacaaggcaggagctccaggagcggccaaggggcgctgtggaggagaggcagccggctttcttccctatctttagcctatttctcttccttgaacatgttttaggacaataaatttcaaaatacataccaattaaaatatcacacaccagtccttttactttatcaaaatgcctacaagaccagatgacctgaaagcctgaggtgagacagcaaggacaaaatcctttac

SEQ ID NO: 1801 - DNA, 359 bp, Rattus norvegicus
  Genbank Accession No. AI072617
ttttttttttttttattgattcaactcctttatcatttattcttttgataaacatcagataatatgagcaaagttatcttgctcacaatagttacacattctttgttttactttttacaggttataaatatatgtaagtagataaaattcttggttgatgacacatttcaaaatgttgacatgttttcaatcaggactgaagaaagcttgtggaagttccatcagaccagcagcagcaaacttaatttgcatacattgttcttaaatcaacacctagcatttttaaaagacttttccatttatagctaaaatggtggaagtaggccatacattttattcataaatatactggccattgt

SEQ ID NO: 1802 - DNA, 333 bp, Rattus norvegicus
  Genbank Accession No. AI072634
tttttttttttttttttggagtctaaacttttattggtccctcagtccccaaggggttcccttcttctgagccttagtgcctcagaactctggtatcattggtctcggacaccactttgccatccacgaccttacgggtagttgtcctctggacagtttgcatggagttgctggagtccagggcgtcgttgagactgaaatcgtccccatcctccaacaagcggcggtaggtggcaatctccgcctcaagcttgaccttgatgttcaacagggcttcgtattcctgggtctggcgctgtccttctgcccgagtttgtgccagctctgattcca

SEQ ID NO: 1803 - DNA, 207 bp, Rattus norvegicus
  Genbank Accession No. AI072748
tttttttttttttttttagaatatattatacatatattctagttcactggtataaccctgggccggccaggcagaagacaaatggtcaccctattaacaagtgtcccctgctctgaactggccctaacagactaccttgattttacaagactcatctccatgttctacgtacatcctggaccttatcgctccttgggtccaatcctt

SEQ ID NO: 1804 - DNA, 332 bp, Rattus norvegicus
  Genbank Accession No. AI072751
tttttttttttttttttgcataaaacacctttatttagtggccagagcccaatgagtaatgtcagtcttggcttgattctgttatgatgtgctgttacatacactcttaagaaagcagagaagtgcgtcaccgaaagctctttaacttggaagtgtgtaaagtaaaactgtttgtcctttgataaaaatctttaaaatataaaaatgaagaggaggaaagaaaagaaaagaaccccagagcagtttcaaaactagcagacgtcaccctggactatttacagtaagacgcctttttaataagagaataagtctactcgaggctcttctcacac

SEQ ID NO: 1805 - DNA, 312 bp, Rattus norvegicus
  Genbank Accession No. AI072793
tttttttttttttttttaggggactggaaagatagcttagcagttaaaagcatttgccgctcttactagcgacctggggctcagatcctagcacccacaaagcagcttacaaccatctgtaactgcagttccaggggacccaacaccttcttctggaccatgtgtgccacacatatgtaatacaaatatgtatgcaggcaaaatagtcacactttataaaaataattttaaaaatatatttgtatgtatgtatatatgtatgtatgtatgtatgtgtgcctgcatgagtctgtgtgcatcacatgcatgtgg

SEQ ID NO: 1806 - DNA, 499 bp, Rattus norvegicus
  Genbank Accession No. AI072812
tttttttttttttttttgggagcagtaaacatttattaaatacttcctagacacatcatatacaaaagaggtagccggggcagacgtgagcctgaagaactaacacaccatactaatcactaattctatagtagagaagtacaaagtctgcacaagtaagactttataacagaattttcaatcctgcccgaaggaaaataaactatacatatagttcaatttaaaaaacaaaaacaaaactttaaaagttgtgcttaacatagtggactgctacacagcatcaagtcttagagcactgatgtgctccagggacgacggcctgacagagtgaggacctggagtgctctctgagagctcctcccagaaacgccccagcatctgcagcttgccctcctgtggcgcccactgctctgcagttgactcatatgtcttttgtctgatcgtcttcttcaagctttctgatttcattttttaaacaatttatagtttccctcgtgcc

SEQ ID NO: 1807 - DNA, 476 bp, Rattus norvegicus
  Genbank Accession No. AI072877
tttttttttttttttttccttaagaaccaagctttatttacattaaaaaaaaaaaggaaaaagaaaataagttgttgggggaagacaagttttacacaaaagtactacaacagtatctccctttggtaaaaagtgtaataaatgtcttgtacatctgtttataggtactaaatctgaacccacatagtactattgtacacaagaagctagagcagttatgctagcacatcaaagcatagttctttaataaaaaattgacagtatgtacattatttacaaaaaggaaaaccaagttaaaactgtgtgtgcgtgtgtgtgtgagtgtgcctgtgcgagagcgagagagcgagagagagggagagagggggagagatttttctatttggacagcatttcacactcccctgcctacaccctgggttgaaccacccctgggatctctctctctgtctctcattctttcattcatattcatt

SEQ ID NO: 1808 - DNA, 444 bp, Rattus norvegicus
  Genbank Accession No. AI072881
  misc_feature (1)..(444): n = a or c or g or t
tttttttttttttttttacttgctctgggattggtagggtttttttttcttttttcagacgcactacctttctcagaactgggcccaggggttaggataagaagtccttcctgggcgcaggcagctttgctgtggtgccatctctgtggagttgctgggtgaggcaggagaggagttgcccccacaatggacagctcctggggggcagctcctgcttcagaaaaaagcagatgagccaccctggactgtgatgtcttcagcctgatgagaggccttggtgcagccattttctcaagagacacaaattttgacagtccctgtgagggcatcttaaagctgaggtgagaaggcagggcctggcactggtttgaccgattttgctgtgcactgcttagggactacatggtgtantttggagccgctggtgttgggaaaactgggaga

SEQ ID NO: 1809 - DNA, 357 bp, Rattus norvegicus
  Genbank Accession No. AI072885
  misc_feature (1)..(357): n = a or c or g or t
tttttttttttttttttgctcctctcttggtattttattgaagggttccaggcaacattaacagcacaatgttcatataacaatatcatataccgacttaactgtgacataaatgccattaacttactgaaattcacattatgaacacataatgggaatatgttcctcaaaacaggaaggtgaatattaaccaatgggacaaaactatctttaagagatagacataacaggaaaagattccatttggctcaagggccctgagggcagagtcctatgtttgtgtctttagaggtcccaggctttggatgaggcggcttangaaagtgtccagccgattcctggacctgtatgctatca

SEQ ID NO: 1810 - DNA, 425 bp, Rattus norvegicus
  Genbank Accession No. AI072886
tttttttttttttttttacagagaaggtgcagacattttattctgacttaagagtgaccacaagaacgtccaccttccaaagggccaaataaaaatagacctttacaaattaaaaaaaggtaccatttatgtacacagtgacatcagctaatgctaccatacaaacagacagtatgaacaaacagaaaggaagaagctgcagctggacagacagtcactgaggtccacaggagctgagggcaacactccacatccacacggctgggccaggagggctgtgctggcttctccggaagctttcttgtcaccaaggtccgcatcaaaatgtcacatggctagctgagtcaagctaatgtccgttccagctggaactgcttaacaaagtcacatgcagacatctcataaaataccaaactcccacagca

SEQ ID NO: 1811 - DNA, 333 bp, Rattus norvegicus
  Genbank Accession No. AI072896
tttttttttttttttttggtttaatttttcagtggagaattgtgaagctggagttcctgagtcgtcttctccttattagtctttaagggagtgggaggccttggcagtccggctgttgacgaagtccgtcttcttaaactgagccttcttgtaggcattatggagctcggtgtgtgcccacagagagtacaggaggacagaggcagctttgctggccttgttgggggcatagccttctcctatgctgatggtcataattttctgcagccctccagtgttcagaaggtctcgtgcattctggtaactattttgcattaaattgttcaacgtata

SEQ ID NO: 1812 - DNA, 388 bp, Rattus norvegicus
  Genbank Accession No. AI072914
  misc_feature (1)..(388): n = a or c or g or t
ttttttttttttttgttagaccagacaaacccttttattacactgttacaacaggggcttccacacagaattatcagagatgactatcggctcttaactgtgtctgctgttggagctttctacctttgtgtctggctgttctgctgcataaactcttcaacaactatgtcctccgatcttgcaggaccagcaaaggggaaaggagagttatcaaacccctctctgggcttcctccacattcttgattctatagaggtaatcacttccctgcttctcagccttcccctccttgccccatggggagggcttgtttcccttctgaatctgtctatacaatggtgtcaaggtgcattanaagggaaacagtgtagcatggggtacagggaaa

SEQ ID NO: 1813 - DNA, 495 bp, Rattus norvegicus
  Genbank Accession No. AI072950
tttttttttttttttttatgttgcaaaaacaagttttacttttaacaaaaacatttaacaccttccattcagaaccggctggacatacataagcagcattctgaggtcacacacacagctgtgcctgttgagtgctgaaggtacagcaccaggtctgtggcattgggtcacagtccagctggacaccgtgggcacacctcggatttctggacttagtctaggacagacactgtgtttagcctgtcatttggtttaaaggttggttttgttgtaacagtgcttatcataccacatgtcagcagctcttagcattactgagggcaaggagggaaggactaacagcacaccagcttggtaagatcataaatatagaagcttaaattatcactgttgccagctttaacataactagaataagctaccagggtatcacccccagggatagccgaccagtcagctgtatctaaagttcattttaagcctcgtgccgaattc

SEQ ID NO: 1814 - DNA, 558 bp, Rattus norvegicus
  Genbank Accession No. AI072957
  misc_feature (1)..(558): n = a or c or g or t
tttttttttttttttttaaaaatgtaatactgtttatttaacttcaaaaacatttcagcattctaaacatacaaaaaataacagaatgttgcaaattgggtttaggtacagagggttcttgaccttccattgatgcagtagttcttcactttgctgacaacgatgagttctacagttgctttaaaaagtttaaaatctactgcacttaactaaaggaaaaactccaaacacttctcatgccagctgacccctccccccgcctccacaactaagaatgtcagcagaatgctatgccactatgtacaaaaacaagactacctgaagctaaatggatgcccaccgcagtatcaacaggtccagcctcacagtgcacgccctgagctacggccccctctgaaaggcatctcncctcacaacgtccacgccaaacaaggagcatcaagaatctgtctgggctgttttgttctctttacaaactatagatatgtacagctgataactcaggatttctagccaatagccatagagttaacactaccttacgagttgagaacaaaa

SEQ ID NO: 1815 - DNA, 268 bp, Rattus norvegicus
  Genbank Accession No. AI073003
tttttttttttttttttgaatatattatacatatattctagttcactggtataaccctgggccggccaggcagaagacaaatggtcaccctattgacaagtgtcccctgctctgaactggccctagcagactaccttgattttacaagacccatctccatgttctacgtacttcctggaccttatcgctccttgggtccaatccttgaaccaggacttcatgggcctgaaaggaaaagcaagccttcatcctccacctcccatcgcag

SEQ ID NO: 1816 - DNA, 320 bp, Rattus norvegicus
  Genbank Accession No. AI073004
tttttttttttttttttgtggtttcccaaccgcattttaccactttgaaatgttttaagtcatcagtccagagatgcccagaattcttgctgacccgttctgttgggtcaccctgcccccggtttaaagcaatcgaacctttgtatcagaaagaattctgccctgagcacagtaagaggaagcaagtgagctatcagacatctccctgtgaaatgaaaaggctttaggctttcaagccccattgcggttcttccctgaagcaacaaaaatcctttttaaaaattctcttcttccaacatcagaatggtaacctcgtgccg

SEQ ID NO: 1817 - DNA, 364 bp, Rattus norvegicus
  Genbank Accession No. AI073056
cggccgcagcactgctgtgttgctgctggattccttgtcctgggtcatcctcatcattcgggaagaggtcatccaacggctctttggaagaatcagagtctttgtcttccgagggagagatgtcgtcgtcgtatttcttcagctggttcatgaactccaggtgcttcttctcctcctccagctgagccacggactgctcgctcttctgtaacttctgctgtgtgttggccagttcatcccgcagccactggttctcctggcacagacgtcgaacctgagctcggagcttctgcttctcggactccacggcattcaggtgattagacagggccatcatcacctgcgcctcgctcaggccgagctc

SEQ ID NO: 1818 - DNA, 343 bp, Rattus norvegicus
  Genbank Accession No. AI073059
tttttttttttttttttcaacttttagattttattgaccaagctgatcatgttttattgttcagagcctcccagcagggctatgaccaggacccacgccaaggaggctggaagaactgataatgatgagtagcaaagggcaggcaggcctgtgcctgctcacatccaagtggaaacaatgtctctgaggtggggctgtccaggtccagcctgttcaggcttcacagccacacccacatgagggctcttgagtgaggccggcgtagaaaaggcatgggaacagaacctgtagaaaatcccaactaccataaccagcattcattcctacttgaagttaatctctt

SEQ ID NO: 1819 - DNA, 403 bp, Rattus norvegicus
  Genbank Accession No. AI073086
tttttttttttttttttgcagtgatcagtatctttattcatacacgcttgcttccgaactacaatgaatgcatctaacagagcgaatcatgcaaacgaagagtagaggttacacaaatccaaaaaagctaggcgctaatttacatatctacctcacctgctaggtaaccaaacaagcagcggaacagcccctggcttatcagtaaaggcctgttcaggcaacagcttcaaccttcactccttcctccaaaccaatttggggttttgcatgattttttttcaataagagatttaaacacggcgtgtccttcataaaacaaaacagaattcatgtaggaaacgcaactccaaacgcatctgatcatctataaaaggtattctgaaaaaccgtcatagtcaggata

SEQ ID NO: 1820 - DNA, 327 bp, Rattus norvegicus
  Genbank Accession No. AI073118
  misc_feature (1)..(327): n = a or c or g or t
tttttttttttttttttccttcaccatgcttatttattcagagtaccagcgatttcagtttactgactcattcattctctgcaagtctgacgcagaacaggggaaacacatccatgtgaccacaccaccacaggtcggggaacactgtgaatgtaaatgctttataacatgtcaacaaacagataaacgaacaaaaacaaacaaaaaccccaaaacaaacaaaaacgctacttatggcaaacaagaaagtaaagatccaaatgctgccttgtctccagtgcgacttcagctgtgctttccacganggctgtcagtgctccagaaata

SEQ ID NO: 1821 - DNA, 477 bp, Rattus norvegicus
  Genbank Accession No. AI073178
tttttttttttttttttcacacaatagattttattttacaagatgctagccatttatttaacaaaatggaaatctctgatatctagcacttttctacatttacattgtcagagaggagacgcttacattctacagcatacgtgataataaaagaatccattgtaaatttagatcagctaaaacattttctctaatgactaggattcattatcctccagtgaggtaaggtgacgtttgctttgtaagaggagatgtggtagggacaccgccctccctcccctctcatctagatattgggtatttgatggatagaacaggtgcaagtccttttctctggtcaagtgtaaatcccttgaatttaggaaacaactccaaccatgaaccaaaggtgaaggctgcttccacccgctccgctcacacactgctccataaggcacgaggaccctggcttccctcacatgctgactgcaaagcctg

SEQ ID NO: 1822 - DNA, 345 bp, Rattus norvegicus
  Genbank Accession No. AI073193
tttttttttttttttttcccagtgtagaagtgatggtaatgaagacacctgtgtaggaatcaaaacctcaaaaaaaccaaaacaacaaaccactaaaaatgtcatctgaatttctgatttgaatagcaaacttggagaaggaagagtaactgtggaacaaaaatttatgaaacattcaaatgaagaacagagtctgggctactaaaaatgcccaacacaagacactccacaaacctcccatctgttgtcttaatctaaagactattggctaacatacaataatctgattaataacctgagaagttaaattttgaaagtggcaaaagcaagctgagtgaacaactc

SEQ ID NO: 1823 - DNA, 454 bp, Rattus norvegicus
  Genbank Accession No. AI073208
  misc_feature (1)..(454): n = a or c or g or t
tttttttttttttttttaaatcttgtctgttttatttagctctggaacaaaccagattaccaggaattttagggatgggaaaaacggattagaatcacattccgaattaatacattcaggggctggagatgtagctcggggttgagcgcgcttgtctgatacagccaaggccctagttaggtccccaacaccacaaaacagaacaaacccaaggggaaggagggaaaatccaaccaccagaatattaaatttgtgtttaggtagcatcctcttgggattctttcactgcctgagatgaggctgttctggcttgactcaaatctctggggctggcagagctcagagtccagagctgaggcaggtaggtgactggttgggcatangaggcaatctgattggcttttcttgttgccctgtgtaagttgacggtcggcaaagccttttcactccatgt

SEQ ID NO: 1824 - DNA, 558 bp, Rattus norvegicus
  Genbank Accession No. AI073210
  misc_feature (1)..(558): n = a or c or g or t
tttttttttttttttttcatgttactgtaaaatacatacagacctttaatggaaaaagaagagcaaatctccatacaataaaactgcatagtccatttttaaaaagaaaatcaaaggcagcacagtatgcatgcagctgtttgtgagaacagagtgtctgtccacaagactatgcagctgacatggagcttcctgggtcttcctgcaagttcagtgtgatcagtggtatgtgctgctgtacccaaagccagagcagtgccatctgcccaggactctcctagtgggagacgaggtgactgaagggcctgtggaggaggctgctgtctagtccttcccactgaaagagcgaatgcaacaagttgcaagtctgagacaacgctgcagtccctccacttcgcagctgctagtgtgtccttgtgtgtgctcacgggactcgctgagagctcttcttgctggcctaagccggcacttcaccaaggtcgctaccatcgtcatcatcgtcctcttcctcnctcttctctttgagcattttcaggtacttactagctaaaatcttct

SEQ ID NO: 1825 - DNA, 516 bp, Rattus norvegicus
  Genbank Accession No. AI100768
atgactccttcatattgtattttgatgttctaagctattgtagatcaaaacactttattatcaagaaatacactagtgagcatattttctaatacagaaaggaaataaatgacttggctctggagacgtgtttttcttatctcatattgataatatgatacagtcacattaataagtctgaaaactactttcattctttctacacataagcaacaggcagtatgtgcaaaagtatgaattccagaagctgtggtgtgtgcatgcacactgattttctttatagtgaacagccacttctaatatctcataacagcatgtatacagacaatggtcacagatctccatcaaagccgcagtaactgaagataatgcaggcttgaaggttaacaggaagctgccgctcaagagtttccactcctcatcaaaggactctgtgggaccaacgtcttcttccctgatgcaaatgggcttgtttcaagtttctctggctactgaaatgctgctcggatgactctg

SEQ ID NO: 1826 - DNA, 505 bp, Rattus norvegicus
  Genbank Accession No. AI100785
ccttttccaaatgagcaatttattatttgaacagatacataaaaatgattccaatttaaaaaaatactaaaaacatacatcaaccacaaaagcacttactctgactggaggacaatgatcaaggctattttcaatagcaataaacacaaggaaccaacacatacaagtcatgatgcgtatacatcttatccttgacaaagtacgttgttctaacatgaatgctttgttcccagctcctcctgtacattcaccatgaaatctatttgcgtatgtgactcaaaggcactcagttcagaggttataaagtcctgagcttaagtaggaaacagattcccaactaaaatttgaacataaattccaacgatcagagaatatgaaaatgtttaaagatgtttctgtacataaataattcataacgtaagagtacacggaatgccagacaagaccacgcacgtaaggcgaaggaatatcctcagaatcaaactgatttcccttattcaagtta

SEQ ID NO: 1827 - DNA, 334 bp, Rattus norvegicus
  Genbank Accession No. AI100841
acgttaacaaggaaaaatgtttaataatgaacatttctgacaattctgaactctagtatatatcagaaaacaatgaacaaattatttttgacaagtagagctgaaccgagtgcaaccttacatataggaccccacactccatggagtcaccacaccgaccttcccacagtacattcctccttcaatacactcttgactacagaagtaaagggaagctctgacatgaatcctcctgaaggttacatcagcacagagtacttagtctaaagtttaccacagtgtggaggaacccctcagacattcccacagagtactcagaccctgcccccagccc

SEQ ID NO: 1828 - DNA, 471 bp, Rattus norvegicus
  Genbank Accession No. AI101026
gttggcctggaaggctcgcttgctctgtgggcaaggaccagttatttacacagaatcattgtacagtatttacaggaagaggccagacacagcatccgtgtggatagttaaagaaagggcaagaaccacgtggggaaggaaactctaatatcaaagtaaacgcagaaactgaaaagtgtggaagaccagaggagcgtctgtctgaatcagaagacagtctgctgcggcagacccaaggaagaagcctcaagtagcctgcagaggtgtggggaagggtgtgctgggcatgaaataaagccttgaaaagtatgcagtatggaagagaaaaaatatgctacctgctgtttcagagaaaagaatacaattagcactttatcatccataacttatgctcccccatcaaagagcaatccccacttcttttaaaagtatctggacaagagactaagaaagagaattctgcctcgtgcc

SEQ ID NO: 1829 - DNA, 519 bp, Rattus norvegicus
  Genbank Accession No. AI101102
atatcattagtttatttacatttttttctagtataagagttcaagagtttaatccaatttccagatcatatctcttaaactttcttcattctgcaaaataaaagcaaaattaatggcattagaagcttgactttacaggttacaacaatttcatatcatctaccaatttgatacatcagaaagcgtttacagtatcattttattcatactgatttgcttcatcacatgtaccaaaacgctggataaatttcgctcaataaacctgtatgtatatgaagggatctaggctatcactatgcaacatttctgtggacatggaggaacttactatttctcaacttcagcagactaacttactaataccgcagaacagacactagcattggtagaaatgaaacaccagaacacttcacggtttcttccccatcaactttgtggatgtcaatgacacttggtaatgttaaaggttggatatccctagtgcatttttaatcccagaagattcagttattttttagt

SEQ ID NO: 1830 - DNA, 547 bp, Rattus norvegicus
  Genbank Accession No. AI101116
cagaataacaagttttttttatttttgaaaatactgttttgttaacaccacagtggtaaacaactttacgtttgtgtttctttacagaacattgattcacagatagttcaaaacccacaaagaagctaaaggcctttacattaaatgtctttttcccaaaagtcttccctttatgccatttttgtcctcaagcaataaaatttgattatgcaccatttaataagtcacatttacatagcaaaataatgaaggcacagctaatacaagcaaacttaaatccttcctatttctgagctggggttggggatacacacttgggttggttcttcaagtatatacttttttccaaacattagcttcattgaggagttctgatggttttcacagctacttgctaaaagctacaagacaaaaagacttcacaaagtcaaactaggcaacactggatacacatgctttacagaattgctacattctacatctcttcaagtaaattatatttctaaaatgctttaagggaatttaatacttaaaacattggggggaa

SEQ ID NO: 1831 - DNA, 492 bp, Rattus norvegicus
  Genbank Accession No. AI101181
agatagcacaggttactgtcactttattgtgctggctttgggttccccaagagctgcatgcattagtgacagggttgaccacctgactgaaaccagccattgagcaggaactgccaaaaagagttggaggaaggagtaacacactttcaactctagggaggtccaggccaagagcagggagaactacctgttagccaccttcaggaccagagttctacctcattttatgcgtgtctagtagcctatgtctagtaacctataccggctgcctgctataaccctgcctttagaaaagaggcccagtttgaaagctacaaagtcctgtcgtgcagctgaggcccccaatcctttggcctctttcttgcagttggaaataactaaagagaaaaagataggaaaggaaaagctatcaccatctgttctggccatgttcctacaagacagcagcctgaaattaaggtaccagggtttacccatgtacccaaacatttt

SEQ ID NO: 1832 - DNA, 374 bp, Rattus norvegicus
  Genbank Accession No. AI101256
aacaatcacataaggaagcatttatttgaggttgaacatgaagtcacacaaataaaaatttgtataaacacaaatccacattgagtcataacacagggaaggaacaaaggacagattaacaaaggaactaattggcagctatgtacagtgggacacaattgtgtcatgtacactacaaagtctttacaaaataatcatcttaggtcaacagaagatcaagcaaccttcaatgtcgtcctgtaagatggtttctttacacctcctgctctcccagcgtcctcctttagtagggctggtaattgttctggtgattgccaccccctcgggatgccttgccataagtgctctgctgaccgctgtagtctcctcgtgcc

SEQ ID NO: 1833 - DNA, 465 bp, Rattus norvegicus
  Genbank Accession No. AI101258
ggaagattttatttttgggatgtcagaaattacagcaatatattcataaatacctaattactacattcaacaaataatattacaatacagttaattcaaacaagtacacttagaacgggtttaatttcacagcatctaaactgcccccagagcgaccgaggcacccatcctccctcctggctgggtctgggtgcgcggccccagcagtgaggcatagggcacacacaagtacgaaaccagtgagatgcctcctcagggtcaaggcagactctagggttgaagttaagcactggatcagacagtggggacaggctacggcaagtcgtgaagtaaaagcttttgtacttgagtacagactgctgctgttaagtggctaatgcacacctcagaggtgctgagcctgctgtgcaggccatctgcatgctggggcctgtgcagctgatgggtgggggcggaggcatcgag

SEQ ID NO: 1834 - DNA, 597 bp, Rattus norvegicus
  Genbank Accession No. AI101331
ttttgtccctcaaatctggaacaatcatgtcataacaaaggaacaagttcacgagttaaataaaaccttcttcaaggtttaaacaaaataggaaagaactaacattactatttctaaagataggttatcaatcttttcttttcgtatgaaacatgaaaatgtgacgagacagtctgagacattccattctacttgctttatcagacaaaacttccagtcattttgttttaaaatcactttctgaaagtcttaaacccattagtacgttaacgttccaaacgcagcccgcgatcacagctagaactgaggagagctgttctgagagtactaagatcaagtaggtgtcctgaagtagtagccttcagtctcagaatactgaaggccaccatagctacaggaggaggggacaggaggaggacccagactcaggtccctcagactctgccagtccttgacgtaaggagtggtctcatggctggctatataccagcccaccattttcttatactatcttaccataataaaatgcagaatattaatgaccaggaaatactgctactgaactgaaggtgaccacacatatcacattattgaatg

SEQ ID NO: 1835 - DNA, 662 bp, Rattus norvegicus
  Genbank Accession No. AI101380
aagttgaaaaaacaaaattactcaaagaatctctctaaatgagtcagacacaaagttcctaagatcagcaactttggcgcccgagtcaaagatgccaatgaccaagttccaagtcgtggaaagttacacattacacatcttacagccgattcctaccactgagtagttcagctgccctcctgtgccacccgagagagaaccagggctaggggagggcaggaggtgaggtaaccataacagcatacatcactcctcttctccctagacggtcactctccaaagggcagtatggacaggattaagatacgaggggcagtaactgagatgtctctttatcaaaactgtaactctgtacgaaacacaaactcacgaacatcagatgaacagtgatctctagaaggcgagaacaaaggctcactcatgcagtagaaggactggtttaagaggtctccaggctgctcaagacctgtgaactatctgatatcaccttccggctacctagagagcctttcaccgtcaaggtacatacggtatggttgtctttctccttctaccttgaagtcagtattccagctttaaagcaagtgcttatccaggcagcagtgagactccaaaggttttccaatatttattttgaggtagtgctcatttatttgcattct

SEQ ID NO: 1836 - DNA, 655 bp, Rattus norvegicus
  Genbank Accession No. AI101381
acttaaaggtttttattattattattacaatgacaattgcagtttcattgttacagagaattaaacacaggaccgggtcactccacagagtctggttactggagacttctgtccctccattcctcactgcctgatcaggagaccatgcatcccgtcatttcacttaaagaagagaaaacaaccctacctctccgtgtgttctgagtcatccagtcaacagaggagcaggaggaaggccacgtagctcagagatgaaaacgtgcttcatggcatcactggcaaacttctgatgcgctggctcatggtgtcctgagagagtgatccggtctcctaggtgactgggcagacttgcgtccccgtagttacgcctcatccaaggacctcacttctaagctcctttcagagctgtgagctgctggtagctgaccactgggcaaactgaggtaaacataggtggtaacgtgcctgccacacggtttgaaaccttcgaagattctctcaaaatctaccacgatcacatatgaatctattattacaaaggagtggaactaacaatgaagcagtagttaggagtgaatcccagggacagagtttatacagaaaaagccactatttacccttagaaacacttttcacgttcaaactgaagcgaaca

SEQ ID NO: 1837 - DNA, 593 bp, Rattus norvegicus
  Genbank Accession No. AI101395
ttttgaaatgaaaattgtagaatcacacaaaaacacaataaaaaggcattagaagcattacatagtgcaaacacccaggtacagggctattaacttagtggcgctgtaaaaagttacacaaggacacacggaaacatttccctctggcctcgttagtaagctgccgttcttctcagtttattaccctcgtttgctcctgcactggcaagcaccagactgggaatgccatgaaacctcctcctgcacaccagcagcagggcatcttatgccagctactcaagtgtatgcagaaccagttcctacacagcaagcccacagaagagcaagcgctccatcagcagagtgtgctacggaaacttacatgtgcttctcaaagcatctggagatgactcttcctaatcaagagcctggtgccaaggaaaggacgagcaggtgagcagagacttacagcaaacaatgcaggttctactaagcaggcagcaaggagaagtaaacactttcagaacataaagaattctcaatataaacctcaaagcacagttgaccaagactacaagcttccttcaccttcaaggcagtcagagttgttaaga

SEQ ID NO: 1838 - DNA, 559 bp, Rattus norvegicus
  Genbank Accession No. AI101401
caccatcaagttttctgttttatttaagattttagttttaattctgaagaaagaggtacatttccttgtttttagttttagcatcaggttataaccaggtttgttttcttttctcctgtcttttcaatactgcacaaacgtccggaactacagggttaaggaaaagcggcaggcaaggagggcagagatttgctcctgtgggtgatcggtggccccagggcagtgctggctcacaatgccctgtcagatggacttatggtcaaaggaagaaaagattctgacagaggagaaagactgaggaaatcacgtataattcagctctcataaggataggtattaaatttgtgaatatttttttcttttaaaacatctgaatttaagtctaaagccaaaattttttctccttaaaaaattacttctccctccttataaactctttagcaataggccagttactactacagatcaatttatcttgtcatcaacttccaataaatccctttgcttaacaacacaattgagtcctccccatcaattcaataaagaatttaaaattgaa

SEQ ID NO: 1839 - DNA, 324 bp, Rattus norvegicus
  Genbank Accession No. AI101441
ggttattgcacatctatcagacaaacgtgtatgtgtaatatatatacttaaatatgctacacataaagactggcacctcacggaatatgtgtttaacaaaggccatcattacaccacagatatttcaaggacccttccacagttacaaatgcaatgttgaattaccacacaggtttaaagaagccacagactcccaagtgtttctgctttagagttcaatgagaagctcagcacaaacgcaggcaagagaagacgtttctggtagtatcaatggtcccatcctccgagaaccgggtatcggcccataagtggttttaaagagcc

SEQ ID NO: 1840 - DNA, 577 bp, Rattus norvegicus
  Genbank Accession No. AI101462
cagctcctccaccagcttggtggtgggcgtgttcgtggtgtacgtggtgcatacctgctgggttatgtatggtatcgtctatacccgtccgtgctcgggtgacgccaactgcatccagccctatctggcccggcggcccaagctgcagctgagtgtttacaccaccacacggtccagccttggtgcagagaacaatgtggacctggtcttgaacgtggaagactttgatgtggagtccaaatttgaaaggacagttaatgtttctgtaccaaagaaaacaagaaacaatgggacgctgtacgcatatattttcctacatcatgctgggattctgccctggcacgatgggaaacaggtacacctggtgctgatccctgcaggtgttggggctgccattgagcacgcatgatggatttccatgtcagcttgtccacgtgctccttacgtggatttcacacacacaaaagtcattctgtaccaactctgggatcaaatggctctttttcccttttgtttaaaatttgattgtttaaagcttaatgtatgtttgtttctattttaaaataaaccttgtgcc

SEQ ID NO: 1841 - DNA, 557 bp, Rattus norvegicus
  Genbank Accession No. AI101492
aagtgtaaaagctggaggtttattgttatttggtgattaataaatcaaactgcttttgacactgccccaccagtatattaccattcacccgtacaaagtctttcaaccagacagactgaggcgtgaggcagagagcagacatgtgcacactgtgccgacctcctcagtcacgcctccaccccgacctttatccatgttttcttcctggagaaagtgtcagaaaagtgtacagcctggggccaacctgcctctcaaccttttagtatcaagcgacttacagaagttacagaattcaccttctatttcccttgattttacttgtctgaactcattctagattatttaacattataatttcgggcaaccatacaagagagaacacagtgacctaagagaatactgaaccagagtcagtcacatacatcactgaccctaacgttgtattttaactggtcccaaaggaatgtatcaccccaagagtgtgagagtcaggcaagcagaacgtctctggggaaggaagaaaggggctatagaacagccaaacttactgaaaattg

SEQ ID NO: 1842 - DNA, 477 bp, Rattus norvegicus
  Genbank Accession No. AI101494
cacggtagcttttattgccaacagacttacatctatagtcactgaaacaattaactatttaaaaatggttgcttctctcaatcgtcgagccgtggttattctgtgtgctgggagaagagccggtcacagaaacataacgaggtgcatcttctagaaaacgtctagctacaccgcttgttccatgctttggggactgtatggacggacgcaaaaacccacgtggtcttagtgtctaagtcagagggccagaggggctgctctggaatcagaagtgcatgggtggccgtcccgctgataaaggcacgcactccagtacctaataatgaggacagcagcattgtctagagttagcctgccacctgccatacctgggccacaggaggggatgttatatgctgcctccacttggttatcccagaagcttggctatggcgtgccgggactgtggtgaaaggcatgagaccagaagcaacaccg

SEQ ID NO: 1843 - DNA, 610 bp, Rattus norvegicus
  Genbank Accession No. AI101527
gtgtattccaaactttattaaacatatatatctgaaatatgtttacacggaggacaaacagatagatatttcaagtaacttatgggacagtcattatctgttaaaaatattctttcttccacacacacaatttttctttttacatctaaaagctggatgcaaacttgtgatgtaaactgacttcattgttaactgttgaagatgggagacacacgttcgcagctcagttaaacaacacaacaaaaagctgttccctcacacgcaaagatgccatgtctctcccagcagaactgcacactgtatgtttacgccacatcatttcttcttctttcctttccctttcttactcccctctccctgctgaagacttgggtcagcacctcctgacttctgagtccttgtttttagcttgggtatcatttctgctacgtacagcatcaccgacttacgtgatgggaactgtacaagacagaggctgccatcttcctgtttgagctgtacccgaactctgcctctatactgaacatcacgattccattctctggaatacattttgtttttctccagaaacgcattcagtccaactgctgaacatacatcctgaatctaa

SEQ ID NO: 1844 - DNA, 465 bp, Rattus norvegicus
  Genbank Accession No. AI101582
ccccattgagccacaagccattcagagtgtgcagcctggtggccattttatttctctgtaagagatcagttcaaggtgtcgtctgcaagcctaaactccatggtgatgtctccagtgagggggtgaaactccacagcatagctgactgattgagggccatccagaggcgcgctaggatccagtgtggcactgaggaagtacacagcttgcttgcagtgggggttccagcagcagtcccccttgtcctctgcagggttcatgaggccggtgctgaccgtgctatctggagtcagctggtattccatccacaggacagctccatggctcttcccgggcctcctcagttccatcacgcccctggattgcataggctgctgggggatgggctgctggaaatcaaaagtcaggatctgtcgaggctctgagaggcttctgcatgggtattcccacagtggctgtggctct

SEQ ID NO: 1845 - DNA, 485 bp, Rattus norvegicus
  Genbank Accession No. AI101695
aataagtcagcctctaggtattgcttttacaggtttatggaaattcaaggatctacaccattcacactttacacaccactcacacttccaaaaatagatttctagccagacacagcatggccttccccagtgcagtatctcagttctgtcaacctggagaagttaaaccctgtcctgggccctggcatagccctccagagtgacaccctgaaactatgatcaacagtcttgggtctgaagtcttcccaggcttaaggtcaaccagcatcaaacaatgctgacgggaaaagcctaagcatgagtccgtttgccacctcagctctccgtgtccttcccggaggttgagtgggggaggcaggtgcggctgtgggtgacgtctggttgggttcctgtaaacatccatcacaaaggtggcaagtcacaagccaggtccagggcaacggaaagctgggtggcaggcgaagcgttcggaggatctggcaact

SEQ ID NO: 1846 - DNA, 453 bp, Rattus norvegicus
  Genbank Accession No. AI101708
aaaagttttttttttacttagttttttaaaggttacaagattgaatgcacaatatgatccggttttgtgaaaataaaatatacatatatacaaacaagatacataaaaccacttggaaaggtatacgaagatatgtacagtgtgtactaaggatcaaactaaggtaattatatcttttccttgcttacttataattcctgatttttatagaaacaaaatgatttaataataagaaaattattttttaaatataaaataactgaaacaggtgcagcattgtttagatcaacatttgaaaataaactcaaactataggcagtgtgttggttctcagaccttcaattgttttctccttcagcttctgaatgctaactatgaaggttaagactgtctaggaattacatatcaaaagaagtatgtatgagcaggtagtttgaagactcctctacaagg

SEQ ID NO: 1847 - DNA, 439 bp, Rattus norvegicus
  Genbank Accession No. AI101763
ataaaatgaattttattacaaaactctaataaaattataacccaagatttgtgagatcttatcccaacattgccattttctgtttagacgcagttgggaggagcaaaagactagggcgagagaaaactgaagcctctccctttcttcttccagcaatgggagggagttcatcacgtttccggctttggtctcttcatcggattgtgatcagaagggtttctttttcagcccaaagacagcgatgaataacgcagtttcagtgacagctggaaaagcgctgtggaagtagggggtgggtttagagcccctttcgacccaaacactcaaaccttcaagccttatatgtgagtgggttagcggatgggtacgactctttaaaactctaccaatttcacatgtgcaggaaaggtctaggtgggggaaacctttagatttgggg

SEQ ID NO: 1848 - DNA, 457 bp, Rattus norvegicus
  Genbank Accession No. AI101818
agggaggataaatatttatttgcacataacatttcttagttttgaaaaacacaatatcctagtcacatttacacagtactttaacattgcaataaattacattcaagatattcagtaattttgaccaggaatttgaaattaggagtaaatatagaatactacattttcttatattttatgatttcaaaatattaagattaagatagagatagcattaaaattcacacaagaacaaaattactataaaaatactcagaaatacagaatttcataggctgattgcttatttaaaccagtgatcattgcagtttcattcactgggcatttcaacaaaacagacatcacgctatagagacaccaggagagtgttttggggattggcctggtacattacagacagtgaggatgtttagatggaatgcgctattacaacatacacaaaggtagcacatttgga

SEQ ID NO: 1849 - DNA, 475 bp, Rattus norvegicus
  Genbank Accession No. AI101874
cacctttattacaccgccgtgggccatggagcccagggcactggctctttatcaaatctgaggaaaaaatacacctaagtcagcctcactcctttggtcattatcattacaaagcaaacagaaacaaagttattcatgaactgtgggcagtcagtccatccttctctcccctcttcctctggaagtaggaaaagcaggtcctcaggagctgctgctggagctgatggtgggtttctttttttcttttctacaaaagcaagaatgactgagaaacagtgggaatgtctccttccccacgtgggcggagggatgggttggaggtgaagtcttcactggaggatggagaggcggctgtggaaggcgagtctgctgggcaggtgcattcactgccggccttgcacacgcacacaggctgtgcctcttgcaggcagcatggtttccgatccttccgcaggatgcagcagttcttttaaaa

SEQ ID NO: 1850 - DNA, 595 bp, Rattus norvegicus
  Genbank Accession No. AI101901
  misc_feature (1)..(595): n = a or c or g or t
aagccatagaagaatatttattgatatgggaaaatgttaacaatatacttctatatgaaatatgtaggatacaaaacagtatatacgatttaataccatttttacggaaagaaaaatagccatatatacaaaatcatgcataataaaaaataaaaactgtatacaccattcatggtcatctctttagtggactggatgtgattacaattcactggagtgattacagcatccatcactcgcctgccctgtaaacagtgtctgcttcatctgtcctgtgattagtgcttccaacagtctgtctctgacagacgccttcccaagcagcttctccgatttgctcttatatactggcatgtagagaacatttcaactgatataatatagagattgccacagcagatgcctggctttagaaagttatttggagaactagaaaattctctacataggattttctctaatagagaaaaatatgcattgatggtatgtgaatacgtaatttcaggagttagaactgaagaatttaggatctncccttccacctgcagtgaaagaaggttaaggatctcaaccccataaaacgtgattagtaatc

SEQ ID NO: 1851 - DNA, 572 bp, Rattus norvegicus
  Genbank Accession No. AI101926
atcgaaaaggctgtggtgtcccagcgcctcacagagtctccctgtgcccttgtggccagccagtatggatggtctggaaacatggagaggatcatgaaggcacaagcataccagacgggcaaggacatctctacaaattactatgccagtcagaagaaaacgtttgaaattaatcctagacacccactgatcagggacatgctgcggagggttaaggaagatgaagatgacaagaccgtcatggatcttgctgtagttttgtttgaaacggcaactcttcggtcaggataccttctacccgacaccaaggcatatggagacaggatagaaaggatgctccgcctcagcttaaacattgaccctgaagcacaggtagaggaagagccagaggaggagcctgaagacaccacagaagacaccacagatgactccgagcaggatgaagaagagacagacgcaggggcagaagaagaagaagaagaacaggaaacaggaaaggaacctacagagaaggatgaattgtaattatactctcactatgaatcctgtgtggagagggaatgtgacatttt

SEQ ID NO: 1852 - DNA, 476 bp, Rattus norvegicus
  Genbank Accession No. AI101967
gtgttgtacaaaaatacaagcttaaaaaaaactgaagttctaataatcacaaatacaaagggatctatctgggtggtgtttgggttctccgtgccccaaagtccccggataagaaagtctccatttctgatgtaaaggacaagataaaattccttattttgctaacgctgagagtgcaccattggatgggtgcatttgatcagggaccagcagggaaggcatctcccacaggctcggctcacaccaatctgcgcatgcaccaactctccggaacagcctcctcccagcaacagcctgggctgccccgggtttccttcgtaggcaggcgcttccagcttgtgttctctagagacaaggtgccagcacttcggtattactgtcacgtttcgatagaatttggtttatttctctattcacttgttttcaaggcaagaaaaatgtagctaaaggaacaactagccctttcttccatttct

SEQ ID NO: 1853 - DNA, 639 bp, Rattus norvegicus
  Genbank Accession No. AI102042
ataacacttgaaggtataaaatgctacatttccaaaaatatatatattttttctgcaccagcacccttgtatagtaaaagtatctactttttgttcatttgtttcaatgcactacactttatctacaatttcattacatgtatacagcaaataggcaagcatggcttttacatccttaatgatattttctatacagggaggtttaaaaaaaatatttgaacagtttgcccagtaatgtgacacataatgcatgtaccttgttctcgtataattttaagtggtgtaaaataaagatttgaaaattttaactcagatactcaactttttaaaaatagtgttgtagttttgttctttgcattacttttcaaaactccttgttaagtttttctctcatggcacactttgttctaatacttcaaattttggcaggcaatataaaaaggctgcaatgtctgccctttgagggcactgtagtgactaaacaaacagcatgtcaaattttgaatacttttgaagtcacttccccaatgacgtccctgaccgaaggttcatgcatgatgcattgtcacacagtacattcagagagagctttgacttcgctaggaaagaaaaggattcctacaagtctttcacagtaac

SEQ ID NO: 1854 - DNA, 625 bp, Rattus norvegicus
  Genbank Accession No. AI102045
aggtttttaaaccggcctttattaaaacaattgtaatacaaatattccaaaaatataaacagactcttaatggcatcctacagttcaagtttttgaatacaacaaatgtatcaaatcatgaagcaaggtggtcaaggatcccatagcccagtcacagtgggaagcagacccctccccttcaaatggcatcttggaaataggcagatctggagtaatcacaggtaaggagaatcaccagcttgcagagcagagcagagcagttctgggagctgaccctgcactaaaggatggggcagctggccagacctgtgacctcttctcccctgaatatatttaactaatgatgttttctagaaagagggactggggatgtagcttagctgggagtgtgtgcttaacacacacgatgccctgggttgttcccagcacctcctaaagcagcaaggtgatcacacctgtaaccccagcactcaggaggtcagttcaagatcattcctggctaaatgtgagttgaggcccctgcttggaattcatgaaaccctgtctaggggtagaggtaagggagaaggctaagctattttaaaaaaggaactgaagagtagccccaaatggaaatggctcacac

SEQ ID NO: 1855 - DNA, 657 bp, Rattus norvegicus
  Genbank Accession No. AI102065
actgcataagtcaaagatttatatttttgggttctttctagacaaagttcttaaaagaatcacagacgaaagctcatgcataaatcacatatttcctcactaacaaaaatacaaaattgataattttaaaaagatcagttttcagtgacccagatggctgaggaaatgctgcttggcattttttttttcctgatctgacgcagaacatcctaacttgagaacaatgctgccagtcttcacttatttcagaaaaccggcagcgagggatttttgaaggaaagctggaactgaagaagtactgccccttcttgaccccaagtcaggggacacatggcactcttccacgatgttctcagttcagccagtgactcacaccttcacaagccagacctcattacgacgtccatagggcttcatgggagggtcatacccggcgcagtagtagacatcaccctggtaggtggctggtgtgccctccagggtggtacgtagctgggtggcgtgagcaacatagtcggcttccttggcataaccaccgaattgcgtagaatagacagtgatgccctcccgctcctcgattttcacgctctggtcactgggcgttggcgggctgccttgaaattggttcggaatccggaaccagactttcagtttctt

SEQ ID NO: 1856 - DNA, 600 bp, Rattus norvegicus
  Genbank Accession No. AI102070
gtaattgctctatttattaatacgtgtatcacaaatgttcacaatatcaatgcattcttgttggcatgctagacagaggcattatttttaagatcttttaaaaatatgttgacctttgtttcccttccacactcacttttaaattgatctgatgaggtcctcaaagtctataatgtcaatgcaagaaagaaaataacatacggaaagaaaaggcaaaataatagaaattagttggggcaaatcaaaagtagcgtctttgccttccagggaagtaacaacacaaccttgtaacaggatctctccacacccacctcttggaacaatgagcaaggcagcagctaatacttagcactttctgccatgcacgccacatgctgttttctcctcatgaatccctcccactgtgtctcctctaatgtgctagacagcctaaagaaggtaggaaagaatcccaggaaagggaaaagcaaaccaaatcagattaagccagaaagaaaagataataaccatctgcattatctacagaaaagtgtgtggcattcttggaccacagcgaggggctgactgaagcctcccctactacatgcaaagccacagggg

SEQ ID NO: 1857 - DNA, 651 bp, Rattus norvegicus
  Genbank Accession No. AI102073
atcaaatgaatactttattagagttgtaacacttataaaataaatttatcagattttaagaccaaccaacactttttcatttttatagctaagatacataacgagaatcttaaacgccatcatctctgttcaagtgctttgtcattcagctcacaaatgtagaatgtagttcatctccagttctaagtattcacagtcagtcagctttgggcttggtccttgctaatctagtagcaatccatttatagaagtcccaccaatacatctgaatgaattaattagttaataccacactgaacatggcctgttacaccttgggaaaaataaaacctccactaaattctagtgtactacactttagtgattccaagtacaatgtacaatgtatctttatggcacatttgtgacttcatagtattcataatacaggtttcaggtgtgtggtctggagctggaaaaatatgaaggaagtcaggcattttagaagagataagacatgagtgtaaggccataagactggtttcatcacgcaacatatagaaatatatctcttcttcagctgtgttacaaactgagcttctagttggttcttcttctggaggagtattagataaacagcacttgatcactgggcattggttatgttattca

SEQ ID NO: 1858 - DNA, 571 bp, Rattus norvegicus
  Genbank Accession No. AI102097
ggaagtcgttcactcatcttgtttattacagaaatttctagctctgcatcaagcacaacgcaatgaaatattacattgatttcttttccgtcatcacaccggcatttgcaaacacacagccaacgttgtaaataaaatatactgaagtagtgatctgaacctgaagtccaaaggggacatgtctgtgacgacagaagcctgtctctgcagtgtgccaagtgagttcacctccatgtgtgtgatcggcatttgaggacatgtcactacagagcaagtcgctcatttgcatgagcaactctgaaatgtatggcacccatatagtttcccagcatgggaccttgggacccctggggtttagtgcatatgcagataagtgacttgagagaacctgggtgcaactcccatttggccctcacaagggagcctcataggaagtgtcggcatcactgcctgtccagggctcccaaagaacttcacaaggtagagtgcggttttgtggtaggtgtgctctgttggagggtagactgatggggaagtttaaggtaaatcagaactaggttccagagtcaag

SEQ ID NO: 1859 - DNA, 538 bp, Rattus norvegicus
  Genbank Accession No. AI102152
atttattataaaaaaatgtaatctctttacacaaaagatactttaaaaacagcaaaatttacccaaatctatcgaacgtaggggtttgaatcaatccaagggccaaaaacattgaagataattgtgcattttctagtaattcattccagatacacatttccaagtttatggtaaaagataaaagatcaaatgccagcctccaccgggagctaacaaagcaaagtatctccactcaaggttggcccatcctttacttagaatgaaacttagaattttaagtcttaccgtacagcgttaatataaagactgacacacaacagatatgagtgcagaggcatccattccaaccctatatacttttgtatttaaaaaaaattgcaccatgtctgttagaaataacgaacatgcagaaggcattcgtaattgttcttgtcagctaggatgtattttgcgataaattcaaaacttaaatatgaaattaagctcaactagaagccatctcagctcagtactctgactcatgtaatttgttaatact

SEQ ID NO: 1860 - DNA, 533 bp, Rattus norvegicus
  Genbank Accession No. AI102191
caagttttgtctgtttattttacttctttcctccatgatttttggacacagcagtacaaacacaagctgtgtggctgggagactgctgcaccccacctttatccagacatgtgacccacgctcccctgggctgacagcaagaaagggaggagcaaaaatgtcacatttctacccctgagtgccctagtacctgaaatgtcccccaacccagtcagctgtgagagtccaacaggtccccagctgaggtccaactccaggctctccaacagctggccggtgctcacggttggatcctcttgcggtataagtaggcattgctcacttggttcatgattaccaaactggtgaggatggggcacaacacagccaggtaccaggcaccaccagtgacattggcggtgaaccagagtgaacacatgcccagtaggaggctggtactacccagcaggtagcccactaacccagaagtggcatggtagagtttcagttttgccaagggccaccggggcagcaactttgggtagagcagcccc

SEQ ID NO: 1861 - DNA, 471 bp, Rattus norvegicus
  Genbank Accession No. AI102194
atttttatacatttttttgtattaaaaagaaaagcataataattaccaccaattacaaaggactagagcaggaccagaataatgaatgaatcacttcagcctgggaagcagacactctcaataatattaatgttataatacaagctcattcaagtattttacatttttttgtcctgttgaatgtgatatcctagaacatggtaaagacaatgtacgagcgtaaggtggaaccttctctgcaaagcccatgagagttttcctttcctgtgagaactgggctcaaagttttcttctgcctctgccatcaccatggctggaggagagatgatagccttgccttcccaccccagaggggcttcttccctcagagggtctgggaggatccgggagagaatggcaaacctagcctggatagtctagatggaaaccaccttccctgacactgggccttgagccctgaggttctgtggt

SEQ ID NO: 1862 - DNA, 491 bp, Rattus norvegicus
  Genbank Accession No. AI102286
  misc_feature (1)..(491): n = a or c or g or t
aaaagggaagggttttattctcaagcgtctaaggatttacaaacaagggtattttgttttaaaaagggaagagggcaacactggtggcctgaggaggaggtcagagggtgggatcaggccactccaggtcactacctgcccaagacccactctgcctgggccagagggatggctggtgacagagggaaggacttgggaaaaggtagggaagtgggagactcctccaggctcccacttaacactagagggcagtagacaaagacaaagacaagaccagacagacagacagacacaagacacacacacatagaaaataaagttaaataaaaataaaaccatgaggcccagtcttgggcctgtgctggccctgggaccagccatgtgacctaagtacacacaaaggctaccgacgagacttggctagcctcagaatggtaagggtgggctgggctttctattctatccctacttcactccatctncccaacaca

SEQ ID NO: 1863 - DNA, 487 bp, Rattus norvegicus
  Genbank Accession No. AI102429
gagtggtaccttatttttattttaacactgataatgttaataattgtgatataatgtagtaacgaaatttaatacctcaactccttttgttctttctctttatcaagccttttaaaatacatagttcaatacataaaatagtcaaaatgaatcccaaaccacttcaccttgccaaacagaaactacacatctgtgctgtcccagcacctggcatctactctctttctccctccaggaactgaaatacatgttattggtattttttgtagggggctattttttttaactgaaatccacatattaatcaagtttatccctttttcaggctttacactactaaaggggaaaacaagcacgagtgtacaatgtgccttaagagattgttcattagtgtgtcagtcaaggagttacacaaatgcatcctaattactgaatataaaattggttccagtaacttcaaggatacagtcgggctcttttaagaaat

SEQ ID NO: 1864 - DNA, 490 bp, Rattus norvegicus
  Genbank Accession No. AI102438
catttcagagttttattgtgttgcactgaaggaacagcggggcggttacacagttctctcattcgttttttgaaaatctaaagtacttgcaaattcttaataccttgaccactggattagaacagtaagcattaatataaccgatttcttagataataatgtcttacaaataaaaagccatttaaaatagctttaagtgcattctttacaggtaactcggcatgtgtattagcacttaggcttaagaattacagcaagtgtattactctggtggagtgagggagacccctctcatgcaatacatagggataatattcaagtcgacagcgaacgagatcccactcctcctacagctgtgtccatgtataatcatctacggtgataagcaggaaacctacgatgcttcccacgcgtcagatacacactttcagttcaccagaagcacctcattatctacggttaatttatatttagatggcatttcaataaa

SEQ ID NO: 1865 - DNA, 526 bp, Rattus norvegicus
  Genbank Accession No. AI102472
aaatacaactatcttacagatttattaatgaaaaatactttacaaaaacagtatgctctgccctaaaatagtttagctgactcttgagagtttaagggtgactgagcaagtggcagtaatggctctgctgctgaggacaggagggagtgttagtgtgcccaacgccacctgttcagaagggcaaatagtctattggcagctccccactccaggcctatggtctgagtcacgaggaaggctgacaggccacacctgggcagctgagcttcccttaagaacatgatcagaatcctgactactgacaggagatggggaagggagttaggtaatatggacaggtggataaacaaggagtataagttgggaatatagtagggccaggagttgagggctctgatggagatgggggctaaaagaaaccagaaataaagtagcccagacaagcctagaacttgctatgtagccaaggatgaatttgaacctttgatcctgctacccccacctcccaagtgccagggtgacaggt

SEQ ID NO: 1866 - DNA, 643 bp, Rattus norvegicus
  Genbank Accession No. AI102495
aaaagtatccgatctctttattctcaaaacattataatactacataaaatccaagaggtatggggttggtctttggtctttgtggctttagggaaagcagaggagcccagaacgtgtctgtcatcctcgggatgtagaaagatactgattgaaggcatacatagatcccaagtgtgctgggaaatgggctccagctcttccagaggaatgaaagttaatttgagaaggcaactaagtaagaggaccaggcatcggagcagtagaaggatatctatcgggaaggtgaagggtaggcacctcctctttcctttctgctagactctaagaacagggactagcgacccagcaagtgaccaaagtagacagctacttggacccccctgggggagcaccagatcactccgcggccagtcagttggcacgctcacggggtggaatgctctccataagaatggagacaaactgctccaatttctgtgcagctgctttcccggcctccagaacttcctggtgactggccttctccaagttgttgtaatccatgacaaccttgttagtaatgagtgagaaaccaaagacacggagcccacagtgtctcgcaacgataacttctgggactgtgctcatgccaacagcatctgct

SEQ ID NO: 1867 - DNA, 537 bp, Rattus norvegicus
  Genbank Accession No. AI102574
cccttaaaatgcaagtttattgaataaagctgagaggagcagtaaacagacaaaaaatgcatccacacctaaataaaaaatgtacgtatttacaaagttcagtaactgttaggttttcacatgcagaggttatgcacaggaaaatgttggtagtagcttttagatgtcctgaaatgctggaaagcaatggaaagacacataaacaaattaaggtttctataggtcaattaacaaaaagctacacagtccccgcttagttaaacattctggttccaatccctccttctaggcacaagcaagttgccacattctttgaaatggttcacaatgaccattagtcatgtccggctacaggagcaaagtttaaatatccttttatttaaaccacctatcccattcaggaagagtgcaacatgcctccatgaaaataagaagagaactttaaagcccagattctactcattaaaaacgtgaatggagaaaacaagtagtgtctgtgcaacacagtgcagttatttgtacagaatgttctttaag

SEQ ID NO: 1868 - DNA, 481 bp, Rattus norvegicus
  Genbank Accession No. AI102588
gtttagtaagaagaatcacatttaatcagtttctttcttgcagtttcagatgctcaagtacagctcaaaaaaatctgaaacagctagatccatgacagactggtacaaagagtactgcattttaaaaaatgataaaaaatacacacacacacgcgcatacacacacacacgcgcgcgcacacacacacacacactcaaattaggccccctccctacccataaatgtacactttttggaaactaaactggcttgaaaatccctctttcatggacacaggaagaagagaacgatgagagggaagaagatggcagccgcccagtcccactctctgcagggttaggtgccaaatgttcgatggtcgggcccaaggcagcctgaacaggacactggagtactggcattcctgccaccaggggctctagcaagaaccctagctccatggtaatactgaatgtgcatagtggccggacggtgctagtt

SEQ ID NO: 1869 - DNA, 515 bp, Rattus norvegicus
  Genbank Accession No. AI102606
aaatttcattaacttttaattaagttaaatgtaagttacacgtgctcggagcagccacagcaggattcgcggtacagacttgcagcttaggacagacaacttaaagcagctcctgaacagcaatgcagatgacaccagttcctaaggactcctcctcaggtgaacaattagacgccactgcgctttccacttgggatggcaccctcatgtttgataagagcatgtgtacccacattctatactcagcttgtgcttcagagacaagagcagagagccccgagggcggccaggaatgagcctgctctaagacgaggttctgctagtctatggtcattcttctttcccgttttgctctaatgtactgttaaaagaacaaatgcttcagaaaaaaaaaaaaaacgcttcagcactgtgtgagtgacccaaactgcagggcagggctggggggcgcagggctgagcatcctcagcccccaggcacgtgtgtgccacgcagacacagggtgaggggctaca

SEQ ID NO: 1870 - DNA, 547 bp, Rattus norvegicus
  Genbank Accession No. AI102634
ccttttcaatgtttaattttgttgaagttaaatgttggccgtaggcatgacatcacagcattaagacttgcacccgctgagttttctcaagataattcatctttatgccatgttatttagacattgtcccagaatagcttgaggtataattcattcaggaactatcctttgcaaaggagatgatcagcatttcaatagtatgtcttcctggaagggtagactctgctatatcttccttgtctgcatcaaaagactccagaggaatgtgcacacacctcatatcccacttgtagagcaagccttccagtgaccagtcagcacttctgacctggtatgtagaccagaattgaactttgggattcttctgcatcagaaagtatactgtggctaaaatgctttcaaagtcttctggttcaaagaaaacatcagatccaagaatgatgtcttgtggtggcaatgacaaagtgtcctttgatatgtggccccacgtcagtcctacaatttgcacctgtggcaagttattcattctggcaactttgccaacaaa

SEQ ID NO: 1871 - DNA, 496 bp, Rattus norvegicus
  Genbank Accession No. AI102643
cttagtaagcttttatttactgtttggagacagacagtatcaccaaggctggccttgaatttgaactcacaatcttcctgcctttgcacatacactcctatgtgccgagtgtgtactacctcacccagctaaattttattttattctagtgagaactgaggggggaaatatatatttatatatatacatacacacatacatacagcttaggtttagagttagggattgggaggatagcaaaatttcctctgagatcacaccctttggaactttccagtttcttagaaatgaaagaagatatagctttagaaaaaggaaatagaagtctcccccaggttgtacttgaactcataatccagtgctgagattatgaatatccaccaacgagtctggctctcagaatagtttttgaagataaaagttatccttgcactttctcttggccacattggaaagcccacagtgataagaatcatcacgaaagcaggcagaccaa

SEQ ID NO: 1872 - DNA, 419 bp, Rattus norvegicus
  Genbank Accession No. AI102670
ctatgacaaactttaatgactcactgtgtgcagcttgaatgacaaggcctgggaattacccacaagcctaacattcgggtggcctagcagcaccaccaccctggcctcctagaggctggtggagaacaaaaagtcaactgagagaacatgtcctggtgtgccaagcagagcacaccgtggttagtgctggtgtcacaaggacagtgatgtttacacagggtaagagacgacacacatgaaaagacataagggtaggagctgactagggcagccgtggtatctgcatgacaacatacacaggaaatgccagaggacagtagagccgcgtggtgctgggcaaggctgggtacacagacccaggctgaggaccccagtgacctgacacacccaggtggaggaaccaaactggacctcgtgcc

SEQ ID NO: 1873 - DNA, 596 bp, Rattus norvegicus
  Genbank Accession No. AI102689
caaaataaatgcaaaattttattatatgggacaaggaagattcgcttctcgggctctccgtttccagttctctacgctgagataacaagctctgagaagcggtccatgacagaactcagaacaagagccatacgaacccctagaaacctcaaccacatgaagcctggatgtgtgtgcacaaaggacttggtggatgaaaagtcagcttgatttcagttacttgggcgtgaccctgaagactcggatgtggatggctgagttgttcctgatcctagtcagtggctctcgagagtcagtctctggctccaactcatccaccagctccaccgtggaggtattagcagccacctgtagggacccaaagctgcctgcctgcagctgcagggcgatgttgatggcacggttgatggccaggcccaagccatgaatgtagatttcagtgcatgcgttctgccccctagtgcctccgtccagcagcttttggcagcgagctagctgagccttaaaatcagtcttcatgttgacataaatatcattgggcctccgcggcaagcggtggggaagtcgtttccgaagggtgtactccacggggtcca

SEQ ID NO: 1874 - DNA, 523 bp, Rattus norvegicus
  Genbank Accession No. AI102711
acaaagaagcaactttattactcgttcttattactcattcccagtcaggttctcttcttgctcttgccagtgactttggccggcgtgagggctggagctgtagcctggtacagagtggaggatatcttgttgatgtagtacagaccaaccatggagaagatgaagcaagtggtgacacagactcggtggatgaggccagatgcgaagagtgccaacagcaagcagaggagaatctcagggaagatttttgcttggaagcctttaccaaagaccagattctccagattattgaaggcagttagggagaagacgaaaaggccggagcccagcaggcccccctgaatggtgagccactcggtggaggccaactggcggctgtatatctgcatgccagcgaagagcagcagggacaggagggaggacagcgccaaggaggtcccggtaccgactaccatcacgccccgtccgtgggtccaatccgtgcctctggagaaagaggggagccaaagccggccctcgtgcc

SEQ ID NO: 1875 - DNA, 575 bp, Rattus norvegicus
  Genbank Accession No. AI102727
ctaaaaactgtaggctttttattcagttaagaggtagacagatgaacatggaaggctgtcccattgaatttgcccaaagttcccattccacttcattcacccatcccacactgccagaaatctcaaaagaataaccacaaccaccaggctttgtcttcctacttcttagcaacacgtccacgaactgtttgcaaagaagttactacaaacttaaattttcactgtgccaaagattctcggccctctaagaagttgtcacatgtcaacagaacctgccactagtgacagggagcagagtgccgtgactatttctatgagagactacaagggaagcttcagttacatgtttgttaaatccctgtgcacgctggggaagaagctggtgaggccaacaaagcagtatatgccatcaaatggctctgcttggctgtttaaaaagaatccacattaagttatctcacagacgacattaaaacataatggaattgatgcctgatacaaaagttgagaaatatgtacaggaagtcatagcccaagagaaaagggaccttagaatgaatcaatggaaacctggc

SEQ ID NO: 1876 - DNA, 564 bp, Rattus norvegicus
  Genbank Accession No. AI102734
gaagttagaaaagtcttttaagtttttaaattaaaattgcaccctggtgcattgattttaatttgggaactcaatccaaggcagtttctccttagtggtggccctctggccctggacacacacacacagactgggggcccgcagaatagctggaacagcaagggatgggacaatcaaatatccattcatcagagggcagccaagtcttcagttctgcacaccttgctggtgattgggtgacaagtttcagagtcaacaagaggccaccaccagcagagatgaaaattgtctaccagtaatggggtagaaagtccatgattctgaggacccttctgggaccacctcccttgggggtggagcttttcaatggctggtgtgccttctccttcccagagtagcacggctatccagctgcatgctcactccatctacgatcaccctttgttccccacaactgggcagaggtgagccttgccctttgactggaacatgtgtataggccccactctcttacaaacattagctaaatttatattcatatattattatagttatttattaaaa

SEQ ID NO: 1877 - DNA, 700 bp, Rattus norvegicus
  Genbank Accession No. AI102753
tgtttatttccatctttaatactagtccaaaacagactgatacccatgagcatagtttaaatgtaacaaagaaaagagttaaactatatacattaaggaaaaaggaaagaaaacctttttttataccaaccttttcctattaatgcagtttctgattagaactaaacatgtctctttctcaatttaatttaggatgaagtaatagaacttttatgatcaacttcataaactgtctttaaggagaaaacgaatttttaagtgggtgtcaccatatttaccagtgaactggctgcatggttgccttgtctccttgaagtctggctatcattagaactaacaagatcaagtccatgaggccctcggggaactcaatggctgtgacatccaaggggagggcacataccatacatcacaatgatgaaagttaatgctcttaccctctgagtccatgtaaaaaaacttattactctcattcaaactaactgaagtcaaacagttaaaaagtcagaatgaagaataaaactattttcttttcacagagaggagggacactccttcagctccatttaaagtgaattctgtgctgagtccctgctccttcagaacagtaaactgaaagtcagttattgctagcaaagctccagtggtctctttcctacctcaaagatgttccacacaaaaaggctattggtttgacttg

SEQ ID NO: 1878 - DNA, 532 bp, Rattus norvegicus
  Genbank Accession No. AI102768
ggatgcagacaaactttaattgcaaagccttcatgtacagcacactgagcaatgaacaagcaggagagttgttcacattcagagacatggacacaaacatcgtttgcaattcagacaatctagagcattccacatgggaacgagcctccttatctttctgaagactgcttgacactttaataaatgattaggcatacttagaaattcaaagtagggtgtaccttgcaaggaaagagtgtgaacaccttttcccaaacgtacacgggtggttctgcttgacaaagcaaggtatttgctggaggacgctgaggaaaagtgagtctgagtttttctgagccaagcaagctggtccccctttcacacagggagacacatcagccctagctcaaaacagacatcctgggcagcccttgccctcactgttcctattacctcacagtccttatttagcccaaagaaaattcttgaccagcaaattcagaatatcactgaacttggggatagtatggaaattcttatatcacatatataa

SEQ ID NO: 1879 - DNA, 595 bp, Rattus norvegicus
  Genbank Accession No. AI102788
cagtgtacactctctttattatgagaatgaaacccaataagcaaaatacatcaggaatttcaaattgtactgcaaagaaggcccggctggtctctgttgggagcgatctcacttacgctgaccctgccactggctgagtgtgagcccctctgtcctctgggccaggcagtgccacaggccaccaggtgggcagatcctcttcctgtgtcttgaggcaagtcgagactacgtgtggctctgccgtccttccctgggcttgggttcgttgagttagtggtttgctactattgtcaggattgtactgtccccttaaggtaccacatgccaccacagcttacacaacagtcctttagcactttatccacctcctgcttgcttagctcttctccacattcttgagtcagccgagactggatcatattccgacgtactcggtaatttttggaaaatatttcaagcaaaacctgtcgatgctggtcactcatgtctccagactcccagagggcaaataccttctgctcatcaggggaagcaggacgaacaggatactgaaagagatacagcttctctgccagacttttggccaagtacacat

SEQ ID NO: 1880 - DNA, 562 bp, Rattus norvegicus
  Genbank Accession No. AI102871
tcttttgttttggtttattgtacatgctttattaaaacggtactcgtatttacagcattgcaggaagagtccctcccaaggtgctctcacagacatccagactcactcacacagacattcataccgctcggccccactcactcacaccagtgacatgtgagggtcagacccctaaaatttaggcagctgttggggaagaactgttggttttcaatctttcttagaaaagaaaaaagcacagggatgcacttggccatcacgatgctagcgatgtttgtgcactaactcatggcagttaacactgagaactcctcctccactccacacacagtgacatcagcctcagtctcagtgctgcttgtactgacttctcaattcacaggggctttcccaaaaagtaattcaagtttatggaagtgaaataaggcacaattaatattgttttgacctaacggaaggaaaggaaagaaataaaactggtttcaaaatatcttagctgggaactgttgactttaatctactggaaatcccttcttcaaatcttataaagacatttttccct

SEQ ID NO: 1881 - DNA, 616 bp, Rattus norvegicus
  Genbank Accession No. AI102955
tattgccccaatgaatcttgaaaatttattatttgggagaatatcagatattgatctttttgctttatagctcatgataataatcagaaaatatacattttgaaataaagtcaaaagaaaataattacatatggtacatattacagatttcttatttatacatcagcaaagcagtgctaaaagcatatttatggcccacaatcagcaaacgtggacattttgtctagagctgcagcaactcaaatccttctaggtcagtgaagacagagaaatacactgaagggctatcaccgtatctggctgtaaacctgtatttccactccttcccctcccctatatatatatatgcatgtgtttattgcctttagagttctgctggtttaacaatacactacatagccattgccatcatttggtttctaaaaatatataaaatgaatgggaaggcgctcccgcgactgacgcagccatgtcctggcatggaaggcgcactgggaaaatgtggagcagcaatactgagtgaatactgatggccgtgactcgacacagccggcagccttctcccgggacttaaaaaacctttgcggccgctccaacatcagaatggcctcgtgcc

SEQ ID NO: 1882 - DNA, 531 bp, Rattus norvegicus
  Genbank Accession No. AI102972
ccaggccatactttattttacacaagtggtggccccagagccacagggacgtgttctggagagtaggcacagtgcccaaggctgcaggagcctgacaaggggaattcatgccttctccttggtccccatgaccaaattaaaaaatatcacacagcacacactgccacacccatccccctcttccctttcagcatcagccaattcagctttctagccagacagtggctataactggatttacagagaaccatgcagccaagaaaccagagccatgaaggggagaggctttgcattgacttcctacacgcactgtcccacaggagcaaagtgactccaccaagccactgcgtggctggatgatgacaggacaggctttaagacaaggctgggaccccgtacaccatgcctggaagaccaccacttttcaggcaagatattaccagagccaaacacgaacctgaggctactgtgatgcaaagtcccttccctccccaggtcctaggcagtgcccgtggagggctggataatttt

SEQ ID NO: 1883 - DNA, 322 bp, Rattus norvegicus
  Genbank Accession No. AI103008
aggtctaattacttttatttttttaaaccccagatagaacaaagaatcattactttgggcattactaacagttgtcttttaaagttacatcaacatgtttaatctctctccatatatgtagttttctgcaaattaaaatctaaagctaacctttgttaactctcacagatggggattatggttaagaagtgggtaatgtaagctaatgggtgaaactccgaaagaatatactacacgttgtaatgtgacaagaccgcaggcggatgtggagagaaagctgtgatgatcacatctctacccatgtgagatcgaagctcatgaa

SEQ ID NO: 1884 - DNA, 461 bp, Rattus norvegicus
  Genbank Accession No. AI103059
aacactgcatatattccttatcgttctgttgatacaacatggagaactttgtaaggagaaaaaccaaaaggtgctaagagaaaaagaggtgcagaaaccaggtaagaagccaggaagaggctaagataaaccagagacaagaaaggtgggtaggtaagcatggcgatgcacacctttaatgccggaaacatttgggaagcagctagtaaatcctaggccagtctgagctacataatgaaacattctcaaaatatcaaagtaagtaaacagaaaagtgtgggtggagagaagccccctcatctgctgcaacatttaacccttgcagtcccagaagcctagacagaaagctgctgggacaccccattctggcttctcagtacaagtgagaggtcaccgataagacagatccatcaggaaaaggaatacacatgtaggagctgagacagcagccagccttgctg

SEQ ID NO: 1885 - DNA, 604 bp, Rattus norvegicus
  Genbank Accession No. AI103094
gatattacttccaataagtacaatatttattaaacatatcttcagttttgttacatagtgtgcaacaaattacaatattctgcagccacaaattatatgcagagtatgaagaaactattaatcagatagtgtaatctttccatttataactctaccaggaagaactagcaaatcagatcttacatataacgtctcactaaactttatgcatggaaactgacagacactggttgtgctgtttgatacaaaatggctgaacttcatcttcagaagactaaacccaacatctaaacatgccaatataaacatcaaaacaaaatatattctaaccaaccacgggaaacgatctggtatcaggaaagcaacaaggattacacacattattttataaaccagcacacaaaggtttaaaacagttctgaaaatgaagttagctgtcttgagtcaagggaataaaaaaaaaagtcagtattgaccatttacaatctctgaccttgtggaaacggtaagaatctgttgtaatgcagctacatacagtacaattcaggcaatttgttttttcacttgggttcaaattgcgaattcattgctgtgagaaaaggac

SEQ ID NO: 1886 - DNA, 536 bp, Rattus norvegicus
  Genbank Accession No. AI103105
  misc_feature (1)..(536): n = a or c or g or t
atcagatagtcttttatttaaatattttcttgttgcttcttttttttttttcggagctggggaccgaacccagggccttggcaagcgctaccactgagttaaattcccaaccccttctcgttgcttcttaactagctgggcactccaccgcaccgctgttgatgtcatctatgatgtcatgagggtggcggccgtccacattgcagcccacagactgtgcagtacccaggatctccttgatagttccagaaagttctctggccaaagaccggtgtctcatctgccgggcaatgttgacaatctcatcaaaagtgatgtttccattgtgtttaatgtttttctgcttcttcctgtctcttggtggctccttgagggctttgatgatcagggcagaggcagagggcaccacctcaatctgggcctgtctgttctggatggtcagtttcactgtaatcctgaggcctttccagtcaccggtagccttggcgatgtcatcaccaacttttttgggagacagacccanaggaccgatctta

SEQ ID NO: 1887 - DNA, 540 bp, Rattus norvegicus
  Genbank Accession No. AI103106
aatagtaaaacagccttttatttgttaatgttgataagaaatttaagcatgttacactatcttaaaaacctcaactagcgcacgtgaagagaaagtctcccccaccctagcccgcctgccccattcccctcaggaatcaagactctaagagaaggagttgactgaacgacggctctgcgaaacgtccatccagagtgcttacatgatggctggcgcaatactgccttcctacaaaacgtttcttctcttttctatttaaaaaaaaggtaaccttgatcacttattacaaaaaaattccatacaaaagttcatatattgaaaaacgcctttcccccctcccacacagcaccattttatatatagcagagaaggatcaagagcagatcgcctatctagggagagcgatcttcaattatgcctggacacgcagtggttttcttaccctccctgttccctcttaaaagaacttaaaaaaaaaaaaaattacatacacacattcaaaaaagaaaaaaaaaatgccaaaaacttgagggccccttt

SEQ ID NO: 1888 - DNA, 531 bp, Rattus norvegicus
  Genbank Accession No. AI103143
tggccctgggcggcctgcctcccggtggcggctcacacccgcagcactacggtcgcctgcccgggaccatctggagctacactcaggtgcggcgcacgggaggcggcggcgtggaaacggtgcagggccccggcgtgtcctgggtgcacccggacggcgtaggcgtgcagattgacaccatcacgccagagatccgcgctctctacaacgtgctggccaaggtgaagcgcgagcgtgacgagtacaaacggaggtgggaggaagagctggccaaatgtatgaaccttcagaccatggtggacacgctgcaggaggcagcacaagaagccgaggccatccaggaggagatgaacgagaagatcgaacggctcaaggccgagctggtggtgttcaaaggtctcatgagtgaccccatgacagacctggacacaaagatccaagaaaaggctatgaaggtggacatggacatctgccgccggatcgatatcacggctaagctgtgcgatgtcgcacagcaccggaactcggaag

SEQ ID NO: 1889 - DNA, 588 bp, Rattus norvegicus
  Genbank Accession No. AI103150
caacgtgcatttatttaatatacattgtatgggttcaagcagacttaatttaaaaaaacaaataaaacaaaacagcacagctcagaaaccacggagaaaggacagacatctaagaaaagagacgacacaagagaaagctggagagctggcgtcagggctcttggttggagacctgctttgaatatgtttcttgcaggtacttcttaaatgctgtggggtttttccagagctctgcagcatgtgtgttcaaagggctctcgatgttgggttctcctagcaggctctggatggagagcaagatggtcctgacatcatacagtgcagaccacttgtccttgaggatgtccaggcagatgttgccctgggtgtccacgttggggtggtagcacggtgtgaggaacttcactgtgggtgcgttgtaagggtagccactggggaactctagggagagtttatacctcaggtcttcatatacagtgccggcggctccatggatggttcctacccatttgaacaggttgtctgattcggggaaggcggaaattcctttgtcaccagacatcatgagggtcatcagctcctgctgta

SEQ ID NO: 1890 - DNA, 580 bp, Rattus norvegicus
  Genbank Accession No. AI103162
aagcctcgcccgggttctgactccagccctgatgcggcttctggccccggttctgaagagcaacttgacttcggtgccaatgcccaccagcactggattgttgactctgcctgcttgccctgaggagtccccgctgctcgttggccccatggtgattgactttaatattcctgtggatctggagcttttggcaaagaagaacccagagataaagatgggcggccgttacttccccaaggactgtatctcccctcacaaggtggccatcattatcccattccgtaaccggcaggagcacctcaaatactggctgtattatttgcatccagtccttcagcgccagcaactcgactatggcatctacgtcatcaatcaggctggagacaccatgtttaatcgagctaagctgctcaacgttggctttcaagaggccttgaaagactatgactacaactgctttgtgttcagtgatgtggacctcattccaatggatgaccataatgcctacaggtgcttttcacagccacggcatatttctgtcgcaatggacaagttcgggtttagcctgccttacgttcaa

SEQ ID NO: 1891 - DNA, 447 bp, Rattus norvegicus
  Genbank Accession No. AI103245
ccgaagccacggcccaactttatttacactcattgcaaagcatgactgagggtaaaggacaggtaccaggggatggggggctgggggtcatggaaactgtgcgggtgcacggtagggttgcaggaaaaaaggaaggcggtggtgaggatggacagcccctttttcagtgtcccccaggctcccaggcgtccgggggcaaaaagcaggtgaggctgccttcaggatttggacttggacacagccagtccaatgagtccatctttcttcatggccttgtcaatcaggcgttccagctccttgagccggtagttgcccacggccaggtagaagacataatcccgctgctcctctttgctacctttgggcaacagctcctccagcagcacgatgcctttacggatgtcgtcattgaatttgcttcaaaccaggcaccaggcgtatttaaac

SEQ ID NO: 1892 - DNA, 567 bp, Rattus norvegicus
  Genbank Accession No. AI103314
cagactactttatattttcataacattttaacatttaatagaaactatatacaataacttcactatatcttacatgaaggagccaccacagaaatttacataaattaaaagcaagaataattaaggagaacccagacctgtgaactgcttttctcagtcggttcactaggaaagggggtttatattgcccaatgatgtggagcagaggaaaggcttaaatacagctttagatacggctacagagactaagagccaacacctgaagagcaccgttcttcaccacagccaaccccgcctagacatccacgtggatctcagcccatggctcagaagtcccagtataaatgtctccaataggcactgcatctcaaaggcagggagcacctcacgctcttcctcgcaaaaaatcccaaaacttaaatactaacttgtcatcacagagacttgggttatgtttgtctacagcactctcaagccccgaaggaaacaacgtggtctgagctgtccctgttcagtgagagatgatcaaagatacacttgtctgaaaaatggagagttcaaatccaa

SEQ ID NO: 1893 - DNA, 386 bp, Rattus norvegicus
  Genbank Accession No. AI103377
tgactttttggtgggaacttcatcggtaggatctgtttgtacagatacacatctactttttctggaggcctctttcaagtccggcttgtatcgcagttctgtgtctaggaccccagagaggacctcctctatcttctgcactatctcttcatttgggagactccttgcagaggcagctgtgtcacctgcctggttcccttcaatgggtgcattcgtttcaccattcagctggccttcactccttccactggaaagctcctgttgtatttcccggaatttactgaccacgaaagacctaaaaacctgctcgatgtcggccgccatggcgtccgctccgttctctcaactcctcctcgctagtcctccaggctcccagccctcgtgcc

SEQ ID NO: 1894 - DNA, 597 bp, Rattus norvegicus
  Genbank Accession No. AI103379
gggttatcttttttttattgggatttaggttccaaacaaggtacaaagcagtggtgagaggatcttgaggttgctgggtgataagggaagtccaggcttggctagatggaccactgcctgaggccaaatggaaaccaggactggaaaggatctggggggtagggggactagggcttaggggaattcatggagatcagcgaattgtatatcgtacataggggacctcgacgtcctcgccactttcatcgttgcagcacagctcaagcaccagtgcacgcacatggcggcccagctttctctttgacactcggctcacaatctctgtcatcggctgatccaaccgttccttgagcttagcagctggcatgaagaaagaatagagcatggacacaccctgggacagcatggtgatctctaatttgtgctccgtcttaaagtaatcaaggaactgcttgagagtcatctcctcaccattaggctgtagcccttgtacttcaaagcgatcccacaatgtccactcttgattatagtactggtgacgaggcgcagcaagaggttccgaaaacccaaagaagggcagggccaaatcctcgtgcc

SEQ ID NO: 1895 - DNA, 660 bp, Rattus norvegicus
  Genbank Accession No. AI103388
aggatcagtccagaagtaaaactctttattttcactgtccaaacatcagtcaatatactgggaaagccagcggaaaccctcgccgtagccttgcctcttgagcacactgcacatgaacacttccatggggcgggcgttcagctccttcagagtcacattcccctttcctgtggtttgcccatagagcccaaatatttcacggagtttttcttcactgattgcatctgtcctgtcaattttgtttcccaagataaggattggcacgttggatattgtctcatcagtcattaaagcattaagttcaactttggattccatgagacgagaatgatctgcacagtccaccagaaaaactattccattaattgctgggaggtaatttttccaaacccgacgtgcttgctcgtgcccaccaagatcaaaagtggtgaaagtcattccagcaatcgtcagttcttctgaagtgggatggagtgttggtacgtgctggcctagtctgtcatctttcagcatgtgaagaagagtggttttgcccgcattgtccaaacctaagaatacaagttttccagatttcttgtagagtcctaggaactgaagcacactgctgaagccattgtagatccactcaaagatgaaagacattattgatgcttacaacgg

SEQ ID NO: 1896 - DNA, 443 bp, Rattus norvegicus
  Genbank Accession No. AI103396
attaatttcattttaacattttgtcttcaacaattccagagattggtatgagaatgaggataattgaaaagtagctgatggaggctagttggccaataatgataaatgggtgttctactggttggcctccgattcatgttaagactaggaggttggctactaggattcagtaaaggatttgggtgattgggcggaatgttaagctgcgttgttttgaagtatgcaggaatggtaggaaggctaagattaggattgataagattagggctacgactcctcctagtttgttgggaatggagcgtagaatagcggccgcaaaggtccttgtcctttttatcactttttaaaaacccgtgagatgggatcaacattgaaagtggggatttttttttctaaagcaatcattacatgagaaataaatttatataacccctcctcgtgcc

SEQ ID NO: 1897 - DNA, 512 bp, Rattus norvegicus
  Genbank Accession No. AI103410
cttgtacaaaacactttattatagagaagagttggcttatgggctcaaacatctagatctgggtgtctattctctttcctgttttgtctccagcactgggagctagggtccctcctcatctataagttatctctgtgaacagagggggtcttccccaacaccctgcagttccagaataagtctacaggctgaagtggtctgaccatacaagaaaagctctttacaaaaggttctgtggggcagaaaattccagaggccatcctgccagcagaactgggctgccagctcagtggtgggcagggctcactggcaggtcaaccatgtgtcacccaaagtctagccatagcagaatgaaagccgagctgtaccgatcactgggaacagtggggtgacaaagttgtcagtcacaaggtgcctttctgggtcatggcaaatgtgggtttggacttctggtccttaggccacaagagagccactgggcggtaagccaagcctggtgtgggggaaaggcc

SEQ ID NO: 1898 - DNA, 542 bp, Rattus norvegicus
  Genbank Accession No. AI103428
tatctttattgacttttttttctgaatgcaatgactgtttttttttttttttaactcttaaggaaaataaacatcttttagaaacagctcgatacacacaatcttcagtgtgaagcaatatactaataagaacactagttgtcttaacatttacagtcttcatatatattatatatatgtatatgtatacatatatatacactatataacgaggccagatataatacacacgtttaccattttacagtcatatgtacagaaagttgcaggggaaggggggctgcatcaggcctattgaagcgtggacagctgagaacacaaacggacaggtgggggctggccgtggtggtgatggtggtatctgctggggaaggagcatcacttcagctctgaccccagccaaagccaggttagggctctgtgctgtggaacacaggacgcacagcagcgacacacagaagcgagcatgttcccaacatatatacattctatgtaccatatatatagaggggtacacaggtttgtacacgaatctagcacgg

SEQ ID NO: 1899 - DNA, 541 bp, Rattus norvegicus
  Genbank Accession No. AI103441
atatatatatctatatttttgtattggggggagggagtagaaaagaaagcagcccctatactgggccctattcagtggcagcttcttgttccatagggttaaggaagactttgaggaaataaaagttgtttggaaaaatccaggtgtagttgctttgtatgctgtgatgggtaggagagatgaagtgaagtgtgaaggcccctcacaccctccatcttgcctcagactatgtcctggaagcctggggcggagaaaacgccactttcattcctgcttcttggggttatttactgccacgtagtgatagaggaccacaagcaagaaaagcgacacgcccagcatgttggcgaagatggcgagctgcacgtccgtgatcatcctgtggacaaggggaaggactgagcctcggttcggacactccttgctctctcaccaggctagatccttgccaccacgatccaacctcctccgggttcgcctgtgaaacgaagcctgggagcgtctcacctgactagcttcacccgactccgaccctcgtgcc

SEQ ID NO: 1900 - DNA, 500 bp, Rattus norvegicus
  Genbank Accession No. AI103456
ttctttgtgcatcctgactccaccctctcaactcccgtctgtttcacagctcttcccaccaacccagccctggtaactgctgatccagtttttctctgaccttgtctcaaatgccgtgcgggtataattaggatgtaggctgctgagtggggtctcacatttggctactggctttaaggtctgtgttacaggatggatcagtggtcacttccctctgttgctgagttgttctactctatggttatcttgcactttgtttaatcatcaaccagataaaagatatttaggttgtagggtttttttaatttttaaatttaaatataaaatttttatataggattttatgtaaataccttcccttttccctccccttggagtggaatgctgccatgtatgtttaactttataataaattgtcaaaactttcccaaaaaaaaaaaaaaaaaacctcgtgccgaattcttggcctcgagggccaaattccctatagtgagtcgtat

SEQ ID NO: 1901 - DNA, 451 bp, Rattus norvegicus
  Genbank Accession No. AI103480
tgtatagggacatgtgcatgggtgtgtgtatttgtgtgtgtgtgcatgggcacaagtgggtgcatgatgtatggaacatgcatacgtatgtacaagtgtgcatgatttatgtatgcatgcatgggtgtggagggcatgatgagtaggggcattcacgtggaggtcagaggacaactgtgtggaggcagggttcttcaagtgtgttcctgagatagagctcaggtcaccaagtgtgtacatgaagcacctttcttttcctgctgagccatctcaccactgtacaattttttttaaatttgatttacattgtttacctttacaagtatctgaataatagctctagtattcggtgatggtcaagggtaaaggtctttgtagtactaacaataaaggaaggggtgggagcctgttgacagtctaaaatagggaagagaacaaaatagacaggaga

SEQ ID NO: 1902 - DNA, 484 bp, Rattus norvegicus
  Genbank Accession No. AI103496
aggtttcaataactttattgggaggtttttattttctgtgaaatacactagaggttggggaagggttcatattcactttgcaagggaagggtttcccaccactaaaggaaaaggcatggggcagggcacactggggtttggatccactttcctacctccttctgctttgctcacattactttttctcagtgaacacaatacaaaagaaattcaaaacagaccaacctccagagggggtcacatctaaaccttctcccagcccaggctttgcctgggctgggagaggccagggtagctcactctacagccctaggctgcacagaaaggctgagggctcagacaggtactccaaagttaataaattagaataaattataaggagaaggaatgcaattttgtgctgggagggtcccttctctccaacacataaaagttgggggaggagatggggtatctccaaaggcctctacatttgggactaaaa

SEQ ID NO: 1903 - DNA, 535 bp, Rattus norvegicus
  Genbank Accession No. AI103521
ctaaaatcttaatcctttaattagtttccctctttccttctctttgcttccccgaggagagaagagggacctctgtcgcctgcacatggttcatggcccctgggtgccaggcaggtcctgggctccgggtcacatgcagccccggcaggaggcccgcgtactgctgaggtccctgtggcttggttaggtgcgttggctgggcagctcctgggagatgaagcggcgtaggcgctccaggtattgactatacagctcaatgtcgttgtgcccagcaccctccacccacagcggctccacggcctttggacagcgctcatacagtgccagcccgtgtgagaagtcgatcacctcgtcttctgtgccgtggatgatgagcaccggtgacgtgatcttcgacaccttctcgatgttagggaaagcatcgaagcagtaggtcttcttggtgtcagggaaggccacccgcatgccggaggtgagaggcgagtgcaggaccactgcagcacacttcataacgggacgccagatccactgtggg

SEQ ID NO: 1904 - DNA, 483 bp, Rattus norvegicus
  Genbank Accession No. AI103552
cgttttaaaatggctttattaaaggctagagtataaaataggaccaagttacaagctgtcagtaagaatttacgatttcgaaagtatgtatcaaaggagagggcagggtgaggaatggaaggccacccccacactggcatgtggggtgcacctggccgaggggcagattctgctgctcctgacaggaccggaaccaacccagagggcagaccagacgcacagagcctgggttcctgagggcttctgttggacacagccaccaagagcaagacacggagccctggagctgcctcccaggtgccgagcgtgggcgtgtggtagaacccagcatcatacactggcttcagccaaagagtgtgcttcagagcagagtaacgagtgtatgtcatcgtgatgtacaggggaagggaaagtgggaattacagttccggtttcctggccactgccgcatgttccctgggggaggccaagacgccagcgtaa

SEQ ID NO: 1905 - DNA, 499 bp, Rattus norvegicus
  Genbank Accession No. AI103572
gagacagacatggttacttttttatttgaagcaaaaaaaaaaaaaacccataagttttaataaatactgtggaaaacactgaccaaacaaacatacaaagtgacttcaacattaaaaaaaaaaagcaaaaaaagttctgctttataaccgttataacttattttctttttacaatatttaaatacagaaagcacttgccagcgattttgtaatactgcccaaagcatgacgctgtaccagtcagagcatatttgttggtaatgtctgagtttcatgggaaatgactgaaatggcattttcttgcagagacaaaacaaaatacttgtgaagacacagaactgggtgtcggaactaccttaatctccccttctgccccagtttaatggggacacagcttcaacacttcaaaaatgaagcgtcatcattgggggaaagaaaagcttgttttcaacaagcacggactataaaagatcaaaactgatttcttctctgaaaagaa

SEQ ID NO: 1906 - DNA, 447 bp, Rattus norvegicus
  Genbank Accession No. AI103589
tgtttttttttttttttttttttttcagtgtttttgttttattttaaaaagttcacacagcttccccacctttgtcccagcactgcttttgatggctctatcccttctctgtattgagtcaggacagaacaaggctggtgttgggcaaaaggtacctctcagcccccagtagatgcactgacccaccccactcccactcccaggccaaggtggctactacagtgaggaggtgggatggaatgtggtgggcggagagctcctagaggagggtcgggacgcacctctacccttgtggcactacagagccaggaagcagggcagggtagcgtgtaggcaatggcaggtgtctgtctacatgtcacatacatgtgtgggatgggcctgggtggctgcatgccaggttgagtcctgagtcatggtgcacacttctcacaatgaccttgcctc

SEQ ID NO: 1907 - DNA, 478 bp, Rattus norvegicus
  Genbank Accession No. AI103602
ttaagaagatttattgacagactagtcttgcagtccagaaccgggctgacggaggctcaggaagttgtcatggtacaacccggtgtgggatccactctctacatgggacccctgttccacaaggtggctaaaacgaagaggtggggtgagcatagcttcaggaggcccatgttgggccagcttgaacttaagattccataacatgttggttcccattccttgactgtttgggacatgagagaaactcttagaaagttggtaggggtgcgaaggagcatggcgtacagcccaacagatgtcgagacccgcctggtccatcctccctcaggtcaggttgtcgtgatttgcagaaagggtagagaaccatagaacggagttagaggcaggcagctctgggccccggaacacagaagaagaagcatgccttcctggtgccctttcattctatggtggctgctgcctggttatttgcccttga

SEQ ID NO: 1908 - DNA, 568 bp, Rattus norvegicus
  Genbank Accession No. AI103616
gtcattttagggctgaattttaatagactgtaagttggaattcttacatttaaaacagaaccttaaaattactgactggttcattggttcaaaatggttttatggaaaaattaatctgtaacaaaaacttggcatcagacgcgaagactccgccattttctgagcaaagcgtacaaaggctccagggaccaagaccgagggaggggctcagacatttacaacagcaggcattttctcttcctcttcttaacaggagggggacagagaacggctcggatagcttcatcaaacactgtcttgagtcctcgctgtgtgagtgctgagcactccaggtatttgacagcaccgatctctttcgccatggctagcccctgcgggtaggtaatgggagtcagcttcttctccttcagcttctcaatcgtgtccttatcatccctaagatcaagcttcgtccccactaggatgatgggagtattgggacagtggtgtcgtacttcaggataccactttgcacggacattttcaaatgatgcatgactcacaagggaaaagcaaattaagaacacgt

SEQ ID NO: 1909 - DNA, 476 bp, Rattus norvegicus
  Genbank Accession No. AI103637
ctgcttcatctatgaactttagtgtaaaacatttatgtacaagactgttctctaattcatgccaaggcagccacatctgcatgaacatgggtatgactgtcttcaaaaccagctcttcactgtcctggctggttgctctgtcatgcagagttgcagctgtgatgatgagggtgtgcttctgtattctgtggctggcaagctatggcaggcttagaaaggcgcatgatccggcaatgtctggtcaccacttccaggtgaggaagggagggtatcgctgccattctctctgccgcccacaaccttagactttatggtccccactcgatcttcaaatgacttgaaggttgcagagttcctcatgacaggcatacttatcgagtgtcggatggagtagctgctcatatctccgaacttcctgctgatggcagagcccatggtggacagagcagctgatgttttctgccctgcctgtgaaa

SEQ ID NO: 1910 - DNA, 575 bp, Rattus norvegicus
  Genbank Accession No. AI103641
aacggtttcgtaaaattttattaacttgacctttttccggcacagtgtgtggtgtgtgaatctatgaagattcagagcccacccaggacaattgtgcccacatctcccttctgctgacttctttgggtttaagacacccaactccatactgcaatggcctccttctctcctagactacaaggcacataaggctacacggtgatctttgtttggggagctacagcagcccgatttctcagtcagggcgtgagacagaggaagaaggttgggtctacagaaaagtgatggctgttcaccccaggaaggagaggcagggtgcccctgatatgaggacatatgtggatggttacacagggtgggagaagaggccactctatctcacaaagcagaactggagcagcccctcactagagcttgatcaggaagctatgcatctgtgacagaaataaaaagtccttggaaacatacactgcagctggtgggtggaaaaggggaaggcttcattgctcaggtcagcatcaagcacatcctggagaatgtcacggctggctgggccctggatactgagcatgccc

SEQ ID NO: 1911 - DNA, 575 bp, Rattus norvegicus
  Genbank Accession No. AI103708
accaaaagataagtagaaatttatttcaaaatttaatacaaagaatacaaacctcatggttcctcaaagacatcaaattactcttctataattttctcctaacttttgagctggcaggtagagaccatagaagaaaatgttacacagaccgaatcccaagcgttgcgtatttaagcatcactaactgtactgtattttcccaaaccatctggggagtttcgatgggattgttccagcgtgcactgaacagtagtgaattatcatttccatcctaaacccagtaagccgtctccggctgtatttcacccagctgaaagcacataagccataggacatgaaaggaactgtcactagggccagagggcctgataccttggtcagccaccaaacactcttgttgctacagcaaccagtttgcaaacagaaacgatacaggataaaccaaggctctgtgataacatcagggctaagtatccctttcaaagggtgtaatagtagcaaggtaacttagaaattctatccattggtatggatgaattttacctgagatgaggacagtgatggacattaaatgc

SEQ ID NO: 1912 - DNA, 527 bp, Rattus norvegicus
  Genbank Accession No. AI103718
gccaacgggaagtatattttatttacatttttaaaatctgtaactagtctctcttcctcctttcctttcccagagacttgggaagggaaagaacgggaacctcaaagacctacccccaacatacaaagacgcaccccatggctcacaccagcgaatcaaagtgaaagagacatggcctcctaaaaggccccagggctggacaggggagggcaggcctggcaaggtgggtctccagggaagaaaaggacaaggagtaggcaggtcagctgaaagggttggaaagcagtccaatgttctcccctcctcttccctctgcacccacacctctgctgggggagggcaggggtccctttatccccccctcaacaccagacaccatgccagaggctgcagccgttaacggtcaggtctctggacacaaaatacttttgctttgtggtctcctgaggtggtcaccaccagggaagcatctttgctgagtgcaaagtccaggatctcagcagtgtggccccggtagtcagtaagca

SEQ ID NO: 1913 - DNA, 484 bp, Rattus norvegicus
  Genbank Accession No. AI103754
gctccgttaacgttttttactaaagcacccacacaagtttctgtgcaacataaaaacagagtaggccctggggctcctgcctcctctctaagggagggaggccagaaccactgactgatccaggcccacctgtcccccatgcaaaggccaaccccatgatcccaggaaacaacacagcaccccttctggtcccctcctgggggcgctcctcagtaggtggcttgccaaagcttgccccctacaatattgaatgaaaaaggtttcccctcccctggaagcatgaggggtctccagatctgagaattcccccctggaagagacattgccccctagttaaacctcccacctttccaggccctaggggactcgaggggagtggggaaactgaagcacatagaggtggagtgacctagctcaggccactccgcgaggcagtgcaggggctggcccaaccctaacagtgaggaggtttgggctgggaaaa

SEQ ID NO: 1914 - DNA, 457 bp, Rattus norvegicus
  Genbank Accession No. AI103828
gagcttcaatctcaaacctttattttgctgtaaaggggagaaaaatgattagtggggggtttgtacacaacactttcatacaaagaaatgggtgccgcaggcctgatgtccagctttcttcacatttccccattccaatgtgaccagcaagcatgttgctgttccaatgacagtgaccatgccctggtcacaccatttttaagcactcataaaacgaatacacaaacagggttttcagagccaatttttagagaacattatctagtaagcggttcacgcccagccccctgcccttgcccagttttcacttttatttccttaatgttttgactgacagtttcccctctgctcggggtttaaagcaccattcaagcccagcccacaatgtattcagcagtgcagccttagccaagtacatgagtgaggttttctaccaaacatcacaatgacctcatag

SEQ ID NO: 1915 - DNA, 514 bp, Rattus norvegicus
  Genbank Accession No. AI103834
gcccgacgtcttgttgagggaagtggtaacttcaaacacggctgtcacagacgcaagaaggcattcccagtgtgagcattcatgctcctccttaactctgatcttgcaagaggagcttctctgacaccaacaattccatgaagggagcatttagttcaacttggccaacaattcttccagttctggccgagctttgaaccttcccttgaagtcttcttcagtgtgctccctcactgacaatctgactccttctggaagattgatttggagtatttccaggaaaatctcagcgcatgtagcgctcagaccgctgatctgcaccactcgttcatgggtagtaaggactgagtctaggaccattttgttgccttggtctggtagccgcatcacttccatggtcttggtgggcatcgcataactttcctcgactttgatggacagctggttgcagaggcggtggacataccgggcgtaactttctgctagagtcatgtcataagctgtcaggtggata

SEQ ID NO: 1916 - DNA, 526 bp, Rattus norvegicus
  Genbank Accession No. AI103848
attagattacagccatgctcagtcacatgcatattgtctggggctgtttttacagagtagaatagttatgacaaaggccaccaggtctacaaagcctaaaataatatctttacagaaaaagtttgctgacctctgcttcaagtgatcatggtttgatttaaggatatggtgacatctagtgaaagtgtaagtaaggatggagattgtgacctatcaaataggtttctccaaaaaggaagacatttaagaagtgtacatttgacaaatattttgataaaaattatagttatttgaactgcatattcagattatttaacaagagtatttctccctgattcatttattttattatttgagcaagaaaacagatttcttcttcgtatttagccccaaagaggtcacacctgaaagggtgaggaaagataatataactgtctctcatctgctcagagtttcagcaagatgggagatgctgtctgtcttccaaatgccctcgtttcatttgctgaagaattgctatcaccaa

SEQ ID NO: 1917 - DNA, 513 bp, Rattus norvegicus
  Genbank Accession No. AI103851
gctgggtcaagcaattttaatcaagctcatggtcagctaaggacagtcctgaactagcccggaagtgctaggaacagcgttcactgttgtcacttgtaaggtgtcgagggtggcacccattcttggatcttcttcctggtggtggagtaagggacgtattgctctggagtagcactcacattgaacttatggtttgtccaaatgaacttacgagcagtcagtggttttgttgttggagggtcgtcagtcatgcagtgaagccagcggtgccattcaggaggcaccatgcttccatccacatcccagaatgtgtttttgccattcatttcggtggtgtatatgacccatcggtgacggccaaaaaactgcttgttgtcttcgtagtatttgtttccgtatttgtcttcccccaccaaggtaccgagccttatatcatttgccctgaagaaaacccgtatgaggccccgcaggccgccgtggccggtgacctgctgcagcccgcgccctcgtgcc

SEQ ID NO: 1918 - DNA, 437 bp, Rattus norvegicus
  Genbank Accession No. AI103874
gaagtaaactaaatttattatcttcttacaagaatgctttagttgtttggttttgtttcaagtcctgtgccttttaactttcaccataaagtattattttttacatgtccttgacaaaggcttgataagcagttcaactctttgggcaaagtcactagctcttatccgaattagaatacaggacacagaataagtcaagacaatccatgacatttttattgagcctttagtttatgaggtaaaggaaaagcagctctcttgaatactttacatagctgtaggaaaatatttgagacttaaagggagttacaggggattatgtttctcaaaagttgagatcaagtaaacaagctttaaattgtttaaattttccagttgatctttccttacaatagtaacaagctcgaattagccacattaggtttttatgtttgcag

SEQ ID NO: 1919 - DNA, 576 bp, Rattus norvegicus
  Genbank Accession No. AI103911
ttgtgaaaagtttaatatcaaagcagaaaaatattacttatcaaaaatgatttccccatccattttgaagtagaaaatgatgtccccaccttttctcaagtccaagatatgaaaagaaatttagataatgacaactccaattatagatttcacaactatcttgtacaacaatctgtaatgttttattagaattcactatcaaagacattgcacctttccagtctgtgactgaatttaatgatgttcaacagtggttttattatgctaatgcttgataatatttaacagtgaattcaattacttcacattaatgtttgccaatagttattaacaattcttaaatattttaaatcaaccaacctagaagtacacaaggcttactctcaactcttctgaggggacatgaagaccgaaagaaacctaggccctgagtccaagtgtctaacccacaacaactacatcatcactggtgaactcataggtaggtacttccaggttgagaggtgcagggcccttcctgatcctgccagaagcatcatagtgtgacccatggcaagggcaatagtagccaccaaa

SEQ ID NO: 1920 - DNA, 612 bp, Rattus norvegicus
  Genbank Accession No. AI103954
atctatcatagaaaacatgtatcgtttattacatggacttagaaatcaacacaaatcaatgtcaggcactttttaagtacacactatgagaaatgtctaccaaggatatgcacattgagcaggcaacaccacagagactcactcatccatttttaggaacagtacagagttagagaattagaaagaagaaatattgcataattagcccacctgtatcctgtattacatctctccccgatttcaatccactttagggttaaatataagctctcactttgagtgttggatttcactctttcccttagcctactgtcatggtcttaaaggagcgcacctgctttaaggaacatgacacagatgttttataagaagcatcctgaatctatcacatctgaatctacagaaacacatgatggttgactgctggcttttccttccttcttcttttcctttgtgacagtctttccctttgtagtcatggtggctgatactatttatcccaggttgaccttgtatgcccagcgagtctcctgtctcagcttcctgagtgctgggattagttttaacaccactacatatggcttattttgctgtcttttaaagcccgtttta

SEQ ID NO: 1921 - DNA, 587 bp, Rattus norvegicus
  Genbank Accession No. AI103960
tgtaaaattggcaggctaggatgcaggctcaggaggccgcctgcctggcctggtgctgctgggcaaatcgttgcatccgatcctcaagctcgggccggaaatgtcggatcagaccctgtactggccaggcggccccatcacccagagcacaaatggtgtggccttctatctgcttgctgatctcccacagggagtcgatctcagctggccgggcatcccccttcacaaatcgggccatcaccttgttcatccaatcaacgccctcccggcacggggtgcactggccacagctctcatgcttgtagaactcaatgagacgagcgatggctttcacaatgtctgtcgagctgttcataacaataaccgcagctgtgcccaggcccgtctgagcctgcaccagggcatcaaagtccatcagcactgtctcacacacagatttggggatcagtggagtggatgagccaccaggaatcacagcaaggaggttgtcccagccacctaagacaccaccagcatgtttctcaatcagttctttgagtggcacagacatctcttcctccacagtgcatgggtggttgacatggcca

SEQ ID NO: 1922 - DNA, 315 bp, Rattus norvegicus
  Genbank Accession No. AI104035
tttccagtgggtttttattagtagttgcatcatgattcagggtcccagggtagggaccatcatatactgagggcccccttttctaacggggagaagggcaaagagcagaggaaaggtgggcggagccaggtcagatcttcccaggaaatgtgccttcggctatgcgggcatcccaggctgagacccatgagacggggcaaagggacttgtacactcgccgggaccactcccaccctcgtgccgaattcttggcctcgagggccaaattccctatagggagtcgtattaaattcggaatcatgtcaaagctgtttc

SEQ ID NO: 1923 - DNA, 394 bp, Rattus norvegicus
  Genbank Accession No. AI104104
aagggcagtgtataaaaataatttaaacatacatactagcaacaaagcaacacgactctctagttataactacaaacttgcccaagattttttttctccccaaaggttttaaatacattggagacaatgagacagacaggcatgtacacatgtacacatgtacacacacacacacacacgcgcgcacgcacgcacgcacgcatgcacacgctcacacacacatgctcacacacatatatacagctcaagtatgttttctgtgcactttagctaactgctacagctaacgtgaagaactggattcctgagtgacctcgaagtggaaccaaaccccccatcagtgtcagatgccaacttcggagaacaagacgtgatttcccctcccaatcttatt

SEQ ID NO: 1924 - DNA, 493 bp, Rattus norvegicus
  Genbank Accession No. AI104127
ggttcatcaaatttcaaatatattttactgcgttgaatatattctggtgctgtctaaaacacagccaaattagtttatcgatttacatctatcctgtaacttttggaacatcaaggtcaagataaaaaaatattaacaaaactacccaattataatcaccctctccccgggtctgagcctcgtcctgatgccacagtgccgtccttctcagcttgtgctcctggaactgctgatgtctaagtgcacttgggagccctcagctggcctcgttcatcctctcacagggcgacaccctatctgttcccaggtggcagtgaactcctttggcatcatggaagctcatgtttgttaaaggaactgactgggaaacacttaagagtagagaatgtacaaaataatttacagagtgacagatggctttacgtgtgtgttgtctgaaaacttgttgtgtggggacacacacaggaagcaatctgtcatcaaggggctgggc

SEQ ID NO: 1925 - DNA, 494 bp, Rattus norvegicus
  Genbank Accession No. AI104152
  misc_feature (1)..(494): n = a or c or g or t
ggcgatccaaatacatttaatacgtggaataaatacatgaatattaaaataatgtctccccgggtcccacccctggggtccacacacagcccaggaccccttaagaccttcagacccctgtggaaactgaaccctttgtagggaaccgggtggggcttggcaccaacgcagaagccgggaggctgacacatggctacagagacatctatctcaaggaccccaaataccctgcagagaaggctggggacatcctgagcttgtggggactagggaaaatatggcccgaagtggggtctccctggggcgaggtgagtggctgcccctaggggtggctggtggggtccagaaaagggtccggagcttggccgcatcctccacggctgtccgagacctctccttgctggtgccctgtggccgggagccaaacagtgactcatcacagtaggatggggtgtggccaatcaacctgtatttgtttttcttccttggngtga

SEQ ID NO: 1926 - DNA, 495 bp, Rattus norvegicus
  Genbank Accession No. AI104231
gtgcctgagaggacaaagccactggaagggctgctaaggggctgttctttattagtgagtttccctaaggggaaagtgctcaatcccgtggcacagttgtctgagccccatacagcatcccttccaagagccctcatcagaaaaacagtccccgcatccgcctgccgatgccttgtcggtcatacaggacgttgaacttgttcacaaactggttcattgtgttgcacgttttggtgatggtgccgaggtaggccataagccccacgtcattgcattgatcataaaagtctgtcttgaacttgtcagtgctgaaaactggaagacagtggcatagggcataagcctcccgcaggatctcatggttgaagggaacctctcctgcttcaaaggccttgacgtactctaaaatgagcttcacacggctgtgcaacatcttgatggcgctgtgctgagctatgaggtgttcaaccacagtggagttctccccactgcctg

SEQ ID NO: 1927 - DNA, 663 bp, Rattus norvegicus
  Genbank Accession No. AI104253
ggttgacagtttattaaatacactacattttaccttattctttaggttttaaatcattcgcacatggacttggtaaaaacatacttcatagaaaactaagatgaaagtcaaaacaacacattgcacacagatcaactgctgacttgttaggagctttaaactccgtctgcacaggggaggatggagttaggtggtttgactgctcttaagtcctgcaccacactaggacttaaaacgcattgctgtggagatgcggatacaagaagcatctatcaaagaaactgcttaatcatctgaaaaacaggacagaacacttttctttcacacatagttttctaaacttgctctttatgactgtcatttctgtttagagaattagctgtacagactgatgaggccaaaaaaattattttctttagaaactaacaaaggaacctggagcctatttacagcacatgcaaaggagcgtgtgtaggcgccactgcggagcgggctgagcgcccgtcagcgacaggtcagctctccactctacagacaggtccttccctgcattctgcaagaaatacattgtcagggcttggactagaaaaacggcagacgatgcaaagacagaaacaatgaagtttgcaaatcctttatattttcaggtgttgagacaatatc

SEQ ID NO: 1928 - DNA, 619 bp, Rattus norvegicus
  Genbank Accession No. AI104256
  misc_feature (1)..(619): n = a or c or g or t
ccttaacaccacacacatttggatttttattaaagcccagaggacctgttaaaaggctagccttggtagagatgaagatgggtgctggggagcatttccaggtatagctcaggtcaaagggctgtggctgcaatacagctggtacagggtcctgctcagagcaggtcccagatttctctgcagacgcccacacttgacggtgctcagcagcatctcctgctccttggtggtggcacaggcatcataggcagccaggagactggcaggggtgctgtatcgatccaccagggctgctgccttctccccactcagtccacgcacctgcatcagctgccgggcaaatacctctcgcacagactgggccttgttcttgacagcttctgcattgaagtcactgaaggtgaggagtgagcagagagggtttgtggaaggctttgcttctgattcagcatcccctggggttccccaagggcggctgtgtaaggtgtggccctggtacagtctttccaggccctttgtcaaaagcgccaggtagccagctgactccttaatatccatggtacgcttcacaaaaaagccatcaatgacctgngtgtttgtgacagcctgcagcaatgta

SEQ ID NO: 1929 - DNA, 615 bp, Rattus norvegicus
  Genbank Accession No. AI104258
gtaggttgactgtttattcaatgttaatgttacagagttcgtacactgtcggaaccatgcctgagaacccaaagaaagaaatggtgcaatggacagcctcatccacccagacagtgtattaaaacttgattcatatgcattttgatttcacaatcttaaaaaattataacaagacttggaatttacatctgctgcaggtcttcagcgttccagtacagtatgccattaaacaaacctcgtcatacgtctctgttcacttcttaaaccagaaccccgaacagaatttgtctatgtgtgtgaagctggggtaaagcatacattaagggaagattgtgactcaaggtgtgagattacttgttaaggttttctggtgcccaaattaagccttcagtataactaagaatctcaagcttctaatcacccaccctcctcctggctggctcagatcatgccaacactgttgcccagaagtggcatacagtctggtcaggagacactggtctgcacctcctgcttcccacactgctgcactaatccactaatctgcaagacatgctctcaagctgggaaaacttcactcattccggttctactactgtcagtagtgagcgagtc

SEQ ID NO: 1930 - DNA, 613 bp, Rattus norvegicus
  Genbank Accession No. AI104261
atttgagggttttcctcttttttacccactttttaaaatatatttttatttattcttgaggactttcatacatgcatacaatgtttttttgtaacaccaatgggcaagcaggactttaaaaaggtcagtggagaaagtctgtgagcactttcacttcaacgctcctccctccctcagttaggctgcctgcatcagcccgctgatactctcttccacctctgacagcttcttcaagatctgcttgaccttagcttcatcaaactccagacacagaaactcagattcccgtccacttctcccaaattccagctctattatggcaacagggctgtgtatttgagttgagtgccgtgactgggacttgccgtccactctccagcgcaggccccgaagcccgttgtcccagcggctctggctcatgaggctctctcggatttttgtcttatggctcttccaaaacttggagatgactgcagcttgttcactggtgatgccgccttgcttcttggtttgagcggtcaggaatgcctctaactggttgaaatccatgtctgcagatgcaatagacttgagaattcccctcatcttcgccaggaaggggcagaattcctcc

SEQ ID NO: 1931 - DNA, 580 bp, Rattus norvegicus
  Genbank Accession No. AI104279
ggtgggaggcagtcctttaatggggtggggcacaagatagcagaacttccatccaagagccacaggaactgaagccagcgtgacgcggcaggcttttcggtaacaatagttgagatggcacaggtgaagggttgggcaaacaattcagctctggtgagctctgccacgccccactgacagcatctggtacagactaactcaggcgtggaaaacgagccaaagtccagaggcaggagcccacacgacagcacggaaggtgactcatgtgaggctgtcaatgagggagtcccgcatgctggtggcaatggtgctaggtttggcttcattcagcttgaagacactctccaccactgacagctctgtgctggtcgtgtccaggccacagaaagcacaccaatcattcactaccatcccggcagcaatcacctcgctccctcggttcacagtgcctgccacaaggggaacctgaagaagggaggacagctcatcctgatcctcgatcgaagttttagggtgcaccagacctccttgattactgaagacacagtagcttccaactaacacctggtcagcaaccgtc

SEQ ID NO: 1932 - DNA, 472 bp, Rattus norvegicus
  Genbank Accession No. AI104340
cacaaagacagccgcatcatcaaagccaacccagcatgggtgacagctcacaaagctggaacttgcaacacactgcacagcctgcaggcatcaccacaaattgaagagtgtccctttcaggtgactcagctggtctgagctgcttccaggcagctcatctggtctttgttttctctaagtagttcagctgtggctatctgtttcttctaggcagcagtctatttcctttgggaaggaggggcctagtgcatatggtcagtttcaggggcttcgagaagctattttgagtgtactgcatctcttagtgagcatcatcacagcattttcctccctgtgttggttcatttccctaaaacattctgtcttaagaaatttcacacaaaaatgggaggttgtaatcttaagaactgccacacactggtacaggctggcacacaccctattgtgtgccatcatgaaatcaggtgactaa

SEQ ID NO: 1933 - DNA, 596 bp, Rattus norvegicus
  Genbank Accession No. AI104342
acgggttttttttggggggtttttttttaaacaggtaccaatttcagtctatttaaatatagtattaatacatgtaatatttcaatgctttgatatctgaaatttattgatttttgttcaatgacatgaaactacactgtgatgccatttacagaagcttgataaaatatactgaaaaatacttattataccacagtaagctttaaaaaaataaaattaagccattacagttaagttacaaaaaaggtgaaaacacaaaacatggctaacagtggtgatctaactgggtaaacaagacaaagaaaataatttcaacatttactcatttccttaacatggtagtctaaattaaattcctaagagtgggaggaggccagcttcatgggtagtttgctctgctgtgcaaactgaggtccacactacagtttcaagataaactacttagtcacatctgagcagggaactaaaggaactgagccatcatgatggagttaatttcaacatctccttacagctttcctttgtctttgtttttgagacaagctatcactatgtaactctggctacctgaattctagactaaactggccttatac

SEQ ID NO: 1934 - DNA, 468 bp, Rattus norvegicus
  Genbank Accession No. AI104355
gagctgagagttctacatcttcatctgaaggctgctaacagaatactggcttccaggcagctacaaggagggccttaaagcctacgcacagtgacacacctactccaacaaggccacaccctctaatagtgccactccctgggccgaacatatacaaatcatcacagtatccaacataaaaaacatagtcagggttggagagatggctcagtggttaagagcactgactgctcttccagaggtcctgagttcaaatcccagcaactacaaggtggttcacaccatctatgatagaatccgatgccctcttctggtgtgtgtggagatagctacaatgtactcatatacattaaataaataaatcagcagtttacaaaaatacagatttattgcgtttcaacattcttgcaactgtacagagaccaagacccttgtgcccaattcttggccttgaaggccaaattccct

SEQ ID NO: 1935 - DNA, 569 bp, Rattus norvegicus
  Genbank Accession No. AI104357
tttctctttacacaatgacgtgttgctggggcctaatgttctcactgaacagtagaaaaccaaaatttgtcatttcttaaagaattgagtacaaaaaccttacataaattaaaaggatgaatacatttacaggtgtcgatgcaaacgttcccaactcaaggcaagtaacaacccatggaggtcaggagggaaaaaaccagaacagaaactgggtcctaaggctcggactttcccaccctgttagactggcaagaaaagaagtggtaactagttcaggaacccttgccagcctcgggaaatcctggaagtctgctgttggttaataccctgcacagatcactacatggtgctcacagagatccactaggctggggactgactgacttttccacagatctccccagccaccaagtgaccgagccacatgaactaaggactaaatcaagatatgcacagggtattaaacatataccaagggaacagttaacttgaatacaaggtcaaaaatcagcaacaagttctacgatccagtgctgatatcagatacaagcttcaaggacaaatttctt

SEQ ID NO: 1936 - DNA, 598 bp, Rattus norvegicus
  Genbank Accession No. AI104373
gagggagaattctttattgcgtgaggcgcgttggagggcagcccagcagggcacgacctcagccagctggcggtcagggctgggccggacgccatgggcctcttttcccgtcttcctctggtccctggggagccaccctcactcggcagattcggcatcaaacctgagttcctgcagaacctcactgatggcctccatggttttaattacctttatcttcagctggtgcaacttttcagggtcctgttctgacactcctggtgtccccatcacctgcagcagcgccaccgtggctaggcgcgtctgttctagctcttgaaggttgcgcacgtggcgggcgagcaccggttgcgctcgaggccctgccagctccgcttccactgccagtacctcgcacgaggcagcggcgaaggcctgggtcacctcatgcacgacactccggtaactcgggaagtcatggtgcagatcactgagcaggtactgacggtgagcttggtctagacggcggaaggcctgtgcacgttcattctgcagctgctggatcctctgcaccagcgtagcgatcggggcatctctccaggcccacgtgggctccgca

SEQ ID NO: 1937 - DNA, 584 bp, Rattus norvegicus
  Genbank Accession No. AI104388
aatgagtccttccaacgtttattataaaaggtgggtagcggcggtgagagggccagagggacgggaacctagacttatttgttcttcatgtagatctttggggtctgccagttctcaggggcttccttcaggcctgccttcagccagatgcgcttcaagtctttctcaaacttgatctgcttccttttcaaacgtccttcccggactttacgtcgtagaaaccgtgtcctcttgatcagtttacggtacttgtggtggttcatcttccgccttcggatcttcagcacatttttgcactgcattggagtggcatcccagacttccctgtctccctgtttggcttcctcctccccctggctaggtggacatttgtagaattgggagggagccagagtcactgggacctcaacattcagtctgggcaacaggtattgaacagtcagccagctctctagaggactgatggccatcttcctggggaccaggaactcttcaagctctaactgggccctcttaccagggagggaggcagcccgacttgggcttgcaggctgcaaactgtaaaggggtcgaaaagcatggct

SEQ ID NO: 1938 - DNA, 530 bp, Rattus norvegicus
  Genbank Accession No. AI104399
gtcacagaacgtgtttcattattggttctttttacattccacttgcccccccccctcgaggctagagccccctcactgtcttaaaattatgacaaaccatgtttaggcccaggtgtttatttcccttatatgtaggatggttcacaaacacaatacaagggcttcggcactacagggaggggatatcccaggcctctaagagtaaaaggatcttggccttaatgtacactgaaattcagacccgaagactctgaatctctgcatcacacatccagtagggcttgggagtgaagctagagccaaggccatctaagtgacaggccaaagtgacaagaagcctacttcctgtggtccagctatgagtttccatcccaaaccaatggaaggccgttttcacccattagggcccaaagggacagctagttctactccttcccctccttaagaagccatcttggtgacatatttgattttacccattgtaagtggtaaagggattggcctggtccaactattatggcgaggtaaga

SEQ ID NO: 1939 - DNA, 598 bp, Rattus norvegicus
  Genbank Accession No. AI104488
atggttcacacgcgtggcatatgcaacttttaataaaccaaagaaaaagtcccaaatatacaagtgaaaaaaatccaaacagttgacacaggcctaactgatagttactttatgtacagctgtatgtataagttcaaaaaagctatcctatttgtatgtacaaaagtttatacacagttctgtacataagggtctatacattttattttctcagaacccttaggtgtcacctctagaagacaccaacacttcattcacatattttataaaagaaagacttccaggactgacaatcttgtgtcccttgtatttgaaccatgtaggctccatttgattatttaacagccttttgtcataatgtagatcatggtaggtatgtggatccccttaacattctcacacagcgtgctccaatgtaaaaagcccattacaaagatggggaatgaaagtcatggccaggatgccaccgcaggtccaagtatgggtgggccagcctgccctgttcactgtctatattccagttcatctacactgatgactttggtgggcatggagggcaaaggctgctgtagcacatctgagccaaaccacttggcaa

SEQ ID NO: 1940 - DNA, 532 bp, Rattus norvegicus
  Genbank Accession No. AI104520
cagttcaagttatttatttaagccatctcctcttacgagcaaagggatggaggagcaaagtaatggtcaccatctgataaaggaaagatgagctgagcatccaatgggctttcgtggtccacacacaagagtcagggtccaaatcagtgctgtggtcccttgtcgcctgggcgaagagccaggttctctttactcatcttcatagccagtcggaagcgggttcatgtgaggattgtggaagagggtatggttaccatctccccaggggaagggcttagtcctgatgcggagatgggggtaggcgacgaactcgggtctctcgtgctcttcgtgtcgcgacttcaggaaaacgttgagcatgctcactcccaccccgggcagcgccacgaagtaggtgagggccttccaaatacgagctgaaccctcctcgccgtgggcgccactcgacatgggccgccccacccgtgggagggcccggcccagcagcccagagactcgagacgcactcagcaccgccgacgcccctcgggcc

SEQ ID NO: 1941 - DNA, 586 bp, Rattus norvegicus
  Genbank Accession No. AI104523
gtttgtggaaatgttttaattagaggatttgtagatacagtggttaatctgttgcccacaattccttaccaatgaggcttcatgctgggataccctcctccccaccatcttaacacaggatggtcacagaccacattctcatgttacaagattcacatctctggtaatccaaggactgtggtacaaaaggaacacttcatagctggggtcactacagtttgctagaaacatcagttactttagaatactttaactataaaatatattgaatttccatatattaaccatatacatgtgtacctattactaaatgtagtcagttgttacaaaataagacattctgagagcaggctacacacacacaccagcctgaactccccgggtgaggccctgtgccattagctgcaactgtccatccaaactcagctcctgactatactcgtggccaaacatacccacaaggcactggcaacccagtccataccggtgccaccagctgtgtgagcacaagttccctcaattccagagcaaagactcttgactacagacctggccaccccttgtttggtccctgaacttgagccac

SEQ ID NO: 1942 - DNA, 556 bp, Rattus norvegicus
  Genbank Accession No. AI104587
cctctcccttgggacatatttattgtgtttttcagctacagcactaacaggagaatctgcaacacctgagggcagaacccaacaaccaggagcctcttgccccgtgcacaagcggggcctcagctaccctagttatgtctgaagagcttcaggcccatccaagtccacaggtggaagaacacgtacaccggtacggtgaccggcagaagcaaactgtagaagcacaggctgctggcgctggtacagccctctgggaagttttcttccacagaggcggagtagaacaggcccgccagggagatgagcgggatgaggacagtcagggtgggcagagacaggatcatcctcctcccttctgaaggtatacagttcaagaaaactcggttgttttcaaagttatgttcttgtgctggtgcactcctgtcttatcttccctttctctggactcctctttcatccaggcatgcttcccaagagcacacaaaaacttcagcggtcccaggctgagggtgacggctcctcagcctcgttctgatccaatccaccaccacacgaa

SEQ ID NO: 1943 - DNA, 395 bp, Rattus norvegicus
  Genbank Accession No. AI104608
tgacacagccacagtgacatgatgggtacacaagcccaggaatgcagctcacccactaccactactgggttccagatccacctgggcaactccgaaggcatcctgagaaaacaagtgctccatttcttctactgtcccactcagcatagcaattcagcaaatgatcaaaagggtttacaatgcatcaattagtccatacaagaattcattcaatttgaaaaatagccagttccgtcatatatgccaacacaccaataaggtatttatgacacaggatctttattttcccatccgtgtgtgccgaagctacagacgttgagacgcgaaccaatcttgtggctgataagtgaattctgaaatgcctatggaaatgtgaataaaggcagttcataaat

SEQ ID NO: 1944 - DNA, 449 bp, Rattus norvegicus
  Genbank Accession No. AI104658
  misc_feature (1)..(449): n = a or c or g or t
ggcccttcagttatttttactagatttttaaatgctttaaatttttttttgtcctttttatcttttaaatacaaagtctgtactgtcccagtgcccaaagtcttcctttgcactagggtccagtagagtctgtatcttcaatcagaacctctgtggtagcaccgagtatatccgagttcatgaccagcccttcagtgcccccactgctgccacttcccacaaagatcttcccgtcagccataaggctcacccgttctgtcccactgcagtatgactttgacaacccttcagcttctaggagtaggcactctccagatgttgagtttcccaagggcttcangaagaaaaaggaagcccctgactatctgcaggttgtgtcaggggttctgggttagtgcccaggatatctgtgctggtgatgagggcacccgcattggctgccagagctt

SEQ ID NO: 1945 - DNA, 439 bp, Rattus norvegicus
  Genbank Accession No. AI104675
ggatttttaaattgtattttatttagagtattacagctacatgtggctaatggttacttcacaggacagcatccttgctcagggccttgctcaagaggcagggagcatgatgatcctcaagtcctctggatagagagtgccaaggtacaaaagcacaaaagccctcatgtgggaggaaagtgagcttcatcttgttacatcttgatacgaagagcccccacgcgtatcctcaagggaagtctggtcctgcctgcagtggggctgcacagacttgagcttctcacagacttgagcttctccagttaggcaggtaagtggagaagacaaggccaacctcaggtactgagggtgcagggacccctcggagagtattctctgtatggaggccatcacaggctgttacccttacgggatcttgtttctgggcttgctttcgctt

SEQ ID NO: 1946 - DNA, 479 bp, Rattus norvegicus
  Genbank Accession No. AI104679
gaagagcacaagtatttttatttctttcttttttttttcttttttttcctttttttcggagctggggaccaaacccagggccttgcgcttgctaggcaagcgctctaccactgagctaaatccccaaccccttttttatttctttaacaatgcaaaatatacacgttgacttgactaggacatattcacatgtaaattttttctcatatccacaactctggatagatcagaggaatgacaaagatcatcacaggaagcagactgtagtatctccaaagtttattccagtccatttcttcttttatactccaaaacatcttcgttgtgttggtggatgagataaatccacatgaaaatcgaggtgcccaaggtcagcccaactttcacccagttaggtttggcattgactggctcccggacatagaactttgaccgtgttgaagagcatctcggcagcctggcgggggccagcagccgga

SEQ ID NO: 1947 - DNA, 466 bp, Rattus norvegicus
  Genbank Accession No. AI104753
aagaataacacaattgctttatttaatgattttaccatttgggcagccaaaaccagtagcttgcttctgatttaattagtcctaagaccatccatctttttaagtactccccaaactgggatatgatcaactcaacagcaagtaggcatcttcatgaaaaccagtttaaactcttgtctctcgtcagttaaactgcacacagaaggtaggcagcaaaggcctgtgggttctaaaatgatgggtgtagtaggaatgaggaaggtctgcagtatgtgggatttgttccccaaaagtcagacttcacagtgcttgttgctgtcttggcaaaaaattggccagtgacaatgttttcctcattagctactgggctgatggaagactgccgcagttacagactcccagagaggaaactaagagtctagggtgagtgtaagtacccagccctttccccatgcactcacctcca

SEQ ID NO: 1948 - DNA, 480 bp, Rattus norvegicus
  Genbank Accession No. AI104773
atgatgacattaatctctatttatttagtcattgaaacatggtgtacattgatgagttttatataaacatttagtacatctaaaatccacaattggtaaacaatctgtgcttgcatttgtgtacaacattggcatttatatctggacgttttgttgttgtggagacccagtctctgagtctaatcacattgctccgtgttaccttaacaactgtgacagaagtgatatgttccttacaaggatcgttgcttcctagaaaaggtgtcacacatggggctaataaaccggatatcaaggaaacaagagaaacacagttgactttagataaaatacatgcaggagatttctggagatccatgtcaatgcgcagcggtggcacaagcagtgtggtacccagaatgaacactcagttctaaccatcagatactcgggtcaagtctccctgccccttctgaaaggggtggtgctagccagagctgg

SEQ ID NO: 1949 - DNA, 312 bp, Rattus norvegicus
  Genbank Accession No. AI104821
ttttttttttttttttttttttttttcgtttttaaaatgttttttttttctagcagtacattctttaaaagaagttaacaacttcagttccaaatataaggattaagtaatgcaaatgaaaagctgttgttttcggtgaagctaccgcctaatgaccctgggaaaagtagtcttaagaactgaaccggtgcaaaagtcccttagaaaagcttcatttgttgcctgtaaagagtcttcttaaggtcactttacgtctagaccatcgcctcgtccccaaaggaggagctttgcttggtaatggcttgtggttcc

SEQ ID NO: 1950 - DNA, 571 bp, Rattus norvegicus
  Genbank Accession No. AI104846
ctctttaaaaggcgtttattgatcatatacaaaataaagaaaaccttatatatcacaaacatacactatgtacagcaataaatacccggggggccaggcccagtgccgcccctcctggacaataatttagcaataaatactgcgcagggcacgggtgggcaccaaggctgctgcctgctgaggccaggtgacttgatcgctctgcactgatgccaagtccagacctcaccttgcagccagatccccgatggccctacccaggtgctggagacagggtctcaccttgcagccacacaacagcccctcctcacttggatgtttaaggaccctcaccccatttagggtactctctactaacctccccctggcttcagccctgcagggcaggcaggggctgatcaactctgcttggacacacctctcagcaccaggagaccaacagagctggacacacaatagcccttgtcctgttgccctaagttgccaggagaaggctttctgtacccattcccatttggttaaaggcttcagggactagcagacagagagaaatgggaggaaaggtagggtt

SEQ ID NO: 1951 - DNA, 461 bp, Rattus norvegicus
  Genbank Accession No. AI104864
ggggttttatatttattgcaactacaacttttcaaagaacgttagttatttaaattttgttcagacatgcttaaatatatacaaaacgacagtctctaatcccttgaggagaaggcggaacttcagtgttcctcatcggttcaggcacctcgccttgttgcaagcatttccaggcggcctttgagtgtcagttctgcagcactgcttctgcagcgcagcccctgccggctggctcgcggggacaggctatagcccgcggctgtcagcagcacagtcctcgctcgacttttgaacctgggtaaggagatgtccgggccttgttgtgggaattgtctttgacaccattagaaccagacatgatgttggctttaaggtgaaacccacaggatggaaatgggtttctgggtgcggggatggcgcggcagcctgaggaccggacagttacggacgcgagggccacc

SEQ ID NO: 1952 - DNA, 430 bp, Rattus norvegicus
  Genbank Accession No. AI104878
gtccattcaaaaagctttatagtctgtcaccacgaaaccatggcggcagtcattgtcggcaagcgtatacacatggaaaggcagttttcaggaggtaagaactggtccgtggtgggcgcggggggggattccatgaccaaacccaaggtgctctccaaacttggagaaggttctaccactgagtcaagcatggtccaccaacctcggcctctttcacagaggcaaaatttccagagtaaatcccctctgagaagttaaacaagatctccacacatgttccaaatatatcaatttcatacaaaatggagaaaccggagagcaacaagtcaaatatgtaaatatgtgagtcaaaaatatacaggcaccttcctgatatctaagcccaccggcttgggcacagcatccggaagcatgtccccttcgggaggga

SEQ ID NO: 1953 - DNA, 422 bp, Rattus norvegicus
  Genbank Accession No. AI104897
aaaaacaccaccaaagtaaacctattagcttccatgagctggtcacacctggacagttggtagagctcccgtgtggtcttgagcaaagagcttgagccatcctgcagactgcagcctgagcgctgtgtgcctgcagactgcagcctaaggaccgtgcctgcagactgcagcctgagcgctgtgtgcctgcaaactgcagcctgagcgctgtgtgcctgcagactgcagcctaaggaccgtgcctgcatactgcagcctgagcgctgtgtgcctgcagactgcagcctgagcgctgtgtgcctgcagactgcagcctgagcgctgtgagcctgcaaactgcagcctgagcgctgtgaacctgctggtacccaaggttaagtgatcagctccaaaccatgcaagaaaaaccagcgacacccaca

SEQ ID NO: 1954 - DNA, 587 bp, Rattus norvegicus
  Genbank Accession No. AI104907
tttttttttttttttttttttttttttttttattgatgttcttttttatttttaaaatcacacactgtatacacatacaaatccgtctaaaatttattcaccaaacccccagtttttcagcaattagttcttactcagcaccaaaaactccagtctgtggagacagacagacttctgcagtgtggttgagcattgtcaggtcctaggttaattccgagacttgccccctttgatccttttctcttcatggctctctagacacaggctgtcaagacttcagattcatgagccatgactaccacgaaactcaacagcctttggagaagaactcaaaataatgagatgactgaaatgagagacgctacatgactggtgagcactctccattccgaggacattggtatttttaataagtttctagactgtttggtcataatgccatgatcgcactaggttatttctagcctgagactctgtgactttgtcatacatctcaaagaaaaaagtgatcagtattgtgggaacactttaggacaagttagggaatcaagcggcagctgagaacctgtgaacacagactaatgagg

SEQ ID NO: 1955 - DNA, 503 bp, Rattus norvegicus
  Genbank Accession No. AI104979
atctttcttccataggtttaatttattaaaataatttcctacaaaaatcaggacgaacactgagtgtgctgtgcatccttctcctggttctttacacaggacagtgctgttcagcgggttttgcttttcagtttctgtctggtacgttttccgggtctcttgtttgcccctttcttcccaggccttctggggcccttgccatgagccaccttgccccggaagctggagacatcgtcgtagctctcccgtgtgttccatttggagcctttcttctttccgccaaaaccaaacttctgatttttgtatcttcgtttggcattgggccctttacttatctgctggcctttagctcctcctgcctttgcacctcgttccacaggcttctgatcgccctcaaggaaatccagcttatcagagaagcctttctggtacttcttgatggcattcatcatatgcgctttctcctgctgcctcttgtgaaggacctcagtttgcaccttctt

SEQ ID NO: 1956 - DNA, 681 bp, Rattus norvegicus
  Genbank Accession No. AI105050
gagggtatatactttattgaaaactttaaatactcttcagagagaacatcacatcttcaatcaaggctcttgtgtggcctacatggcaaactgagctctcagcatggaggtcagtgcatagtgctgttgtgtttggctgaagggcccctcacgacccatgctcctctgccagcttgtcagcctttgccacagcttcttcaatgggtcccaccatgtagaaggcttgttccgggagatggtcatagtcacctgctaagatctgctggaatcctttaatggtctccttcaggggcaccagctttcccatgtgacctgtgaagacctcagcaacctggaatggctgtgacaagaagcgctgtatcttccttgccctggacaaagtcaatttatcttcctcagaaagttcatccatacccaagatggcaatgatgtcctggagagatttgtagtcctgcaggatcttttgcaccccacgagcaacatcataatgctcactgccaacgatgttgggatccataattcgagaggtggagtccagcggatccacagctggatagatgcccaactcagcaatagcacgggacagcacagtagtagcatccaaatgggcaaaggtagttgcaggggcagggtcagtcaggtcatcagctggcacatagatagcctgcactgacgtgatcg

SEQ ID NO: 1957 - DNA, 668 bp, Rattus norvegicus
  Genbank Accession No. AI105080
atcaatctgcaatttttattgtatcacttaacacattttttttaaaatgtcatgacactctttgaatcttaagttgtctattcaggttttgaggtttaaaatgttctaagaacctccttgtcttaaagtaacagactggaatgataagcaagtgcatgtgaagacatatccataccaacaataggaacgtttttcaactgtgcactctaacatagacatatgtactctcatgggccttggaccttctaagatgggttcttcttaccaacactggcagaggatgctttcaaccctgtggccatccagaaaaagcagtcctacatagagtgtactatggaggaagagcttatcttcctttcacatcatgtacaggtcaactgtggctatacttgaagagtgagttccagtgacaaccatcacctaagacgtgcataaattcctataattagtgccagaaggacaatatgtttcactgtatagacaccagctgtccagtctagcttcaggacacctaggctttcagacatctgatacaaagggtgcttctggagtgatggcccctggcaactgtctatattgtggccacttctgaggaagcatcgctgataaacacaagctactgtgtttactctgtcacacaaagcctgctaactgactactccgatctg

SEQ ID NO: 1958 - DNA, 513 bp, Rattus norvegicus
  Genbank Accession No. AI105105
ggtggagttcaactttattgctcccttcagaagggaaggaggacgtgggtgtcgttcccacaccatcccttgcttgggggatcctggccaccgccacacactcacatacactcggataaataaatactgcctggtaggctcactgctccagtccgagaatctgatcggtcttgcttccgcccgctggaggagcatgggggggcctgtcctccgctgtacaggcgggggagtgacgaggagggtccacgactaactggacaggaggctcagctcagggtgcagcgttcccgcctgctcagctgccggctcacctttcgacgccgctgctctaggcctcgttctaggcgctcatcttcctccagagcgattcgttccttctggtccaggtcccggaccagttcatccctctggttcaccagtgataccagctcctccaacaagagttgctcccggtgctgctgtgcaactgttttctgccactcttcaatggccagcatggcccgcaactcacgg

SEQ ID NO: 1959 - DNA, 565 bp, Rattus norvegicus
  Genbank Accession No. AI105110
aaggacgcacagactttcctcctttattgttaagctgcaacatacatggtttaataaaacaacaacaaaaacatttaacaatcaagtgaaaataaactagaaatgaacgctcagaacaaaatcttttccactggaaacatgtcaggacggactcgggcttcgtccccacctcacggcgatttccttgtgacttaggagcctacataccccatgttttctgtagccatgcaggcgtgagtggaagtctgaatgattaaataaacgcaaagtctgtcgtttactgtaaagaatcatctcccgaggcagccaaactgagttagacaacaaaaccatttaagaaactcgccacatgttcgggttcatcttagaatccgtgaaccttcagctgctcctccttgacgatgccaacctccaaaagaaactggcaaatgttcttcctttggtcgccttgaagctgaatgacctctccgtactcagggtgttcaatcacagtcccattacaggcgaatttctttttgaaagctttcacaagtttctttttgtcataatcggccgcaatgccctg

SEQ ID NO: 1960 - DNA, 596 bp, Rattus norvegicus
  Genbank Accession No. AI105131
attaggcaggaagagttgatatttaataaagaaagaaagattgaaccgagaccccagcagtcctctggtcagctctttccatcttcaggagtgagtgctccgaggcccggcagccccaccgagtgctggaagacagctcgggcatactgatgtagcacgcggttcatgtaacagtgttgccagggcagcagcccttccaggaagccaatgtggccaccccgagctgtgatgagcagggccacgtagggagacttctgggcagcctgcagagggagggcctgcactggggagaagggatcgtctgctgcattgaggcagaggacaggggtgcagatggcatccaccttggttctcgggcttgaggcatggtaataagccgcacagtctttatacccaaaagccacagatgtgtagcgctcatccagctggcggattgtgcgggcctttatcgcaaagtctacatccaacaccttttcaattgactttctgttcctggccacaagccggcagagtccagcagtgaggggctggttgaagagcagtgagttgagtggggtctccaaggagtcaacggtctcaaaggaatcccaacacgc

SEQ ID NO: 1961 - DNA, 622 bp, Rattus norvegicus
  Genbank Accession No. AI105137
gtctagtggcatcgggtttatttatgggaatgcagagcttaaggtttttcaagaggcacttgggaggcacagacgtaaaggcagccacagctaaaggtggactcttgtttcaacccccagggccacagaagacagcttcatcagatggagatgtcaaagtttactttctaaggcaatcttaaagtctggcattcagggttgggggcacagggcccatccacttctctcctagcaggtaagctagcaactccatgcggtcagacccaaatagcatgtaggttttaccatccacgtgggcaacagtggtgggcagcccaaaggccccatatttgcaggctgccccagtggtctccctgagcttgctcttcaccagttcggtggagatcttattcagaaggtgttgggcttgcgctgtggccattccggccttctctgctgcagacaaaatgttctgggactccgtgatatcttcatctcgggaccaaatgcgcatccacagctctctggacaccttctccagcatctctggttgctccatgctcaccgcggtgaggaagcgcatggcatttaccgttcctttcttaacatattcaccaaagaaatccttggggacgctcatggg

SEQ ID NO: 1962 - DNA, 592 bp, Rattus norvegicus
  Genbank Accession No. AI105153
aaatgacaaacgtagttagaggctttatttaaaaatctctcactgttcattatcaaagttacaagattgtttgcataccaatagactgactgtaaacaggaaattctcattaaggaaagacgggtttactgtaatttgatcttttacaaaaaaattactgcaagttattaataacagaatttctcttttactttcttaagtctaattctattgaaaattcaaccagtgtttccactctccagccgaaggtccgaccaccgtcaccttaggaaacaccccctgatttgttaatcagacacgaactggcacatttccaatgttttcactgagcaaaagcgtgcgcactgcagttcccgagaagagaggctgcgtggtcctgcctgtcagcgaggtttactgacgcagtggtggagcacactcagccctgccggtgccctatctcccatggaatcttctgccgccttggcttgcagcagcccggggttctgttgcctccactgagcctgacgggaagcaagggtgtcatgcttcggtgtcctgactgcgggtggttccatccagtgagcaggacacggccttcagtctgttggct

SEQ ID NO: 1963 - DNA, 603 bp, Rattus norvegicus
  Genbank Accession No. AI105196
cactgataggaaaataattttatttaggttttttaaaaaagttaactttcacatataaatttaaacttaaagattacagtgtatattttccaaaaggagcgcccctgaagggtggccagacaagctcgccgagtgggcacagggacactcgctccaaaaggagctcaggtggaagcgctttctttaatcttccacagtggcccttccctgttcctcaccgggcctatgactggtaagaaaacccacaaccatcactttggggcaacagcatctcactatatgggaataagaaacatgtctaggaatgaaagcacaaagctcaatgatccacatatcccacaacaatcattacatctgcagcaacgtataacaggagtattggatagttcaaaaattcttgtaaaaagggccaaagaacacaaaatctgtttaaaggtaatttctgtaattaaatgagaaaaattattttttccatattacaaatgcctttacactataagacctagaggggttaaaacccttcaaatctgggctctcctttctcagtaaaatgtttggcacaacccttgagctgctgttgaaatcaacagctgataggtttta

SEQ ID NO: 1964 - DNA, 463 bp, Rattus norvegicus
  Genbank Accession No. AI105309
caattccatcaaatttattatagactttgaaagttggcggttcacctgcttggtgtacagaagacagactctaagaaaggatctggaggcaccgcctcttctgtcaattgtaatgtatttggcaaaagtgaagactttgtaaacaccaactccatggctcaaagcagactttctccacagcacagttcaaaagccaggagaatgccaataagttagacctctgtgtttgacattctctctctgccctgcagctatgagtagcagcaagtgacccaatggaccctaccatttcccaaaatggcttccctctgaatgtgctcagaatccactcacgccacatgcatacgcacaccacagatacatgcacaccaatggccccttggatttggattgggggtttgagacgaggcacagtaagaaagcaccaattgggggccacaggcctgcgccctggaaaaggcaa

SEQ ID NO: 1965 - DNA, 556 bp, Rattus norvegicus
  Genbank Accession No. AI105371
ttttttttttttttttttttttttttaggaaatttttttttaccgacagttgcagaagcaaactcagatcacgtgacccattttgaagtcagaagacttaattggacttaagaactgtgcaggggggagggtccacagctctttaagcattagatgtccagcttcgaaattcacttaatgtgtaaactgcatttattaattcctttggttccacacatccgaccctgtcactcgatgtgctcactaaacgcattcccccaaccgcagcaacctgtgccttggagagagtcctggtatgtctcctgaatcccgacttcatgtctggagcaccaagaaaggtgccttacagattcccacgaccatgggcaagctctggtgtcatgctgacctgccgtcgcctctaactgtccagttcctcctccaggccacgttctccttcgtggctgcggcgtccttcagggtagccatcaccagttccttggtcctgactgcttcgtccctgcgccgcgagtccctttccggcatctcctgcagcattaactgcttctggagttct

SEQ ID NO: 1966 - DNA, 619 bp, Rattus norvegicus
  Genbank Accession No. AI105429
tttttttgggctttaaatagatttttatttgtttatattatttttttctcccatacaggaatagcattacaacctaacattcagaatcctgttacacacatacacaggcatgccacatgaccaggtcgaggtggttgtgtccttgagtctgtcgacacatcacaacatggtcagtcaaagagttttcacttcagccagtctcaacacaaaacacccaacagagatgcactcaacttgttggttccatttggaactaggtggtagggaaagaaggtatttgaagcagggtgggggttgtctgcattcagtcccctgacacaaagctacgtggatcttgaaagccacccaggagctctggtagggtccttgttgcacctaagacattataggtcccagcaagttgctgaaagggttccaggctggggagcaggcatactccaaaacagcaccaaactgcactcacacacacagggccctgctgggctagactggcaaaggttagaaagtgacaccagctcaagagaaccactcagacttactggagaaagctgtaagttgccctttgatgtgattgggacttactctagaaacaggtccctctgacatccttagttttggc

SEQ ID NO: 1967 - DNA, 595 bp, Rattus norvegicus
  Genbank Accession No. AI105435
aaggcacaggctctttattttcctcttttatctgcttagtgttgaacacagaaggtactgctcctgggatagaggcaggaaggctcactgtgaagtccactacaccttctcacacaaggtctgctccgtctcagtggcttctgtgtcactcccctttgtctcttccagttccaaaaaacttaaaacagggtagatggagtttgatttcatccacagttaaaaagcactgagggccaagagccacactgagaattaatttcttcttctttctatagagcatatctgaatgaagaaagacatttcctaagtctcaaatcagtgtctcactttcaaccataaaagctgggtccatccattacttcttgagcaaagtatttctctgttgaagtgggttcatttttcaaccgtgaatgcctgaatcccagtaattgctctccccaggatcagagcatggatgtcatgtgtaccttcgtaagtgttcactgcctctaaattcatagcatgccggatcacatggtactcatcagaaatcccatttcctcccaggatgtctcgtgcctggcgggcgatgtccagggctttcccacagttgttt

SEQ ID NO: 1968 - DNA, 448 bp, Rattus norvegicus
  Genbank Accession No. AI111401
  misc_feature (1)..(448): n = a or c or g or t
tttttttttttttttttctgtgaaaagacaaaaggaccaaactttatttctctacgcagccttggctggcctggaactcactatgtagaacaggttggccttgagctcacagagatcctcctgttgctgcctttagagtggctacctattggcaacaagcgccctcagcagagcactgatgagtcctcagagctcgtcggacgtgatgttcaccttgggtaggttacattctttactagtttgacagctctgaagaatgtcctggtagtggttcttcagatcctcatacaaggcaacagttttctgcgagtgagctaagggtaacaccttttcattcagcagcatttgtatctggaatttttcttgaggggtctgtgcgtcttcacaatggtaaagcacanatattaggtttgaagcatatggtacgatgtgaccacttcggaactcc

SEQ ID NO: 1969 - DNA, 478 bp, Rattus norvegicus
  Genbank Accession No. AI111559
tttttttttttttttttgtgacgaacacttttatttacaaatataattaaaagccctgacagttaatcatgctcttcctcggaacctgaaaaatgttttcttttttaagttttttttttaagtgcatgcaaaaggagtgaagcctttttctcttcatcattttttattgtaagaaaatacacagtttgaaaggatgaataatgcagtatttatgaccacagatagggagcgtgggtaggggaaggagaaataaacagatgattggacagagaagacattgaactccagagactgaagcgggaggtgggcgtgggggcggggaggaacaggaggaggaagtaaaaaaattttgatcagagaaacagttaaaatacaatatgaaaataagcaattcctctccttagattccctctatacacaaaatacatgatttgccaaagcccaattttgtgctactgggattccctcgtgccgaatt

SEQ ID NO: 1970 - DNA, 312 bp, Rattus norvegicus
  Genbank Accession No. AI111599
tttttttttttttttttgctacaataatgcacttttaatggtaaaattcttgacagcacaatgtctatttggcaaatcttctgttcaagcatccatccagtcacctctggaaaaggtgcacccactgcactgtccacttgtcagaggagcccttgaaattcagaaatgaaggaccttgtgtggagcttgccatgccttcagttaaagggacccacatgtggtacctgcaggaatatgctgtttagaaacatgtatttataacgtgttatttacccatgttcttaaatactgtttcagcttaacaatcaatct

SEQ ID NO: 1971 - DNA, 410 bp, Rattus norvegicus
  Genbank Accession No. AI111683
tttttttttttttttttacaagtacactaacataaaagttttattgaataaatacatgtgctgttatgtaaaattaagcaaaaaggacattctatgactaaaacaaacaaaaaacaaataccaccctctgtggtccacctctaccatgggcaatccagatggaaccggtcgctgcagcagttggtactctccgcagctgcctgaggtttttaactaatcctaaacacctctgcatagggacggcctgcacaagacatacagagtgcaaaatacaaatgggggaaatatggttgcaaggctgcttctgttttcatctgaaacttgaaaacacctttgtactttaaggcacaggacgagccaccacatgaataagttaccagagctgtacttcaaaccactaatttccctca

SEQ ID NO: 1972 - DNA, 513 bp, Rattus norvegicus
  Genbank Accession No. AI111695
tttttttttttttttttgccatataaattagtcagacattttattatagagtatatatatttatatcaaaagcacaaaaagacttttattctgggaaaactaggaagattgtgacattacaggagcatgattcaacaattccagtccatgtccacagtattaggtgccccatcagctgaaaaggacatccggggcagaggtcacagctctgagcgcccaaggctgcttagcatgatttccttaccaaactgagacctgcattcccaaacccaggtacccactttccagatatttgctacaaactgaagtgggcactgagccaaagattacacttgaaaataaccaaagctagtgctcctgtatgctggaagattaatcctcaaataataaggatatcataattggcactgtcatctaattctaaataaaagaatcatcagacatcctggaggatctgcaatgaattacacaggaagaagttaaaatcagaagcatcctctagtaaccaagcta

SEQ ID NO: 1973 - DNA, 425 bp, Rattus norvegicus
  Genbank Accession No. AI111725
tttttttttttttttttattcaactctttgacagtattttattccaaatgctgacctggcctatggttagaaaaaagcaagctgttgtctgatcccacagtgcctgcagggaaagcccagtgccacatctgctctccctcctgatgcttctcatttcccctcagaagctaaacatggctgtaaaaaagatgctgctgcatggctgcccagcgcccacctgggccacacatcagccatgactgaaaggggttggggttgctgacccaggcagggcaggggaggcaggggaagccttccaggaggaggtgagtttgcagccccaccccctgagcacctctcagaagtcttttttaaatttttttcttttgtttttttctgagacagggttctctgtgtagcgcaggctgccctgcaacttgttctgt

SEQ ID NO: 1974 - DNA, 436 bp, Rattus norvegicus
  Genbank Accession No. AI111798
tttttttttttttttttgctcatagatcgcattttattaagtttctaatatatgacaggcacggtacagcccagtacttgttgttaatcaagacagaagcgtcaacaggctttgagataaaggactcccaatgaggcatggttgggtgttaggtggttatggaaggagacgtttaggttgagacctggggcatgagacagaatcaacttggagcgtggctggctcgtcccagtttctgtgaaaaagacacacagcacatgcacattgcagcaagtggggcagcgggcacactggggctttgaaaaccccaccaaggattgcgctgtctaaggcagtggctgattacctggagatgtggaaattaaattgaatactcgggctggagagggagatggcttggtggttaagagcacttgctgctcttggggagaatcca

SEQ ID NO: 1975 - DNA, 444 bp, Rattus norvegicus
  Genbank Accession No. AI111828
tttttttttttttttttagaacatgagttgagtttactgctgggctgtcaatggtccttacagacctacagtggatggagcacccccaacccctccccagactgtcacagggtttcttacggggtgtcagtttttcatcacaagcagggcagttcagtactggcaatgctgttttactgaagatctggagttgcacaagtagttctttagaacataagatgaaatgcattcatccatcagttacactgagcatttagaagaggcacatacaaaacagttctgcttctacatgataaaaattccatatgatgccattaaatgagctgagagccatcttagagtggctgataattcccacagaggagggaaatgaaagttgcatgaggagtcaagtatcttcatttccaagttcattttagtcacagaacatcctgtcactgaagc

SEQ ID NO: 1976 - DNA, 467 bp, Rattus norvegicus
  Genbank Accession No. AI111840
tttttttttttttttttgtgctccaaggaggtttattaggattccagggctgagagcttacacacggggaagcaacaccaccacagttctgcagtgctcttaaccactgagccatttctccagctccttccttacttccttccatgcgcatggtaatgtttctgtctcacgcaaaactaatgcactggcctttgccctgtaagtgtcctctccagggaagacacacacaccggaggtttctttatttgccattacccacgagcatcctcctcattcctctggaagtttaaagccagaccgtttgtctgttttctgacctcagccaggactgggcacccacatctggtagaagcagggttcgcccggtccatcagtctctgctcacccctcaagcctcagcgctgaagtttggcatgaataaattccagaaggttctccaactgatcctccaggcactgttcatctcc

SEQ ID NO: 1977 - DNA, 496 bp, Rattus norvegicus
  Genbank Accession No. AI111960
tttttttttttttttttactttttaaaaaatttatttaaggaacacaaaatgcatctaagtaattttttttttttttgttttgttttgagatagggtctcccaagtcatgggatcaaaggtgtgtgtcgccattactcgcagagtctaagtgattttttaaaaaccaaaatttcaatgtcatctgcttacccaccactctctccaggctcagggtgtgaagacatcttctgatttccgtactaagtgtctgaatgactgagtcaagagcatgcacaatccagtgggctgggcactttgccacttctggctcggaaccctgaccaccctcccgtcccacaccagtctcctaggcccacagtatacacttggagacagctggtgagggtcgcccaagttagaacaagttttcctgtaaaaacctaactagttaggctcaaattccagcacagcctccctggcctgcaattctggtcaatacaactgccgacactgcac

SEQ ID NO: 1978 - DNA, 502 bp, Rattus norvegicus
  Genbank Accession No. AI111975
tttttttttttttttttcccagagctggggaccgaatccagggccttctaccactgtgctagatccccaaccccaattgatttaatttttaagagattaaaagccatctgtggcaagatggttaaaggtgtagagacagacagttgtcatctttcctggtgatctgagttcaatccccaggaggaccaaccctcaaaagtgtcttctgacaatacaggagctgtggtgtacatgcatgcaggagctgtggtgtacatgcatacaggagctgtggtgtacatgcatgcaggagctgtggtgtacatgcatgcaagagctgtggtgtacatgcatgcaagagctgtggtgtacatgcatgcaagagctgtggtgtacatgcatgcaggagctgtggtgtacatgcatacttcaccccatctcaaacacatgaagcagatacatagcgtaatagaaatctaagtataagatagctatataaatgtacctagggttgagggcaaac

SEQ ID NO: 1979 - DNA, 492 bp, Rattus norvegicus
  Genbank Accession No. AI111986
ttttttattttttatttaaaattttctcaatttttattagttctttgagaattccatacagtgcattttgactcaggcaaaaccatatctgatttttactcaagtaagacagctggaaaggtgggtggtggaaataagagatgtcccttgctgaaactatctttaaatacaaattcgccctgaatggtggggttgtaagatttggtaaactacctcctcctttaactccttgatgaagccagttagttcacaccccttcttaataccctcagtatcttccctttccaccgcccatgaagcccctaaatgctctggttctgcccacctcgtctccccctcccccaagcacccagtttagttgtcctgctgcaggcaggcaaaggtgcagtgaggccattcccgagtagaccagccagttcctgctgtacataaagtcttttcactcaggaccactctagactgtgctaatggtgtcttacaggggggccgcca

SEQ ID NO: 1980 - DNA, 379 bp, Rattus norvegicus
  Genbank Accession No. AI112043
tttttttttttttttttatatatacatatataatttattaaaaacacattagaatctcactatttcaacagcctaaattctagcaacatatacaaatatcaagtgactacagtacatgccgaggtaagaaaaatacattctgggagaatatcactgacactcgagctattttcacttctgtatttcaatacattttattttcaccattcccagtgccaaaaatgagagagactacacacaaattggtctaattgagattggtgccacagttaacctagataccctataaccatccaactccctagatttttgcagttcgaggactttcaagttcaacccaacagaattaacgacttctttttacagagccctgtcagtt

SEQ ID NO: 1981 - DNA, 523 bp, Rattus norvegicus
  Genbank Accession No. AI112092
  misc_feature (1)..(523): n = a or c or g or t
tttttttttttttttttatttgtccataatattttaatacttctccacttttaaatactggttttaattttgtgattgtaacatggaagatccatcttttatatttttaaaaaacatcatcagaatcataaagctattatagttacactctacacactcccaaggtatttgaaaatgattatgttttgagtctgtagatgaccaaggacaacgatccaatacactgtctgtacagcctggactaagtactggcccagcgtctgagccgacaaacgaccgtaagcttcaaggtaaccagcagtctcaccagcgaaccagctcagctcagctcacattctgtagccaccgacactgctattgtataggtgttttaataaagtagtcatgaaaaccaacagatgagaaccgtggctcctttatctttctttgcctccacacacctccctcctgcctttgctgctcctcctatagcaacaccaaatcaagtttctccacctcaaatacggagtcctcaatctctana

SEQ ID NO: 1982 - DNA, 523 bp, Rattus norvegicus
  Genbank Accession No. AI112098
tttttttttttttttttagtgactggactctctttaatgtctgcagaatagaagaatcatgttgggtagacacagcagaactagggatgttgttgtcatagttacatatttataacaatgtcaacttactggctcaccccatctaataacacaggtgcctcctgtgctggctgcatctattgagctcaagctatggacccctattatcctggctccctagagcacaaaccctgagactcactgcagtttcttgcctttctagactctgctagagtttactataaacccctgttacctgaaagtgaagactggccacaaagaagtatacctgtttcgtccaaaccagagcttctggggggtgagagtgtttattttctttttactgagtcacatctggctgggtttcccttggccattccgttgtcctctgtagtaatactgaccatgtgcagctgaaagccagctatggcccccatatagcacaaaaggcaccttcaggactattggtacgtgtaaacttaca

SEQ ID NO: 1983 - DNA, 386 bp, Rattus norvegicus
  Genbank Accession No. AI112111
tttttttttttttttttctattttgaaaagtatttacttagtttgaataaattaattgcaaataaaaattaagctacaatatagagcctcaacagaaatgacaaaacacaacacaggacttggtttccttgcctagtcacggaggttgtgaccagaaaacttcaaaatcaattaaatttccttgaaaaaagggtaataaccagcagttactgatacatcacagctaacttataatacaaatcttgacatgcatttcctgagtgaacccaaatgataattttcaaaacaagaaaatttgacaatcaacacaaaataaaagttcatggcttctaagtgacttttttttgttgttttaattcttttttaaatcaaaacgttgatgtact

SEQ ID NO: 1984 - DNA, 386 bp, Rattus norvegicus
  Genbank Accession No. AI112171
tttttttttttttttttgcaaaacaataaatctttatttgttcacagttaaacacaagcaactgccttgacattttcgaacattctaaggacagcaaacctttgattccattcactgagactgtaccatgttctcctgcagcccatacttatggcatctgattcagagtgtttgacatgcttttaagatcacagtgggaaagtttaaaccttttgagaagtgacttccattgaactaaaaagttttttaaatttttgatttgttttcactgatgggaacccccccccccccttaaactccaagttagccatatatggttcatccatgattgattataaaactaagttatgtcttggcaaaacctgctcctccataatgtgtttgtg

SEQ ID NO: 1985 - DNA, 334 bp, Rattus norvegicus
  Genbank Accession No. AI112208
tttttttttttttttttgggagagtaagatgaatagatttaatcattcttgttcgaaaaacaagacataaattagtgtaatatataatttatatatttatgtagtatatatactatatacagacattagaaaatgtatcctctccatgaggctgagggagaggtgagtgaatgacagcgatgaaatgacaacaggcagggtctgagtggcgaaggtgtaggatcaagaagttgggagaagaggaagaccatgccaacattctgagggcagtggtcgtgggggaaagggttccccactggctgcatctctggcccattaaacatcttggtcctgt

SEQ ID NO: 1986 - DNA, 368 bp, Rattus norvegicus
  Genbank Accession No. AI112237
tttttttttttttttttcattttggcaagccactttaatttacacctttaatgagggctgtaatttcttgaattgtctcaccttgctctcgtacagagaggagtttacactttcagtcctcgtcgtcaggagggacccccagttcttcatctgtccacttcgatggatctggatatgaaaagtgacccagcacagcatccgagtcatgccaaaatctccaaagaatccagaaccacatgagtgagcttaagacctcaccatggatcacctgggactgggtaagctggggaaactccctgtaccggggctgaatgtgtccaccatcgccaacatgacggactccaccgtctccagctgcccgcgcgcgg

SEQ ID NO: 1987 - DNA, 491 bp, Rattus norvegicus
  Genbank Accession No. AI112250
tttttttttttttttttctttgcttttatttttatttatttattcatttatttattttttggttttttttttttcctaaaagtgcccaggtgggcttaaggctgccagacacacgcacatctacagcaacaagggtttctttctattccatctacgtctatcaggagaagggagggaggcaggagagagggaaaatctacctcccccaaatcccaccacaaggagacctatgtgccaagcataatggaagtgtgtgctccccaacaactggctccgcactggttaatattctgctggttttcctcagacatctattttgaaaaagcttaaaaaacacaggagatttgaaataattcaatcctggcaaaaatcaaaactccaaaactaggagcaaaatcatctttcactaaattaatcccttttcctttcttttttcttttcttaaacattttattcgtgttatagagggatttctttatcgtttgccttct

SEQ ID NO: 1988 - DNA, 361 bp, Rattus norvegicus
  Genbank Accession No. AI112338
tttttttttttttttttgtgattgaatgaggtttattggagtcccagagacattggggagaggggtcaggggtcaggttgaggctcacaggggagaaacccctggccaagttcccctatccccttgtggcgttggaacaaagagtcaagttgtagtgatgggaagaccaaagtactacaagtcaagggggaggaaaacctcaatgtctaccacctccaccaggtcacaggattgggacaactgtggtcaaaggattgcgctctacagcataagggaatgtctgccctattactctaaggagagtggggttaggccataaccattccagacaccagcccattctaagtggataggagtatgt

SEQ ID NO: 1989 - DNA, 505 bp, Rattus norvegicus
  Genbank Accession No. AI112343
tttttttttttttttttgagttttaatcaagtttaattcttcaaaagaattattctcaaggaacaaattttaaataactggatcagcatggcaaaaaatcttacatcatacaaagtgcagctctgaggacagtaaaacagtaagaaaagggggcacgggtgagccttagtggcagagtgtgtggcatgcttgatattcatggggttctacttcaaccctatccttgaaaaacaaactatcagaaccatgggtaataaatgtaacggggcacagaacttgagcacgtattcattctgccttgcacatctggcttcatcatggaattcgctgagagtgagcagatcaaaatgagagtgcattcatctggatgagatcccttctgagtcactgtcaaataaaaagacgccatctttgtcaggtactccagctctggcctgagtagccatgatggactaaagacactgcccgggtacagacatgggaaagaagagcagatcaggaaaca

SEQ ID NO: 1990 - DNA, 475 bp, Rattus norvegicus
  Genbank Accession No. AI112365
tttttttttttttttttattaaagaccatcatttattgtttataaaaattgccccaatatacagaaaattcctaattccggtaactaaaaactcccacccgccttgtgtccacaatatccaatctagattggcttgatcttgaagtgtaatccaataaggctgaagactaaacacttcaggtcctggacaagataataaaacactcgcaagccttctggatccttggactggttgacatcaataagggaaccaatttttgatgttgtaaaagaaatgtgctcatctccaatgacaatttcgagttcctgccggcccactcgatcaggagggggccacagagcgtcatcttctttggtgatctcactgtcgtcaataatcctctttaattcttccatcacactcttatgtacataagcctctttcctgatcatgacatcatttttgtaattgctgttgttggcatatcgcaattta

SEQ ID NO: 1991 - DNA, 558 bp, Rattus norvegicus
  Genbank Accession No. AI112512
tttttttttttttttttgtatttaaagtagcaattttatttgagttaaaattatttacaaaaacccaaagacatacttcatgaaactggtacaaactattttttcctgccgttggcttttgctccaaagatcacagctgagaaatactgtataaaatacaaataggattggattcagaaaagtatcctactgttctaatatccaactggtagtatttacagaaatatttacaatggaaaaaaggttaccttaaaactttagttaatttgcaagtcagcctcaagtaccctaaaatgagagttctctgagggttaaaaacacagaaatgcactgcagttggtaaggtgagatcttcctcacaacccacacccaccaaaacctgcatctctatcagtgcttgacaattagttagtatttttaacacattacagacactgttaaacactgaggtaaatcaattatcaaatgatcaccagtgtaacagaaaaaatgtaattcgccctgattgatctcgtccaactatttactgttctgttccttaccagctgccacagtcaa

SEQ ID NO: 1992 - DNA, 406 bp, Rattus norvegicus
  Genbank Accession No. AI112888
tttttttttttttttttcgatttaactgacatttaatggctcagggttacaatttccagacgtgaccccacagtgaggtgctgttcacatcagtgcaggctgttaagttaaaacacaagaagaccagtgctgtgtttgaggggaatccactattaagcataacaacaacttcacagcaaattaaaataaatactcataacctctaacaatgggaagtacccacagggaaaatctagttcagtagcagcactcgaaaagtagacagtcttgtaaacacagcagcttgaacaggggacacatggctgaaccctctacactagggagaaagggagaccggctcaagctgccaccccgagccttccaggcaaagggggacacacgatcgcagacctcagactcaactctg

SEQ ID NO: 1993 - DNA, 372 bp, Rattus norvegicus
  Genbank Accession No. AI112926
  misc_feature (1)..(372): n = a or c or g or t
ttttggttcttttttttccggagctggggaccaagcccagggccttgcgcttcctaggcaagcgctctaccactgagctaaatccccaaccctgagggtcacagttttaattccactgtcttcatctgcttaagattcctctgtgagagcaaaaaagagtgaagagccaaagaatttgacggctagaagttaggaattctggtggctggttcatagatcacaaagtgctgggagaaagacactatttcctatcagcaaactgtgaggtgttgactcgacacagacatatgaactcacttcaaatgctttcgtctgtgtggaccattataccaatgtggtatgacanacacacacacacctaatangagctaa

SEQ ID NO: 1994 - DNA, 539 bp, Rattus norvegicus
  Genbank Accession No. AI112964
tttttttttttttttttccggaggaaaatagattataatggagagatgcattaactttttcagtggagtagactcattttacaatgttttcgagcacttgatagtctttggagaataggatcaaccattgacctaggtaggtactgagtatttttttaggtaaatcagccataatcctatcaaatgaaaaactcctccttcctacctatctttttatttcctttgtgcatttactaaaattgctccatgtctagacactaaaacaattcacctccacagcaaagcttacaaaatttccagttgtaagattttaaagaatgtccctttctatcgctcttcagtcatcatatcctgatcagctggctttcagagtctacgtagatttgtcttacagggttcattcatttaaaagtgcaaggctgctttagtatccttaattagtagactgactttttctgacttgatttccgatccagttggaaagaactaagcataggactgcatacttgagctctccccgaggagagaatttctgactg

SEQ ID NO: 1995 - DNA, 499 bp, Rattus norvegicus
  Genbank Accession No. AI112979
tttttttttttttttttgcaagttaagaagatttattgacagactagtcttgcagtccagaaccgggctgacggaggctcaggaagttgtcatggtacaacccggtgtgggatccactctctacatgggacccctgttccacaaggtggctgctgttgcaaatatccggtaacatcccttacatggcacttacaggtcactggactgtacctccaggactagacatgccattccagaccctgacctcctggcactggagcacatgtgctgttggggtttcagttttgtttcttgtcaggtataaggaatgtcatcccattctgtatgcgtcataccaaaggaagaaaagtgggcatcgctcctgggagtgattgctttggctccctcgatctgcttggccctgggcacctgtgctttactgaggttaatggggcatgcccaacaataactctcccagggtttctgtcacacgccatcctgccctttcaggatctgtcag

SEQ ID NO: 1996 - DNA, 419 bp, Rattus norvegicus
  Genbank Accession No. AI112992
tttttttttttttttttggctgttcaataaaactttatttacaaaaacaggcagcggcccacaggctgtggtttgctgactgctgctgtatacaccgcaatctgtccacaaggcaatcgattctgagagaacacgaggtcttggttggttccacaggggacagcagggccttggagcatttggggaagggggccggaagtctctttccttggcagtctgactccggggggccaagtcaagtggcgctgtagcagacaggccagccaagatcgtgacggcttctcagatggtgccttccatcctggaggccctaaacctacctggtacactgggcttgaacagttctgaaaggcagactctagaccttccagaacgtggtcagacactggtggtcagcaggctagttctgagaaactgtc

SEQ ID NO: 1997 - DNA, 491 bp, Rattus norvegicus
  Genbank Accession No. AI113003
tttttttttttttttttgacaatatatctcattttttttttacttcaaaaaccttttgtccaaagctgccacagcctatagtatcatttctatgtcttgttcctgtgaaaaggggtagtgaaggggtccagcctccttccctcagctccagcttttaagttgtctaggccagcagtgcctctccacctgtccccacggtagggtgccagcacaccctgtgccacagggtcatttgtagagtagatagcgtttcatggcagggggcaatggcagactggatatttgacccagccgggtgtcccccagagcatggcgcacacacaggcggctcaggtgcagaagggattgtggttcctccgctcttctttcgcccaggtagcggatgcggacctggcactgtccccaaacagcacttacagagggataaagggtcctccccttcagtccacggaaggctggtcccaggtacgtgcccccaatagagtagccca

SEQ ID NO: 1998 - DNA, 503 bp, Rattus norvegicus
  Genbank Accession No. AI113020
tttttttttttttttttcacaagcagtaaaaatctgtttaatgatccaagattctgaaagacacactgatagacccagaattgggtgaatacggcatcctagcatttgctgctggcttaagggttgagggctggcggaagggacctcccatggtggtcaattccaacctaacaggtgcctcagtgccctatctccatggaaaccagtctggcactggcatggggccctaaggagcctgcatgaacatctcttgagatagatttcccattggaaacaaccataggtacccttccaaacccaaagctgtcgccattcctccctattacagagacaggaaatggagtgacggattagaaacaaatcacagagcagtaagtacctcctagtgaaggggagggaagctggagccaccacgctcagaactctgccaagagctttaggtggcctgaactgctagagggagggctggagttacccataccttctgatactgctgacaggaa

SEQ ID NO: 1999 - DNA, 518 bp, Rattus norvegicus
  Genbank Accession No. AI113029
tttttttttttttttctgtttaaaagaatgatgaaagtcttttattcttaaacaatatttacacaacactagtaagcacactgataagtgtttaacctctcatggaaacaacagacgtcaacacaaacgtgatttttaaaaatatatatataatacatataagtttatgaagtagatttaaaacactttctcccggtatggttgattcacctgggaagcagtcttttaaaatgagcaacgctggcctcctgccaggttgaggtacaaagtttggggggtgggccccaggtcagttagttttcaacatgagcctcagttgtacacatgcacacaaacaatgaggaagcactagtttgtttttaaatggcgttttacaatacgtttgccaaggctgaagagggaacaacctcacatttgctttccagatgagaccaaccaaccaaggcagagagctcacaaaagagcagcacccatgagagagcccagaaagagggagagacacccagagacagcagctg

SEQ ID NO: 2000 - DNA, 307 bp, Rattus norvegicus
  Genbank Accession No. AI113244
tttttttttttttttttcctttccctttcacctcctgaagtcttgggtttccccatattgttccctgcccctcccacatttccaaagtccaagggccagagtaagggattccagcagccacccagcacgggtctatattagggcttcagtcgtcagcatcatcactggagtctgagttggctggcatcatagggtcatcaatgagtgagaagtccctttctgagctatcatagccctgagataaatcatcatcatcttcatcctcctcttcatcatcgtcctcatgctgcagtgttggtaaccgcaa

SEQ ID NO: 2001 - DNA, 396 bp, Rattus norvegicus
  Genbank Accession No. AI113288
cggacgcaacggtttcctttagcgatatgctgctcaaacagaggtcaccactgttctcaaagagccagctgaactctgctggcttggtttagaatttgtttcatccctagctgtgagtgccttttggtctggaaagttggcttgtctcatcatacccacagctaggacatatactctgtaattatgaattgtccttgttttcctgagctaaaagcgaatgtctttgatcactagagtttgtcagtgttgggttgtttccactgtgaggttcttaaaaaacgttttcgcttcataatgttaaaataactcatgttagaaaccctttccacatgaagggtttgtagttgagacatatatattttactgtttataataaaaaaaatcatctcctcgtgc

SEQ ID NO: 2002 - DNA, 405 bp, Rattus norvegicus
  Genbank Accession No. AI136157
tttttttttttttttttcctgtttttatttttaataatattctcacacaaaaatcaccgaaaatagggtagggatgggaagccccctctgcccctggggcagagagacagtgcagtgcgagggggcgggactgtaaatccccccacccctccgcagccccagcgggagaaaacgaactaagaaaatgaaaataaagccccagagaaaaatcaccccagggtgtccctgccccaaagaggccctgccctgggatgtttcacgccttaaaaaaggggggtatgtgtgtgtgtaggtgtccactgtttttaaaatggccgaggctggggaggacagggttccttttcctcatagttatttctttaaaacatttttttattttatttatttatttttttcctcgggccg

SEQ ID NO: 2003 - DNA, 404 bp, Rattus norvegicus
  Genbank Accession No. AI136338
cggccgcaaaggttttggactagatgagtttccaccgaaatgtcggagaagtcaggccagagcacaaaagcaaaggatgggaagaagtacgcaacactcagtttgtttaatacttacaaaggaaagtccttggaaacacagaagactacagctcgacatgggttacaaagtcttggaaaagttggtatttcacggcggatgcccccacctgctaacctgccaagtcttaaagcagaaaacaaaggcaatgatcctaatgtgaatattgtgcctaaagatggtacaggatgggcatcaaaacaagagcagcacgaagaagaaaaagcaccagaagtgtcaccagcacagcccaaacctggggttgcagctcccccagaagtagcacctgctcccaaatcatgggc

SEQ ID NO: 2004 - DNA, 435 bp, Rattus norvegicus
  Genbank Accession No. AI136396
tttttttttttttttgtattccaacccagagctgatggctttgttttgtttgacaggaaaggacaaagaaaccacaactccacagtggccaaggctcaagtagcacggactgtgctatgtacccaaacggagaaaccttgtctgacgggggatttgggggagccatggggtcctctagtcagtggcaggatctgaggtcaccgcatcttcgcattcctcaaagcctgggaccggcttctgcagaaagtgtgtggtggcctggatcaccttatcaggtccgatgttgtacacagggtgagtgggctgcagaacattttcaggcacacccatgaccacatcgtgcagcatggctccacttccaaaatgctgggcaatggacaggccgctcaggcagtagcaagtatggtagaagtcacgtgacttgccaggtttgtc

SEQ ID NO: 2005 - DNA, 328 bp, Rattus norvegicus
  Genbank Accession No. AI136523
tttttttttttttttttgaaatcactgaattccacgtttattagcctgcagcgggacaagggcctgctaggtccaaggcatgctcactccccaaaggctgaccgctccaggcccacgcaggcttcagctgctctcaggctctgcaggtaaggtggtgtggtggccctttatgatgaagggtgacattggtccccggtgagaggtggaggaggaggcagatcttttggagcatgtccagaaagccggagtcttgggaggtcttggcctgagatgcctcggtcagttttacttgcaaagtcacctttgttggcccttcgagtgagctgca

SEQ ID NO: 2006 - DNA, 474 bp, Rattus norvegicus
  Genbank Accession No. AI136540
  misc_feature (1)..(474): n = a or c or g or t
tttttttttttttttttagaggggagtctgataactttatttctagaccccagagggcgaggacattgcagcagggtgggccctgagttcccaaaagtgcctgggcatgagggttggagaatacagagctggaataagggaccctggcaagagtcagggttgatggtctctgctgcagggcacctcttggctcgtttacttccagcgcccgccgactttgcccttggctgtggcaccggccttcttgctgaacttggccagcatctccactctggcccggacagtcatgatatcgtatttctgacgtttcagcttctccccaaactcaaatttgtcagtctccagttggtacaaggtatcccagagttccttggncttgtccctcagcttatcatcactaagatggtcaatgttcagaggtttgcgcctttcagcaagaatcttctttttcatttcncgggctgtctgtttctt

SEQ ID NO: 2007 - DNA, 503 bp, Rattus norvegicus
  Genbank Accession No. AI136555
tttttttttttttttttgtcgttcagtgtacatcaggtacttgttattaattctactggataagcacttataaataaaggacagttatttcttgtcctcagccaccttcctttgttaagagtcatcatagagagggttgttgtagtttccccaggacccgtagtcatggtcatccagcagccttccgtaggaggaatgcctgatcttcagatatgccgcagctccaaacaccagcaacaccacagcaatgactgtcacggtgatggcggcgatgctgcctgaacttaaggcattctcgacttcctgcatgatcaggaagggggtggtggtctcagactcacagatcactttgccaggctcagtgtcttggggtgatttctccttgggcacaggctctgtgacatgggaagtgggggtgtgactagaactgtgctcttctgttggtgatgcacgtgccattggagctcctgtgggctggatgttgttcacagtagagctgtggt

SEQ ID NO: 2008 - DNA, 381 bp, Rattus norvegicus
  Genbank Accession No. AI136610
tttttttttttttttttgataatatgtgcctttaatcccttcagagttcaaggctagctgggtccatgtagcatgctccaggctgccaggaccacagtaagaaaatattttaaaacaatcttttgagagtttacaaaaaaatcctcaaaattctttattctgacaagatgaggaagttggcatcagtgagtcgtgtgccttccatgagcatcacagcccacaggcacgctgcttgatggtcatgtcgatgtagactgaccagacatctgtgcgttttgggtaggtggtcagtgtgttttcaaaaatggctttagcccgctccacatccccgagctggaactctagctgggcaaacttgacaatcacatccacatgttcctt

SEQ ID NO: 2009 - DNA, 527 bp, Rattus norvegicus
  Genbank Accession No. AI136694
  misc_feature (1)..(527): n = a or c or g or t
cggccgcacaatggtgacatccgcgtctgtgagcagcaggggacagtttagatcaccagagaacactctcatttggaagacagtggggctggcttccttaaataagaaacaaagaaaacataagggtgagagttcagggtttaaacagcaaaacagcaggctgccatcttgggaggctgctggggctcatgctgtcatancacttcccaccaccccaccctgggtgggccagacctggggacatggctttctgcagcgaacatangagatgggcacccggctggctctcctcccaagccatctgacaggctacctcacctgaggtggctttcgtgtttcctctgcttttggtttctgtggatttcctcgatgttttggggctttgagacagtcttattttgaggccctggctggccagggactcacaatgaccctccctcattagcctccagagtaccgaacaggccacacttggcttggtgttcttctacaagtggatggcacaagcaacctcgtgccgaattctt

SEQ ID NO: 2010 - DNA, 560 bp, Rattus norvegicus
  Genbank Accession No. AI136709
tttttttttttttttttccatggacatgggcttttatttgcagactgctggggaagaggggaagctcgaacaggttggtgagttgatgggaggaaagaacttcttgctttaaaatttagtgcatgttgcctgaaaggttagcgtgtatgagaacagatgtggaagtgagaggagagacaaagagaagatggacactttcctcagggaaggcagacggggatatggggaccagggtgagcaaggaagatacactttctataggagacttaaccaaagtcattgtctggttttccgaacacctacctgccctatccaagttcatgcctccgatgcctaccctgttagctctctcggctagcagcagggaaagggataaggaagtagcttcctccaaccagaattgctcctctgcctgccctgcccttccggccaggatcaggaggtcagaaagtccaggagtgcacatgggaacaatggtgtctctcacctagacctcttctctctctgccacactgcaacccctcacatgaggttacagctcttggccctcgtgccgaatt

SEQ ID NO: 2011 - DNA, 560 bp, Rattus norvegicus
  Genbank Accession No. AI136711
  misc_feature (1)..(560): n = a or c or g or t
tttttttttttttttttgagggatcaatcaaggtttattgtccagatggatgaatgtaacaggggctctatacatgctctggagttgacagacagacgaccagagtggagttcaacaaatgctcagcagataaaggaataaaatggctgtggagaaggaaggcagagtcctttgagctcccctgcctctgagggaacactggtccccatagtgtgcttctcaccaagtgtgaggaagctacacatcccatgtagactgtctccatatcagagctggcagtcggggtgtgttcccctgcagggtcagcttgtancaatggcagctgttgccccagcaacagctttggggcctgcagaaaggtatgtggacaggacttctggtccacgtccacgcttcccagggtgctgtgtgggggaggtaaggactcaccgtcaggcagcccatgaggctctgctcaaagggccgctgaaaggctcgagggtctccacaccaatccagcagctctgtagcagcattgtggaagttggcggggttctgtaagtgctgcttgatgcactgca

SEQ ID NO: 2012 - DNA, 561 bp, Rattus norvegicus
  Genbank Accession No. AI136744
  misc_feature (1)..(561): n = a or c or g or t
tttttttttttttttttcccaaattgtaaactttactgcttcacaggttctacttctgtttacttgttcctggtgagcaccaagcccagggcctcaacaggccaagcatgcgctccactgtgctgcgtctacagccccagatctcacaggtgctcaccactgagcacctcaccggtgggctggggcaccgacattctgaagtggactgtggcttttggctgaagggctggttcaaattctcctagggtcccagtgatccattatccctctagaaaacatctgtcatagagaagctgcgcataagcttcaaaactgcattcctgctggttttacccgactcccacagtgcacagctaggccagacaattgtgggagaaggcctcagcagcctgngcagctactaatgagagctgcaaaaaaggcagcaattggtttcttcctttttgagcctggtcaatgcagaacatgaatcgaaggctttgtagccttaggggaatggatgctcagctactgtctcatcagggagatgatcttccagccccgggctttcagtagaatgcc

SEQ ID NO: 2013 - DNA, 560 bp, Rattus norvegicus
  Genbank Accession No. AI136747
tttttttttttttttgtccagaaaattttaacaggtttatttataattgttataaagttgaactgttgaaatgtgttcactgaaacattttgcttgcattaatgctttacatcttgcatttatattaaaaattcacacacaaatgaacgtggagaaactgccaatacctgattctgtcccctatgtttccactcgcaatcatatacttaggtacctttgacccccatggaaaaaaaatctcgcggccgctcccacttcagattggtaaccctcgtgccgaattcttggcctcgagggccaaattccctatagtgagtcgtattaaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctct

SEQ ID NO: 2014 - DNA, 542 bp, Rattus norvegicus
  Genbank Accession No. AI136838
  misc_feature (1)..(542): n = a or c or g or t
tttttttttttttttttaagtgataaactcactcctctttattgttattaaggtttcagtggtttctttcagttacagagcacttatttaattccgctgttggccatggtttgggccctgcaaactcccttccccttcacctcaaagggagctcctttgtatgtggctacacactcatcattggtgtgcaggtcaggctggatctgctcccagatcttcttcttagggttcagctccttgtcaggctctccagggaaagcatcaaaagtaattctgtctccaggaacagacccgttgggaggggccaaaatctccactttctctggtgaactggcgcacatcaccattgcttgggacagcactccccgcatttttgcaggcttcagattacaaagcanaaccaccatccggttttgcatctgttctagagggacatgattcaccagcccgctgacgaccgtccgtggagctgcttctcccacatcgacttcctccacatancacgaatctgcatccgggtgttttttggcagtgacaataca

SEQ ID NO: 2015 - DNA, 462 bp, Rattus norvegicus
  Genbank Accession No. AI136862
tttttttttttttttttacagtgtgagagagatggaattcagttttattttgtcctctctgtaacttccatttacaccacggccttgtctatcaaagaggaggaggaaaaccttgccttatgccaccaagctcaagtacccacgtacttgttagagacaccaggcagggtatctgtttctccagtttttggctccaagaggttatacttttagtaccagcatagtgaggaacccctggcaaactgctggaaatgtcttctgtgttagtcagtgtaccatcccgtaaagtgcttctggagttaaaaatatgtcaagctgtcaaaactgtcgacgcttttgcaacaagggataaaagatcccaatggacatttcactgagtctttctcagatgggtctcgtaattggcacagctgctttaccctccaaggcgctggccctcaccccaggcgaagcctcctggcc

SEQ ID NO: 2016 - DNA, 376 bp, Rattus norvegicus
  Genbank Accession No. AI136977
tttttttttttttttttaattcactcaaaattcttcagtttttacaaaactaacagggtggagtagggaagggagcagggaggcagccgcaggggtgggtaggcggagaggcaggctatgcttctgtcttcacctgagcctggttgcctgccacattgttcggctcacccttcatctcagcatcagtgggatggtccacctcaaatacaagtgtggcatttggttgccacagcaatatcccaagccttgatgacctccccttttcccaggtcaaaggagaatttgtccttgcggtccaaactggagtcaaactttgtgccatctagcagccagccagtgtagtggacaaagactcggtcccccctcgtgccgaatt

SEQ ID NO: 2017 - DNA, 387 bp, Rattus norvegicus
  Genbank Accession No. AI137062
tttttttttttttttttaacattgttaaaaatatttattttgatagtctatcgtaagtcagtacagactccactctgcctcagatgtgttgaaatgacgtctcctttctcatccagccggagcacacacctcccatgttgcactgcgtccagatccagatgaccgaacagtcctttatccccaaagtaggcttaaaactgatggttcaggcattccaggatctgcaccccttgtgaatcccaggtaaatcacgagaggaataaagccccagcggatggcaaactggccgcccttgaagagctgctgcagcctctgtttggcttccttgctcagcttcaccatgacgacgacggaccagccgaacgatgcctcgtgccgaattcttgg

SEQ ID NO: 2018 - DNA, 483 bp, Rattus norvegicus
  Genbank Accession No. AI137123
ttttttttttttttcttgaacacaaacgaaggtcatttgactggaagccagacatcaccatcacgtcagaaaatgtcaaccccgaaacctgctgtagggttcactccacaaggacggcttcagaccgcagcagccagggaatgtgctgaagaatggctggacaatgcttctgtctttcagagtgctgcctattcccacacgcccaggactcggctatatatttatatatatgtataatacattctatcttaccctaaccatgtatacttgcccctttaatgcctctaccagtcattagacaatgataaataaccgcaacatgttcttacctgttatgctcaaacagaactttggtaacacttgctctctaaggggaaatcgtgactcaatcacacgcctttggttgacaccgtccgtcctcctaagggctgtttagggctctctgtcccagcacactggagtccgcctacatgtgctgacgtt

SEQ ID NO: 2019 - DNA, 456 bp, Rattus norvegicus
  Genbank Accession No. AI137131
tttttttttttttttttaggcacagaagttttactactgaaaattgattgtgtactagtcaaaaaataaaacttcgtatttcaaaatccaagttataatcttaaagccaaccactgaacagtaactagtaatacaaagaaatgaccaagaaattgaaacagtatattagaccgtgcttaacacaaaacatggcagtaatgaagtattggggcttaatccaagagagcattaaaataatgaaaaacacgattacacaacccaagggctttcccttggaaggagccacagaactggcagagagaaatggtccggcttaatgctgtacacacgagatacacttaagtcttcctttttcttctttttgttacgagagttggagatcaaaggctgtgcttgctcggcaagcactcctgaggcagactttggcttaaaagacgtaatgtgctgaacgctggg

SEQ ID NO: 2020 - DNA, 470 bp, Rattus norvegicus
  Genbank Accession No. AI137176
  misc_feature (1)..(470): n = a or c or g or t
tttttttttttttttttactttaatagacccaggcggattcagtggtttattattaacagaaaatggtactttaacccccaagtctggggtggaagaaagcaccccatttccctccaagccattactgtcactgtcagaccctgtctccttctccaaatcgtgggaagcatcctgtgcatgtttggatttgaggacctattccagcaggtcctcgagatggctgatctgtcacaaagagtcaggctgggggtgaaatttgaggaagatcttcttggagaggtccacagtatccccttggggctgaatgggatacctcttcttgttgttaatgaaagcctgctctagtgggaaaacactcttctcaaactggtgctgttggaaggggatccctctggctatgctgtgagccagggtcnccaagaagagacaccaacgtggctggtagtaatcagccaccagcctcgtgccg

SEQ ID NO: 2021 - DNA, 498 bp, Rattus norvegicus
  Genbank Accession No. AI137259
  misc_feature (1)..(498): n = a or c or g or t
tttttttttttttttttatatagcaaaaatttatttaaaaaaaaacatcttagtaaatttaattctacttagcaataagtcgtattctagaaggaaaaaaatattttgtcagagaggcgtagccatcgagcccttgagcaggaatggtagcacatgcctgtaatcccaacactcaggaggcggaagcaggaggactgccctcaagcttgaggccaccctggaccagtagtgaagatcacgtcatggtgaataccacacaggaaaactgcttcacgggggcagggggagtcaacattcctcactaaagaacccctcacaacagagtgttgaagtccacatcacagttaacagagaaaatccactgtgaatccacaggaaaagccgtcagcccattccaaattattcctgacaagcactggcacanactcattttaagaatacttaagaacttgttctagacaggtatccagtgagtgtccccaacagctccccagagtc

SEQ ID NO: 2022 - DNA, 546 bp, Rattus norvegicus
  Genbank Accession No. AI137275
  misc_feature (1)..(546): n = a or c or g or t
cggccgccagggaggcctaggccctgtccggccggcgcgcccgaggtggggagggaagttgcggggccgccgctcacccccccccccctcgaccgggcttcctatttaccgaagcgtagcggcggactgtgacggcagcacagcccctcgcctctcttggcgcaccggtcggcactgttctctcgcgcggggctcccgcgtccgcccgtgggccgttgggagcgggagaggcggaggcggcccgaggccaaagcacccgccaggcgccgagggtaagtgaggtctcgggcggctgcttaggcccggagtgagttggggcgggtggaggaggcaggggcggtgcgagtctcgttgctcacctggcttctaaggaagttgggcactggaggatctgaagaactctttcccttcncacctctcatttntgccttttgagttcttttccgggcggcttcttgattgactaatctcttccaaacccggtccggttgatttgagtcctgaattcttttccccgtcgtctccaccgcctctagcccgtcacga

SEQ ID NO: 2023 - DNA, 629 bp, Rattus norvegicus
  Genbank Accession No. AI137283
  misc_feature (1)..(629): n = a or c or g or t
tttttttttttttttttccacataaatataagtttatttttctacatacttttaatttttgtcactcacacactttaccctgtatagaaatattggtgcaaattttggtacttggcttcttaaacttaggggtattttcagatcttttatttccttctgaggataagtgaagcaattaaaaaactccctgatggtttcactcactgcctgctgggtggtgtcctgagctgcccttaagctgtggggctttccttattcaaagcctatttatcacactcggtgtctgcatagtacatctcaaggctgaaaaactagtgctttgaaaggcacaaaggctacaatttgggttgcttcttgaattttatcctgtgtgttttctgatgcgcaataacgtgtgagctctgtgtgaatgccttcccacagttgctgcacacatatggtcgctcaccagtatgagtcctctcatgcctggtaatgtgggaactctgacggaaagctttcccacagtgctgacagtggtatggcttanctccagtgtgagtcctcangtgttgagagatggctgagcggtcattgaaagtcctcccacactctgaacactcaaatggtatctctccactatgaattct

SEQ ID NO: 2024 - DNA, 455 bp, Rattus norvegicus
  Genbank Accession No. AI137337
  misc_feature (1)..(455): n = a or c or g or t
tttttttttttttttttaatatatttatcttgagcaaattctgtcttgtctcgaaatgttgtactattttcaattagctgctgaactatttcctctcctttaatgcccttgtctttcagagcctttatatcatcttgagtaagtttctgggactttccatcatcaactatatttcgattatcagtgcctgcttctttggtctctgatgtgggctcttccagcttcttcctgagctgaaggcttcctccactgctcacttcaaacgttgacccgtaactatggccaatggcgttatccaggtagaaccactgtttttcanaagttactttttttctccgctggacttgcactgctttgaacacatcttctcgtttcagtaccacgaagtcgccgtcatggatgcagtggtccccgagatgcggggctgtgggctcggctgctccgctgctgacaac

SEQ ID NO: 2025 - DNA, 399 bp, Rattus norvegicus
  Genbank Accession No. AI137345
tttttttttttttttgtcaaaatattttattgacggtctcacagtcttagaaaagtgggtggtagcacacacctttaatcccagcagtcgagacacaggcaggtagggctagctcaggatttgaggccagcctggtctaccagagtaagacctctctccaagaggacgacagaagctcgtgggctggaccttgctgttgggaagcccaggtccccgtaggctcagtgtcgtcctagtggtcagggcagagtaggcattctatggttgggcttagggttcaggtgttaagtgtctgtctgtctgtctgggtaaagggctctgattcttgttctacaccagggtcttcatgttctttgtacctgaaaccccacttccactgatatgggagtcagcttctca

(The sequence listing continues in the following parts.)

We claim:

1. A method for determining whether a test compound is a liver toxin, comprising:
   (a) exposing liver tissue or liver cells to the test compound;
   (b) preparing a normalized gene expression profile of at least ten genes for said liver tissue or liver cells, wherein the gene expression profile contains the differential gene expression values for said at least ten genes upon exposure to the test compound, and wherein said at least ten genes are listed in one of Tables 5A-5XX;
   (c) comparing the gene expression profile to a hepatotoxicity model, the hepatotoxicity model comprising information from one or more of Tables 5A-5XX, and comprising:
      (i) the normalized mean expression levels of said at least ten genes in liver tissue or liver cells exposed to a known hepatotoxin, and
      (ii) the normalized mean expression levels of said at least ten genes in unexposed liver tissue or liver cells; and
   (d) scoring the comparison to determine whether the test compound is a hepatotoxin.

2. The method of claim 1, wherein the gene expression profile contains the differential gene expression values for at least 100 genes that are listed in one of Tables 5A-5XX, and wherein the hepatotoxicity model comprises the MeanTox and Mean Nontox gene expression values in said one of Tables 5A-5XX.

3. The method of claim 1, wherein said gene expression profile is generated by hybridization of nucleic acids to a microarray, and is normalized for hybridization conditions, label intensity, and reading efficiency prior to comparison.

4. The method of claim 1, wherein the hepatotoxicity model comprises all the information in any one of Tables 5A-5XX.

5. The method of claim 1, wherein the liver tissue or liver cells are exposed to the test compound in vivo and the hepatotoxicity model is generated by exposure of liver tissue or liver cells to the known hepatotoxin in vivo.

6. The method of claim 1, wherein the known hepatotoxin is associated with at least one of genotoxic carcinogenesis, non-genotoxic carcinogenesis, cholestasis, direct-acting toxicity, hepatitis, liver enlargement, inflammation, necrosis, necrosis with steatosis, peroxisome proliferation, steatosis, and steatosis with hepatitis.

7. The method of claim 1, wherein the known hepatotoxin is one or more of amiodarone, alpha-naphthylisothiocyante (ANIT), acetaminophen (APAP), AY-25329, carbamazepine, carbon tetrachloride, chlorpromazine, CI-1000, clofibrate, cyproterone acetate (CPA), diclofenac, diflunisal, dimethylnitrosamine (DMN), 17α-ethinylestradiol, gemfibrozil, hydrazine, imipramine, indomethacin, lipopolysaccharide, lovastatin, methotrexate, phenobarbital, tacrine, tamoxifen, tetracycline, valproate and Wy-14643.

8. The method of claim 1, wherein the liver tissue or liver cells exposed to the test compound are rat liver tissue or rat liver cells, and the hepatotoxicity model is generated by exposure of rat liver tissue or rat liver cells to the known hepatotoxin.

9. The method of claim 1, wherein the gene expression profile contains the differential gene expression values for at least 20 genes that are listed in one of Tables 5A-5XX, and wherein the hepatotoxicity model comprises the MeanTox and Mean Nontox gene expression values in said one of Tables 5A-5XX.

10. The method of claim 1, wherein the gene expression profile contains the differential gene expression values for at least 30 genes that are listed in one of Tables 5A-5XX, and wherein the hepatotoxicity model comprises the MeanTox and Mean Nontox gene expression values in said one of Tables 5A-5XX.

* * * * *